US009029523B2

(12) United States Patent
Alexandrov et al.

(10) Patent No.: US 9,029,523 B2
(45) Date of Patent: May 12, 2015

(54) PROMOTER, PROMOTER CONTROL ELEMENTS, AND COMBINATIONS, AND USES THEREOF

(75) Inventors: Nickolai Alexandrov, Thousand Oaks, CA (US); Nestor Apuya, Culvar City, CA (US); Vyacheslav Brover, Simi Valley, CA (US); Jean-Baptiste Dumas, Paris (FR); Yiwen Fang, Los Angeles, CA (US); Ken Feldmann, Newbury Park, CA (US); Diane Jofuku, Arlington, VA (US); Edward A. Kiegle, Chester, VT (US); Bill Kimmerly, Richland, WA (US); Shing Kwok, Woodland Hills, CA (US); Peter Mascia, Thousand Oaks, CA (US); Jack Okamuro, Oak Park, CA (US); Roger Pennell, Malibu, CA (US); Richard Schneeberger, Van Noys, CA (US); Tatiana Tatarinova, Los Angeles, CA (US); Wayne Volkmuth, Foster City, CA (US)

(73) Assignee: Ceres, Inc., Thousand Oaks, CA (US)

( * ) Notice: Subject to any disclaimer, the term of this patent is extended or adjusted under 35 U.S.C. 154(b) by 2434 days.

(21) Appl. No.: 11/004,678

(22) Filed: Dec. 3, 2004

(65) Prior Publication Data

US 2011/0191912 A1    Aug. 4, 2011
US 2015/0033417 A9    Jan. 29, 2015

Related U.S. Application Data

(63) Continuation of application No. 10/886,468, filed on Jul. 6, 2004, now Pat. No. 8,877,916, which is a continuation of application No. 10/653,278, filed on Sep. 3, 2003, now abandoned, which is a continuation-in-part of application No. 09/775,870, filed on Feb. 1, 2001, now abandoned, and a continuation-in-part of application No. 10/372,233, filed on Feb. 25, 2003, now abandoned, and a continuation-in-part of application No. 09/924,702, filed on Aug. 9, 2001, now abandoned, said application No. 10/372,233 is a continuation of application No. 10/158,820, filed on Jun. 3, 2002, now abandoned, which is a continuation of application No. 09/938,697, filed on Aug. 24, 2001, now abandoned, which is a continuation-in-part of application No. 09/754,185, filed on Jan. 5, 2001, now abandoned, and a continuation-in-part of application No. 09/774,340, filed on Jan. 31, 2001, now abandoned, and a continuation-in-part of application No. 09/776,014, filed on Feb. 1, 2001, now abandoned, and a continuation-in-part of application No. 09/775,870, and a continuation-in-part of application No. 09/842,246, filed on Apr. 26, 2001, now abandoned, and a continuation-in-part of application No. 09/845,209, filed on May 1, 2001, now abandoned, (Continued)

(51) Int. Cl.
| C12N 15/82 | (2006.01) |
| C07H 21/04 | (2006.01) |
| C12N 5/14 | (2006.01) |
| C12N 15/00 | (2006.01) |
| A01H 5/00 | (2006.01) |
| C07K 14/415 | (2006.01) |

(52) U.S. Cl.
CPC .......... *C12N 15/8216* (2013.01); *C07K 14/415* (2013.01)

(58) Field of Classification Search
None
See application file for complete search history.

(56) References Cited

U.S. PATENT DOCUMENTS

| 5,362,865 | A | 11/1994 | Austin |
| 5,424,412 | A | 6/1995 | Brown |
| 5,659,122 | A | 8/1997 | Austin |
| 5,754,888 | A | 5/1998 | Yang et al. |
| 5,764,903 | A | 6/1998 | Yu |
| 5,857,208 | A | 1/1999 | Ofek |
| 5,974,563 | A | 10/1999 | Beeler, Jr. |
| 6,092,066 | A | 7/2000 | Ofek |
| 6,448,476 | B1 | 9/2002 | Barry |
| 2002/0144304 | A1 | 10/2002 | Fincher et al. |
| 2003/0226166 | A1 | 12/2003 | Falco |
| 2005/0048556 | A1 | 3/2005 | Heck |
| 2005/0086718 | A1 | 4/2005 | Heard |
| 2006/0008816 | A1 | 1/2006 | Lu |
| 2006/0041952 | A1 | 2/2006 | Cook |
| 2006/0137034 | A1 | 6/2006 | Schneeberger |
| 2006/0150283 | A1 | 7/2006 | Alexandrov |
| 2006/0150285 | A1 | 7/2006 | Nadzan |
| 2006/0168696 | A1 | 7/2006 | Feldmann |
| 2006/0195934 | A1 | 8/2006 | Apuya |
| 2006/0195943 | A1 | 8/2006 | Feldmann |
| 2006/0236421 | A1 | 10/2006 | Pennell |
| 2007/0006335 | A1 | 1/2007 | Cook |
| 2007/0006345 | A1 | 1/2007 | Alexandrov |
| 2007/0199090 | A1 | 8/2007 | Apuya |
| 2011/0014706 | A2 | 1/2011 | Cao et al. |

FOREIGN PATENT DOCUMENTS

| EP | 1033405 | 9/2000 |
| WO | WO 01/98480 | 12/2001 |
| WO | WO 01/98480 A2 * | 12/2001 |

OTHER PUBLICATIONS

Donald & Cashmore, EMBO J 9:1717-26 (1990).*
Kim et al., Plant Mol Biol 24:105-17 (1994).*
Dolferus et al., Plant Physiol 105:1075-87 (1994).*
Tyagi, Current Sci 80(2):161-69 (2001).*

(Continued)

*Primary Examiner* — Medina A Ibrahim
*Assistant Examiner* — Russell Boggs
(74) *Attorney, Agent, or Firm* — Birch, Stewart, Kolasch & Birch, LLP

(57) ABSTRACT

The present invention provides DNA molecules that constitute fragments of the genome of a plant, and polypeptides encoded thereby. The DNA molecules are useful for specifying a gene product in cells, either as a promoter or as a protein coding sequence or as an UTR or as a 3' termination sequence, and are also useful in controlling the behavior of a gene in the chromosome, in controlling the expression of a gene or as tools for genetic mapping, recognizing or isolating identical or related DNA fragments, or identification of a particular individual organism, or for clustering of a group of organisms with a common trait. One of ordinary skill in the art, having this data, can obtain cloned DNA fragments, synthetic DNA fragments or polypeptides constituting desired sequences by recombinant methodology known in the art or described herein.

14 Claims, 7 Drawing Sheets

Figure 1:
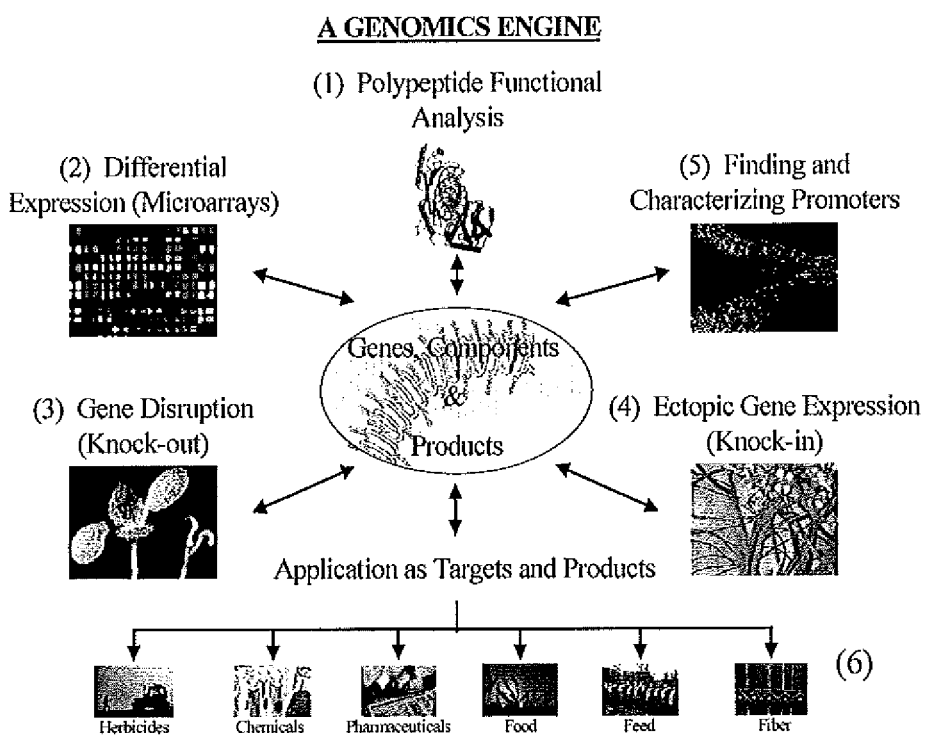

Related U.S. Application Data and a continuation-in-part of application No. 09/924,702, filed on Aug. 9, 2001, now abandoned.

(60) Provisional application No. 60/200,034, filed on Apr. 26, 2000, provisional application No. 60/205,233, filed on May 17, 2000, provisional application No. 60/201,017, filed on May 1, 2000, provisional application No. 60/224,390, filed on Aug. 9, 2000, provisional application No. 60/228,208, filed on Aug. 25, 2000, provisional application No. 60/228,052, filed on Aug. 25, 2000, provisional application No. 60/228,049, filed on Aug. 25, 2000, provisional application No. 60/228,132, filed on Aug. 25, 2000, provisional application No. 60/228,152, filed on Aug. 25, 2000, provisional application No. 60/228,135, filed on Aug. 25, 2000, provisional application No. 60/228,322, filed on Aug. 25, 2000, provisional application No. 60/228,156, filed on Aug. 25, 2000, provisional application No. 60/228,323, filed on Aug. 25, 2000, provisional application No. 60/228,133, filed on Aug. 25, 2000, provisional application No. 60/228,320, filed on Aug. 25, 2000, provisional application No. 60/228,159, filed on Aug. 25, 2000, provisional application No. 60/228,047, filed on Aug. 25, 2000, provisional application No. 60/228,202, filed on Aug. 25, 2000, provisional application No. 60/228,163, filed on Aug. 25, 2000, provisional application No. 60/228,153, filed on Aug. 25, 2000, provisional application No. 60/228,179, filed on Aug. 25, 2000, provisional application No. 60/228,180, filed on Aug. 25, 2000, provisional application No. 60/228,209, filed on Aug. 25, 2000, provisional application No. 60/228,177, filed on Aug. 25, 2000, provisional application No. 60/227,791, filed on Aug. 25, 2000, provisional application No. 60/228,207, filed on Aug. 25, 2000, provisional application No. 60/228,151, filed on Aug. 25, 2000, provisional application No. 60/227,770, filed on Aug. 25, 2000, provisional application No. 60/228,025, filed on Aug. 25, 2000, provisional application No. 60/227,781, filed on Aug. 25, 2000, provisional application No. 60/227,783, filed on Aug. 25, 2000, provisional application No. 60/227,731, filed on Aug. 25, 2000, provisional application No. 60/227,732, filed on Aug. 25, 2000, provisional application No. 60/227,729, filed on Aug. 25, 2000, provisional application No. 60/228,167, filed on Aug. 25, 2000, provisional application No. 60/227,734, filed on Aug. 25, 2000, provisional application No. 60/227,792, filed on Aug. 25, 2000, provisional application No. 60/228,098, filed on Aug. 25, 2000, provisional application No. 60/227,730, filed on Aug. 25, 2000, provisional application No. 60/228,048, filed on Aug. 25, 2000, provisional application No. 60/227,728, filed on Aug. 25, 2000, provisional application No. 60/227,773, filed on Aug. 25, 2000, provisional application No. 60/228,033, filed on Aug. 25, 2000, provisional application No. 60/228,024, filed on Aug. 25, 2000, provisional application No. 60/227,769, filed on Aug. 25, 2000, provisional application No. 60/227,780, filed on Aug. 25, 2000, provisional application No. 60/227,725, filed on Aug. 25, 2000, provisional application No. 60/227,774, filed on Aug. 25, 2000, provisional application No. 60/227,976, filed on Aug. 25, 2000, provisional application No. 60/228,046, filed on Aug. 25, 2000, provisional application No. 60/227,733, filed on Aug. 25, 2000, provisional application No. 60/227,929, filed on Aug. 25, 2000, provisional application No. 60/228,096, filed on Aug. 25, 2000, provisional application No. 60/227,931, filed on Aug. 25, 2000, provisional application No. 60/228,178, filed on Aug. 25, 2000, provisional application No. 60/228,061, filed on Aug. 25, 2000, provisional application No. 60/228,150, filed on Aug. 25, 2000, provisional application No. 60/228,041, filed on Aug. 25, 2000, provisional application No. 60/227,793, filed on Aug. 25, 2000, provisional application No. 60/228,031, filed on Aug. 25, 2000, provisional application No. 60/228,217, filed on Aug. 25, 2000, provisional application No. 60/228,027, filed on Aug. 25, 2000, provisional application No. 60/228,043, filed on Aug. 25, 2000, provisional application No. 60/228,026, filed on Aug. 25, 2000, provisional application No. 60/228,038, filed on Aug. 25, 2000, provisional application No. 60/228,036, filed on Aug. 25, 2000, provisional application No. 60/227,790, filed on Aug. 25, 2000, provisional application No. 60/228,039, filed on Aug. 25, 2000, provisional application No. 60/228,030, filed on Aug. 25, 2000, provisional application No. 60/228,032, filed on Aug. 25, 2000, provisional application No. 60/228,149, filed on Aug. 25, 2000, provisional application No. 60/228,040, filed on Aug. 25, 2000, provisional application No. 60/227,777, filed on Aug. 25, 2000, provisional application No. 60/228,037, filed on Aug. 25, 2000, provisional application No. 60/228,028, filed on Aug. 25, 2000, provisional application No. 60/228,055, filed on Aug. 25, 2000, provisional application No. 60/227,932, filed on Aug. 25, 2000, provisional application No. 60/227,936, filed on Aug. 25, 2000, provisional application No. 60/228,044, filed on Aug. 25, 2000, provisional application No. 60/228,216, filed on Aug. 25, 2000, provisional application No. 60/228,065, filed on Aug. 25, 2000, provisional application No. 60/227,975, filed on Aug. 25, 2000, provisional application No. 60/228,181, filed on Aug. 25, 2000, provisional application No. 60/228,187, filed on Aug. 25, 2000, provisional application No. 60/228,064, filed on Aug. 25, 2000, provisional application No. 60/227,954, filed on Aug. 25, 2000, provisional application No. 60/228,074, filed on Aug. 25, 2000, provisional application No. 60/227,939, filed on Aug. 25, 2000, provisional application No. 60/228,165, filed on Aug. 25, 2000, provisional application No. 60/228,221, filed on Aug. 25, 2000, provisional application No. 60/228,063, filed on Aug. 25, 2000, provisional application No. 60/228,240, filed on Aug. 25, 2000, provisional application No. 60/227,955, filed on Aug. 25, 2000, provisional application No. 60/228,161, filed on Aug. 25, 2000, provisional application No. 60/228,164, filed on Aug. 25, 2000, provisional application No. 60/228,054, filed on Aug. 25, 2000, provisional application No. 60/228,189, filed on Aug. 25, 2000, provisional application No. 60/227,982, filed on Aug. 25, 2000, provisional application No. 60/227,978, filed on Aug. 25, 2000, provisional application No. 60/228,053, filed on Aug. 25, 2000, provisional application No. 60/227,979, filed on Aug. 25, 2000, provisional application No. 60/224,390, filed on Aug. 25, 2000.

Related U.S. Application Data

(56) References Cited

OTHER PUBLICATIONS

Miki_In Vitro Cell Dev Biol—Plant_38_139_2002.*
Office Action dated May 13, 2009 in U.S. Appl. No. 11/058,689.
Kim et al., "A 20 Nucleotide Upstream Element is Essential for the Nopaline Synthase (*nos*) Promoter Activity," Plant Molecular Biology, vol. 24, pp. 105-117, 1994.
Donald et al., "Mutation of Either G Box or I Box Sequences Profoundly Affects Expression From the *Arabidopsis* rbcS-1A Promoter," EMBO Journal, vol. 9, No. 6, pp. 1717-1726, 1990.
Dolferus et al., "Differential Interactions of Promoter Elemtns in Stress Responses of the *Arabidopsis* Adh Gene," Plant Physiology, vol. 105, pp. 1075-1087, 1994.
DATABASE Genbank [Online] Feb. 14, 2004, "*Arabidopsis thaliana* genomic DNA, chromosome 5, P1 clone: MNC17." retrieved from NCBI accession No. AB016890 BA000015.
Database EMBL Nov. 24, 2004 WiscDsLox 262D09 *Arabidopsis thaliana* T-DNA insertion flanking sequences XP002372669.
Database EMBL Mar. 21, 2002 *Arabadopsis thaliana* cDNA clone: RAFL09-89-K19,5-end. XP002372670.
Database EMBL Apr. 23, 2002, *Arabidopsis thaliana* putative photoassimilate-responsive protein PAR (At5g52390) mRNA, complete cds. XP002372671.
Database Geneseq Oct. 18, 2000 *Arabadopsis thaliana* protein fragment SEQ ID No. 62052, XP002372672.
Shahmuradov I A et al., PlantProm: a database of plant promoter sequences, Nucleic Acids Research, Oxford University Press, Surrey GB vol. 31, No. 1, 2003, pp. 114-117 XP002993034.
Database EMBL Nov. 16, 1998 *Arabidopsis thaliana* genomic DNA, chromosome 5, TAC clone: K24M7 XP002372668 retrieved from EBI accession No. EM_PRO: AB019226 Database accession No. AB019226.
Benfey, et al, Science, (1990), vol. 250, pp. 959-966.
Sato, et al, NCBI GenBank Sequence Accession No. AB022216, pp. 1-31 (Dec. 27, 2000).
Tyagi, et al, Current Science, (2001), vol. 80., pp. 161-169.
Maniatis, et al, Molecular Cloning: A Laboratory Manual, Cold Spring Harbor Laboratory (1982).
GenBank Accession No. NM 112618 (Apr. 20, 2007).
Goto, et al., Genes Genet. Syst., (2002), vol. 77, pp. 89-95.
Shen, et al., Plant J., (2002), vol. 29(3), pp. 371-380.
Doerks, et al., TIG, (1998), vol. 14, pp. 248-250.
Smith, et al., Nature Biotechnology, (1997), vol. 15, pp. 1222-1223.
Bork, et al., TIG, (1996), vol. 12, pp. 425-427.
Guo, et al., PNAS, (2004), vol. 101, pp. 9205-9210.
Keskin, et al., Protein Science, (2004), vol. 13, pp. 1043-1055.
Thornton, et al., Nature structural Biology, structural genomics supplement, (Nov. 2000).
Wells, Biochemistry, (1990), vol. 29, pp. 8509-8517.
Miyoshi, et al., Plant J, (2003), vol. 36, pp. 532-540.
Ngo, et al., The Protein Folding Problem and Tertiary Structure Prediction, K. Merz and S. LeGrand (eds.), (1994), pp. 492-495.
Office Action dated Jul. 28, 2008 in U.S. Appl. No. 11/058,689.
Office Action dated May 7, 2009 in U.S. Appl. No. 11/097,589.
NCBI GenBank ATU27811, "*Arabidopsis thaliana* actin 7 (ACT7) gene, complete cds," Apr. 17, 1997.
NCBI GenBank AF308778, "*Arabidopsis thaliana* actin 7 (ACT7) gene, promoter region," Oct. 2, 2001.
NCBI GenBank AB016893, "*Arabidopsis thaliana* genomic DNA, chromosome 5, P1 clone:MYH9," Feb. 14, 2004.
NCBI GenBank U37281, "*Arabidopsis thaliana* actin-2 mRNA, complete cds." Sep. 29, 1995.

* cited by examiner

PROMOTER, PROMOTER CONTROL ELEMENTS, AND COMBINATIONS, AND USES THEREOF

This application is a Continuation of application Ser. No. 10/886,468, filed Jul. 6, 2004, now U.S. Pat. No. 8,877,916 which is a Continuation of application Ser. No. 10/653,278, filed on Sep. 3, 2003, now abandoned which is a continuation-in-part of the following applications. The entire contents of which are hereby incorporated by reference:

| Attorney Docket No. | Filed | Application Number |
| --- | --- | --- |
| 2750-1399P | Feb. 1, 2001 | 09/775,870 now abandoned |
| 2750-1549P | Feb. 25, 2003 | 10/372,233 now abandoned |
| 2750-1469P | Aug. 9, 2001 | 09/924,702 now abandoned |

Moreover,

Application Ser. No. 10/372,233 listed above is a continuation of application Ser. No. 10/158,820, filed on Jun. 3, 2002, now abandoned the entire contents of which are also hereby incorporated by reference. Application Ser. No. 10/158,820 is a continuation of application Ser. No. 09/938,697, filed on Aug. 24, 2001, now abandoned the entire contents of which are hereby incorporated by reference.

Application Ser. No. 09/938,697 is a continuation-in-part of the following non-provisional and provisional applications, to which the present application claims priority under 35 USC §119(e) and §120, the entire contents of which are hereby incorporated by reference:

| Attorney No | Appln No | Filed |
| --- | --- | --- |
| 2750-1154P | 09/754,185 | Jan. 5, 2001 now abandoned |
| 2750-1398P | 09/774,340 | Jan. 31, 2001 now abandoned |
| 2750-1400P | 09/776,014 | Feb. 1, 2001 now abandoned |
| 2750-1399P | 09/775,870 | Feb. 1, 2001 now abandoned |
| 2750-1439P | 09/842,246 | Apr. 26, 2001 now abandoned |
| 2750-0832P | 60/200,034 | Apr. 26, 2000 |
| 2750-1444P | 09/845,209 | May 1, 2001 now abandoned |
| 2750-0889P | 60/205,233 | May 17, 2000 |
| 2750-0841P | 60/201,017 | May 1, 2000 |
| 2750-1469P | 09/924,702 | Aug. 9, 2001 now abandoned |
| 2750-1114P | 60/224,390 | Aug. 9, 2000 |
| 2750-1181P | 60/228,208 | Aug. 25, 2000 |
| 2750-1168P | 60/228,052 | Aug. 25, 2000 |
| 2750-1169P | 60/228,049 | Aug. 25, 2000 |
| 2750-1170P | 60/228,132 | Aug. 25, 2000 |
| 2750-1171P | 60/228,152 | Aug. 25, 2000 |
| 2750-1172P | 60/228,135 | Aug. 25, 2000 |
| 2750-1173P | 60/228,322 | Aug. 25, 2000 |
| 2750-1174P | 60/228,156 | Aug. 25, 2000 |
| 2750-1175P | 60/228,323 | Aug. 25, 2000 |
| 2750-1176P | 60/228,133 | Aug. 25, 2000 |
| 2750-1177P | 60/228,320 | Aug. 25, 2000 |
| 2750-1178P | 60/228,159 | Aug. 25, 2000 |
| 2750-1167P | 60/228,047 | Aug. 25, 2000 |
| 2750-1180P | 60/228,202 | Aug. 25, 2000 |
| 2750-1164P | 60/228,163 | Aug. 25, 2000 |
| 2750-1182P | 60/228,153 | Aug. 25, 2000 |
| 2750-1183P | 60/228,179 | Aug. 25, 2000 |
| 2750-1184P | 60/228,180 | Aug. 25, 2000 |
| 2750-1185P | 60/228,209 | Aug. 25, 2000 |
| 2750-1187P | 60/228,177 | Aug. 25, 2000 |
| 2750-2132P | 60/227,791 | Aug. 25, 2000 |
| 2750-1189P | 60/228,207 | Aug. 25, 2000 |
| 2750-1179P | 60/228,151 | Aug. 25, 2000 |
| 2750-1144P | 60/227,770 | Aug. 25, 2000 |
| 2750-1133P | 60/228,025 | Aug. 25, 2000 |
| 2750-1134P | 60/227,781 | Aug. 25, 2000 |
| 2750-1135P | 60/227,783 | Aug. 25, 2000 |
| 2750-1136P | 60/227,731 | Aug. 25, 2000 |
| 2750-1137P | 60/227,732 | Aug. 25, 2000 |
| 2750-1138P | 60/227,729 | Aug. 25, 2000 |
| 2750-1139P | 60/228,167 | Aug. 25, 2000 |
| 2750-1140P | 60/227,734 | Aug. 25, 2000 |
| 2750-1141P | 60/227,792 | Aug. 25, 2000 |
| 2750-1166P | 60/228,098 | Aug. 25, 2000 |
| 2750-1143P | 60/227,730 | Aug. 25, 2000 |
| 2750-1190P | 60/228,048 | Aug. 25, 2000 |
| 2750-1145P | 60/227,728 | Aug. 25, 2000 |
| 2750-1146P | 60/227,773 | Aug. 25, 2000 |
| 2750-1147P | 60/228,033 | Aug. 25, 2000 |
| 2750-1148P | 60/228,024 | Aug. 25, 2000 |
| 2750-1149P | 60/227,769 | Aug. 25, 2000 |
| 2750-1150P | 60/227,780 | Aug. 25, 2000 |
| 2750-1151P | 60/227,725 | Aug. 25, 2000 |
| 2750-1152P | 60/227,774 | Aug. 25, 2000 |
| 2750-1188P | 60/227,976 | Aug. 25, 2000 |
| 2750-1165P | 60/228,046 | Aug. 25, 2000 |
| 2750-1142P | 60/227,733 | Aug. 25, 2000 |
| 2750-1218P | 60/227,929 | Aug. 25, 2000 |
| 2750-1191P | 60/228,096 | Aug. 25, 2000 |
| 2750-1220P | 60/227,931 | Aug. 25, 2000 |
| 2750-1186P | 60/228,178 | Aug. 25, 2000 |
| 2750-1222P | 60/228,061 | Aug. 25, 2000 |
| 2750-1223P | 60/228,150 | Aug. 25, 2000 |
| 2750-2133P | 60/228,041 | Aug. 25, 2000 |
| 2750-2116P | 60/227,793 | Aug. 25, 2000 |
| 2750-2117P | 60/228,031 | Aug. 25, 2000 |
| 2750-1217P | 60/228,217 | Aug. 25, 2000 |
| 2750-2119P | 60/228,027 | Aug. 25, 2000 |
| 2750-1219P | 60/228,043 | Aug. 25, 2000 |
| 2750-2121P | 60/228,026 | Aug. 25, 2000 |
| 2750-2122P | 60/228,038 | Aug. 25, 2000 |
| 2750-2123P | 60/228,036 | Aug. 25, 2000 |
| 2750-2124P | 60/227,790 | Aug. 25, 2000 |
| 2750-2125P | 60/228,039 | Aug. 25, 2000 |
| 2750-2126P | 60/228,030 | Aug. 25, 2000 |
| 2750-2127P | 60/228,032 | Aug. 25, 2000 |
| 2750-2128P | 60/228,149 | Aug. 25, 2000 |
| 2750-2129P | 60/228,040 | Aug. 25, 2000 |
| 2750-2130P | 60/227,777 | Aug. 25, 2000 |
| 2750-2131P | 60/228,037 | Aug. 25, 2000 |
| 2750-2118P | 60/228,028 | Aug. 25, 2000 |
| 2750-1201P | 60/228,055 | Aug. 25, 2000 |
| 2750-1192P | 60/227,932 | Aug. 25, 2000 |
| 2750-1193P | 60/227,936 | Aug. 25, 2000 |
| 2750-1194P | 60/228,044 | Aug. 25, 2000 |
| 2750-1195P | 60/228,216 | Aug. 25, 2000 |
| 2750-1196P | 60/228,065 | Aug. 25, 2000 |
| 2750-1197P | 60/227,975 | Aug. 25, 2000 |
| 2750-1198P | 60/228,181 | Aug. 25, 2000 |
| 2750-1221P | 60/228,187 | Aug. 25, 2000 |
| 2750-1200P | 60/228,064 | Aug. 25, 2000 |
| 2750-1216P | 60/227,954 | Aug. 25, 2000 |
| 2750-1202P | 60/228,074 | Aug. 25, 2000 |
| 2750-1203P | 60/227,939 | Aug. 25, 2000 |
| 2750-1212P | 60/228,165 | Aug. 25, 2000 |
| 2750-1213P | 60/228,221 | Aug. 25, 2000 |
| 2750-1199P | 60/228,063 | Aug. 25, 2000 |
| 2750-1214P | 60/228,240 | Aug. 25, 2000 |
| 2750-1204P | 60/227,955 | Aug. 25, 2000 |
| 2750-1211P | 60/228,161 | Aug. 25, 2000 |
| 2750-1210P | 60/228,164 | Aug. 25, 2000 |
| 2750-1209P | 60/228,054 | Aug. 25, 2000 |
| 2750-1208P | 60/228,189 | Aug. 25, 2000 |
| 2750-1207P | 60/227,982 | Aug. 25, 2000 |
| 2750-1206P | 60/227,978 | Aug. 25, 2000 |
| 2750-1205P | 60/228,053 | Aug. 25, 2000 |
| 2750-1215P | 60/227,979 | Aug. 25, 2000 |

Application Ser. No. 09/924,702 listed above claims priority under 35 USC §119(e) of the following application. The entire contents of which are hereby incorporated by reference.

| Country | Filed | Attorney No. | Application No. |
|---|---|---|---|
| United States | Aug. 9, 2000 | 2750-1114P | 60/224,390 |

The entire contents of the applications listed in the table above are expressly incorporated herein by reference.

In addition, this application claims priority to application Ser. No. 10/645,822, filed Aug. 22, 2003, which is either a Continuation-In-Part of one of the following co-pending applications or a Nonprovisional application claiming priority to one of the following co-pending Provisional applications.

| Number | II. Filed | a. application Ser. No. |
|---|---|---|
| 1. | 5 Jan. 2001 | 09/754,184 |
| 2. | 9 Apr. 2003 | 10/409,117 |
| 3. | 4 Apr. 2001 | 09/824,790 |
| 4. | 17 Jun. 2003 | 10/462,849 |
| 5. | 29 Dec. 2000 | 09/750,044 |
| 6. | 21 Nov. 2002 | 10/300,941 |
| 7. | 6 Jan. 2003 | 10/336,798 |
| 8. | 7 Nov. 2002 | 10/289,416 |
| 9. | 9 Dec. 2002 | 10/314,246 |
| 10. | 4 Aug. 2003 | 10/633,229 |
| 11. | 6 Jan. 2003 | 10/336,816 |
| 12. | 13 Jan. 2003 | 10/340,649 |
| 13. | 13 Jan. 2003 | 10/340,584 |
| 14. | 29 Jul. 2003 | 10/628,535 |
| 15. | 15 Jul. 2003 | 10/618,812 |
| 16. | 5 May 2003 | 10/428,842 |
| 17. | 15 Jul. 2003 | 10/618,811 |
| 18. | 21 Jul. 2000 | 09/620,394 |
| 19. | 9 Nov. 2000 | 09/708,427 |
| 20. | 15 Aug. 2003 | 10/642,811 |
| 21. | 2 Jan. 2001 | 09/750,910 |
| 22. | 18 Dec. 2002 | 60/433,952 |
| 23. | 8 May 2003 | 10/431,436 |
| 24. | 10 Feb. 2003 | 10/360,648 |
| 25. | 12 Aug. 2002 | 10/216,621 |
| 26. | 16 Jun. 2003 | 10/461,476 |
| 27. | 29 Oct. 2002 | 10/282,058 |
| 28. | 3 Mar. 2003 | 10/376,785 |
| 29. | 3 Mar. 2003 | 10/376,797 |
| 30. | 25 Feb. 2000 | 09/513,996 |
| 31. | 24 Aug. 2001 | 09/935,625 |
| 32. | 28 Feb. 2003 | 10/375,265 |
| 33. | 3 Mar. 2003 | 10/376,766 |
| 34. | 12 Oct. 2000 | 09/686,093 |
| 35. | 6 Oct. 2000 | 09/680,498 |
| 36. | 28 Sep. 2000 | 09/671,635 |
| 37. | 22 Sep. 2000 | 09/667,517 |
| 38. | 20 Sep. 2000 | 09/665,714 |
| 39. | 20 Jul. 2000 | 09/621,323 |
| 40. | 4 Aug. 2000 | 09/633,191 |
| 41. | 30 Aug. 2000 | 09/651,370 |
| 42. | 1 May 2003 | 10/426,837 |
| 43. | 1 Nov. 2000 | 09/702,841 |
| 44. | 25 Oct. 2000 | 09/696,751 |
| 45. | 2 Feb. 2003 | 10/356,562 |
| 46. | 6 Jan. 2003 | 10/336,799 |
| 47. | 21 Jan. 2003 | 10/347,322 |
| 48. | 4 Apr. 2003 | 10/406,556 |
| 49. | 13 Jan. 2003 | 10/340,820 |
| 50. | 18 Jul. 2003 | 10/621,442 |

Through the 50 applications listed above, the present application also claims priority to Number 2

Application Ser. No. 10/409,117 is a continuation of application Ser. No. 10/084,376 filed Feb. 28, 2002, to which the present application also claims priority to and incorporates by reference. Furthermore, application Ser. No. 10/084,376 is a continuation of application Ser. No. 09/924,701 filed Aug. 9, 2001, to which the present application also claims priority to and incorporates by reference. Moreover, application Ser. No. 09/924,701 claims priority to under 35 USC 119(e) of provisional application No. 60/224,391 filed Aug. 9, 2000, to which the present application also claims priority.

B. Number 3

Application Ser. No. 09/824,790 listed above (as item no. 3) is a continuation-in-part of the following applications to which the present application also claims priority:

| applicaton Ser. No. | Filed |
|---|---|
| 60/199,123 | Apr. 24, 2000 |
| 60/194,698 | Apr. 5, 2000 |
| 60/196,168 | Apr. 11, 2000 |
| 60/197,397 | Apr. 14, 2000 |
| 60/195,258 | Apr. 7, 2000 |
| 60/194,884 | Apr. 6, 2000 |
| 60/196,483 | Apr. 12, 2000 |
| 60/194,682 | Apr. 5, 2000 |
| 60/194,385 | Apr. 4, 2000 |
| 60/198,400 | Apr. 19, 2000 |
| 60/198,765 | Apr. 21, 2000 |
| 60/198,629 | Apr. 20, 2000 |
| 60/198,268 | Apr. 17, 2000 |

C. Number 4

Application Ser. No. 10/462,849 listed above 617 claims priority under 35 USC §119(e) of provisional application No. 60/389,140 filed Jun. 17, 2002.

D. Number 6

Application Ser. No. 10/300,941 listed above is a continuation-in-part of application Ser. No. 09/617,682 filed on Jul. 19, 2000, application Ser. No. 09/617,681 filed on Jul. 19, 2000, and application Ser. No. 09/688,051 filed on Oct. 13, 2000.

Through the three applications mentioned above, application Ser. No. 10/300,941 also claims priority under 35 USC §119(e) of the following provisional applications:

| Country | Filing Date | application Ser. No. | Status |
|---|---|---|---|
| U.S. States | Jul. 19, 1999 | 60/144,331 | Pending at the time of filing 09/617,682 |
| U.S. States | Jul. 19, 1999 | 60/144,333 | Pending at the time of filing 09/617,681 |
| U.S. States | Oct. 13, 1999 | 60/159,294 | Pending at the time of filing 09/688,051 |

E. Number 7

Application Ser. No. 10/336,798 listed above is a continuation of co-pending application Ser. No. 10/136,365, filed on May 2, 2002, the entire contents of which are also hereby incorporated by reference. Through application Ser. No. 10/136,365, this application also claims priority under 35 USC §119(e) and §120 of the following applications:

| Country | Client No. | application Ser. No. |
|---|---|---|
| U.S. States | Dec. 8, 2000 | 80180.003 | 09/731,809 | which is a conversion of and claims priority to the following provisional applications:

| Country | | Client No. | application Ser. No. |
|---|---|---|---|
| U.S. States | Dec. 8, 1999 | 80180.001 | 60/169,692 |
| U.S. States | Dec. 8, 1999 | 80180.002 | 60/169,691 |

F. Number 8

Application Ser. No. 10/289,416 listed above is a continuation of co-pending application Ser. No. 10/103,783 filed on Mar. 25, 2002. Through application Ser. No. 10/103,783, this application also claims priority under 35 USC §119(e) and §120 of the following applications:

| Country | Filing | Client No. | application Ser. No. | Status |
|---|---|---|---|---|
| U.S. States | Jan. 19, 2001 | 80182.003 | 09/764,425 | Pending at the time of filing Which claims priority of the provisional applications listed below: |
| U.S. States | Jan. 19, 2000 | 80182.002 | 60/176,866 | Pending at the time of filing |
| U.S. States | Jan. 19, 2000 | 80183.002 | 60/176,867 | Pending at the time of filing |
| U.S. States | Jan. 20, 2000 | 80184.002 | 60/176,910 | Pending at the time of filing |
| U.S. States | Jan. 26, 2000 | 00152.001 | 60/178,166 | Pending at the time of filing |
| U.S. States | Jan. 27, 2000 | 80182.001 | 60/178,544 | Pending at the time of filing |
| U.S. States | Jan. 27, 2000 | 80183.001 | 60/178,546 | Pending at the time of filing |
| U.S. States | Jan. 27, 2000 | 80184.001 | 60/178,545 | Pending at the time of filing |

G. Number 9

Application Ser. No. 10/314,246 listed above is a continuation of co-pending application Ser. No. 09/570,582 filed on May 12, 2000. Through application Ser. No. 09/570,582, this application claims priority under 35 USC §119(e) of the following application:

| Country | Filing | application Ser. No. | Status |
|---|---|---|---|
| U.S. States | May 14, 1992 | 60/134,221 | Pending at the time of filing |

H. Number 10

Application Ser. No. 10/633,229 listed above is a continuation of application Ser. No. 09/649,866, filed on Aug. 23, 2000. Through application Ser. No. 09/649,866, this application also claims priority under 35 USC §119(e) of the following provisional application:

| Country | FilingDate | application Ser. No. |
|---|---|---|
| U.S. | Aug. 23, 1999 | 60/149,930 |

I. Number 11

Application Ser. No. 10/336,816 listed above is a continuation of application Ser. No. 10/119,718 filed on Apr. 11, 2002. Through application Ser. No. 10/119,718, this application also claims priority under 35 U.S.C. §120 of the following application:

| Country | Client No. | application Ser. No. |
|---|---|---|
| U.S. | Aug. 10, 2001 | 710-0004-55300-US-U-31610.01 09/925,897 |

J. Number 12

Application Ser. No. 10/340,649 listed above is a continuation of application Ser. No. 10/112,879 filed on Apr. 2, 2002. Through application Ser. No. 10/112,879 this application also claims priority under 35 USC §119(e) and §120 of the following applications:

| Country | Filing Date | application Ser. No. | Status |
|---|---|---|---|
| U.S. | Jun. 16, 2000 | 09/594,599 | Pending at the time of filing 10/112,879. This application is a continuation of the following provisional application: |
| U.S. | Jun. 16, 1999 | 60/139,453 | Pending at the time of filing 09/594,599 |

K. Number 13

Application Ser. No. 10/340,584 listed above is a continuation of application Ser. No. 10/128,238 filed on Apr. 24, 2002. Through application Ser. No. 10/128,238, the present application also claims priority under 35 USC §120 of the following application:

| Country | application Ser. No. | Filing Date | Status |
|---|---|---|---|
| U.S. | 09/925,483 | Aug. 10, 2001 | Pending at the time of filing 10/128,238 |

L. Number 14

Application Ser. No. 10/628,535 listed above is a continuation-in-part of application Ser. No. 09/637,780, filed on Aug. 11, 2000. Through application Ser. No. 09/637,780, this application also claims priority under 35 USC §119(e) of the following provisional application:

| Country | Filing Date | application Ser. No. |
|---|---|---|
| U.S. | Aug. 13, 1999 | 60/148,684 |

M. Number 15

Application Ser. No. 10/618,812 listed above is a continuation of application Ser. No. 09/689,980, filed on Oct. 13, 2000. Through application Ser. No. 09/689,980, this application also claims priority under 35 USC §119(e) of the following application:

| Country | Filing Date | Client No. | application Ser. No. |
|---|---|---|---|
| U.S. | Oct. 14, 1999 | 80146.001 | 60/159,331 |

N. Number 16

Application Ser. No. 10/428,842 listed above is a continuation of application Ser. No. 09/620,111 filed Jul. 21, 2000. Application Ser. No. 09/620,111 claims priority under 35 USC 119(e) of provisional Application No. 60/145,089, filed Jul. 22, 1999.

O. Number 17

Application Ser. No. 10/618,811 listed above claims priority under 35 USC §119(e) of provisional application No. 60/395,650 filed Jul. 15, 2002.

P. Number 18

Application Ser. No. 09/620,394 listed above claims priority under 35 USC §119(e), of the following applications:

| Country | Filing Date | Client No. | application Ser. No. |
|---|---|---|---|
| U.S. | Jul. 21, 1999 | 80134.001 | 60/145,088 |

Number 19

Application Ser. No. 09/708,427 listed above is a continuation-in-part and claims priority under 35 USC §120 of the following applications:

| Country | Filing Date | Client No. | application Ser. No. |
|---|---|---|---|
| U.S. | Jan. 7, 2000 | 80070.002 | 09/479,221 |
| U.S. | Apr. 28, 2000 | 80123.002 | 09/559,232 |
| U.S. | Jun. 16, 2000 | 80132.024 | 09/595,331 |
| U.S. | Jul. 14, 2000 | 80134.017 | 09/614,388 |
| U.S. | Jul. 19, 2000 | 80134.020 | 09/617,683 |
| U.S. | Jul. 20, 2000 | 80134.026 | 09/620,998 |
| U.S. | Jul. 21, 2000 | 80134.023 | 09/620,313 |
| U.S. | Jul. 21, 2000 | 80134.021 | 09/620,390 |
| U.S. | Jul. 21, 2000 | 80134.025 | 09/620,314 |
| U.S. | Aug. 2, 2000 | 80137.004 | 09/630,442 |
| U.S. | Aug. 4, 2000 | 80138.004 | 09/635,643 |
| U.S. | Aug. 4, 2000 | 80138.003 | 09/635,640 |
| U.S. | Aug. 9, 2000 | 80139.004 | 09/635,642 |
| U.S. | Aug. 10, 2000 | 80139.003 | 09/635,641 |
| U.S. | Aug. 16, 2000 | 80142.003 | 09/643,672 |
| U.S. | Aug. 18, 2000 | 80143.004 | 09/643,671 |
| U.S. | Aug. 25, 2000 | 80144.003 | 09/649,868 |
| U.S. | Aug. 25, 2000 | 80144.004 | 09/649,867 |
| U.S. | Oct. 13, 2000 | 80148.003 | 09/689,981 |
| U.S. | Oct. 13, 2000 | 80145.004 | 09/688,050 |
| U.S. | Oct. 13, 2000 | 80146.004 | 09/688,052 |
| U.S. | Oct. 13, 2000 | 80147.003 | 09/689,982 |
| U.S. | Oct. 13, 2000 | 80147.004 | 09/689,983 |

Application Ser. No. 09/708,427 also claims priority under 35 USC §119(e) of the following provisional applications:

| Country | Client No. | application Ser. No. |
|---|---|---|
| U.S. | Nov. 10, 1999 | 80161.001 | 60/164,319 |
| U.S. | Nov. 9, 1999 | 80161.002 | 60/164,260 |
| U.S. | Nov. 10, 1999 | 80162.001 | 60/164,317 |
| U.S. | Nov. 9, 1999 | 80162.002 | 60/164,259 |
| U.S. | Nov. 10, 1999 | 80163.001 | 60/164,321 |
| U.S. | Nov. 10, 1999 | 80163.002 | 60/164,318 |
| U.S. | Nov. 24, 1999 | 80173.001 | 60/167,382 |
| U.S. | Nov. 23, 1999 | 80173.002 | 60/167,362 |

Q. Number 20

Application Ser. No. 10/642,811 listed above is a continuation of co-pending application Ser. No. 09/689,984, filed on Oct. 13, 2000. Through application Ser. No. 09/689,984, this application also claims priority under 35 USC §119(e) of the following provisional application:

| Country | Filing Date | application Ser. No. |
|---|---|---|
| U.S. | Oct. 14, 1999 | 60/159,330 |

R. Number 23

Application Ser. No. 10/431,436 listed above is a continuation of application Ser. No. 10/227,279, filed on Aug. 26, 2002.

Application Ser. No. 10/227,279 is a continuation of application Ser. No. 09/940,245, filed on Aug. 24, 2001.

Application Ser. No. 09/940,245, is a Continuation-In-Part of the following applications to which the present application also claims priority under 35 USC §119(e) and §120:

| Client No. | Filing Date | application Ser. No. | |
|---|---|---|---|
| 91000.002 | Apr. 6, 2000 | 09/543,680 | which claims priority |
| 91000.001 | Apr. 6, 1999 | 60/128,234 | and |
| 91001.001 | Apr. 8, 1999 | 60/128,714 | |
| 80126.002 | May 4, 2000 | 09/566,262 | which claims priority to |
| 80126.001 | May 4, 1999 | 60/132,484 | |
| 80127.002 | May 5, 2000 | 09/565,309 | which claims priority to |
| 80127.001 | May 5, 1999 | 60/132,485 | |
| 91002.002 | May 5, 2000 | 09/565,308 | which claims priority to |
| 91002.001 | May 6, 1999 | 60/132,487 | |
| 80129.002 | May 5, 2000 | 09/565,307 | which claims priority to |
| 80129.001 | May 6, 1999 | 60/132,486 | |
| 80130.002 | May 5, 2000 | 09/565,310 | which claims priority to |
| 80130.001 | May 7, 1999 | 60/132,863 | |
| 80131.002 | May 11, 2000 | 09/572,408 | which claims priority to |
| 80131.001 | May 11, 1999 | 60/134,256 | |
| 80117.002 | May 12, 2000 | 09/570,768 | and |
| 80116.002 | May 12, 2000 | 09/570,738 | which both claim priority to |
| 80116.001 | May 14, 1999 | 60/134,219 | and |
| 80117.001 | May 14, 1999 | 60/134,218 | |
| 91007.002 | May 18, 2000 | 09/573,655 | which claims priority to |
| 91007.001 | May 18, 1999 | 60/134,768 | and |
| 91008.001 | May 19, 1999 | 60/134,941 | and |
| 91009.001 | May 20, 1999 | 60/135,124 | and |
| 91010.001 | May 21, 1999 | 60/135,353 | and |
| 91011.001 | May 24, 1999 | 60'135,629 | and |
| 91012.001 | May 25, 1999 | 60/136,021 | and |
| 91013.001 | May 27, 1999 | 60/136,392 | and |
| 91014.001 | May 28, 1999 | 60/136,782 | and |
| 91015.001 | Jun. 1, 1999 | 60/137,222 | and |
| 91016.001 | Jun. 3, 1999 | 60/137,528 | and |
| 91017.001 | Jun. 4, 1999 | 60/137,502 | and |
| 91018.001 | Jun. 7, 1999 | 60/137,724 | and |
| 91019.001 | Jun. 8, 1999 | 60/138,094 | |
| 80132.013 | Jun. 16, 2000 | 09/595,330 | which claims priority |
| 80132.001 | Jun. 18, 1999 | 60/139,458 | |
| 80132.014 | Jun. 16, 2000 | 09/595,333 | which claims priority |
| 80132.002 | Jun. 18, 1999 | 60/139,454 | |
| 80132.015 | Jun. 16, 2000 | 09/595,328 | which claims priority |
| 80132.003 | Jun. 18, 1999 | 60/139,459 | |
| 80132.016 | Jun. 16, 2000 | 09/595,335 | which claims priority to |
| 80132.004 | Jun. 18, 1999 | 60/139,461 | |
| 80132.017 | Jun. 16, 2000 | 09/595,329 | which claims priority to |
| 80132.005 | Jun. 18, 1999 | 60/139,462 | |
| 80132.018 | Jun. 16, 2000 | 09/595,332 | which claims priority |
| 80132.006 | Jun. 18, 1999 | 60/139,457 | |

| Client No. | Filing Date | application Ser. No. | |
|---|---|---|---|
| 80132.019 | Jun. 16, 2000 | 09/594,598 | which claims priority to |
| 80132.007 | Jun. 18, 1999 | 60/139,460 | |
| 80132.020 | Jun. 16, 2000 | 09/594,595 | which claims priority |
| 80132.008 | Jun. 18, 1999 | 60/139,456 | |
| 00033.003 | Jun. 9, 2000 | 09/592,459 | which claims priority and |
| 00033.001 | Jun. 10, 1999 | 60/138,540 | |
| 00033.002 | Jun. 10, 1999 | 60/138,847 | |
| 80132.021 | Jun. 16, 2000 | 09/594,597 | which claims priority |
| 80132.009 | Jun. 18, 1999 | 60/139,463 | |
| 80132.022 | Jun. 16, 2000 | 09/595,298 | which claims priority |
| 80132.010 | Jun. 18, 1999 | 60/139,455 | |
| 00034.002 | Jun. 14, 2000 | 09/593,710 | which claims priority |
| 00034.001 | Jun. 14, 1999 | 60/139,119 | |
| 00045.002 | Jun. 23, 2000 | 09/602,016 | which claims priority |
| 00045.001 | Jun. 24, 1999 | 60/140,695 | |
| 00048.002 | Jun. 29, 2000 | 09/606,181 | which claims priority |
| 00048.001 | Jun. 29, 1999 | 60/140,991 | |
| 00050.002 | Jun. 30, 2000 | 09/607,081 | which claims priority |
| 00050.001 | Jul. 1, 1999 | 60/141,842 | |
| 00051.002 | Jun. 30, 2000 | 09/610,157 | which claims priority |
| 00051.001 | Jul. 1, 1999 | 60/142,154 | |
| 00052.002 | Jun. 30, 2000 | 09/609,198 | which claims priority to |
| 00052.001 | Jul. 2, 1999 | 60/142,055 | |
| 00053.002 | Jul. 6, 2000 | 09/611,409 | which claims priority |
| 00053.001 | Jul. 6, 1999 | 60/142,390 | |
| 00054.002 | Jul. 7, 2000 | 09/612,645 | which claims priority |
| 00054.001 | Jul. 8, 1999 | 60/142,803 | |
| 00058.002 | Jul. 7, 2000 | 09/613,547 | which claims priority |
| 00058.001 | Jul. 9, 1999 | 60/142,920 | |
| 80134.016 | Jul. 21, 2000 | 09/620,393 | which claims priority |
| 80134.002 | Jul. 21, 1999 | 60/145,086 | |
| 80134.018 | Jul. 14, 2000 | 09/614,450 | which claims priority and |
| 80134.004 | Jul. 16, 1999 | 60/144,085 | |
| 80134.014 | Jul. 19, 1999 | 60/144,334 | |
| 80135.003 | Jul. 21, 2000 | 09/621,900 | which claims priority to |
| 80135.001 | Jul. 23, 1999 | 60/145,224 | |
| 80135.004 | Jul. 20, 2000 | 09/620,978 | which claims priority |
| 80135.002 | Jul. 20, 1999 | 60/144,884 | |
| 80136.004 | Jul. 27, 2000 | 09/628,984 | which claims priority to |
| 80136.001 | Jul. 27, 1999 | 60/145,918 | and |
| 80136.003 | Aug. 5, 1999 | 60/147,192 | |
| 80136.005 | Jul. 27, 2000 | 09/628,987 | which claims priority |
| 80136.002 | Jul. 27, 1999 | 60/145,919 | |
| 80137.003 | Aug. 2, 2000 | 09/628,985 | which claims priority to |
| 80137.001 | Aug. 2, 1999 | 60/146,388 | |

S. Number 24

(a) application Ser. No. 10/360,648 listed above is a continuation of application Ser. No. 10/156,076, filed on May 29, 2002, which in turn is a continuation of application Ser. No. 09/940,256 filed on Aug. 24, 2001.

Through application Ser. No. 09/940,256, the present application claims priority under 35 USC §119(e), §119(a-d) and §120 of the following applications:

| Client No | Filing Date | application Ser. No |
|---|---|---|
| 91000.002 | Apr. 6, 2000 | 09/543,680 |
| 91000.001 | Apr. 6, 1999 | 60/128,234 |
| 91001.001 | Apr. 8, 1999 | 60/128,714 |
| 80126.002 | May 4, 2000 | 09/566,262 |
| 80126.001 | May 4, 1999 | 60/132,484 |
| 80127.002 | May 5, 2000 | 09/565,309 |
| 80127.001 | May 5, 1999 | 60/132,485 |
| 91002.002 | May 5, 2000 | 09/565,308 |
| 91002.001 | May 6, 1999 | 60/132,487 |
| 80129.002 | May 5, 2000 | 09/565,307 |
| 80129.001 | May 6, 1999 | 60/132,486 |
| 80130.002 | May 5, 2000 | 09/565,310 |
| 80130.001 | May 7, 1999 | 60/132,863 |
| 80131.002 | May 11, 2000 | 09/572,408 |
| 80131.001 | May 11, 1999 | 60/134,256 |
| 80117.002 | May 12, 2000 | 09/570,768 |
| 80116.002 | May 12, 2000 | 09/570,738 |
| 80116.001 | May 14, 1999 | 60/134,219 |
| 80117.001 | May 14, 1999 | 60/134,218 |
| 91007.002 | May 18, 2000 | 09/573,655 |
| 91007.001 | May 18, 1999 | 60/134,768 |
| 91008.001 | May 19, 1999 | 60/134,941 |
| 91009.001 | May 20, 1999 | 60/135,124 |
| 91010.001 | May 21, 1999 | 60/135,353 |
| 91011.001 | May 24, 1999 | 60/135,629 |
| 91012.001 | May 25, 1999 | 60/136,021 |
| 91013.001 | May 27, 1999 | 60/136,392 |
| 91014.001 | May 28, 1999 | 60/136,782 |
| 91015.001 | Jun. 1, 1999 | 60/137,222 |
| 91016.001 | Jun. 3, 1999 | 60/137,528 |
| 91017.001 | Jun. 4, 1999 | 60/137,502 |
| 91018.001 | Jun. 7, 1999 | 60/137,724 |
| 91019.001 | Jun. 8, 1999 | 60/138,094 |
| 80132.013 | Jun. 16, 2000 | 09/595,330 |
| 80132.001 | Jun. 18, 1999 | 60/139,458 |
| 80132.014 | Jun. 16, 2000 | 09/595,333 |
| 80132.002 | Jun. 18, 1999 | 60/139,454 |
| 80132.015 | Jun. 16, 2000 | 09/595,328 |
| 80132.003 | Jun. 18, 1999 | 60/139,459 |
| 80132.016 | Jun. 16, 2000 | 09/595,335 |
| 80132.004 | Jun. 18, 1999 | 60/139,461 |
| 80132.017 | Jun. 16, 2000 | 09/595,329 |
| 80132.005 | Jun. 18, 1999 | 60/139,462 |
| 80132.018 | Jun. 16, 2000 | 09/595,332 |
| 80132.006 | Jun. 18, 1999 | 60/139,457 |
| 80132.019 | Jun. 16, 2000 | 09/594,598 |
| 80132.007 | Jun. 18, 1999 | 60/139,460 |
| 80132.020 | Jun. 16, 2000 | 09/594,595 |
| 80132.008 | Jun. 18, 1999 | 60/139,456 |
| 00033.003 | Jun. 9, 2000 | 09/592,459 |
| 00033.001 | Jun. 10, 1999 | 60/138,540 |
| 00033.002 | Jun. 10, 1999 | 60/138,847 |
| 80132.021 | Jun. 16, 2000 | 09/594,597 |
| 80132.009 | Jun. 18, 1999 | 60/139,463 |
| 80132.022 | Jun. 16, 2000 | 09/595,298 |
| 80132.010 | Jun. 18, 1999 | 60/139,455 |
| 00034.002 | Jun. 14, 2000 | 09/593,710 |
| 00034.001 | Jun. 14, 1999 | 60/139,119 |
| 00045.002 | Jun. 23, 2000 | 09/602,016 |
| 00045.001 | Jun. 24, 1999 | 60/140,695 |
| 00048.002 | Jun. 29, 2000 | 09/606,181 |
| 00048.001 | Jun. 29, 1999 | 60/140,991 |
| 00050.002 | Jun. 30, 2000 | 09/607,081 |
| 00050.001 | Jul. 1, 1999 | 60/141,842 |
| 00051.002 | Jun. 30, 2000 | 09/610,157 |
| 00051.001 | Jul. 1, 1999 | 60/142,154 |
| 00052.002 | Jun. 30, 2000 | 09/609,198 |
| 00052.001 | Jul. 2, 1999 | 60/142,055 |
| 00053.002 | Jul. 6, 2000 | 09/611,409 |
| 00053.001 | Jul. 6, 1999 | 60/142,390 |
| 00054.002 | Jul. 7, 2000 | 09/612,645 |
| 00054.001 | Jul. 8, 1999 | 60/142,803 |
| 00058.002 | Jul. 7, 2000 | 09/613,547 |
| 00058.001 | Jul. 9, 1999 | 60/142,920 |
| 80134.016 | Jul. 21, 2000 | 09/620,393 |
| 80134.002 | Jul. 21, 1999 | 60/145,086 |
| 80134.018 | Jul. 14, 2000 | 09/614,450 |
| 80134.004 | Jul. 16, 1999 | 60/144,085 |
| 80134.014 | Jul. 19, 1999 | 60/144,334 |
| 80135.003 | Jul. 21, 2000 | 09/621,900 |
| 80135.001 | Jul. 23, 1999 | 60/145,224 |
| 80135.004 | Jul. 20, 2000 | 09/620,978 |
| 80135.002 | Jul. 20, 1999 | 60/144,884 |
| 80136.004 | Jul. 27, 2000 | 09/628,984 |
| 80136.001 | Jul. 27, 1999 | 60/145,918 |
| 80136.003 | Aug. 5, 1999 | 60/147,192 |
| 80136.005 | Jul. 27, 2000 | 09/628,987 |
| 80136.002 | Jul. 27, 1999 | 60/145,919 |

-continued

| Client No | Filing Date | application Ser. No | |
|---|---|---|---|
| 80137.003 | Aug. 2, 2000 | 09/628,985 | |
| 80137.001 | Aug. 2, 1999 | 60/146,388 | |

T. Number 25

Application Ser. No. 10/216,621 listed above is a continuation of U.S. application Ser. No. 09/940,257 filed Aug. 24, 2001. Application Ser. No. 09/940,247 is a continuation-in-part of the following 821 applications:

| | Client No. | Filing Date | application Ser. No. | |
|---|---|---|---|---|
| 1. | 80001.006 | 3 Sep. 1999 | 09/391,631 | which claims priority to |
| 2. | 80001.001 | 4 Sep. 1998 | 60/099,671 | and |
| 3. | 80002.001 | 4 Sep. 1998 | 60/099,672 | and |
| 4. | 80003.001 | 11 Sep. 1998 | 60/099,933 | and |
| 5. | 80004.001 | 17 Sep. 1998 | 60/100,864 | and |
| 6. | 80005.001 | 18 Sep. 1998 | 60/101,042 | and |
| 7. | 80007.001 | 24 Sep. 1998 | 60/101,682 | and |
| 8. | 80008.001 | 30 Sep. 1998 | 60/102,533 | and |
| 9. | 80009.001 | 30 Sep. 1998 | 60/102,460 | and |
| 10. | 80010.001 | 5 Oct. 1998 | 60/103,116 | and |
| 11. | 80011.001 | 5 Oct. 1998 | 60/103,141 | and |
| 12. | 80014.001 | 9 Oct. 1998 | 60/103,574 | and |
| 13. | 80015.001 | 13 Oct. 1998 | 60/103,907 | and |
| 14. | 80024.001 | 29 Oct. 1998 | 60/106,105 | and |
| 15. | 80025.001 | 30 Oct. 1998 | 60/106,218 | and |
| 16. | 80027.001 | 6 Nov. 1998 | 60/107,282 | and |
| 17. | 80030.001 | 10 Nov. 1998 | 60/107,836 | and |
| 18. | 80032.001 | 16 Nov. 1998 | 60/108,526 | and |
| 19. | 80033.001 | 17 Nov. 1998 | 60/108,901 | and |
| 20. | 80036.001 | 20 Nov. 1998 | 60/109,267 | and |
| 21. | 80037.001 | 23 Nov. 1998 | 60/109,594 | and |
| 22. | 80041.001 | 30 Nov. 1998 | 60/110,263 | and |
| 23. | 80042.001 | 1 Dec. 1998 | 60/110,495 | and |
| 24. | 80043.001 | 2 Dec. 1998 | 60/110,626 | and |
| 25. | 80044.001 | 3 Dec. 1998 | 60/110,701 | and |
| 26. | 80045.001 | 7 Dec. 1998 | 60/111,339 | and |
| 27. | 80046.001 | 9 Dec. 1998 | 60/111,589 | and |
| 28. | 80049.001 | 14 Dec. 1998 | 60/112,096 | and |
| 29. | 80050.001 | 15 Dec. 1998 | 60/112,224 | and |
| 30. | 80051.001 | 16 Dec. 1998 | 60/112,624 | and |
| 31. | 80052.001 | 17 Dec. 1998 | 60/112,862 | and |
| 32. | 80063.001 | 7 Jan. 1999 | 60/115,152 | and |
| 33. | 80066.001 | 7 Jan. 1999 | 60/115,156 | and |
| 34. | 80069.001 | 8 Jan. 1999 | 60/115,365 | and |
| 35. | 80071.001 | 11 Jan. 1999 | 60/115,339 | and |
| 36. | 80073.001 | 13 Jan. 1999 | 60/115,847 | and |
| 37. | 80079.001 | 21 Jan. 1999 | 60/116,674 | and |
| 38. | 80082.001 | 22 Jan. 1999 | 60/116,962 | and |
| 39. | 80094.001 | 18 Feb. 1999 | 60/120,583 | and |
| 40. | 80095.001 | 22 Feb. 1999 | 60/121,072 | and |
| 41. | 80101.001 | 2 Mar. 1999 | 60/122,568 | and |
| 42. | 80111.001 | 12 Mar. 1999 | 60/123,941 | |
| 43. | 80010.002 | 5 Oct. 1999 | 09/413,198 | which claims priority to |
| 44. | 80010.001 | 5 Oct. 1998 | 60/103,116 | and |
| 45. | 80011.001 | 5 Oct. 1998 | 60/103,141 | and |
| 46. | 80012.001 | 6 Oct. 1998 | 60/103,215 | and |
| 47. | 80013.001 | 8 Oct. 1998 | 60/103,554 | and |
| 48. | 80014.001 | 9 Oct. 1998 | 60/103,574 | and |
| 49. | 80015.001 | 13 Oct. 1998 | 60/103,907 | and |
| 50. | 80016.001 | 14 Oct. 1998 | 60/104,268 | and |
| 51. | 80017.001 | 16 Oct. 1998 | 60/104,680 | and |
| 52. | 80018.001 | 19 Oct. 1998 | 60/104,828 | and |
| 53. | 80019.001 | 20 Oct. 1998 | 60/105,008 | and |
| 54. | 80020.001 | 21 Oct. 1998 | 60/105,142 | and |
| 55. | 80021.001 | 22 Oct. 1998 | 60/105,533 | and |
| 56. | 80022.001 | 26 Oct. 1998 | 60/105,571 | and |
| 57. | 80023.001 | 27 Oct. 1998 | 60/105,815 | and |
| 58. | 80024.001 | 29 Oct. 1998 | 60/106,105 | and |
| 59. | 80025.001 | 30 Oct. 1998 | 60/106,218 | |
| 60. | 80010.003 | 5 Oct. 1999 | 09/412,922 | which claims priority to |
| 61. | 80010.001 | 5 Oct. 1998 | 60/103,116 | and |
| 62. | 80011.001 | 5 Oct. 1998 | 60/103,141 | and |
| 63. | 80012.001 | 6 Oct. 1998 | 60/103,215 | and |
| 64. | 80013.001 | 8 Oct. 1998 | 60/103,554 | and |
| 65. | 80014.001 | 9 Oct. 1998 | 60/103,574 | and |
| 66. | 80015.001 | 13 Oct. 1998 | 60/103,907 | and |
| 67. | 80016.001 | 14 Oct. 1998 | 60/104,268 | and |
| 68. | 80017.001 | 16 Oct. 1998 | 60/104,680 | and |
| 69. | 80018.001 | 19 Oct. 1998 | 60/104,828 | and |
| 70. | 80019.001 | 20 Oct. 1998 | 60/105,008 | and |
| 71. | 80020.001 | 21 Oct. 1998 | 60/105,142 | and |
| 72. | 80021.001 | 22 Oct. 1998 | 60/105,533 | and |
| 73. | 80022.001 | 26 Oct. 1998 | 60/105,571 | and |
| 74. | 80023.001 | 27 Oct. 1998 | 60/105,815 | and |
| 75. | 80024.001 | 29 Oct. 1998 | 60/106,105 | and |
| 76. | 80025.001 | 30 Oct. 1998 | 60/106,218 | and |
| 77. | 80026.001 | 2 Nov. 1998 | 60/106,685 | and |
| 78. | 80027.001 | 6 Nov. 1998 | 60/107,282 | and |
| 79. | 80028.001 | 9 Nov. 1998 | 60/107,720 | and |
| 80. | 80029.001 | 9 Nov. 1998 | 60/107,719 | and |
| 81. | 80030.001 | 10 Nov. 1998 | 60/107,836 | and |
| 82. | 80031.001 | 12 Nov. 1998 | 60/108,190 | and |
| 83. | 80032.001 | 16 Nov. 1998 | 60/108,526 | and |
| 84. | 80033.001 | 17 Nov. 1998 | 60/108,901 | and |
| 85. | 80034.001 | 19 Nov. 1998 | 60/109,124 | and |
| 86. | 80035.001 | 19 Nov. 1998 | 60/109,127 | and |
| 87. | 80036.001 | 20 Nov. 1998 | 60/109,267 | and |
| 88. | 80037.001 | 23 Nov. 1998 | 60/109,594 | and |
| 89. | 80038.001 | 25 Nov. 1998 | 60/110,053 | and |
| 90. | 80039.001 | 25 Nov. 1998 | 60/110,050 | and |
| 91. | 80040.001 | 27 Nov. 1998 | 60/110,158 | and |
| 92. | 80041.001 | 30 Nov. 1998 | 60/110,263 | and |
| 93. | 80042.001 | 1 Dec. 1998 | 60/110,495 | and |
| 94. | 80043.001 | 2 Dec. 1998 | 60/110,626 | and |
| 95. | 80044.001 | 3 Dec. 1998 | 60/110,701 | and |
| 96. | 80045.001 | 7 Dec. 1998 | 60/111,339 | and |
| 97. | 80046.001 | 9 Dec. 1998 | 60/111,589 | and |
| 98. | 80047.001 | 10 Dec. 1998 | 60/111,782 | and |
| 99. | 80048.001 | 11 Dec. 1998 | 60/111,812 | and |
| 100. | 80049.001 | 14 Dec. 1998 | 60/112,096 | and |
| 101. | 80050.001 | 15 Dec. 1998 | 60/112,224 | and |
| 102. | 80051.001 | 16 Dec. 1998 | 60/112,624 | and |
| 103. | 80052.001 | 17 Dec. 1998 | 60/112,862 | and |
| 104. | 80053.001 | 18 Dec. 1998 | 60/112,912 | and |
| 105. | 80054.001 | 21 Dec. 1998 | 60/113,248 | and |
| 106. | 80055.001 | 22 Dec. 1998 | 60/113,522 | and |
| 107. | 80056.001 | 23 Dec. 1998 | 60/113,826 | and |
| 108. | 80057.001 | 28 Dec. 1998 | 60/113,998 | and |
| 109. | 80058.001 | 29 Dec. 1998 | 60/114,384 | and |
| 110. | 80059.001 | 30 Dec. 1998 | 60/114,455 | and |
| 111. | 80060.001 | 4 Jan. 1999 | 60/114,740 | and |
| 112. | 80061.001 | 6 Jan. 1999 | 60/114,866 | and |
| 113. | 80062.001 | 7 Jan. 1999 | 60/115,153 | and |
| 114. | 80063.001 | 7 Jan. 1999 | 60/115,152 | and |
| 115. | 80064.001 | 7 Jan. 1999 | 60/115,151 | and |
| 116. | 80065.001 | 7 Jan. 1999 | 60/115,155 | and |
| 117. | 80066.001 | 7 Jan. 1999 | 60/115,156 | and |
| 118. | 80067.001 | 7 Jan. 1999 | 60/115,154 | and |
| 119. | 80068.001 | 8 Jan. 1999 | 60/115,364 | and |
| 120. | 80069.001 | 8 Jan. 1999 | 60/115,365 | and |
| 121. | 80071.001 | 11 Jan. 1999 | 60/115,339 | and |
| 122. | 80072.001 | 12 Jan. 1999 | 60/115,518 | and |
| 123. | 80073.001 | 13 Jan. 1999 | 60/115,847 | and |
| 124. | 80074.001 | 14 Jan. 1999 | 60/115,905 | and |
| 125. | 80075.001 | 15 Jan. 1999 | 60/116,383 | and |
| 126. | 80076.001 | 15 Jan. 1999 | 60/116,384 | and |
| 127. | 80077.001 | 19 Jan. 1999 | 60/116,329 | and |
| 128. | 80078.001 | 19 Jan. 1999 | 60/116,340 | and |
| 129. | 80079.001 | 21 Jan. 1999 | 60/116,674 | and |
| 130. | 80080.001 | 21 Jan. 1999 | 60/116,672 | and |
| 131. | 80081.001 | 22 Jan. 1999 | 60/116,960 | and |
| 132. | 80082.001 | 22 Jan. 1999 | 60/116,962 | and |
| 133. | 80083.001 | 28 Jan. 1999 | 60/117,756 | and |
| 134. | 80084.001 | 3 Feb. 1999 | 60/118,672 | and |
| 135. | 80085.001 | 4 Feb. 1999 | 60/118,808 | and |

-continued

| | Client No. | Filing Date | application Ser. No. | |
|---|---|---|---|---|
| 136. | 80086.001 | 5 Feb. 1999 | 60/118,778 | and |
| 137. | 80087.001 | 8 Feb. 1999 | 60/119,029 | and |
| 138. | 80088.001 | 9 Feb. 1999 | 60/119,332 | and |
| 139. | 80089.001 | 10 Feb. 1999 | 60/119,462 | and |
| 140. | 80091.001 | 12 Feb. 1999 | 60/119,922 | and |
| 141. | 80092.001 | 16 Feb. 1999 | 60/120,196 | and |
| 142. | 80093.001 | 16 Feb. 1999 | 60/120,198 | and |
| 143. | 80094.001 | 18 Feb. 1999 | 60/120,583 | and |
| 144. | 80095.001 | 22 Feb. 1999 | 60/121,072 | and |
| 145. | 80096.001 | 23 Feb. 1999 | 60/121,334 | and |
| 146. | 80097.001 | 24 Feb. 1999 | 60/121,470 | and |
| 147. | 80098.001 | 25 Feb. 1999 | 60/121,704 | and |
| 148. | 80099.001 | 26 Feb. 1999 | 60/122,107 | and |
| 149. | 80100.001 | 1 Mar. 1999 | 60/122,266 | and |
| 150. | 80101.001 | 2 Mar. 1999 | 60/122,568 | and |
| 151. | 80102.001 | 3 Mar. 1999 | 60/122,611 | and |
| 152. | 80103.001 | 4 Mar. 1999 | 60/121,775 | and |
| 153. | 80104.001 | 5 Mar. 1999 | 60/123,534 | and |
| 154. | 80106.001 | 9 Mar. 1999 | 60/123,680 | and |
| 155. | 80108.001 | 10 Mar. 1999 | 60/123,715 | and |
| 156. | 80109.001 | 10 Mar. 1999 | 60/123,726 | and |
| 157. | 80110.001 | 11 Mar. 1999 | 60/124,263 | and |
| 158. | 80111.001 | 12 Mar. 1999 | 60/123,941 | |
| 159. | 80026.002 | 28 Oct. 1999 | 09/428,944 | which claims priority to |
| 160. | 80026.001 | 2 Nov. 1998 | 60/106,685 | and |
| 161. | 80027.001 | 6 Nov. 1998 | 60/107,282 | and |
| 162. | 80028.001 | 9 Nov. 1998 | 60/107,720 | and |
| 163. | 80029.001 | 9 Nov. 1998 | 60/107,719 | and |
| 164. | 80030.001 | 10 Nov. 1998 | 60/107,836 | and |
| 165. | 80031.001 | 12 Nov. 1998 | 60/108,190 | and |
| 166. | 80032.001 | 16 Nov. 1998 | 60/108,526 | and |
| 167. | 80033.001 | 17 Nov. 1998 | 60/108,901 | and |
| 168. | 80034.001 | 19 Nov. 1998 | 60/109,124 | and |
| 169. | 80035.001 | 19 Nov. 1998 | 60/109,127 | and |
| 170. | 80036.001 | 20 Nov. 1998 | 60/109,267 | and |
| 171. | 80037.001 | 23 Nov. 1998 | 60/109,594 | and |
| 172. | 80038.001 | 25 Nov. 1998 | 60/110,053 | and |
| 173. | 80039.001 | 25 Nov. 1998 | 60/110,050 | and |
| 174. | 80040.001 | 27 Nov. 1998 | 60/110,158 | and |
| 175. | 80041.001 | 30 Nov. 1998 | 60/110,263 | |
| 176. | 80042.002 | 1 Dec. 1999 | 09/451,320 | which claims priority to |
| 177. | 80042.001 | 1 Dec. 1998 | 60/110,495 | and |
| 178. | 80043.001 | 2 Dec. 1998 | 60/110,626 | and |
| 179. | 80044.001 | 3 Dec. 1998 | 60/110,701 | and |
| 180. | 80045.001 | 7 Dec. 1998 | 60/111,339 | and |
| 181. | 80046.001 | 9 Dec. 1998 | 60/111,589 | and |
| 182. | 80047.001 | 10 Dec. 1998 | 60/111,782 | and |
| 183. | 80048.001 | 11 Dec. 1998 | 60/111,812 | and |
| 184. | 80049.001 | 14 Dec. 1998 | 60/112,096 | and |
| 185. | 80050.001 | 15 Dec. 1998 | 60/112,224 | and |
| 186. | 80051.001 | 16 Dec. 1998 | 60/112,624 | and |
| 187. | 80052.001 | 17 Dec. 1998 | 60/112,862 | and |
| 188. | 80053.001 | 18 Dec. 1998 | 60/112,912 | and |
| 189. | 80054.001 | 21 Dec. 1998 | 60/113,248 | and |
| 190. | 80055.001 | 22 Dec. 1998 | 60/113,522 | and |
| 191. | 80056.001 | 23 Dec. 1998 | 60/113,826 | and |
| 192. | 80057.001 | 28 Dec. 1998 | 60/113,998 | and |
| 193. | 80058.001 | 29 Dec. 1998 | 60/114,384 | and |
| 194. | 80059.001 | 30 Dec. 1998 | 60/114,455 | and |
| 195. | 80062.001 | 7 Jan. 1999 | 60/115,153 | and |
| 196. | 80063.001 | 7 Jan. 1999 | 60/115,152 | and |
| 197. | 80064.001 | 7 Jan. 1999 | 60/115,151 | and |
| 198. | 80065.001 | 7 Jan. 1999 | 60/115,155 | and |
| 199. | 80066.001 | 7 Jan. 1999 | 60/115,156 | and |
| 200. | 80068.001 | 8 Jan. 1999 | 60/115,364 | and |
| 201. | 80081.001 | 22 Jan. 1999 | 60/116,960 | |
| 202. | 80084.002 | 3 Feb. 2000 | 09/497,191 | which claims priority to |
| 203. | 80084.001 | 3 Feb. 1999 | 60/118,672 | and |
| 204. | 80085.001 | 4 Feb. 1999 | 60/118,808 | and |
| 205. | 80086.001 | 5 Feb. 1999 | 60/118,778 | and |
| 206. | 80087.001 | 8 Feb. 1999 | 60/119,029 | and |
| 207. | 80088.001 | 9 Feb. 1999 | 60/119,332 | and |
| 208. | 80089.001 | 10 Feb. 1999 | 60/119,462 | and |
| 209. | 80091.001 | 12 Feb. 1999 | 60/119,922 | and |
| 210. | 80092.001 | 16 Feb. 1999 | 60/120,196 | and |
| 211. | 80093.001 | 16 Feb. 1999 | 60/120,198 | and |
| 212. | 80094.001 | 18 Feb. 1999 | 60/120,583 | and |
| 213. | 80095.001 | 22 Feb. 1999 | 60/121,072 | and |
| 214. | 80096.001 | 23 Feb. 1999 | 60/121,334 | and |
| 215. | 80097.001 | 24 Feb. 1999 | 60/121,470 | and |
| 216. | 80098.001 | 25 Feb. 1999 | 60/121,704 | and |
| 217. | 80099.001 | 26 Feb. 1999 | 60/122,107 | |
| 218. | 80100.002 | 1 Mar. 2000 | 09/517,537 | which claims priority to |
| 219. | 80100.001 | 1 Mar. 1999 | 60/122,266 | and |
| 220. | 80101.001 | 2 Mar. 1999 | 60/122,568 | and |
| 221. | 80102.001 | 3 Mar. 1999 | 60/122,611 | and |
| 222. | 80103.001 | 4 Mar. 1999 | 60/121,775 | and |
| 223. | 80104.001 | 5 Mar. 1999 | 60/123,534 | and |
| 224. | 80106.001 | 9 Mar. 1999 | 60/123,680 | and |
| 225. | 80108.001 | 10 Mar. 1999 | 60/123,715 | and |
| 226. | 80109.001 | 10 Mar. 1999 | 60/123,726 | and |
| 227. | 80110.001 | 11 Mar. 1999 | 60/124,263 | and |
| 228. | 80111.001 | 12 Mar. 1999 | 60/123,941 | |
| 229. | 80141.006 | 11 Aug. 2000 | 09/637,565 | which claims priority to |
| 230. | 80141.002 | 12 Aug. 1999 | 60/148,342 | |
| 231. | 80141.007 | 11 Aug. 2000 | 09/637,564 | which claims priority to |
| 232. | 80141.003 | 12 Aug. 1999 | 60/148,340 | |
| 233. | 80141.008 | 11 Aug. 2000 | 09/637,792 | which claims priority to |
| 234. | 80141.004 | 12 Aug. 1999 | 60/148,337 | |
| 235. | 91022.002 | 23 Feb. 2001 | 09/790,663 | which claims priority to |
| 236. | 91022.001 | 25 Feb. 2000 | 60/185,140 | and |
| 237. | 91023.001 | 28 Feb. 2000 | 60/185,398 | and |
| 238. | 91024.001 | 29 Feb. 2000 | 60/185,750 | |
| 239. | 91025.002 | 1 Mar. 2001 | 09/795,359 | which claims priority to |
| 240. | 91025.001 | 1 Mar. 2000 | 60/186,277 | and |
| 241. | 91026.001 | 3 Mar. 2000 | 60/186,670 | and |
| 242. | 91027.001 | 7 Mar. 2000 | 60/187,379 | and |
| 243. | 91028.001 | 9 Mar. 2000 | 60/187,985 | and |
| 244. | 91030.001 | 10 Mar. 2000 | 60/188,174 | and |
| 245. | 91031.001 | 13 Mar. 2000 | 60/188,687 | and |
| 246. | 91032.001 | 15 Mar. 2000 | 60/189,460 | and |
| 247. | 91033.001 | 16 Mar. 2000 | 60/189,958 | and |
| 248. | 91034.001 | 17 Mar. 2000 | 60/189,965 | and |
| 249. | 91035.001 | 20 Mar. 2000 | 60/190,090 | and |
| 250. | 91036.001 | 23 Mar. 2000 | 60/191,549 | and |
| 251. | 91037.001 | 24 Mar. 2000 | 60/191,826 | and |
| 252. | 91038.001 | 27 Mar. 2000 | 60/192,420 | and |
| 253. | 91039.001 | 29 Mar. 2000 | 60/192,855 | and |
| 254. | 91040.001 | 30 Mar. 2000 | 60/193,243 | and |
| 255. | 91041.001 | 31 Mar. 2000 | 60/193,469 | |
| 256. | 80208.002 | 16 Mar. 2001 | 09/804,470 | which claims priority to |
| 257. | 80208.001 | 16 Mar. 2000 | 60/190,120 | and |
| 258. | 80209.001 | 16 Mar. 2000 | 60/189,947 | and |
| 259. | 80210.001 | 16 Mar. 2000 | 60/189,948 | and |
| 260. | 80211.001 | 16 Mar. 2000 | 60/190,121 | |
| 261. | 91042.002 | 4 Apr. 2001 | 09/824,790 | which claims priority to |
| 262. | 91045.001 | 6 Apr. 2000 | 60/194,884 | and |
| 263. | 91042.001 | 4 Apr. 2000 | 60/194,385 | and |
| 264. | 91043.001 | 5 Apr. 2000 | 60/194,682 | and |
| 265. | 91044.001 | 5 Apr. 2000 | 60/194,698 | and |
| 266. | 91046.001 | 7 Apr. 2000 | 60/195,258 | and |
| 267. | 91047.001 | 11 Apr. 2000 | 60/196,168 | and |
| 268. | 91048.001 | 12 Apr. 2000 | 60/196,483 | and |
| 269. | 91049.001 | 14 Apr. 2000 | 60/197,397 | and |
| 270. | 91050.001 | 17 Apr. 2000 | 60/198,268 | and |

| Client No. | Filing Date | application Ser. No. | |
|---|---|---|---|
| 271. 91051.001 | 19 Apr. 2000 | 60/198,400 | and |
| 272. 91052.001 | 20 Apr. 2000 | 60/198,629 | and |
| 273. 91053.001 | 21 Apr. 2000 | 60/198,765 | and |
| 274. 91054.001 | 24 Apr. 2000 | 60/199,123 | and |
| 275. 80227.003 | 11 Apr. 2001 | 09/832,192 | which claims priority to |
| 276. 80227.001 | 12 Apr. 2000 | 60/196,212 | and |
| 277. 80227.002 | 11 Apr. 2000 | 60/196,211 | and |
| 278. 80231.001 | 14 Apr. 2000 | 60/197,869 | and |
| 279. 80231.002 | 13 Apr. 2000 | 60/196,213 | and |
| 280. 80232.001 | 17 Apr. 2000 | 60/197,870 | and |
| 281. 80232.002 | 17 Apr. 2000 | 60/197,871 | and |
| 282. 80242.002 | 28 Apr. 2000 | 60/200,373 | and |
| 283. 80243.002 | 28 Apr. 2000 | 60/200,773 | and |
| 284. 92001.005 | 26 Apr. 2001 | 09/842,246 | which claims priority to |
| 285. 92001.001 | 26 Apr. 2000 | 60/200,034 | |
| 286. 80242.003 | 1 May 2001 | 09/845,208 | which claims priority to |
| 287. 80242.001 | 1 May 2000 | 60/200,763 | and |
| 288. 80243.001 | 1 May 2000 | 60/201,016 | and |
| 289. 80244.001 | 1 May 2000 | 60/200,762 | and |
| 290. 80244.002 | 1 May 2000 | 60/200,761 | and |
| 291. 80250.001 | 11 May 2000 | 60/203,671 | and |
| 292. 80250.002 | 11 May 2000 | 60/203,672 | and |
| 293. 80251.001 | 11 May 2000 | 60/203,669 | and |
| 294. 80251.002 | 11 May 2000 | 60/203,622 | |
| 295. 92002.006 | 1 May 2001 | 09/845,318 | which claims priority to |
| 296. 92002.002 | 1 May 2000 | 60/201,018 | and |
| 297. 92002.003 | 17 May 2000 | 60/205,325 | |
| 298. 92001.006 | 1 May 2001 | 09/845,209 | which claims priority to |
| 299. 92001.002 | 1 May 2000 | 60/201,017 | and |
| 300. 92001.003 | 17 May 2000 | 60/205,233 | |
| 301. 80267.004 | 1 Jun. 2001 | 09/870,646 | which claims priority to |
| 302. 80267.002 | 1 Jun. 2000 | 60/208,648 | |
| 303. 91068.002 | 1 Jun. 2001 | 09/870,476 | which claims priority to |
| 304. 91068.001 | 1 Jun. 2000 | 60/208,324 | and |
| 305. 91069.001 | 5 Jun. 2000 | 60/208,919 | and |
| 306. 91070.001 | 5 Jun. 2000 | 60/208,917 | and |
| 307. 91071.001 | 8 Jun. 2000 | 60/210,008 | |
| 308. 80268.002 | 1 Jun. 2001 | 09/870,664 | which claims priority to |
| 309. 80268.001 | 1 Jun. 2000 | 60/208,312 | and |
| 310. 80269.001 | 5 Jun. 2000 | 60/208,918 | and |
| 311. 80270.001 | 5 Jun. 2000 | 60/208,920 | and |
| 312. 80271.001 | 8 Jun. 2000 | 60/210,006 | and |
| 313. 80272.001 | 9 Jun. 2000 | 60/210,564 | and |
| 314. 80273.001 | 13 Jun. 2000 | 60/211,214 | and |
| 315. 80277.001 | 22 Jun. 2000 | 60/213,249 | and |
| 316. 80280.001 | 27 Jun. 2000 | 60/214,535 | and |
| 317. 80281.001 | 28 Jun. 2000 | 60/214,799 | and |
| 318. 80282.001 | 30 Jun. 2000 | 60/215,127 | |
| 319. 91072.002 | 13 Jun. 2001 | 09/878,974 | which claims priority to |
| 320. 91072.001 | 13 Jun. 2000 | 60/211,210 | and |
| 321. 00238.001 | 15 Jun. 2000 | 60/211,539 | and |
| 322. 00239.001 | 19 Jun. 2000 | 60/212,414 | and |
| 323. 00240.001 | 20 Jun. 2000 | 60/212,677 | and |
| 324. 80276.001 | 20 Jun. 2000 | 60/212,713 | and |
| 325. 91077.001 | 22 Jun. 2000 | 60/213,195 | and |
| 326. 00246.001 | 22 Jun. 2000 | 60/213,221 | and |
| 327. 00247.001 | 27 Jun. 2000 | 60/214,760 | and |
| 328. 80286.003 | 12 Jul. 2001 | 09/902,613 | which claims priority to |
| 329. 80299.002 | 1 Aug. 2000 | 60/223,114 | |
| 330. 80288.003 | 13 Jul. 2001 | 09/903,497 | which claims priority to and |
| 331. 80288.002 | 13 Jul. 2000 | 60/217,846 | |
| 332. 80299.004 | 3 Aug. 2000 | 60/223,099 | |
| 333. 80286.004 | 1 Aug. 2001 | 09/918,556 | which claims priority to |
| 334. 80286.001 | 1 Aug. 2000 | 60/223,115 | |
| 335. 80288.004 | 3 Aug. 2001 | 09/920,626 | which claims priority to |
| 336. 80288.001 | 3 Aug. 2000 | 60/223,100 | and |
| 337. 80294.001 | 18 Aug. 2000 | 60/226,325 | and |
| 338. 80304.001 | 31 Aug. 2000 | 60/237,361 | |
| 339. 80285.004 | 7 Aug. 2001 | 09/922,661 | which claims priority to |
| 340. 80285.001 | 7 Aug. 2000 | 60/223,329 | and |
| 341. 80302.001 | 31 Aug. 2000 | 60/229,521 | and |
| 342. 80295.001 | 18 Aug. 2000 | 60/226,381 | |
| 343. 92001.007 | 9 Aug. 2001 | 09/924,702 | which claims priority to |
| 344. 92001.004 | 9 Aug. 2000 | 60/224,390 | |
| 345. 80295.003 | 16 Aug. 2001 | 09/930,244 | which claims priority to |
| 346. 80302.002 | 31 Aug. 2000 | 60/237,362 | and |
| 347. 80295.002 | 16 Aug. 2000 | 60/225,848 | |
| 348. 80294.003 | 16 Aug. 2001 | 09/930,231 | which claims priority to |
| 349. 80294.002 | 16 Aug. 2000 | 60/225,849 | |
| 350. 80297.004 | 16 Aug. 2001 | 09/930,223 | which claims priority to |
| 351. 80297.002 | 16 Aug. 2000 | 60/225,847 | |
| 352. 80303.003 | 20 Aug. 2001 | 09/931,911 | which claims priority to |
| 353. 80303.002 | 31 Aug. 2000 | 60/229,520 | |
| 354. 00170.003 | 26 Feb. 2002 | 10/082,096 | which is a 1.53(b) continuation of |
| 355. 00170.002 | 1 Mar. 2001 | 09/795,347 | which claims priority to |
| 356. 00171.001 | 2 Mar. 2000 | 60/186,390 | and |
| 357. 00170.001 | 1 Mar. 2000 | 60/186,283 | and |
| 358. 80199.001 | 1 Mar. 2000 | 60/186,296 | and |
| 359. 80200.001 | 2 Mar. 2000 | 60/187,178 | and |
| 360. 00172.001 | 2 Mar. 2000 | 60/186,386 | and |
| 361. 80201.001 | 2 Mar. 2000 | 60/186,387 | and |
| 362. 00173.001 | 3 Mar. 2000 | 60/186,748 | and |
| 363. 80202.001 | 3 Mar. 2000 | 60/186,669 | and |
| 364. 00174.001 | 7 Mar. 2000 | 60/187,378 | and |
| 365. 00175.001 | 8 Mar. 2000 | 60/187,896 | and |
| 366. 80203.001 | 8 Mar. 2000 | 60/187,888 | and |
| 367. 00177.001 | 10 Mar. 2000 | 60/188,187 | and |
| 368. 80204.001 | 10 Mar. 2000 | 60/188,186 | and |
| 369. 00178.001 | 10 Mar. 2000 | 60/188,185 | and |
| 370. 80205.001 | 10 Mar. 2000 | 60/188,175 | and |
| 371. 00179.001 | 14 Mar. 2000 | 60/189,080 | and |
| 372. 80206.001 | 14 Mar. 2000 | 60/189,052 | and |
| 373. 00180.001 | 15 Mar. 2000 | 60/189,461 | and |
| 374. 80207.001 | 15 Mar. 2000 | 60/189,462 | and |
| 375. 00181.001 | 16 Mar. 2000 | 60/189,953 | and |
| 376. 80212.001 | 16 Mar. 2000 | 60/189,959 | and |
| 377. 00182.001 | 20 Mar. 2000 | 60/190,069 | and |
| 378. 80213.001 | 20 Mar. 2000 | 60/190,070 | and |
| 379. 00183.001 | 20 Mar. 2000 | 60/190,545 | and |
| 380. 80214.001 | 20 Mar. 2000 | 60/190,089 | and |
| 381. 00184.001 | 22 Mar. 2000 | 60/191,084 | and |
| 382. 80215.001 | 22 Mar. 2000 | 60/191,097 | and |
| 383. 00185.001 | 23 Mar. 2000 | 60/191,543 | and |
| 384. 80216.001 | 23 Mar. 2000 | 60/191,545 | and |
| 385. 00186.001 | 24 Mar. 2000 | 60/191,823 | and |

| | Client No. | Filing Date | application Ser. No. | |
|---|---|---|---|---|
| 386. | 80217.001 | 24 Mar. 2000 | 60/191,825 | and |
| 387. | 00187.001 | 27 Mar. 2000 | 60/192,421 | and |
| 388. | 80218.001 | 27 Mar. 2000 | 60/192,308 | and |
| 389. | 00188.001 | 29 Mar. 2000 | 60/192,940 | and |
| 390. | 80219.001 | 29 Mar. 2000 | 60/192,941 | and |
| 391. | 00189.001 | 30 Mar. 2000 | 60/193,244 | and |
| 392. | 80220.001 | 30 Mar. 2000 | 60/193,245 | and |
| 393. | 00190.001 | 31 Mar. 2000 | 60/193,453 | and |
| 394. | 80221.001 | 31 Mar. 2000 | 60/193,455 | |
| 395. | 92002.008 | 28 Feb. 2002 | 10/084,376 | which is a 1.53(b) continuation of |
| 396. | 92002.007 | 9 Aug. 2001 | 09/924,701 | which claims priority to |
| 397. | 92002.004 | 9 Aug. 2000 | 60/224,391 | |
| 398. | 00211.003 | 4 Mar. 2002 | 10/086,239 | which is a 1.53(b) continuation of |
| 399. | 00211.002 | 1 May 2001 | 09/845,206 | which claims priority to |
| 400. | 00211.001 | 2 May 2000 | 60/201,275 | and |
| 401. | 80241.001 | 1 May 2000 | 60/200,879 | and |
| 402. | 80245.001 | 2 May 2000 | 60/201,305 | and |
| 403. | 00212.001 | 4 May 2000 | 60/201,740 | and |
| 404. | 80246.001 | 4 May 2000 | 60/201,750 | and |
| 405. | 00213.001 | 5 May 2000 | 60/202,112 | and |
| 406. | 80247.001 | 5 May 2000 | 60/202,180 | and |
| 407. | 00214.001 | 9 May 2000 | 60/202,914 | and |
| 408. | 80248.001 | 9 May 2000 | 60/202,636 | and |
| 409. | 00215.001 | 9 May 2000 | 60/202,919 | and |
| 410. | 80249.001 | 9 May 2000 | 60/202,634 | and |
| 411. | 00216.001 | 10 May 2000 | 60/202,968 | and |
| 412. | 80252.001 | 10 May 2000 | 60/202,963 | and |
| 413. | 00217.001 | 11 May 2000 | 60/203,457 | and |
| 414. | 80253.001 | 11 May 2000 | 60/203,279 | and |
| 415. | 00219.001 | 12 May 2000 | 60/203,916 | and |
| 416. | 80254.001 | 12 May 2000 | 60/203,915 | and |
| 417. | 00220.001 | 15 May 2000 | 60/204,388 | and |
| 418. | 80255.001 | 15 May 2000 | 60/204,122 | and |
| 419. | 00221.001 | 16 May 2000 | 60/204,568 | and |
| 420. | 80256.001 | 16 May 2000 | 60/204,569 | and |
| 421. | 00222.001 | 17 May 2000 | 60/204,830 | and |
| 422. | 80257.001 | 17 May 2000 | 60/204,829 | and |
| 423. | 00223.001 | 18 May 2000 | 60/205,201 | and |
| 424. | 80258.001 | 18 May 2000 | 60/205,058 | and |
| 425. | 00224.001 | 19 May 2000 | 60/205,242 | and |
| 426. | 80259.001 | 19 May 2000 | 60/205,243 | and |
| 427. | 00225.001 | 22 May 2000 | 60/205,572 | and |
| 428. | 80260.001 | 22 May 2000 | 60/205,576 | and |
| 429. | 00226.001 | 23 May 2000 | 60/206,316 | and |
| 430. | 80261.001 | 23 May 2000 | 60/206,319 | and |
| 431. | 00227.001 | 24 May 2000 | 60/206,553 | and |
| 432. | 80262.001 | 24 May 2000 | 60/206,545 | and |
| 433. | 00228.001 | 26 May 2000 | 60/207,367 | and |
| 434. | 80263.001 | 26 May 2000 | 60/207,243 | and |
| 435. | 00229.001 | 26 May 2000 | 60/207,239 | and |
| 436. | 80264.001 | 26 May 2000 | 60/207,354 | and |
| 437. | 00230.001 | 30 May 2000 | 60/207,452 | and |
| 438. | 80265.001 | 30 May 2000 | 60/207,329 | |
| 439. | 92002.009 | 7 Mar. 2002 | 10/091,527 | which is a 1.53(b) continuation of |
| 440. | 92002.005 | 26 Apr. 2001 | 09/842,088 | which claims priority to |
| 441. | 92002.001 | 26 Apr. 2000 | 60/200,031 | |
| 442. | 00191.003 | 13 Mar. 2002 | 10/095,465 | which is a 1.53(b) continuation of |
| 443. | 00191.002 | 4 Apr. 2001 | 09/824,882 | which claims priority to |
| 444. | 00191.001 | 4 Apr. 2000 | 60/194,404 | and |
| 445. | 80222.001 | 4 Apr. 2000 | 60/194,398 | and |
| 446. | 00192.001 | 5 Apr. 2000 | 60/194,683 | and |
| 447. | 80223.001 | 5 Apr. 2000 | 60/194,697 | and |
| 448. | 00193.001 | 6 Apr. 2000 | 60/194,874 | and |
| 449. | 80224.001 | 6 Apr. 2000 | 60/194,872 | and |
| 450. | 00194.001 | 6 Apr. 2000 | 60/194,885 | and |
| 451. | 80225.001 | 6 Apr. 2000 | 60/195,045 | and |
| 452. | 00195.001 | 7 Apr. 2000 | 60/195,283 | and |
| 453. | 80226.001 | 7 Apr. 2000 | 60/195,257 | and |
| 454. | 00196.001 | 11 Apr. 2000 | 60/196,169 | and |
| 455. | 80228.001 | 11 Apr. 2000 | 60/196,089 | and |
| 456. | 00197.001 | 12 Apr. 2000 | 60/196,487 | and |
| 457. | 80229.001 | 12 Apr. 2000 | 60/196,289 | and |
| 458. | 00200.001 | 12 Apr. 2000 | 60/196,485 | and |
| 459. | 80230.001 | 12 Apr. 2000 | 60/196,486 | and |
| 460. | 00201.001 | 17 Apr. 2000 | 60/197,687 | and |
| 461. | 80233.001 | 17 Apr. 2000 | 60/197,678 | and |
| 462. | 00202.001 | 17 Apr. 2000 | 60/198,133 | and |
| 463. | 80234.001 | 17 Apr. 2000 | 60/197,671 | and |
| 464. | 00203.001 | 19 Apr. 2000 | 60/198,386 | and |
| 465. | 80235.001 | 19 Apr. 2000 | 60/198,373 | and |
| 466. | 00204.001 | 20 Apr. 2000 | 60/198,619 | and |
| 467. | 80236.001 | 20 Apr. 2000 | 60/198,623 | and |
| 468. | 00206.001 | 21 Apr. 2000 | 60/198,767 | and |
| 469. | 80237.001 | 21 Apr. 2000 | 60/198,763 | and |
| 470. | 00207.001 | 24 Apr. 2000 | 60/199,124 | and |
| 471. | 80238.001 | 24 Apr. 2000 | 60/199,122 | and |
| 472. | 00208.001 | 26 Apr. 2000 | 60/199,828 | and |
| 473. | 80239.001 | 26 Apr. 2000 | 60/199,818 | and |
| 474. | 00210.001 | 27 Apr. 2000 | 60/200,103 | and |
| 475. | 80240.001 | 27 Apr. 2000 | 60/200,102 | and |
| 476. | 80141.010 | 15 Mar. 2002 | 10/097,600 | which is a 1.53(b) continuation of |
| 477. | 80141.009 | 12 Apr. 2001 | 09/832,934 | which is a 1.53(b) continuation of |
| 478. | 80141.005 | 11 Aug. 2000 | 09/637,820 | which claims priority to |
| 479. | 80141.001 | 12 Aug. 1999 | 60/148,347 | |
| 480. | 91074.003 | 15 Mar. 2002 | 10/097,295 | which is a 1.53(b) continuation of |
| 481. | 91074.002 | 15 Jun. 2001 | 09/881,096 | which claims priority to |
| 482. | 91074.001 | 15 Jun. 2000 | 60/211,538 | and |
| 483. | 91075.001 | 19 Jun. 2000 | 60/212,623 | and |
| 484. | 91076.001 | 20 Jun. 2000 | 60/212,727 | and |
| 485. | 91079.001 | 22 Jun. 2000 | 60/213,270 | and |
| 486. | 91080.001 | 27 Jun. 2000 | 60/214,524 | |
| 487. | 80266.005 | 18 Mar. 2002 | | which is a 1.53(b) continuation of |
| 488. | 80266.004 | 1 Jun. 2001 | 09/870,699 | which claims priority to |
| 489. | 80266.002 | 1 Jun. 2000 | 60/208,421 | |
| 490. | 80266.006 | 18 Mar. 2002 | 10/098,506 | which is a 1.53(b) continuation of |
| 491. | 80266.003 | 1 Jun. 2001 | 09/870,713 | which claims priority to |
| 492. | 80266.001 | 2 Jun. 2000 | 60/209,338 | |
| 493. | 80283.003 | 25 Mar. 2002 | 10/103,845 | which is a 1.53(b) continuation of |

| Client No. | Filing Date | application Ser. No. | |
|---|---|---|---|
| 494. 80283.002 | 5 Jul. 2001 | 09/898,063 | which claims priority to |
| 495. 80283.001 | 5 Jul. 2000 | 60/216,362 | and |
| 496. 80284.001 | 11 Jul. 2000 | 60/217,384 | and |
| 497. 80291.001 | 18 Jul. 2000 | 60/219,033 | and |
| 498. 80292.001 | 25 Jul. 2000 | 60/220,811 | and |
| 499. 80293.001 | 25 Jul. 2000 | 60/220,652 | |
| 500. 00252.003 | 27 Mar. 2002 | 10/106,718 | which is a 1.53(b) continuation of |
| 501. 00252.002 | 5 Jul. 2001 | 09/898,064 | which claims priority to |
| 502. 00252.001 | 5 Jul. 2000 | 60/216,361 | and |
| 503. 00253.001 | 11 Jul. 2000 | 60/217,476 | and |
| 504. 00254.001 | 18 Jul. 2000 | 60/219,004 | and |
| 505. 00255.001 | 25 Jul. 2000 | 60/220,647 | and |
| 506. 00256.001 | 25 Jul. 2000 | 60/220,484 | |
| 507. 80287.005 | 1 Apr. 2002 | 10/109,638 | which is a 1.53(b) continuation of |
| 508. 80287.003 | 12 Jul. 2001 | 09/902,614 | which claims priority to |
| 509. 80287.002 | 12 Jul. 2000 | 60/218,548 | and |
| 510. 80299.003 | 3 Aug. 2000 | 60/223,116 | |
| 511. 80296.004 | 10 Apr. 2002 | 10/119,275 | which is a 1.53(b) continuation of |
| 512. 80296.003 | 16 Aug. 2001 | 09/930,214 | which claims priority to |
| 513. 80303.002 | 31 Aug. 2000 | 60/229,520 | and |
| 514. 80296.002 | 16 Aug. 2000 | 60/225,850 | |
| 515. 80287.005 | 17 Apr. 2002 | 10/123,117 | which is a 1.53(b) continuation of |
| 516. 80287.004 | 3 Aug. 2001 | 09/921,135 | which claims priority to |
| 517. 80287.001 | 3 Aug. 2000 | 60/223,101 | and |
| 518. 80303.001 | 31 Aug. 2000 | 60/229,519 | and |
| 519. 80296.001 | 18 Aug. 2000 | 60/226,323 | |
| 520. 91081.003 | 17 Apr. 2002 | 10/123,222 | which is a 1.53(b) continuation of |
| 521. 91081.002 | 11 Jul. 2001 | 09/902,093 | which claims priority to |
| 522. 91081.001 | 11 Jul. 2000 | 60/217,385 | and |
| 523. 91082.001 | 18 Jul. 2000 | 60/219,021 | and |
| 524. 91083.001 | 25 Jul. 2000 | 60/220,814 | and |
| 525. 91084.001 | 14 Aug. 2000 | 60/224,516 | and |
| 526. 91085.001 | 15 Aug. 2000 | 60/225,302 | and |
| 527. 91086.001 | 21 Aug. 2000 | 60/226,725 | and |
| 528. 91087.001 | 23 Aug. 2000 | 60/227,026 | and |
| 529. 91088.001 | 30 Aug. 2000 | 60/228,897 | |
| 530. 80285.005 | 17 Apr. 2002 | 10/123,159 | which is a 1.53(b) continuation of |
| 531. 80285.003 | 13 Jul. 2001 | 09/903,988 | which claims priority to |
| 532. 80285.002 | 14 Jul. 2000 | 60/218,566 | and |
| 533. 80299.001 | 3 Aug. 2000 | 60/223,098 | |
| 534. 80298.003 | 17 Apr. 2002 | 10/123,111 | which is a 1.53(b) continuation of |
| 535. 80298.002 | 14 Aug. 2001 | 09/928,372 | which claims priority to |
| 536. 80298.001 | 14 Aug. 2000 | 60/224,517 | and |
| 537. 80300.001 | 15 Aug. 2000 | 60/225,303 | and |
| 538. 80301.001 | 21 Aug. 2000 | 60/226,452 | and |
| 539. 80307.001 | 23 Aug. 2000 | 60/227,024 | and |
| 540. 80308.001 | 30 Aug. 2000 | 60/228,898 | |
| 541. 80297.005 | 18 Apr. 2002 | 10/124,666 | which is a 1.53(b) continuation of |
| 542. 80297.003 | 17 Aug. 2001 | 09/931,043 | which claims priority to |
| 543. 80297.001 | 18 Aug. 2000 | 60/226,324 | |
| 544. 80365.002 | 29 Apr. 2002 | 10/133,891 | which is a 1.53(b) continuation of |
| 545. 80365.001 | 31 Jan. 2001 | 09/774,340 | |
| 546. 80326.003 | 29 Apr. 2002 | 10/133,893 | which is a 1.53(b) continuation of |
| 547. 80326.001 | 19 Oct. 2000 | 09/691,039 | |
| 548. 710-0005-55300-U-00001.02 | 29 Apr. 2002 | | which is a 1.53(b) continuation of |
| 549. 710-0005-55300-U-00001.01 | 21 Dec. 2000 | 09/741,043 | |
| 550. 80328.003 | 29 Apr. 2002 | 10/133,373 | which is a 1.53(b) continuation of |
| 551. 80328.001 | 19 Oct. 2000 | 09/691,045 | |
| 552. 80330.003 | 29 Apr. 2002 | 10/133,905 | which is a 1.53(b) continuation of |
| 553. 80330.001 | 19 Oct. 2000 | 09/691,019 | |
| 554. 80267.005 | 29 Apr. 2002 | 10/133,376 | which is a 1.53(b) continuation of |
| 555. 80267.003 | 1 Jun. 2001 | 09/870,675 | which claims priority to |
| 556. 80267.001 | 2 Jun. 2000 | 60/208,649 | |
| 557. 80060.003 | 6 May 2002 | 10/138,320 | which is a 1.53(b) continuation of |
| 558. 80060.002 | 4 Jan. 2000 | 09/478,081 | which claims priority to |
| 559. 80060.001 | 4 Jan. 1999 | 60/114,740 | and |
| 560. 80061.001 | 6 Jan. 1999 | 60/114,866 | and |
| 561. 80067.001 | 7 Jan. 1999 | 60/115,154 | and |
| 562. 80069.001 | 8 Jan. 1999 | 60/115,365 | and |
| 563. 80071.001 | 11 Jan. 1999 | 60/115,339 | and |
| 564. 80072.001 | 12 Jan. 1999 | 60/115,518 | and |
| 565. 80073.001 | 13 Jan. 1999 | 60/115,847 | and |
| 566. 80074.001 | 14 Jan. 1999 | 60/115,905 | and |
| 567. 80075.001 | 15 Jan. 1999 | 60/116,383 | and |
| 568. 80076.001 | 15 Jan. 1999 | 60/116,384 | and |
| 569. 80077.001 | 19 Jan. 1999 | 60/116,329 | and |
| 570. 80078.001 | 19 Jan. 1999 | 60/116,340 | and |
| 571. 80079.001 | 21 Jan. 1999 | 60/116,674 | and |
| 572. 80080.001 | 21 Jan. 1999 | 60/116,672 | and |
| 573. 80082.001 | 22 Jan. 1999 | 60/116,962 | and |
| 574. 80083.001 | 28 Jan. 1999 | 60/117,756 | and |
| 575. 80289.018 | 25 Aug. 2000 | 60/228,025 | and |
| 576. 80289.019 | 25 Aug. 2000 | 60/227,781 | |
| 577. 80289.020 | 25 Aug. 2000 | 60/227,783 | |
| 578. 80289.021 | 25 Aug. 2000 | 60/227,731 | |
| 579. 80289.022 | 25 Aug. 2000 | 60/227,732 | |
| 580. 80289.023 | 25 Aug. 2000 | 60/227,729 | |
| 581. 80289.024 | 25 Aug. 2000 | 60/228,167 | |
| 582. 80289.025 | 25 Aug. 2000 | 60/227,734 | |

-continued

| Client No. | Filing Date | application Ser. No. |
|---|---|---|
| 583. 80289.026 | 25 Aug. 2000 | 60/227,792 |
| 584. 80289.027 | 25 Aug. 2000 | 60/227,733 |
| 585. 80289.028 | 25 Aug. 2000 | 60/227,730 |
| 586. 80289.029 | 25 Aug. 2000 | 60/227,770 |
| 587. 80289.030 | 25 Aug. 2000 | 60/227,728 |
| 588. 80289.031 | 25 Aug. 2000 | 60/227,773 |
| 589. 80289.032 | 25 Aug. 2000 | 60/228,033 |
| 590. 80289.033 | 25 Aug. 2000 | 60/228,024 |
| 591. 80289.034 | 25 Aug. 2000 | 60/227,769 |
| 592. 80289.035 | 25 Aug. 2000 | 60/227,780 |
| 593. 80289.036 | 25 Aug. 2000 | 60/227,725 |
| 594. 80289.037 | 25 Aug. 2000 | 60/227,774 |
| 595. 80289.038 | 25 Aug. 2000 | 60/228,163 |
| 596. 80289.039 | 25 Aug. 2000 | 60/228,046 |
| 597. 80289.040 | 25 Aug. 2000 | 60/228,098 |
| 598. 80289.041 | 25 Aug. 2000 | 60/228,047 |
| 599. 80289.042 | 25 Aug. 2000 | 60/228,052 |
| 600. 80289.043 | 25 Aug. 2000 | 60/228,049 |
| 601. 80289.044 | 25 Aug. 2000 | 60/228,132 |
| 602. 80289.045 | 25 Aug. 2000 | 60/228,152 |
| 603. 80289.046 | 25 Aug. 2000 | 60/228,135 |
| 604. 80289.047 | 25 Aug. 2000 | 60/228,322 |
| 605. 80289.048 | 25 Aug. 2000 | 60/228,156 |
| 606. 80289.049 | 25 Aug. 2000 | 60/228,323 |
| 607. 80289.050 | 25 Aug. 2000 | 60/228,133 |
| 608. 80289.051 | 25 Aug. 2000 | 60/228,320 |
| 609. 80289.052 | 25 Aug. 2000 | 60/228,159 |
| 610. 80289.053 | 25 Aug. 2000 | 60/228,151 |
| 611. 80289.054 | 25 Aug. 2000 | 60/228,202 |
| 612. 80289.055 | 25 Aug. 2000 | 60/228,208 |
| 613. 80289.056 | 25 Aug. 2000 | 60/228,153 |
| 614. 80289.057 | 25 Aug. 2000 | 60/228,179 |
| 615. 80289.058 | 25 Aug. 2000 | 60/228,180 |
| 616. 80289.059 | 25 Aug. 2000 | 60/228,209 |
| 617. 80289.060 | 25 Aug. 2000 | 60/228,178 |
| 618. 80289.061 | 25 Aug. 2000 | 60/228,177 |
| 619. 80289.062 | 25 Aug. 2000 | 60/227,976 |
| 620. 80289.063 | 25 Aug. 2000 | 60/228,207 |
| 621. 80289.064 | 25 Aug. 2000 | 60/228,048 |
| 622. 80289.065 | 25 Aug. 2000 | 60/228,096 |
| 623. 80289.066 | 25 Aug. 2000 | 60/227,932 |
| 624. 80289.067 | 25 Aug. 2000 | 60/227,936 |
| 625. 80289.068 | 25 Aug. 2000 | 60/228,044 |
| 626. 80289.069 | 25 Aug. 2000 | 60/228,216 |
| 627. 80289.070 | 25 Aug. 2000 | 60/228,065 |
| 628. 80289.071 | 25 Aug. 2000 | 60/227,975 |
| 629. 80289.072 | 25 Aug. 2000 | 60/228,181 |
| 630. 80289.073 | 25 Aug. 2000 | 60/228,063 |
| 631. 80289.074 | 25 Aug. 2000 | 60/228,064 |
| 632. 80289.075 | 25 Aug. 2000 | 60/228,055 |
| 633. 80289.076 | 25 Aug. 2000 | 60/228,074 |
| 634. 80289.077 | 25 Aug. 2000 | 60/227,939 |
| 635. 80289.078 | 25 Aug. 2000 | 60/227,955 |
| 636. 80289.079 | 25 Aug. 2000 | 60/228,053 |
| 637. 80289.080 | 25 Aug. 2000 | 60/227,978 |
| 638. 80289.081 | 25 Aug. 2000 | 60/227,982 |
| 639. 80289.082 | 25 Aug. 2000 | 60/228,189 |
| 640. 80289.083 | 25 Aug. 2000 | 60/228,054 |
| 641. 80289.084 | 25 Aug. 2000 | 60/228,164 |
| 642. 80289.085 | 25 Aug. 2000 | 60/228,161 |
| 643. 80289.086 | 25 Aug. 2000 | 60/228,165 |
| 644. 80289.087 | 25 Aug. 2000 | 60/228,221 |
| 645. 80289.088 | 25 Aug. 2000 | 60/228,240 |
| 646. 80289.089 | 25 Aug. 2000 | 60/227,979 |
| 647. 80289.090 | 25 Aug. 2000 | 60/227,954 |
| 648. 80289.091 | 25 Aug. 2000 | 60/228,217 |
| 649. 80289.092 | 25 Aug. 2000 | 60/227,929 |
| 650. 80289.093 | 25 Aug. 2000 | 60/228,043 |
| 651. 80289.094 | 25 Aug. 2000 | 60/227,931 |
| 652. 80289.095 | 25 Aug. 2000 | 60/228,187 |
| 653. 80289.096 | 25 Aug. 2000 | 60/228,061 |
| 654. 80289.097 | 25 Aug. 2000 | 60/228,150 |
| 656. 80289.201 | 25 Aug. 2000 | 60/227,793 |
| 657. 80289.202 | 25 Aug. 2000 | 60/228,031 |
| 658. 80289.203 | 25 Aug. 2000 | 60/228,028 |
| 659. 80289.204 | 25 Aug. 2000 | 60/228,027 |
| 660. 80289.206 | 25 Aug. 2000 | 60/228,026 |
| 661. 80289.207 | 25 Aug. 2000 | 60/228,038 |
| 662. 80289.208 | 25 Aug. 2000 | 60/228,036 |
| 663. 80289.209 | 25 Aug. 2000 | 60/227,790 |
| 664. 80289.210 | 25 Aug. 2000 | 60/228,039 |
| 665. 80289.211 | 25 Aug. 2000 | 60/228,030 |
| 666. 80289.212 | 25 Aug. 2000 | 60/228,032 |
| 667. 80289.213 | 25 Aug. 2000 | 60/228,149 |
| 668. 80289.214 | 25 Aug. 2000 | 60/228,040 |
| 669. 80289.215 | 25 Aug. 2000 | 60/227,777 |
| 670. 80289.216 | 25 Aug. 2000 | 60/228,037 |
| 671. 80289.217 | 25 Aug. 2000 | 60/227,791 |
| 672. 80289.099 | 25 Aug. 2000 | 60/228,041 |
| 673. 80304.002 | 6 Sep. 2000 | 60/231,840 |
| 674. 80305.001 | 6 Sep. 2000 | 60/231,837 |
| 675. 80305.002 | 6 Sep. 2000 | 60/231,833 |
| 676. 80306.001 | 6 Sep. 2000 | 60/231,835 |
| 677. 80306.002 | 6 Sep. 2000 | 60/231,834 |
| 678. 80309.001 | 6 Sep. 2000 | 60/230,430 |
| 679. 91089.001 | 6 Sep. 2000 | 60/230,434 |
| 680. 80310.001 | 13 Sep. 2000 | 60/232,044 |
| 681. 91090.001 | 13 Sep. 2000 | 60/232,043 |
| 682. 80311.001 | 15 Sep. 2000 | 60/232,858 |
| 683. 91091.001 | 15 Sep. 2000 | 60/232,865 |
| 684. 80312.001 | 18 Sep. 2000 | 60/233,621 |
| 685. 91092.001 | 18 Sep. 2000 | 60/233,634 |
| 686. 80313.001 | 20 Sep. 2000 | 60/234,179 |
| 687. 91093.001 | 20 Sep. 2000 | 60/234,178 |
| 688. 80314.001 | 21 Sep. 2000 | 60/234,233 |
| 689. 91094.001 | 21 Sep. 2000 | 60/234,217 |
| 690. 91095.001 | 21 Sep. 2000 | 60/234,220 |
| 691. 80315.001 | 25 Sep. 2000 | 60/234,968 |
| 692. 91096.001 | 25 Sep. 2000 | 60/234,979 |
| 693. 80316.001 | 25 Sep. 2000 | 60/234,974 |
| 694. 91097.001 | 25 Sep. 2000 | 60/235,118 |
| 695. 80317.001 | 26 Sep. 2000 | 60/234,949 |
| 696. 91098.001 | 27 Sep. 2000 | 60/235,577 |
| 697. 91078.001 | 28 Sep. 2000 | 60/235,934 |
| 698. 91099.001 | 29 Sep. 2000 | 60/236,380 |
| 699. 80318.001 | 2 Oct. 2000 | 60/236,732 |
| 700. 91100.001 | 2 Oct. 2000 | 60/237,035 |
| 701. 80319.001 | 4 Oct. 2000 | 60/237,379 |
| 702. 91101.001 | 4 Oct. 2000 | 60/237,505 |
| 703. 80320.001 | 5 Oct. 2000 | 60/237,686 |
| 704. 80321.001 | 10 Oct. 2000 | 60/238,473 |
| 705. 91102.001 | 10 Oct. 2000 | 60/238,472 |
| 706. 80322.001 | 10 Oct. 2000 | 60/238,456 |
| 707. 91103.001 | 10 Oct. 2000 | 60/238,421 |
| 708. 80323.001 | 11 Oct. 2000 | 60/239,091 |
| 709. 91104.001 | 11 Oct. 2000 | 60/239,245 |
| 710. 80324.001 | 17 Oct. 2000 | 60/240,862 |
| 711. 91105.001 | 17 Oct. 2000 | 60/240,863 |
| 712. 80325.001 | 19 Oct. 2000 | 60/241,368 |
| 713. 91106.001 | 19 Oct. 2000 | 60/241,367 |
| 714. 80326.002 | 19 Oct. 2000 | 09/691,020 |
| 715. 80327.001 | 19 Oct. 2000 | 09/691,044 |
| 716. 80327.002 | 19 Oct. 2000 | 09/691,028 |
| 717. 80328.002 | 19 Oct. 2000 | 09/691,056 |
| 718. 80329.001 | 19 Oct. 2000 | 09/691,038 |
| 719. 80329.002 | 19 Oct. 2000 | 09/691,031 |
| 720. 80330.002 | 19 Oct. 2000 | 09/691,018 |
| 721. 80331.001 | 20 Oct. 2000 | 60/241,751 |
| 722. 91107.001 | 20 Oct. 2000 | 60/241,750 |
| 723. 80332.001 | 23 Oct. 2000 | 60/242,065 |
| 724. 91108.001 | 23 Oct. 2000 | 60/242,072 |
| 725. 80334.001 | 24 Oct. 2000 | 60/242,686 |
| 726. 80335.001 | 25 Oct. 2000 | 60/242,705 |
| 727. 91109.001 | 25 Oct. 2000 | 60/242,706 |
| 728. 80336.001 | 26 Oct. 2000 | 60/243,289 |
| 729. 91110.001 | 26 Oct. 2000 | 60/243,288 |
| 730. 80337.001 | 27 Oct. 2000 | 60/243,398 |
| 731. 91111.001 | 27 Oct. 2000 | 60/243,478 |
| 732. 80338.001 | 30 Oct. 2000 | 60/243,723 |
| 733. 91112.001 | 30 Oct. 2000 | 60/243,735 |
| 734. 80339.001 | 1 Nov. 2000 | 60/244,691 |
| 735. 91113.001 | 1 Nov. 2000 | 60/244,747 |
| 736. 80340.001 | 2 Nov. 2000 | 60/244,923 |
| 737. 91114.001 | 2 Nov. 2000 | 60/244,920 |

| | Client No. | Filing Date | application Ser. No. |
|---|---|---|---|
| 738. | 80341.001 | 3 Nov. 2000 | 60/245,164 |
| 739. | 91115.001 | 3 Nov. 2000 | 60/245,165 |
| 740. | 80342.001 | 6 Nov. 2000 | 60/245,676 |
| 741. | 91116.001 | 6 Nov. 2000 | 60/245,576 |
| 742. | 80343.001 | 9 Nov. 2000 | 60/246,732 |
| 743. | 80344.001 | 13 Nov. 2000 | 60/247,010 |
| 744. | 91118.001 | 13 Nov. 2000 | 60/247,051 |
| 745. | 80346.001 | 13 Nov. 2000 | 60/247,050 |
| 746. | 91119.001 | 13 Nov. 2000 | 60/247,049 |
| 747. | 80347.001 | 15 Nov. 2000 | 60/248,198 |
| 748. | 91120.001 | 15 Nov. 2000 | 60/248,197 |
| 749. | 91121.001 | 16 Nov. 2000 | 60/248,555 |
| 750. | 80348.001 | 17 Nov. 2000 | 60/249,256 |
| 751. | 91122.001 | 17 Nov. 2000 | 60/249,257 |
| 752. | 80349.001 | 20 Nov. 2000 | 60/249,454 |
| 753. | 91123.001 | 20 Nov. 2000 | 60/249,453 |
| 754. | 91124.001 | 21 Nov. 2000 | 60/252,080 |
| 755. | 80350.001 | 22 Nov. 2000 | 60/252,464 |
| 756. | 91125.001 | 22 Nov. 2000 | 60/252,465 |
| 757. | 80351.001 | 24 Nov. 2000 | 60/252,598 |
| 758. | 91126.001 | 24 Nov. 2000 | 60/252,590 |
| 759. | 91127.001 | 28 Nov. 2000 | 60/253,140 |
| 760. | 80352.001 | 29 Nov. 2000 | 60/253,722 |
| 761. | 91128.001 | 29 Nov. 2000 | 60/253,748 |
| 762. | 91129.001 | 1 Dec. 2000 | 60/250,356 |
| 763. | 91130.001 | 4 Dec. 2000 | 60/250,46 |
| 764. | 91131.001 | 6 Dec. 2000 | 60/251,387 |
| 765. | 80353.001 | 7 Dec. 2000 | 60/251,504 |
| 766. | 91132.001 | 7 Dec. 2000 | 60/251,508 |
| 767. | 80354.001 | 8 Dec. 2000 | 60/251,853 |
| 768. | 91133.001 | 8 Dec. 2000 | 60/251,854 |
| 769. | 80355.001 | 11 Dec. 2000 | 60/254,174 |
| 770. | 91134.001 | 11 Dec. 2000 | 60/254,196 |
| 771. | 91135.001 | 13 Dec. 2000 | 60/254,891 |
| 772. | 80356.001 | 15 Dec. 2000 | 60/256,503 |
| 773. | 91136.001 | 15 Dec. 2000 | 60/255,415 |
| 774. | 80357.001 | 18 Dec. 2000 | 60/255,891 |
| 775. | 91137.001 | 18 Dec. 2000 | 60/255,892 |
| 776. | 91138.001 | 19 Dec. 2000 | 60/256,306 |
| 777. | 91139.001 | 21 Dec. 2000 | 60/256,929 |
| 778. | 91140.001 | 27 Dec. 2000 | 60/257,978 |
| 779. | 80358.001 | 29 Dec. 2000 | 09/750,044 |
| 780. | 80359.001 | 2 Jan. 2001 | 60/258,880 |
| 781. | 80360.001 | 2 Jan. 2001 | 09/750,910 |
| 782. | 80361.001 | 3 Jan. 2001 | 09/752,823 |
| 783. | 92003.001 | 5 Jan. 2001 | 09/754,184 |
| 784. | 92003.002 | 5 Jan. 2001 | 09/754,185 |
| 785. | 80362.001 | 19 Jan. 2001 | 60/262,389 |
| 786. | 91141.001 | 19 Jan. 2001 | 60/262,359 |
| 787. | 80363.001 | 26 Jan. 2001 | 60/264,026 |
| 788. | 91142.001 | 26 Jan. 2001 | 60/264,027 |
| 789. | 80364.001 | 29 Jan. 2001 | 60/264,282 |
| 790. | 91143.001 | 29 Jan. 2001 | 60/264,257 |
| 791. | 710-0004-55300 US-U-30992.01 | 31 Jan. 2001 | 09/774,106 |
| 792. | 710-0004-55300 US-U-30986.01 | 31 Jan. 2001 | 09/774,089 |
| 793. | 710-0023-55300 US-U-00001.01 | 31 Jan. 2001 | 09/774,090 |
| 794. | 80366.001 | 1 Feb. 2001 | 09/775,870 |
| 795. | 80367.001 | 1 Feb. 2001 | 09/776,014 |
| 796. | 710-3001-55300 US-P-30946.01 | 6 Feb. 2001 | 60/266,468 |
| 797. | 710-3001-55300 US-P-30946.02 | 6 Feb. 2001 | 60/266,469 |
| 798. | 710-3001-55300 US-P-31043.01 | 7 Feb. 2001 | 60/266,863 |
| 799. | 710-0004-55300 US-U-30920.01 | 8 Feb. 2001 | 09/778,734 |
| 800. | 710-3001-55300 US-P-31053.01 | 9 Feb. 2001 | 60/267,425 |
| 801. | 710-3001-55300 US-P-31053.02 | 9 Feb. 2001 | 60/267,430 |
| 802. | 710-3001-55300 US-P-31057.01 | 9 Feb. 2001 | 60/267,426 |
| 803. | 710-3001-55300 US-P-31070.01 | 12 Feb. 2001 | 60/267,707 |
| 804. | 710-3001-55300 US-P-31070.02 | 12 Feb. 2001 | 60/267,706 |
| 805. | 710-3001-55300 US-P-31091.01 | 14 Feb. 2001 | 60/268,366 |
| 806. | 710-3001-55300 US-P-31096.01 | 16 Feb. 2001 | 60/268,921 |
| 807. | 710-3001-55300 US-P-31112.01 | 21 Feb. 2001 | 60/269,890 |
| 808. | 710-3001-55300 US-P-31112.02 | 21 Feb. 2001 | 60/269,891 |
| 809. | 710-3001-55300 US-P-31130.01 | 21 Feb. 2001 | 60/269,892 |
| 810. | 710-3001-55300 US-P-31130.02 | 21 Feb. 2001 | 60/269,893 |
| 811. | 710-3001-55300 US-P-31135.01 | 22 Feb. 2001 | 60/270,122 |
| 812. | 710-3001-55300 US-P-31145.01 | 26 Feb. 2001 | 60/270,913 |
| 813. | 710-3001-55300 US-P-31149.01 | 26 Feb. 2001 | 60/270,912 |
| 814. | 710-3001-55300 US-P-31162.01 | 28 Feb. 2001 | 60/271,724 |
| 815. | 710-3001-55300 US-P-31162.02 | 28 Feb. 2001 | 60/271,725 |
| 816. | 710-3001-55300 US-P-31170.01 | 2 Mar. 2001 | 60/272,467 |
| 817. | 710-3001-55300 US-P-31178.01 | 5 Mar. 2001 | 60/272,783 |
| 818. | 710-3001-55300 US-P-31190.01 | 7 Mar. 2001 | 60/273,554 |
| 819. | 710-3001-55300 US-P-31197.01 | 7 Mar. 2001 | 60/273,553 |
| 820. | 710-3001-55300 US-P-31197.02 | 7 Mar. 2001 | 60/273,552 |
| 821. | 710-0004-55300 US-U-031308.01 | 2 Apr. 2001 | 09/823,082 |

U. Number 26

Application Ser. No. 10/461,476 listed above is a continuation of application Ser. No. 10/191,406, filed on Jul. 10, 2002. Application Ser. No. 10/191,406 is a continuation of application Ser. No. 09/940,255 filed Aug. 24, 2001. Moreover, application Ser. No. 09/940,255 is a continuation-in-part of all the following Nonprovisional applications to which the present application claims priority under 35 USC §120:

| | Country | Appln No | Filing Date |
|---|---|---|---|
| 1. | U.S. | 09/391,631 | Sept. 3, 1999 |
| 2. | U.S. | 09/413,198 | Oct. 5, 1999 |
| 3. | U.S. | 09/412,922 | Oct. 5, 1999 |
| 4. | U.S. | 09/428,944 | Oct. 28, 1999 |
| 5. | U.S. | 09/451,320 | Dec. 1, 1999 |
| 6. | U.S. | 09/478,081 | Jan. 4, 2000 |
| 7. | U.S. | 09/497,191 | Feb. 3, 2000 |
| 8. | U.S. | 09/517,537 | Mar. 1, 2000 |
| 9. | U.S. | 09/637,820 | Aug. 11, 2000 |
| 10. | U.S. | 09/637,565 | Aug. 11, 2000 |
| 11. | U.S. | 09/637,564 | Aug. 11, 2000 |
| 12. | U.S. | 09/637,792 | Aug. 11, 2000 |
| 13. | U.S. | 09/691,039 | Oct. 19, 2000 |
| 14. | U.S. | 09/691,020 | Oct. 19, 2000 |
| 15. | U.S. | 09/691,044 | Oct. 19, 2000 |
| 16. | U.S. | 09/691,028 | Oct. 19, 2000 |
| 17. | U.S. | 09/691,045 | Oct. 19, 2000 |
| 18. | U.S. | 09/691,056 | Oct. 19, 2000 |
| 19. | U.S. | 09/691,038 | Oct. 19, 2000 |
| 20. | U.S. | 09/691,031 | Oct. 19, 2000 |
| 21. | U.S. | 09/691,019 | Oct. 19, 2000 |
| 22. | U.S. | 09/691,018 | Oct. 19, 2000 |
| 23. | U.S. | 09/741,043 | Dec. 21, 2000 |
| 24. | U.S. | 09/750,044 | Dec. 29, 2000 |
| 25. | U.S. | 09/750,910 | Jan. 2, 2001 |

-continued

|  | Country | Appln No | Filing Date |
|---|---|---|---|
| 26. | U.S. | 09/752,823 | Jan. 3, 2001 |
| 27. | U.S. | 09/754,184 | Jan. 5, 2001 |
| 28. | U.S. | 09/754,185 | Jan. 5, 2001 |
| 29. | U.S. | 09/774,106 | Jan. 31, 2001 |
| 30. | U.S. | 09/774,089 | Jan. 31, 2001 |
| 31. | U.S. | 09/774,090 | Jan. 31, 2001 |
| 32. | U.S. | 09/774,340 | Jan. 31, 2001 |
| 33. | U.S. | 09/775,870 | Feb. 1, 2001 |
| 34. | U.S. | 09/776,014 | Feb. 1, 2001 |
| 35. | U.S. | 09/778,734 | Feb. 8, 2001 |
| 36. | U.S. | 09/790,663 | Feb. 23, 2001 |
| 37. | U.S. | 09/795,347 | Mar. 1, 2001 |
| 38. | U.S. | 09/795,359 | Mar. 1, 2001 |
| 39. | U.S. | 09/804,470 | Mar. 16, 2001 |
| 40. | U.S. | 09/823,082 | Apr. 2, 2001 |
| 41. | U.S. | 09/824,790 | Apr. 4, 2001 |
| 42. | U.S. | 09/824,882 | Apr. 4, 2001 |
| 43. | U.S. | 09/832,192 | Apr. 11, 2001 |
| 44. | U.S. | 09/832,934 | Apr. 12, 2001 |
| 45. | U.S. | 09/842,088 | Apr. 26, 2001 |
| 46. | U.S. | 09/842,246 | Apr. 26, 2001 |
| 47. | U.S. | 09/845,208 | May 1, 2001 |
| 48. | U.S. | 09/845,206 | May 1, 2001 |
| 49. | U.S. | 09/845,318 | May 1, 2001 |
| 50. | U.S. | 09/845,209 | May 1, 2001 |
| 51. | U.S. | 09/870,713 | Jun. 1, 2001 |
| 52. | U.S. | 09/870,699 | Jun. 1, 2001 |
| 53. | U.S. | 09/870,675 | Jun. 1, 2001 |
| 54. | U.S. | 09/870,646 | Jun. 1, 2001 |
| 55. | U.S. | 09/870,476 | Jun. 1, 2001 |
| 56. | U.S. | 09/870,664 | Jun. 1, 2001 |
| 57. | U.S. | 09/878,974 | Jun. 13, 2001 |
| 58. | U.S. | 09/881,096 | Jun. 15, 2001 |
| 59. | U.S. | 09/898,063 | Jul. 5, 2001 |
| 60. | U.S. | 09/898,064 | Jul. 5, 2001 |
| 61. | U.S. | 09/902,093 | Jul. 11, 2001 |
| 62. | U.S. | 09/902,613 | Jul. 12, 2001 |
| 63. | U.S. | 09/902,614 | Jul. 12, 2001 |
| 64. | U.S. | 09/903,497 | Jul. 13, 2001 |
| 65. | U.S. | 09/903,988 | Jul. 13, 2001 |
| 66. | U.S. | 09/918,556 | Aug. 1, 2001 |
| 67. | U.S. | 09/920,626 | Aug. 3, 2001 |
| 68. | U.S. | 09/921,135 | Aug. 3, 2001 |
| 69. | U.S. | 09/922,661 | Aug. 7, 2001 |
| 70. | U.S. | 09/924,702 | Aug. 9, 2001 |
| 71. | U.S. | 09/924,701 | Aug. 9, 2001 |
| 72. | U.S. | 09/928,372 | Aug. 14, 2001 |
| 73. | U.S. | 09/930,244 | Aug. 16, 2001 |
| 74. | U.S. | 09/930,231 | Aug. 16, 2001 |
| 75. | U.S. | 09/930,214 | Aug. 16, 2001 |
| 76. | U.S. | 09/930,223 | Aug. 16, 2001 |
| 77. | U.S. | 09/931,043 | Aug. 17, 2001 |
| 78. | U.S. | 09/931,911 | Aug. 20, 2001 |

Furthermore, the some of the above-listed 78 nonprovisional applications themselves claim priority under 35 USC §119(e) of the following applications to which the present application also claims priority:

|  |  | application Ser. No. | Filing Date |  |
|---|---|---|---|---|
| 1. | Nonprovisional | 09/391,631 | Sep. 3, 1999 | claims priority of the following |
|  | 1. | 60/099,671 | Sep. 4, 1998 |  |
|  | 2. | 60/099,672 | Sep. 4, 1998 |  |
|  | 3. | 60/099,933 | Sep. 11, 1998 |  |
|  | 4. | 60/100,864 | Sep. 17, 1998 |  |
|  | 5. | 60/101,042 | Sep. 18, 1998 |  |
|  | 6. | 60/101,682 | Sep. 24, 1998 |  |
|  | 7. | 60/102,533 | Sep. 30, 1998 |  |
|  | 8. | 60/102,460 | Sep. 30, 1998 |  |
|  | 9. | 60/103,116 | Oct. 5, 1998 |  |
|  | 10. | 60/103,141 | Oct. 5, 1998 |  |
|  | 11. | 60/103,574 | Oct. 9, 1998 |  |
|  | 12. | 60/103,907 | Oct. 13, 1998 |  |
|  | 13. | 60/106,105 | Oct. 29, 1998 |  |
|  | 14. | 60/106,218 | Oct. 30, 1998 |  |
|  | 15. | 60/107,282 | Nov. 6, 1998 |  |
|  | 16. | 60/107,836 | Nov. 10, 1998 |  |
|  | 17. | 60/108,526 | Nov. 16, 1998 |  |
|  | 18. | 60/108,901 | Nov. 17, 1998 |  |
|  | 19. | 60/109,267 | Nov. 20, 1998 |  |
|  | 20. | 60/109,594 | Nov. 23, 1998 |  |
|  | 21. | 60/110,263 | Nov. 30, 1998 |  |
|  | 22. | 60/110,495 | Dec. 1, 1998 |  |
|  | 23. | 60/110,626 | Dec. 2, 1998 |  |
|  | 24. | 60/110,701 | Dec. 3, 1998 |  |
|  | 25. | 60/111,339 | Dec. 7, 1998 |  |
|  | 26. | 60/111,589 | Dec. 9, 1998 |  |
|  | 27. | 60/112,096 | Dec. 14, 1998 |  |
|  | 28. | 60/112,224 | Dec. 15, 1998 |  |
|  | 29. | 60/112,624 | Dec. 16, 1998 |  |
|  | 30. | 60/112,862 | Dec. 17, 1998 |  |
|  | 31. | 60/115,152 | Jan. 7, 1999 |  |
|  | 32. | 60/115,156 | Jan. 7, 1999 |  |
|  | 33. | 60/115,365 | Jan. 8, 1999 |  |
|  | 34. | 60/115,339 | Jan. 11, 1999 |  |
|  | 35. | 60/115,847 | Jan. 13, 1999 |  |
|  | 36. | 60/116,674 | Jan. 21, 1999 |  |
|  | 37. | 60/116,962 | Jan. 22, 1999 |  |
|  | 38. | 60/120,583 | Feb. 18, 1999 |  |
|  | 39. | 60/121,072 | Feb. 22, 1999 |  |
|  | 40. | 60/122,568 | Mar. 2, 1999 |  |
|  | 41. | 60/123,941 | Mar. 12, 1999 |  |

-continued

| | | application Ser. No. | Filing Date | |
|---|---|---|---|---|
| 2. | Nonprovisional | 09/413,198 | Oct. 5, 1999 | claims priority of the following |
| | 1. | 60/103,116 | Oct. 5, 1998 | |
| | 2. | 60/103,141 | Oct. 5, 1998 | |
| | 3. | 60/103,215 | Oct. 6, 1998 | |
| | 4. | 60/103,554 | Oct. 8, 1998 | |
| | 5. | 60/103,574 | Oct. 9, 1998 | |
| | 6. | 60/103,907 | Oct. 13, 1998 | |
| | 7. | 60/104,268 | Oct. 14, 1998 | |
| | 8. | 60/104,680 | Oct. 16, 1998 | |
| | 9. | 60/104,828 | Oct. 19, 1998 | |
| | 10. | 60/105,008 | Oct. 20, 1998 | |
| | 11. | 60/105,142 | Oct. 21, 1998 | |
| | 12. | 60/105,533 | Oct. 22, 1998 | |
| | 13. | 60/105,571 | Oct. 26, 1998 | |
| | 14. | 60/105,815 | Oct. 27, 1998 | |
| | 15. | 60/106,105 | Oct. 29, 1998 | |
| | 16. | 60/106,218 | Oct. 30, 1998 | |
| 3. | Nonprovisional | 09/412,922 | Oct. 5, 1999 | claims priority of the following |
| | 1. | 60/103,116 | Oct. 5, 1998 | |
| | 2. | 60/103,141 | Oct. 5, 1998 | |
| | 3. | 60/103,215 | Oct. 6, 1998 | |
| | 4. | 60/103,554 | Oct. 8, 1998 | |
| | 5. | 60/103,574 | Oct. 9, 1998 | |
| | 6. | 60/103,907 | Oct. 13, 1998 | |
| | 7. | 60/104,268 | Oct. 14, 1998 | |
| | 8. | 60/104,680 | Oct. 16, 1998 | |
| | 9. | 60/104,828 | Oct. 19, 1998 | |
| | 10. | 60/105,008 | Oct. 20, 1998 | |
| | 11. | 60/105,142 | Oct. 21, 1998 | |
| | 12. | 60/105,533 | Oct. 22, 1998 | |
| | 13. | 60/105,571 | Oct. 26, 1998 | |
| | 14. | 60/105,815 | Oct. 27, 1998 | |
| | 15. | 60/106,105 | Oct. 29, 1998 | |
| | 16. | 60/106,218 | Oct. 30, 1998 | |
| | 17. | 60/106,685 | Nov. 2, 1998 | |
| | 18. | 60/107,282 | Nov. 6, 1998 | |
| | 19. | 60/107,720 | Nov. 9, 1998 | |
| | 20. | 60/107,719 | Nov. 9, 1998 | |
| | 21. | 60/107,836 | Nov. 10, 1998 | |
| | 22. | 60/108,190 | Nov. 12, 1998 | |
| | 23. | 60/108,526 | Nov. 16, 1998 | |
| | 24. | 60/108,901 | Nov. 17, 1998 | |
| | 25. | 60/109,124 | Nov. 19, 1998 | |
| | 26. | 60/109,127 | Nov. 19, 1998 | |
| | 27. | 60/109,267 | Nov. 20, 1998 | |
| | 28. | 60/109,594 | Nov. 23, 1998 | |
| | 29. | 60/110,053 | Nov. 25, 1998 | |
| | 30. | 60/110,050 | Nov. 25, 1998 | |
| | 31. | 60/110,158 | Nov. 27, 1998 | |
| | 32. | 60/110,263 | Nov. 30, 1998 | |
| | 33. | 60/110,495 | Dec. 1, 1998 | |
| | 34. | 60/110,626 | Dec. 2, 1998 | |
| | 35. | 60/110,701 | Dec. 3, 1998 | |
| | 36. | 60/111,339 | Dec. 7, 1998 | |
| | 37. | 60/111,589 | Dec. 9, 1998 | |
| | 38. | 60/111,782 | Dec. 10, 1998 | |
| | 39. | 60/111,812 | Dec. 11, 1998 | |
| | 40. | 60/112,096 | Dec. 14, 1998 | |
| | 41. | 60/112,224 | Dec. 15, 1998 | |
| | 42. | 60/112,624 | Dec. 16, 1998 | |
| | 43. | 60/112,862 | Dec. 17, 1998 | |
| | 44. | 60/112,912 | Dec. 18, 1998 | |
| | 45. | 60/113,248 | Dec. 21, 1998 | |
| | 46. | 60/113,522 | Dec. 22, 1998 | |
| | 47. | 60/113,826 | Dec. 23, 1998 | |
| | 48. | 60/113,998 | Dec. 28, 1998 | |
| | 49. | 60/114,384 | Dec. 29, 1998 | |
| | 50. | 60/114,455 | Dec. 30, 1998 | |
| | 51. | 60/114,740 | Jan. 4, 1999 | |
| | 52. | 60/114,866 | Jan. 6, 1999 | |
| | 53. | 60/115,153 | Jan. 7, 1999 | |
| | 54. | 60/115,152 | Jan. 7, 1999 | |
| | 55. | 60/115,151 | Jan. 7, 1999 | |
| | 56. | 60/115,155 | Jan. 7, 1999 | |
| | 57. | 60/115,156 | Jan. 7, 1999 | |
| | 58. | 60/115,154 | Jan. 7, 1999 | |
| | 59. | 60/115,364 | Jan. 8, 1999 | |

-continued

|     | application Ser. No. | Filing Date |     |
| --- | --- | --- | --- |
| 60. | 60/115,365 | Jan. 8, 1999 | |
| 61. | 60/115,339 | Jan. 11, 1999 | |
| 62. | 60/115,518 | Jan. 12, 1999 | |
| 63. | 60/115,847 | Jan. 13, 1999 | |
| 64. | 60/115,905 | Jan. 14, 1999 | |
| 65. | 60/116,383 | Jan. 15, 1999 | |
| 66. | 60/116,384 | Jan. 15, 1999 | |
| 67. | 60/116,329 | Jan. 19, 1999 | |
| 68. | 60/116,340 | Jan. 19, 1999 | |
| 69. | 60/116,674 | Jan. 21, 1999 | |
| 70. | 60/116,672 | Jan. 21, 1999 | |
| 71. | 60/116,960 | Jan. 22, 1999 | |
| 72. | 60/116,962 | Jan. 22, 1999 | |
| 73. | 60/117,756 | Jan. 28, 1999 | |
| 74. | 60/118,672 | Feb. 3, 1999 | |
| 75. | 60/118,808 | Feb. 4, 1999 | |
| 76. | 60/118,778 | Feb. 5, 1999 | |
| 77. | 60/119,029 | Feb. 8, 1999 | |
| 78. | 60/119,332 | Feb. 9, 1999 | |
| 79. | 60/119,462 | Feb. 10, 1999 | |
| 80. | 60/119,922 | Feb. 12, 1999 | |
| 81. | 60/120,196 | Feb. 16, 1999 | |
| 82. | 60/120,198 | Feb. 16, 1999 | |
| 83. | 60/120,583 | Feb. 18, 1999 | |
| 84. | 60/121,072 | Feb. 22, 1999 | |
| 85. | 60/121,334 | Feb. 23, 1999 | |
| 86. | 60/121,470 | Feb. 24, 1999 | |
| 87. | 60/121,704 | Feb. 25, 1999 | |
| 88. | 60/122,107 | Feb. 26, 1999 | |
| 89. | 60/122,266 | Mar. 1, 1999 | |
| 90. | 60/122,568 | Mar. 2, 1999 | |
| 91. | 60/122,611 | Mar. 3, 1999 | |
| 92. | 60/121,775 | Mar. 4, 1999 | |
| 93. | 60/123,534 | Mar. 5, 1999 | |
| 94. | 60/123,680 | Mar. 9, 1999 | |
| 95. | 60/123,715 | Mar. 10, 1999 | |
| 96. | 60/123,726 | Mar. 10, 1999 | |
| 97. | 60/124,263 | Mar. 11, 1999 | |
| 98. | 60/123,941 | Mar. 12, 1999 | |
| 4. Nonprovisional | 09/428,944 | Oct. 28, 1999 | claims priority of the following |
| 1. | 60/106,685 | Nov. 2, 1998 | |
| 2. | 60/107,282 | Nov. 6, 1998 | |
| 3. | 60/107,720 | Nov. 9, 1998 | |
| 4. | 60/107,719 | Nov. 9, 1998 | |
| 5. | 60/107,836 | Nov. 10, 1998 | |
| 6. | 60/108,190 | Nov. 12, 1998 | |
| 7. | 60/108,526 | Nov. 16, 1998 | |
| 8. | 60/108,901 | Nov. 17, 1998 | |
| 9. | 60/109,124 | Nov. 19, 1998 | |
| 10. | 60/109,127 | Nov. 19, 1998 | |
| 11. | 60/109,267 | Nov. 20, 1998 | |
| 12. | 60/109,594 | Nov. 23, 1998 | |
| 13. | 60/110,053 | Nov. 25, 1998 | |
| 14. | 60/110,050 | Nov. 25, 1998 | |
| 15. | 60/110,158 | Nov. 27, 1998 | |
| 16. | 60/110,263 | Nov. 30, 1998 | |
| 5. Nonprovisional | 09/451,320 | Dec. 1, 1999 | claims priority of the following |
| 1. | 60/110,495 | Dec. 1, 1998 | |
| 2. | 60/110,626 | Dec. 2, 1998 | |
| 3. | 60/110,701 | Dec. 3, 1998 | |
| 4. | 60/111,339 | Dec. 7, 1998 | |
| 5. | 60/111,589 | Dec. 9, 1998 | |
| 6. | 60/111,782 | Dec. 10, 1998 | |
| 7. | 60/111,812 | Dec. 11, 1998 | |
| 8. | 60/112,096 | Dec. 14, 1998 | |
| 9. | 60/112,224 | Dec. 15, 1998 | |
| 10. | 60/112,624 | Dec. 16, 1998 | |
| 11. | 60/112,862 | Dec. 17, 1998 | |
| 12. | 60/112,912 | Dec. 18, 1998 | |
| 13. | 60/113,248 | Dec. 21, 1998 | |
| 14. | 60/113,522 | Dec. 22, 1998 | |
| 15. | 60/113,826 | Dec. 23, 1998 | |
| 16. | 60/113,998 | Dec. 28, 1998 | |
| 17. | 60/114,384 | Dec. 29, 1998 | |
| 18. | 60/114,455 | Dec. 30, 1998 | |
| 19. | 60/115,153 | Jan. 7, 1999 | |
| 20. | 60/115,152 | Jan. 7, 1999 | |

-continued

| | | application Ser. No. | Filing Date | |
|---|---|---|---|---|
| | 21. | 60/115,151 | Jan. 7, 1999 | |
| | 22. | 60/115,155 | Jan. 7, 1999 | |
| | 23. | 60/115,156 | Jan. 7, 1999 | |
| | 24. | 60/115,364 | Jan. 8, 1999 | |
| | 25. | 60/116,960 | Jan. 22, 1999 | |
| 6. | Nonprovisional | 09/478,081 | Jan. 4, 2000 | claims priority of the following |
| | 1. | 60/116,674 | Jan. 21, 1999 | |
| | 2. | 60/115,518 | Jan. 12, 1999 | |
| | 3. | 60/115,154 | Jan. 7, 1999 | |
| | 4. | 60/115,365 | Jan. 8, 1999 | |
| | 5. | 60/116,384 | Jan. 15, 1999 | |
| | 6. | 60/115,339 | Jan. 11, 1999 | |
| | 7. | 60/116,340 | Jan. 19, 1999 | |
| | 8. | 60/114,866 | Jan. 6, 1999 | |
| | 9. | 60/116,962 | Jan. 22, 1999 | |
| | 10. | 60/114,740 | Jan. 4, 1999 | |
| | 11. | 60/115,905 | Jan. 14, 1999 | |
| | 12. | 60/115,847 | Jan. 13, 1999 | |
| | 13. | 60/116,672 | Jan. 21, 1999 | |
| | 14. | 60/116,383 | Jan. 15, 1999 | |
| | 15. | 60/116,329 | Jan. 19, 1999 | |
| | 16. | 60/117,756 | Jan. 28, 1999 | |
| 7. | Nonprovisional | 09/497,191 | Feb. 3, 2000 | claims priority of the following |
| | 1. | 60/120,196 | Feb. 16, 1999 | |
| | 2. | 60/121,470 | Feb. 24, 1999 | |
| | 3. | 60/122,107 | Feb. 26, 1999 | |
| | 4. | 60/121,334 | Feb. 23, 1999 | |
| | 5. | 60/119,462 | Feb. 10, 1999 | |
| | 6. | 60/120,583 | Feb. 18, 1999 | |
| | 7. | 60/121,704 | Feb. 25, 1999 | |
| | 8. | 60/120,198 | Feb. 16, 1999 | |
| | 9. | 60/121,072 | Feb. 22, 1999 | |
| | 10. | 60/119,922 | Feb. 12, 1999 | |
| | 11. | 60/118,672 | Feb. 3, 1999 | |
| | 12. | 60/118,808 | Feb. 4, 1999 | |
| | 13. | 60/118,778 | Feb. 5, 1999 | |
| | 14. | 60/119,029 | Feb. 8, 1999 | |
| | 15. | 60/119,332 | Feb. 9, 1999 | |
| 8. | Nonprovisional | 09/517,537 | Mar. 1, 2000 | claims priority of the following |
| | 1. | 60/123,534 | Mar. 5, 1999 | |
| | 2. | 60/122,266 | Mar. 1, 1999 | |
| | 3. | 60/123,941 | Mar. 12, 1999 | |
| | 4. | 60/124,263 | Mar. 11, 1999 | |
| | 5. | 60/123,726 | Mar. 10, 1999 | |
| | 6. | 60/122,568 | Mar. 2, 1999 | |
| | 7. | 60/123,680 | Mar. 9, 1999 | |
| | 8. | 60/123,715 | Mar. 10, 1999 | |
| | 9. | 60/121,775 | Mar. 4, 1999 | |
| | 10. | 60/122,611 | Mar. 3, 1999 | |
| 9. | Nonprovisional | 09/637,820 | Aug. 11, 2000 | claims priority of the following |
| | 1. | 60/148,347 | Aug. 12, 1999 | |
| 10. | Nonprovisional | 09/637,565 | Aug. 11, 2000 | claims priority of the following |
| | 1. | 60/148,342 | Aug. 12, 1999 | |
| 11. | Nonprovisional | 09/637,564 | Aug. 11, 2000 | claims priority of the following |
| | 1. | 60/148,340 | Aug. 12, 1999 | |
| 12. | Nonprovisional | 09/637,792 | Aug. 11, 2000 | claims priority of the following |
| | 1. | 60/148,337 | Aug. 12, 1999 | |
| 36. | Nonprovisional | 09/790,663 | Feb. 23, 2001 | claims priority of the following |
| | 1. | 60/185,398 | Feb. 28, 2000 | |
| | 2. | 60/185,140 | Feb. 25, 2000 | |
| | 3. | 60/185,750 | Feb. 29, 2000 | |
| 37. | Nonprovisional | 09/795,347 | Mar. 1, 2001 | claims priority of the following |
| | 1. | 60/186,296 | Mar. 1, 2000 | |
| | 2. | 60/186,748 | Mar. 3, 2000 | |
| | 3. | 60/186,283 | Mar. 1, 2000 | |
| | 4. | 60/191,825 | Mar. 24, 2000 | |
| | 5. | 60/190,069 | Mar. 20, 2000 | |
| | 6. | 60/189,959 | Mar. 16, 2000 | |
| | 7. | 60/190,070 | Mar. 20, 2000 | |
| | 8. | 60/190,545 | Mar. 20, 2000 | |
| | 9. | 60/190,089 | Mar. 20, 2000 | |
| | 10. | 60/191,084 | Mar. 22, 2000 | |
| | 11. | 60/191,097 | Mar. 22, 2000 | |
| | 12. | 60/191,543 | Mar. 23, 2000 | |
| | 13. | 60/189,953 | Mar. 16, 2000 | |
| | 14. | 60/191,823 | Mar. 24, 2000 | |
| | 15. | 60/192,421 | Mar. 27, 2000 | |

-continued

| | | application Ser. No. | Filing Date | |
|---|---|---|---|---|
| | 16. | 60/186,390 | Mar. 2, 2000 | |
| | 17. | 60/192,308 | Mar. 27, 2000 | |
| | 18. | 60/187,178 | Mar. 2, 2000 | |
| | 19. | 60/192,941 | Mar. 29, 2000 | |
| | 20. | 60/193,244 | Mar. 30, 2000 | |
| | 21. | 60/193,245 | Mar. 30, 2000 | |
| | 22. | 60/193,453 | Mar. 31, 2000 | |
| | 23. | 60/193,455 | Mar. 31, 2000 | |
| | 24. | 60/191,545 | Mar. 23, 2000 | |
| | 25. | 60/187,888 | Mar. 8, 2000 | |
| | 26. | 60/186,386 | Mar. 2, 2000 | |
| | 27. | 60/192,940 | Mar. 29, 2000 | |
| | 28. | 60/189,462 | Mar. 15, 2000 | |
| | 29. | 60/186,669 | Mar. 3, 2000 | |
| | 30. | 60/187,896 | Mar. 8, 2000 | |
| | 31. | 60/186,387 | Mar. 2, 2000 | |
| | 32. | 60/188,187 | Mar. 10, 2000 | |
| | 33. | 60/188,186 | Mar. 10, 2000 | |
| | 34. | 60/188,185 | Mar. 10, 2000 | |
| | 35. | 60/188,175 | Mar. 10, 2000 | |
| | 36. | 60/189,080 | Mar. 14, 2000 | |
| | 37. | 60/189,052 | Mar. 14, 2000 | |
| | 38. | 60/189,461 | Mar. 15, 2000 | |
| | 39. | 60/187,378 | Mar. 7, 2000 | |
| 38. | Nonprovisional | 09/795,359 | Mar. 1, 2001 | claims priority of the following |
| | 1. | 60/189,460 | Mar. 15, 2000 | |
| | 2. | 60/190,090 | Mar. 20, 2000 | |
| | 3. | 60/189,965 | Mar. 17, 2000 | |
| | 4. | 60/189,958 | Mar. 16, 2000 | |
| | 5. | 60/188,687 | Mar. 13, 2000 | |
| | 6. | 60/188,174 | Mar. 10, 2000 | |
| | 7. | 60/187,985 | Mar. 9, 2000 | |
| | 8. | 60/187,379 | Mar. 7, 2000 | |
| | 9. | 60/186,277 | Mar. 1, 2000 | |
| | 10. | 60/192,855 | Mar. 29, 2000 | |
| | 11. | 60/186,670 | Mar. 3, 2000 | |
| | 12. | 60/192,420 | Mar. 27, 2000 | |
| | 13. | 60/193,469 | Mar. 31, 2000 | |
| | 14. | 60/193,243 | Mar. 30, 2000 | |
| | 15. | 60/191,826 | Mar. 24, 2000 | |
| | 16. | 60/191,549 | Mar. 23, 2000 | |
| 39. | Nonprovisional | 09/804,470 | Mar. 16, 2001 | claims priority of the following |
| | | 60/189,948 | Mar. 16, 2000 | |
| | | 60/190,121 | Mar. 16, 2000 | |
| | | 60/189,947 | Mar. 16, 2000 | |
| | | 60/190,120 | Mar. 16, 2000 | |
| 41. | Nonprovisional | 09/824,790 | Apr. 4, 2001 | claims priority of the following |
| | 1. | 60/199,123 | Apr. 24, 2000 | |
| | 2. | 60/194,698 | Apr. 5, 2000 | |
| | 3. | 60/196,168 | Apr. 11, 2000 | |
| | 4. | 60/197,397 | Apr. 14, 2000 | |
| | 5. | 60/195,258 | Apr. 7, 2000 | |
| | 6. | 60/194,884 | Apr. 6, 2000 | |
| | 7. | 60/196,483 | Apr. 12, 2000 | |
| | 8. | 60/194,682 | Apr. 5, 2000 | |
| | 9. | 60/194,385 | Apr. 4, 2000 | |
| | 10. | 60/198,400 | Apr. 19, 2000 | |
| | 11. | 60/198,765 | Apr. 21, 2000 | |
| | 12. | 60/198,629 | Apr. 20, 2000 | |
| | 13. | 60/198,268 | Apr. 17, 2000 | |
| 42. | Nonprovisional | 09/824,882 | Apr. 4, 2001 | claims priority of the following |
| | 1. | 60/195,045 | Apr. 6, 2000 | |
| | 2. | 60/196,089 | Apr. 11, 2000 | |
| | 3. | 60/198,373 | Apr. 19, 2000 | |
| | 4. | 60/198,386 | Apr. 19, 2000 | |
| | 5. | 60/197,687 | Apr. 17, 2000 | |
| | 6. | 60/198,133 | Apr. 17, 2000 | |
| | 7. | 60/197,671 | Apr. 17, 2000 | |
| | 8. | 60/195,283 | Apr. 7, 2000 | |
| | 9. | 60/196,289 | Apr. 12, 2000 | |
| | 10. | 60/196,486 | Apr. 12, 2000 | |
| | 11. | 60/198,763 | Apr. 21, 2000 | |
| | 12. | 60/196,169 | Apr. 11, 2000 | |
| | 13. | 60/197,678 | Apr. 17, 2000 | |
| | 14. | 60/194,874 | Apr. 6, 2000 | |
| | 15. | 60/194,885 | Apr. 6, 2000 | |
| | 16. | 60/194,872 | Apr. 6, 2000 | |

-continued

| | application Ser. No. | Filing Date | |
|---|---|---|---|
| 17. | 60/195,257 | Apr. 7, 2000 | |
| 18. | 60/194,697 | Apr. 5, 2000 | |
| 19. | 60/194,683 | Apr. 5, 2000 | |
| 20. | 60/194,398 | Apr. 4, 2000 | |
| 21. | 60/194,404 | Apr. 4, 2000 | |
| 22. | 60/196,487 | Apr. 12, 2000 | |
| 23. | 60/200,102 | Apr. 27, 2000 | |
| 24. | 60/198,623 | Apr. 20, 2000 | |
| 25. | 60/198,767 | Apr. 21, 2000 | |
| 26. | 60/199,122 | Apr. 24, 2000 | |
| 27. | 60/199,124 | Apr. 24, 2000 | |
| 28. | 60/196,485 | Apr. 12, 2000 | |
| 29. | 60/199,828 | Apr. 26, 2000 | |
| 30. | 60/199,818 | Apr. 26, 2000 | |
| 31. | 60/200,103 | Apr. 27, 2000 | |
| 32. | 60/198,619 | Apr. 20, 2000 | |
| 43. Nonprovisional | 09/832,192 | Apr. 11, 2001 | claims priority of the following |
| 1. | 60/200,773 | Apr. 28, 2000 | |
| 2. | 60/196,212 | Apr. 12, 2000 | |
| 3. | 60/197,869 | Apr. 14, 2000 | |
| 4. | 60/196,213 | Apr. 13, 2000 | |
| 5. | 60/197,870 | Apr. 17, 2000 | |
| 6. | 60/197,871 | Apr. 17, 2000 | |
| 7. | 60/200,373 | Apr. 28, 2000 | |
| 8. | 60/196,211 | Apr. 11, 2000 | |
| 44. Nonprovisional | 09/832,934 | Apr. 12, 2001 | is a continuation of the |
| 1. | 09/637,820 | Aug. 11, 2000 | which claims priority of the |
| 2. | 60/148,347 | Aug. 12, 1999 | |
| 45. Nonprovisional | 09/842,088 | Apr. 26, 2001 | claims priority of the following |
| 1. | 60/200,031 | Apr. 26, 2000 | |
| 46. Nonprovisional | 09/842,246 | Apr. 26, 2001 | claims priority of the following |
| 1. | 60/200,034 | Apr. 26, 2000 | |
| 47 Nonprovisional | 09/845,208 | May 1, 2001 | claims priority of the following |
| 1. | 60/203,622 | May 11, 2000 | |
| 2. | 60/200,763 | May 1, 2000 | |
| 3. | 60/201,016 | May 1, 2000 | |
| 4. | 60/200,762 | May 1, 2000 | |
| 5. | 60/200,761 | May 1, 2000 | |
| 6. | 60/203,671 | May 11, 2000 | |
| 7. | 60/203,669 | May 11, 2000 | |
| 8. | 60/203,672 | May 11, 2000 | |
| 48. Nonprovisional | 09/845,206 | May 1, 2001 | claims priority of the following |
| 1. | 60/204,122 | May 15, 2000 | |
| 2. | 60/207,452 | May 30, 2000 | |
| 3. | 60/207,329 | May 30, 2000 | |
| 4. | 60/205,243 | May 19, 2000 | |
| 5. | 60/204,388 | May 15, 2000 | |
| 6. | 60/204,568 | May 16, 2000 | |
| 7. | 60/204,830 | May 17, 2000 | |
| 8. | 60/204,829 | May 17, 2000 | |
| 9. | 60/205,201 | May 18, 2000 | |
| 10. | 60/207,367 | May 26, 2000 | |
| 11. | 60/205,242 | May 19, 2000 | |
| 12. | 60/203,279 | May 11, 2000 | |
| 13. | 60/205,572 | May 22, 2000 | |
| 14. | 60/205,576 | May 22, 2000 | |
| 15. | 60/206,316 | May 23, 2000 | |
| 16. | 60/206,319 | May 23, 2000 | |
| 17. | 60/206,553 | May 24, 2000 | |
| 18. | 60/206,545 | May 24, 2000 | |
| 19. | 60/205,058 | May 18, 2000 | |
| 20. | 60/202,180 | May 5, 2000 | |
| 21. | 60/207,354 | May 26, 2000 | |
| 22. | 60/204,569 | May 16, 2000 | |
| 23. | 60/201,275 | May 2, 2000 | |
| 24. | 60/200,879 | May 1, 2000 | |
| 25. | 60/201,305 | May 2, 2000 | |
| 26. | 60/201,740 | May 4, 2000 | |
| 27. | 60/203,915 | May 12, 2000 | |
| 28. | 60/202,112 | May 5, 2000 | |
| 29. | 60/203,916 | May 12, 2000 | |
| 30. | 60/202,914 | May 9, 2000 | |
| 31. | 60/202,636 | May 9, 2000 | |
| 32. | 60/202,634 | May 9, 2000 | |
| 33. | 60/202,963 | May 10, 2000 | |
| 34. | 60/203,457 | May 11, 2000 | |
| 35. | 60/202,968 | May 10, 2000 | |

-continued

| | application Ser. No. | Filing Date | |
|---|---|---|---|
| 36. | 60/201,750 | May 4, 2000 | |
| 37. | 60/207,239 | May 26, 2000 | |
| 38. | 60/207,243 | May 26, 2000 | |
| 39. | 60/202,919 | May 9, 2000 | |
| 49. Nonprovisional | 09/845,318 | May 1, 2001 | claims priority of the following |
| 1. | 60/205,325 | May 17, 2000 | |
| 2. | 60/201,018 | May 1, 2000 | |
| 50. Nonprovisional | 09/845,209 | May 1, 2001 | claims priority of the following |
| 1. | 60/205,233 | May 17, 2000 | |
| 2. | 60/201,017 | May 1, 2000 | |
| 51. Nonprovisional | 09/870,713 | Jun. 1, 2001 | claims priority of the following |
| 1. | 60/209,338 | Jun. 2, 2000 | |
| 52. Nonprovisional | 09/870,699 | Jun. 1, 2001 | claims priority of the following |
| 1. | 60/208,421 | Jun. 1, 2000 | |
| 53. Nonprovisional | 09/870,675 | Jun. 1, 2001 | claims priority of the following |
| 1. | 60/208,649 | Jun. 2, 2000 | |
| 54 Nonprovisional | 09/870,646 | Jun. 1, 2001 | claims priority of the following |
| 1. | 60/208,648 | Jun. 1, 2000 | |
| 55. Nonprovisional | 09/870,476 | Jun. 1, 2001 | claims priority of the following |
| 1. | 60/208,324 | Jun. 1, 2000 | |
| 2. | 60/210,008 | Jun. 8, 2000 | |
| 3. | 60/208,917 | Jun. 5, 2000 | |
| 4. | 60/208,919 | Jun. 5, 2000 | |
| 56. Nonprovisional | 09/870,664 | Jun. 1, 2001 | claims priority of the following |
| | 60/208,918 | Jun. 5, 2000 | |
| | 60/214,535 | Jun. 27, 2000 | |
| | 60/208,920 | Jun. 5, 2000 | |
| | 60/215,127 | Jun. 30, 2000 | |
| | 60/214,799 | Jun. 28, 2000 | |
| | 60/213,249 | Jun. 22, 2000 | |
| | 60/210,564 | Jun. 9, 2000 | |
| | 60/210,006 | Jun. 8, 2000 | |
| | 60/208,312 | Jun. 1, 2000 | |
| | 60/211,214 | Jun. 13, 2000 | |
| 57. Nonprovisional | 09/878,974 | Jun. 13, 2001 | claims priority of the following |
| 1. | 60/211,539 | Jun. 15, 2000 | |
| 2. | 60/214,760 | Jun. 27, 2000 | |
| 3. | 60/213,195 | Jun. 22, 2000 | |
| 4. | 60/213,221 | Jun. 22, 2000 | |
| 5. | 60/212,677 | Jun. 20, 2000 | |
| 6. | 60/212,414 | Jun. 19, 2000 | |
| 7. | 60/211,210 | Jun. 13, 2000 | |
| 8. | 60/212,713 | Jun. 20, 2000 | |
| 58. Nonprovisional | 09/881,096 | Jun. 15, 2001 | claims priority of the following |
| 1. | 60/213,270 | Jun. 22, 2000 | |
| 2. | 60/212,727 | Jun. 20, 2000 | |
| 3. | 60/212,623 | Jun. 19, 2000 | |
| 4. | 60/211,538 | Jun. 15, 2000 | |
| 5. | 60/214,524 | Jun. 27, 2000 | |
| 59. Nonprovisional | 09/898,063 | Jul. 5, 2001 | claims priority of the following |
| 1. | 60/216,362 | Jul. 5, 2000 | |
| 2. | 60/220,811 | Jul. 25, 2000 | |
| 3. | 60/220,652 | Jul. 25, 2000 | |
| 4. | 60/217,384 | Jul. 11, 2000 | |
| 5. | 60/219,033 | Jul. 18, 2000 | |
| 60. Nonprovisional | 09/898,064 | Jul. 5, 2001 | claims priority of the following |
| 1. | 60/217,476 | Jul. 11, 2000 | |
| 2. | 60/216,361 | Jul. 5, 2000 | |
| 3. | 60/220,647 | Jul. 25, 2000 | |
| 4. | 60/220,484 | Jul. 25, 2000 | |
| 5. | 60/219,004 | Jul. 18, 2000 | |
| 61. Nonprovisional | 09/902,093 | Jul. 11, 2001 | claims priority of the following |
| 1. | 60/226,725 | Aug. 21, 2000 | |
| 2. | 60/225,302 | Aug. 15, 2000 | |
| 3. | 60/228,897 | Aug. 30, 2000 | |
| 4. | 60/227,026 | Aug. 23, 2000 | |
| 5. | 60/217,385 | Jul. 11, 2000 | |
| 6. | 60/219,021 | Jul. 18, 2000 | |
| 7. | 60/224,516 | Aug. 14, 2000 | |
| 8. | 60/220,814 | Jul. 25, 2000 | |
| 62. Nonprovisional | 09/902,613 | Jul. 12, 2001 | claims priority of the following |
| 1. | 60/217,754 | Jul. 12, 2000 | |
| 2. | 60/223,114 | Aug. 1, 2000 | |
| 63. Nonprovisional | 09/902,614 | Jul. 12, 2001 | claims priority of the following |
| 1. | 60/223,116 | Aug. 3, 2000 | |
| 2. | 60/218,548 | Jul. 12, 2000 | |

-continued

| | | application Ser. No. | Filing Date | |
|---|---|---|---|---|
| 64. | Nonprovisional | 09/903,497 | Jul. 13, 2001 | claims priority of the following |
| | 1. | 60/217,846 | Jul. 13, 2000 | |
| | 2. | 60/223,099 | Aug. 3, 2000 | |
| 65. | Nonprovisional | 09/903,988 | Jul. 13, 2001 | claims priority of the following |
| | 1. | 60/218,566 | Jul. 14, 2000 | |
| | 2. | 60/223,098 | Aug. 3, 2000 | |
| 66. | Nonprovisional | 09/918,556 | Aug. 1, 2001 | claims priority of the following |
| | 1. | 60/223,115 | Aug. 1, 2000 | |
| 67. | Nonprovisional | 09/920,626 | Aug. 3, 2001 | claims priority of the following |
| | 1. | 60/223,100 | Aug. 3, 2000 | |
| | 2. | 60/237,361 | Aug. 31, 2000 | |
| | 3. | 60/226,325 | Aug. 18, 2000 | |
| 68. | Nonprovisional | 09/921,135 | Aug. 3, 2001 | claims priority of the following |
| | 1. | 60/223,101 | Aug. 3, 2000 | |
| | 2. | 60/226,323 | Aug. 18, 2000 | |
| | 3. | 60/229,519 | Aug. 31, 2000 | |
| 69. | Nonprovisional | 09/922,661 | Aug. 7, 2001 | claims priority of the following |
| | 1. | 60/229,521 | Aug. 31, 2000 | |
| | 2. | 60/226,381 | Aug. 18, 2000 | |
| | 3. | 60/223,329 | Aug. 7, 2000 | |
| 70. | Nonprovisional | 09/924,702 | Aug. 9, 2001 | claims priority of the following |
| | 1. | 60/224,390 | Aug. 9, 2000 | |
| 71. | Nonprovisional | 09/924,701 | Aug. 9, 2001 | claims priority of the following |
| | 1. | 60/224,391 | Aug. 9, 2000 | |
| 72. | Nonprovisional | 09/928,372 | Aug. 14, 2001 | claims priority of the following |
| | 1. | 60/227,024 | Aug. 23, 2000 | |
| | 2. | 60/228,898 | Aug. 30, 2000 | |
| | 3. | 60/225,303 | Aug. 15, 2000 | |
| | 4. | 60/224,517 | Aug. 14, 2000 | |
| | 5. | 60/226,452 | Aug. 21, 2000 | |
| 73. | Nonprovisional | 09/930,244 | Aug. 16, 2001 | claims priority of the following |
| | 1. | 60/237,362 | Aug. 31, 2000 | |
| | 2. | 60/225,848 | Aug. 16, 2000 | |
| 74. | Nonprovisional | 09/930,231 | Aug. 16, 2001 | Claims priority of the following |
| | 1. | 60/225,849 | Aug. 16, 2000 | |
| 75 | Nonprovisional | 09/930,214 | Aug. 16, 2001 | Claims priority of the following |
| | 1. | 60/225,850 | Aug. 16, 2000 | |
| | 2. | 60/229,520 | Aug. 31, 2000 | |
| 76. | Nonprovisional | 09/930,223 | Aug. 16, 2001 | Claims priority of the following |
| | 1. | 60/225,847 | Aug. 16, 2000 | |
| 77. | Nonprovisional | 09/931,043 | Aug. 17, 2001 | Claims priority of the following |
| | 1. | 60/226,324 | Aug. 18, 2000 | |
| 78. | Nonprovisional | 09/931,911 | Aug. 20, 2001 | Claims priority of the following |
| | 1. | 60/229,520 | Aug. 31, 2000 | |
| | Nonprovisional | 09/940,255 | Aug. 24, 2001 | Claims priority of the following |
| | 1. | 60/228,025 | Aug. 25, 2000 | |
| | 2. | 60/227,781 | Aug. 25, 2000 | |
| | 3. | 60/227,783 | Aug. 25, 2000 | |
| | 4. | 60/227,731 | Aug. 25, 2000 | |
| | 5. | 60/227,732 | Aug. 25, 2000 | |
| | 6. | 60/227,729 | Aug. 25, 2000 | |
| | 7. | 60/228,167 | Aug. 25, 2000 | |
| | 8. | 60/227,734 | Aug. 25, 2000 | |
| | 9. | 60/227,792 | Aug. 25, 2000 | |
| | 10. | 60/227,733 | Aug. 25, 2000 | |
| | 11. | 60/227,730 | Aug. 25, 2000 | |
| | 12. | 60/227,770 | Aug. 25, 2000 | |
| | 13. | 60/227,728 | Aug. 25, 2000 | |
| | 14. | 60/227,773 | Aug. 25, 2000 | |
| | 15. | 60/228,033 | Aug. 25, 2000 | |
| | 16. | 60/228,024 | Aug. 25, 2000 | |
| | 17. | 60/227,769 | Aug. 25, 2000 | |
| | 18. | 60/227,780 | Aug. 25, 2000 | |
| | 19. | 60/227,725 | Aug. 25, 2000 | |
| | 20. | 60/227,774 | Aug. 25, 2000 | |
| | 21. | 60/231,840 | Sep. 6, 2000 | |
| | 22. | 60/231,837 | Sep. 6, 2000 | |
| | 23. | 60/231,833 | Sep. 6, 2000 | |
| | 24. | 60/231,835 | Sep. 6, 2000 | |
| | 25. | 60/231,834 | Sep. 6, 2000 | |
| | 26. | 60/228,163 | Aug. 25, 2000 | |
| | 27. | 60/228,046 | Aug. 25, 2000 | |
| | 28. | 60/228,098 | Aug. 25, 2000 | |
| | 29. | 60/228,047 | Aug. 25, 2000 | |
| | 30. | 60/228,052 | Aug. 25, 2000 | |
| | 31. | 60/228,049 | Aug. 25, 2000 | |
| | 32. | 60/228,132 | Aug. 25, 2000 | |

-continued

| | application Ser. No. | Filing Date |
|---|---|---|
| 33. | 60/228,152 | Aug. 25, 2000 |
| 34. | 60/228,135 | Aug. 25, 2000 |
| 35. | 60/228,322 | Aug. 25, 2000 |
| 36. | 60/228,156 | Aug. 25, 2000 |
| 37. | 60/228,323 | Aug. 25, 2000 |
| 38. | 60/228,133 | Aug. 25, 2000 |
| 39. | 60/228,320 | Aug. 25, 2000 |
| 40. | 60/228,159 | Aug. 25, 2000 |
| 41. | 60/228,151 | Aug. 25, 2000 |
| 42. | 60/228,202 | Aug. 25, 2000 |
| 43. | 60/228,208 | Aug. 25, 2000 |
| 44. | 60/228,153 | Aug. 25, 2000 |
| 45. | 60/228,179 | Aug. 25, 2000 |
| 46. | 60/228,180 | Aug. 25, 2000 |
| 47. | 60/228,209 | Aug. 25, 2000 |
| 48. | 60/228,178 | Aug. 25, 2000 |
| 49. | 60/228,177 | Aug. 25, 2000 |
| 50. | 60/227,976 | Aug. 25, 2000 |
| 51. | 60/228,207 | Aug. 25, 2000 |
| 52. | 60/228,048 | Aug. 25, 2000 |
| 53. | 60/228,096 | Aug. 25, 2000 |
| 54. | 60/227,932 | Aug. 25, 2000 |
| 55. | 60/227,936 | Aug. 25, 2000 |
| 56. | 60/228,044 | Aug. 25, 2000 |
| 57. | 60/228,216 | Aug. 25, 2000 |
| 58. | 60/228,065 | Aug. 25, 2000 |
| 59. | 60/227,975 | Aug. 25, 2000 |
| 60. | 60/228,181 | Aug. 25, 2000 |
| 61. | 60/228,063 | Aug. 25, 2000 |
| 62. | 60/228,064 | Aug. 25, 2000 |
| 63. | 60/228,055 | Aug. 25, 2000 |
| 64. | 60/228,074 | Aug. 25, 2000 |
| 65. | 60/227,939 | Aug. 25, 2000 |
| 66. | 60/227,955 | Aug. 25, 2000 |
| 67. | 60/228,053 | Aug. 25, 2000 |
| 68. | 60/227,978 | Aug. 25, 2000 |
| 69. | 60/227,982 | Aug. 25, 2000 |
| 70. | 60/228,189 | Aug. 25, 2000 |
| 71. | 60/228,054 | Aug. 25, 2000 |
| 72. | 60/228,164 | Aug. 25, 2000 |
| 73. | 60/228,161 | Aug. 25, 2000 |
| 74. | 60/228,165 | Aug. 25, 2000 |
| 75. | 60/228,221 | Aug. 25, 2000 |
| 76. | 60/228,240 | Aug. 25, 2000 |
| 77. | 60/227,979 | Aug. 25, 2000 |
| 78. | 60/227,954 | Aug. 25, 2000 |
| 79. | 60/228,217 | Aug. 25, 2000 |
| 80. | 60/227,929 | Aug. 25, 2000 |
| 81. | 60/228,043 | Aug. 25, 2000 |
| 82. | 60/227,931 | Aug. 25, 2000 |
| 83. | 60/228,187 | Aug. 25, 2000 |
| 84. | 60/228,061 | Aug. 25, 2000 |
| 85. | 60/228,150 | Aug. 25, 2000 |
| 86. | | Aug. 25, 2000 |
| 87. | 60/230,430 | Sep. 6, 2000 |
| 88. | 60/230,434 | Sep. 6, 2000 |
| 89. | 60/232,044 | Sep. 13, 2000 |
| 90. | 60/232,043 | Sep. 13, 2000 |
| 91. | 60/232,858 | Sep. 15, 2000 |
| 92. | 60/232,865 | Sep. 15, 2000 |
| 93. | 60/233,621 | Sep. 18, 2000 |
| 94. | 60/233,634 | Sep. 18, 2000 |
| 95. | 60/246,732 | Nov. 9, 2000 |
| 96. | 60/247,010 | Nov. 13, 2000 |
| 97. | 60/247,051 | Nov. 13, 2000 |
| 98. | 60/247,050 | Nov. 13, 2000 |
| 99. | 60/247,049 | Nov. 13, 2000 |
| 100. | 60/234,179 | Sep. 20, 2000 |
| 101. | 60/234,178 | Sep. 20, 2000 |
| 102. | 60/234,233 | Sep. 21, 2000 |
| 103. | 60/234,217 | Sep. 21, 2000 |
| 104. | 60/234,220 | Sep. 21, 2000 |
| 105. | 60/234,968 | Sep. 25, 2000 |
| 106. | 60/234,979 | Sep. 25, 2000 |
| 107. | 60/234,974 | Sep. 25, 2000 |
| 108. | 60/235,118 | Sep. 25, 2000 |
| 109. | 60/234,949 | Sep. 26, 2000 |

-continued

| | application Ser. No. | Filing Date |
|---|---|---|
| 110. | 60/235,577 | Sep. 27, 2000 |
| 111. | 60/235,934 | Sep. 28, 2000 |
| 112. | 60/236,380 | Sep. 29, 2000 |
| 113. | 60/236,732 | Oct. 2, 2000 |
| 114. | 60/237,035 | Oct. 2, 2000 |
| 115. | 60/237,379 | Oct. 4, 2000 |
| 116. | 60/237,505 | Oct. 4, 2000 |
| 117. | 60/237,686 | Oct. 5, 2000 |
| 118. | 60/238,473 | Oct. 10, 2000 |
| 119. | 60/238,472 | Oct. 10, 2000 |
| 120. | 60/238,456 | Oct. 10, 2000 |
| 121. | 60/238,421 | Oct. 10, 2000 |
| 122. | 60/239,091 | Oct. 11, 2000 |
| 123. | 60/239,245 | Oct. 11, 2000 |
| 124. | 60/240,862 | Oct. 17, 2000 |
| 125. | 60/240,863 | Oct. 17, 2000 |
| 126. | 60/241,368 | Oct. 19, 2000 |
| 127. | 60/241,367 | Oct. 19, 2000 |
| 128. | 60/241,751 | Oct. 20, 2000 |
| 129. | 60/241,750 | Oct. 20, 2000 |
| 130. | 60/242,065 | Oct. 23, 2000 |
| 131. | 60/242,072 | Oct. 23, 2000 |
| 132. | 60/242,686 | Oct. 24, 2000 |
| 133. | 60/242,705 | Oct. 25, 2000 |
| 134. | 60/242,706 | Oct. 25, 2000 |
| 135. | 60/243,289 | Oct. 26, 2000 |
| 136. | 60/243,288 | Oct. 26, 2000 |
| 137. | 60/243,398 | Oct. 27, 2000 |
| 138. | 60/243,478 | Oct. 27, 2000 |
| 139. | 60/243,723 | Oct. 30, 2000 |
| 140. | 60/243,735 | Oct. 30, 2000 |
| 141. | 60/244,691 | Nov. 1, 2000 |
| 142. | 60/244,747 | Nov. 1, 2000 |
| 143. | 60/244,923 | Nov. 2, 2000 |
| 144. | 60/244,920 | Nov. 2, 2000 |
| 145. | 60/245,164 | Nov. 3, 2000 |
| 146. | 60/245,165 | Nov. 3, 2000 |
| 147. | 60/248,198 | Nov. 15, 2000 |
| 148. | 60/248,197 | Nov. 15, 2000 |
| 149. | 60/248,555 | Nov. 16, 2000 |
| 150. | 60/249,256 | Nov. 17, 2000 |
| 151. | 60/249,257 | Nov. 17, 2000 |
| 152. | 60/249,454 | Nov. 20, 2000 |
| 153. | 60/249,453 | Nov. 20, 2000 |
| 154. | 60/252,080 | Nov. 21, 2000 |
| 155. | 60/252,464 | Nov. 22, 2000 |
| 156. | 60/252,465 | Nov. 22, 2000 |
| 157. | 60/252,598 | Nov. 24, 2000 |
| 158. | 60/245,676 | Nov. 6, 2000 |
| 159. | 60/245,576 | Nov. 6, 2000 |
| 160. | 60/252,590 | Nov. 24, 2000 |
| 161. | 60/253,140 | Nov. 28, 2000 |
| 162. | 60/253,722 | Nov. 29, 2000 |
| 163. | 60/253,748 | Nov. 29, 2000 |
| 164. | 60/250,356 | Dec. 1, 2000 |
| 165. | 60/250,46 | Dec. 4, 2000 |
| 166. | 60/251,387 | Dec. 6, 2000 |
| 167. | 60/251,504 | Dec. 7, 2000 |
| 168. | 60/251,508 | Dec. 7, 2000 |
| 169. | 60/251,853 | Dec. 8, 2000 |
| 170. | 60/251,854 | Dec. 8, 2000 |
| 171. | 60/254,174 | Dec. 11, 2000 |
| 172. | 60/254,196 | Dec. 11, 2000 |
| 173. | 60/254,891 | Dec. 13, 2000 |
| 174. | 60/256,503 | Dec. 15, 2000 |
| 175. | 60/255,415 | Dec. 15, 2000 |
| 176. | 60/255,891 | Dec. 18, 2000 |
| 177. | 60/255,892 | Dec. 18, 2000 |
| 178. | 60/256,306 | Dec. 19, 2000 |
| 179. | 60/256,929 | Dec. 21, 2000 |
| 180. | 60/257,978 | Dec. 27, 2000 |
| 181. | 60/258,880 | Jan. 2, 2001 |
| 182. | 60/262,389 | Jan. 19, 2001 |
| 183. | 60/262,359 | Jan. 19, 2001 |
| 184. | 60/264,026 | Jan. 26, 2001 |
| 185. | 60/264,027 | Jan. 26, 2001 |
| 186. | 60/264,282 | Jan. 29, 2001 |

| | application Ser. No. | Filing Date |
|---|---|---|
| 187. | 60/264,257 | Jan. 29, 2001 |
| 188. | 60/266,468 | Feb. 6, 2001 |
| 189. | 60/266,469 | Feb. 6, 2001 |
| 190. | 60/266,863 | Feb. 7, 2001 |
| 191. | 60/267,425 | Feb. 9, 2001 |
| 192. | 60/267,430 | Feb. 9, 2001 |
| 193. | 60/267,426 | Feb. 9, 2001 |
| 194. | 60/267,707 | Feb. 12, 2001 |
| 195. | 60/267,706 | Feb. 12, 2001 |
| 196. | 60/268,366 | Feb. 14, 2001 |
| 197. | 60/268,921 | Feb. 16, 2001 |
| 198. | 60/269,890 | Feb. 21, 2001 |
| 199. | 60/269,891 | Feb. 21, 2001 |
| 200. | 60/269,892 | Feb. 21, 2001 |
| 201. | 60/269,893 | Feb. 21, 2001 |
| 202. | 60/270,122 | Feb. 22, 2001 |
| 203. | 60/270,913 | Feb. 26, 2001 |
| 204. | 60/270,912 | Feb. 26, 2001 |
| 205. | 60/271,724 | Feb. 28, 2001 |
| 206. | 60/271,725 | Feb. 28, 2001 |
| 207. | 60/272,467 | Mar. 2, 2001 |
| 208. | 60/272,783 | Mar. 5, 2001 |
| 209. | 60/273,554 | Mar. 7, 2001 |
| 210. | 60/273,553 | Mar. 7, 2001 |
| 211. | 60/273,552 | Mar. 7, 2001 |
| 212. | 60/227,793 | Aug. 25, 2000 |
| 213. | 60/228,031 | Aug. 25, 2000 |
| 214. | 60/228,028 | Aug. 25, 2000 |
| 215. | 60/228,027 | Aug. 25, 2000 |
| 216. | 60/228,026 | Aug. 25, 2000 |
| 217. | 60/228,038 | Aug. 25, 2000 |
| 218. | 60/228,036 | Aug. 25, 2000 |
| 219. | 60/227,790 | Aug. 25, 2000 |
| 220. | 60/228,039 | Aug. 25, 2000 |
| 221. | 60/228,030 | Aug. 25, 2000 |
| 222. | 60/228,032 | Aug. 25, 2000 |
| 223. | 60/228,149 | Aug. 25, 2000 |
| 224. | 60/228,040 | Aug. 25, 2000 |
| 225. | 60/227,777 | Aug. 25, 2000 |
| 226. | 60/228,037 | Aug. 25, 2000 |
| 227. | 60/227,791 | Aug. 25, 2000 |
| 228. | 60/228,041 | Aug. 25, 2000 |

V. Number 27

Application Ser. No. 10/282,058 listed above is a continuation-in-part of application Ser. No. 09/940,258 filed on Aug. 24, 2001 and application Ser. No. 10/162,726 filed on Jun. 6, 2002.

Through application Ser. Nos. 09/940,258 and 10/162,726, the present application also claims priority under 35 USC §119(e) and/or §120 of the following applications:

| | Filing Date | Appln. No. | |
|---|---|---|---|
| 1. | Sept. 3, 1999 | 09/391,631 | which claims priority to |
| 2. | Sept. 4, 1998 | 60/099,671 | and |
| 3. | Sept. 4, 1998 | 60/099,672 | and |
| 4. | Sept. 11, 1998 | 60/099,933 | and |
| 5. | Sept. 17, 1998 | 60/100,864 | and |
| 6. | Sept. 18, 1998 | 60/101,042 | and |
| 7. | Sept. 24, 1998 | 60/101,682 | and |
| 8. | Sept. 30, 1998 | 60/102,533 | and |
| 9. | Sept. 30, 1998 | 60/102,460 | and |
| 10. | Oct. 5, 1998 | 60/103,116 | and |
| 11. | Oct. 5, 1998 | 60/103,141 | and |
| 12. | Oct. 9, 1998 | 60/103,574 | and |
| 13. | Oct. 13, 1998 | 60/103,907 | and |
| 14. | Oct. 29, 1998 | 60/106,105 | and |
| 15. | Oct. 30, 1998 | 60/106,218 | and |
| 16. | Nov. 6, 1998 | 60/107,282 | and |
| 17. | Nov. 10, 1998 | 60/107,836 | and |
| 18. | Nov. 16, 1998 | 60/108,526 | and |
| 19. | Nov. 17, 1998 | 60/108,901 | and |
| 20. | Nov. 20, 1998 | 60/109,267 | and |
| 21. | Nov. 23, 1998 | 60/109,594 | and |
| 22. | Nov. 30, 1998 | 60/110,263 | and |
| 23. | Dec. 1, 1998 | 60/110,495 | and |
| 24. | Dec. 2, 1998 | 60/110,626 | and |
| 25. | Dec. 3, 1998 | 60/110,701 | and |
| 26. | Dec. 7, 1998 | 60/111,339 | and |
| 27. | Dec. 9, 1998 | 60/111,589 | and |
| 28. | Dec. 14, 1998 | 60/112,096 | and |
| 29. | Dec. 15, 1998 | 60/112,224 | and |
| 30. | Dec. 16, 1998 | 60/112,624 | and |
| 31. | Dec. 17, 1998 | 60/112,862 | and |
| 32. | Jan. 7, 1999 | 60/115,152 | and |
| 33. | Jan. 7, 1999 | 60/115,156 | and |
| 34. | Jan. 8, 1999 | 60/115,365 | and |
| 35. | Jan. 11, 1999 | 60/115,339 | and |
| 36. | Jan. 13, 1999 | 60/115,847 | and |
| 37. | Jan. 21, 1999 | 60/116,674 | and |
| 38. | Jan. 22, 1999 | 60/116,962 | and |
| 39. | Feb. 18, 1999 | 60/120,583 | and |
| 40. | Feb. 22, 1999 | 60/121,072 | and |
| 41. | Mar. 2, 1999 | 60/122,568 | and |
| 42. | Mar. 12, 1999 | 60/123,941 | |

|     | Filing Date | Appln. No. | |
| --- | --- | --- | --- |
| 43. | Oct. 5, 1999 | 09/413,198 | which claims priority to |
| 44. | Oct. 5, 1998 | 60/103,116 | and |
| 45. | Oct. 5, 1998 | 60/103,141 | and |
| 46. | Oct. 6, 1998 | 60/103,215 | and |
| 47. | Oct. 8, 1998 | 60/103,554 | and |
| 48. | Oct. 9, 1998 | 60/103,574 | and |
| 49. | Oct. 13, 1998 | 60/103,907 | and |
| 50. | Oct. 14, 1998 | 60/104,268 | and |
| 51. | Oct. 16, 1998 | 60/104,680 | and |
| 52. | Oct. 19, 1998 | 60/104,828 | and |
| 53. | Oct. 20, 1998 | 60/105,008 | and |
| 54. | Oct. 21, 1998 | 60/105,142 | and |
| 55. | Oct. 22, 1998 | 60/105,533 | and |
| 56. | Oct. 26, 1998 | 60/105,571 | and |
| 57. | Oct. 27, 1998 | 60/105,815 | and |
| 58. | Oct. 29, 1998 | 60/106,105 | and |
| 59. | Oct. 30, 1998 | 60/106,218 | |
| 60. | Oct. 5, 1999 | 09/412,922 | which claims priority to |
| 61. | Oct. 5, 1998 | 60/103,116 | and |
| 62. | Oct. 5, 1998 | 60/103,141 | and |
| 63. | Oct. 6, 1998 | 60/103,215 | and |
| 64. | Oct. 8, 1998 | 60/103,554 | and |
| 65. | Oct. 9, 1998 | 60/103,574 | and |
| 66. | Oct. 13, 1998 | 60/103,907 | and |
| 67. | Oct. 14, 1998 | 60/104,268 | and |
| 68. | Oct. 16, 1998 | 60/104,680 | and |
| 69. | Oct. 19, 1998 | 60/104,828 | and |
| 70. | Oct. 20, 1998 | 60/105,008 | and |
| 71. | Oct. 21, 1998 | 60/105,142 | and |
| 72. | Oct. 22, 1998 | 60/105,533 | and |
| 73. | Oct. 26, 1998 | 60/105,571 | and |
| 74. | Oct. 27, 1998 | 60/105,815 | and |
| 75. | Oct. 29, 1998 | 60/106,105 | and |
| 76. | Oct. 30, 1998 | 60/106,218 | and |
| 77. | Nov. 2, 1998 | 60/106,685 | and |
| 78. | Nov. 6, 1998 | 60/107,282 | and |
| 79. | Nov. 9, 1998 | 60/107,720 | and |
| 80. | Nov. 9, 1998 | 60/107,719 | and |
| 81. | Nov. 10, 1998 | 60/107,836 | and |
| 82. | Nov. 12, 1998 | 60/108,190 | and |
| 83. | Nov. 16, 1998 | 60/108,526 | and |
| 84. | Nov. 17, 1998 | 60/108,901 | and |
| 85. | Nov. 19, 1998 | 60/109,124 | and |
| 86. | Nov. 19, 1998 | 60/109,127 | and |
| 87. | Nov. 20, 1998 | 60/109,267 | and |
| 88. | Nov. 23, 1998 | 60/109,594 | and |
| 89. | Nov. 25, 1998 | 60/110,053 | and |
| 90. | Nov. 25, 1998 | 60/110,050 | and |
| 91. | Nov. 27, 1998 | 60/110,158 | and |
| 92. | Nov. 30, 1998 | 60/110,263 | and |
| 93. | Dec. 1, 1998 | 60/110,495 | and |
| 94. | Dec. 2, 1998 | 60/110,626 | and |
| 95. | Dec. 3, 1998 | 60/110,701 | and |
| 96. | Dec. 7, 1998 | 60/111,339 | and |
| 97. | Dec. 9, 1998 | 60/111,589 | and |
| 98. | Dec. 10, 1998 | 60/111,782 | and |
| 99. | Dec. 11, 1998 | 60/111,812 | and |
| 100. | Dec. 14, 1998 | 60/112,096 | and |
| 101. | Dec. 15, 1998 | 60/112,224 | and |
| 102. | Dec. 16, 1998 | 60/112,624 | and |
| 103. | Dec. 17, 1998 | 60/112,862 | and |
| 104. | Dec. 18, 1998 | 60/112,912 | and |
| 105. | Dec. 21, 1998 | 60/113,248 | and |
| 106. | Dec. 22, 1998 | 60/113,522 | and |
| 107. | Dec. 23, 1998 | 60/113,826 | and |
| 108. | Dec. 28, 1998 | 60/113,998 | and |
| 109. | Dec. 29, 1998 | 60/114,384 | and |
| 110. | Dec. 30, 1998 | 60/114,455 | and |
| 111. | Jan. 4, 1999 | 60/114,740 | and |
| 112. | Jan. 6, 1999 | 60/114,866 | and |
| 113. | Jan. 7, 1999 | 60/115,153 | and |
| 114. | Jan. 7, 1999 | 60/115,152 | and |
| 115. | Jan. 7, 1999 | 60/115,151 | and |
| 116. | Jan. 7, 1999 | 60/115,155 | and |
| 117. | Jan. 7, 1999 | 60/115,156 | and |
| 118. | Jan. 7, 1999 | 60/115,154 | and |
| 119. | Jan. 8, 1999 | 60/115,364 | and |
| 120. | Jan. 8, 1999 | 60/115,365 | and |
| 121. | Jan. 11, 1999 | 60/115,339 | and |
| 122. | Jan. 12, 1999 | 60/115,518 | and |
| 123. | Jan. 13, 1999 | 60/115,847 | and |
| 124. | Jan. 14, 1999 | 60/115,905 | and |
| 125. | Jan. 15, 1999 | 60/116,383 | and |
| 126. | Jan. 15, 1999 | 60/116,384 | and |
| 127. | Jan. 19, 1999 | 60/116,329 | and |
| 128. | Jan. 19, 1999 | 60/116,340 | and |
| 129. | Jan. 21, 1999 | 60/116,674 | and |
| 130. | Jan. 21, 1999 | 60/116,672 | and |
| 131. | Jan. 22, 1999 | 60/116,960 | and |
| 132. | Jan. 22, 1999 | 60/116,962 | and |
| 133. | Jan. 28, 1999 | 60/117,756 | and |
| 134. | Feb. 3, 1999 | 60/118,672 | and |
| 135. | Feb. 4, 1999 | 60/118,808 | and |
| 136. | Feb. 5, 1999 | 60/118,778 | and |
| 137. | Feb. 8, 1999 | 60/119,029 | and |
| 138. | Feb. 9, 1999 | 60/119,332 | and |
| 139. | Feb. 10, 1999 | 60/119,462 | and |
| 140. | Feb. 12, 1999 | 60/119,922 | and |
| 141. | Feb. 16, 1999 | 60/120,196 | and |
| 142. | Feb. 16, 1999 | 60/120,198 | and |
| 143. | Feb. 18, 1999 | 60/120,583 | and |
| 144. | Feb. 22, 1999 | 60/121,072 | and |
| 145. | Feb. 23, 1999 | 60/121,334 | and |
| 146. | Feb. 24, 1999 | 60/121,470 | and |
| 147. | Feb. 25, 1999 | 60/121,704 | and |
| 148. | Feb. 26, 1999 | 60/122,107 | and |
| 149. | Mar. 1, 1999 | 60/122,266 | and |
| 150. | Mar. 2, 1999 | 60/122,568 | and |
| 151. | Mar. 3, 1999 | 60/122,611 | and |
| 152. | Mar. 4, 1999 | 60/121,775 | and |
| 153. | Mar. 5, 1999 | 60/123,534 | and |
| 154. | Mar. 9, 1999 | 60/123,680 | and |
| 155. | Mar. 10, 1999 | 60/123,715 | and |
| 156. | Mar. 10, 1999 | 60/123,726 | and |
| 157. | Mar. 11, 1999 | 60/124,263 | and |
| 158. | Mar. 12, 1999 | 60/123,941 | |
| 159. | Oct. 28, 1999 | 09/428,944 | which claims priority to |
| 160. | Nov. 2, 1998 | 60/106,685 | and |
| 161. | Nov. 6, 1998 | 60/107,282 | and |
| 162. | Nov. 9, 1998 | 60/107,720 | and |
| 163. | Nov. 9, 1998 | 60/107,719 | and |
| 164. | Nov. 10, 1998 | 60/107,836 | and |
| 165. | Nov. 12, 1998 | 60/108,190 | and |
| 166. | Nov. 16, 1998 | 60/108,526 | and |
| 167. | Nov. 17, 1998 | 60/108,901 | and |
| 168. | Nov. 19, 1998 | 60/109,124 | and |
| 169. | Nov. 19, 1998 | 60/109,127 | and |
| 170. | Nov. 20, 1998 | 60/109,267 | and |
| 171. | Nov. 23, 1998 | 60/109,594 | and |
| 172. | Nov. 25, 1998 | 60/110,053 | and |
| 173. | Nov. 25, 1998 | 60/110,050 | and |
| 174. | Nov. 27, 1998 | 60/110,158 | and |
| 175. | Nov. 30, 1998 | 60/110,263 | |
| 176. | Dec. 1, 1999 | 09/451,320 | which claims priority to |
| 177. | Dec. 1, 1998 | 60/110,495 | and |
| 178. | Dec. 2, 1998 | 60/110,626 | and |
| 179. | Dec. 3, 1998 | 60/110,701 | and |
| 180. | Dec. 7, 1998 | 60/111,339 | and |
| 181. | Dec. 9, 1998 | 60/111,589 | and |
| 182. | Dec. 10, 1998 | 60/111,782 | and |
| 183. | Dec. 11, 1998 | 60/111,812 | and |
| 184. | Dec. 14, 1998 | 60/112,096 | and |
| 185. | Dec. 15, 1998 | 60/112,224 | and |
| 186. | Dec. 16, 1998 | 60/112,624 | and |
| 187. | Dec. 17, 1998 | 60/112,862 | and |
| 188. | Dec. 18, 1998 | 60/112,912 | and |
| 189. | Dec. 21, 1998 | 60/113,248 | and |
| 190. | Dec. 22, 1998 | 60/113,522 | and |

-continued

|  | Filing Date | Appln. No. |  |
|---|---|---|---|
| 191. | Dec. 23, 1998 | 60/113,826 and |  |
| 192. | Dec. 28, 1998 | 60/113,998 and |  |
| 193. | Dec. 29, 1998 | 60/114,384 and |  |
| 194. | Dec. 30, 1998 | 60/114,455 and |  |
| 195. | Jan. 7, 1999 | 60/115,153 and |  |
| 196. | Jan. 7, 1999 | 60/115,152 and |  |
| 197. | Jan. 7, 1999 | 60/115,151 and |  |
| 198. | Jan. 7, 1999 | 60/115,155 and |  |
| 199. | Jan. 7, 1999 | 60/115,156 and |  |
| 200. | Jan. 8, 1999 | 60/115,364 and |  |
| 201. | Jan. 22, 1999 | 60/116,960 |  |
| 202. | Feb. 3, 2000 | 09/497,191 which claims priority to |  |
| 203. | Feb. 3, 1999 | 60/118,672 and |  |
| 204. | Feb. 4, 1999 | 60/118,808 and |  |
| 205. | Feb. 5, 1999 | 60/118,778 and |  |
| 206. | Feb. 8, 1999 | 60/119,029 and |  |
| 207. | Feb. 9, 1999 | 60/119,332 and |  |
| 208. | Feb. 10, 1999 | 60/119,462 and |  |
| 209. | Feb. 12, 1999 | 60/119,922 and |  |
| 210. | Feb. 16, 1999 | 60/120,196 and |  |
| 211. | Feb. 16, 1999 | 60/120,198 and |  |
| 212. | Feb. 18, 1999 | 60/120,583 and |  |
| 213. | Feb. 22, 1999 | 60/121,072 and |  |
| 214. | Feb. 23, 1999 | 60/121,334 and |  |
| 215. | Feb. 24, 1999 | 60/121,470 and |  |
| 216. | Feb. 25, 1999 | 60/121,704 and |  |
| 217. | Feb. 26, 1999 | 60/122,107 |  |
| 218. | Mar. 1, 2000 | 09/517,537 which claims priority to |  |
| 219. | Mar. 1, 1999 | 60/122,266 and |  |
| 220. | Mar. 2, 1999 | 60/122,568 and |  |
| 221. | Mar. 3, 1999 | 60/122,611 and |  |
| 222. | Mar. 4, 1999 | 60/121,775 and |  |
| 223. | Mar. 5, 1999 | 60/123,534 and |  |
| 224. | Mar. 9, 1999 | 60/123,680 and |  |
| 225. | Mar. 10, 1999 | 60/123,715 and |  |
| 226. | Mar. 10, 1999 | 60/123,726 and |  |
| 227. | Mar. 11, 1999 | 60/124,263 and |  |
| 228. | Mar. 12, 1999 | 60/123,941 |  |
| 229. | Aug. 11, 2000 | 09/637,565 which claims priority to |  |
| 230. | Aug. 12, 1999 | 60/148,342 |  |
| 231. | Aug. 11, 2000 | 09/637,564 which claims priority to |  |
| 232. | Aug. 12, 1999 | 60/148,340 |  |
| 233. | Aug. 11, 2000 | 09/637,792 which claims priority to |  |
| 234. | Aug. 12, 1999 | 60/148,337 |  |
| 235. | Feb. 23, 2001 | 09/790,663 which claims priority to |  |
| 236. | Feb. 25, 2000 | 60/185,140 and |  |
| 237. | Feb. 28, 2000 | 60/185,398 and |  |
| 238. | Feb. 29, 2000 | 60/185,750 |  |
| 239. | Mar. 1, 2001 | 09/795,359 which claims priority to |  |
| 240. | Mar. 1, 2000 | 60/186,277 and |  |
| 241. | Mar. 3, 2000 | 60/186,670 and |  |
| 242. | Mar. 7, 2000 | 60/187,379 and |  |
| 243. | Mar. 9, 2000 | 60/187,985 and |  |
| 244. | Mar. 10, 2000 | 60/188,174 and |  |
| 245. | Mar. 13, 2000 | 60/188,687 and |  |
| 246. | Mar. 15, 2000 | 60/189,460 and |  |
| 247. | Mar. 16, 2000 | 60/189,958 and |  |
| 248. | Mar. 17, 2000 | 60/189,965 and |  |
| 249. | Mar. 20, 2000 | 60/190,090 and |  |
| 250. | Mar. 23, 2000 | 60/191,549 and |  |
| 251. | Mar. 24, 2000 | 60/191,826 and |  |
| 252. | Mar. 27, 2000 | 60/192,420 and |  |
| 253. | Mar. 29, 2000 | 60/192,855 and |  |
| 254. | Mar. 30, 2000 | 60/193,243 and |  |
| 255. | Mar. 31, 2000 | 60/193,469 |  |
| 256. | Mar. 16, 2001 | 09/804,470 which claims priority to |  |
| 257. | Mar. 16, 2000 | 60/190,120 and |  |
| 258. | Mar. 16, 2000 | 60/189,947 and |  |

-continued

|  | Filing Date | Appln. No. |  |
|---|---|---|---|
| 259. | Mar. 16, 2000 | 60/189,948 and |  |
| 260. | Mar. 16, 2000 | 60/190,121 |  |
| 261. | Apr. 4, 2001 | 09/824,790 which claims priority to |  |
| 262. | Apr. 6, 2000 | 60/194,884 and |  |
| 263. | Apr. 4, 2000 | 60/194,385 and |  |
| 264. | Apr. 5, 2000 | 60/194,682 and |  |
| 265. | Apr. 5, 2000 | 60/194,698 and |  |
| 266. | Apr. 7, 2000 | 60/195,258 and |  |
| 267. | Apr. 11, 2000 | 60/196,168 and |  |
| 268. | Apr. 12, 2000 | 60/196,483 and |  |
| 269. | Apr. 14, 2000 | 60/197,397 and |  |
| 270. | Apr. 17, 2000 | 60/198,268 and |  |
| 271. | Apr. 19, 2000 | 60/198,400 and |  |
| 272. | Apr. 20, 2000 | 60/198,629 and |  |
| 273. | Apr. 21, 2000 | 60/198,765 and |  |
| 274. | Apr. 24, 2000 | 60/199,123 |  |
| 275. | Apr. 11, 2001 | 09/832,192 which claims priority to |  |
| 276. | Apr. 12, 2000 | 60/196,212 and |  |
| 277. | Apr. 11, 2000 | 60/196,211 and |  |
| 278. | Apr. 14, 2000 | 60/197,869 and |  |
| 279. | Apr. 13, 2000 | 60/196,213 and |  |
| 280. | Apr. 17, 2000 | 60/197,870 and |  |
| 281. | Apr. 17, 2000 | 60/197,871 and |  |
| 282. | Apr. 28, 2000 | 60/200,373 and |  |
| 283. | Apr. 28, 2000 | 60/200,773 |  |
| 284. | Apr. 26, 2001 | 09/842,246 which claims priority to |  |
| 285. | Apr. 26, 2000 | 60/200,034 |  |
| 286. | May 1, 2001 | 09/845,208 which claims priority to |  |
| 287. | May 1, 2000 | 60/200,763 and |  |
| 288. | May 1, 2000 | 60/201,016 and |  |
| 289. | May 1, 2000 | 60/200,762 and |  |
| 290. | May 1, 2000 | 60/200,761 and |  |
| 291. | May 11, 2000 | 60/203,671 and |  |
| 292. | May 11, 2000 | 60/203,672 and |  |
| 293. | May 11, 2000 | 60/203,669 and |  |
| 294. | May 11, 2000 | 60/203,622 |  |
| 295. | May 1, 2001 | 09/845,318 which claims priority to |  |
| 296. | May 1, 2000 | 60/201,018 and |  |
| 297. | May 17, 2000 | 60/205,325 |  |
| 298. | May 1, 2001 | 09/845,209 which claims priority to |  |
| 299. | May 1, 2000 | 60/201,017 and |  |
| 300. | May 17, 2000 | 60/205,233 |  |
| 301. | Jun. 1, 2001 | 09/870,646 which claims priority to |  |
| 302. | Jun. 1, 2000 | 60/208,648 |  |
| 303. | Jun. 1, 2001 | 09/870,476 which claims priority to |  |
| 304. | Jun. 1, 2000 | 60/208,324 and |  |
| 305. | Jun. 5, 2000 | 60/208,919 and |  |
| 306. | Jun. 5, 2000 | 60/208,917 and |  |
| 307. | Jun. 8, 2000 | 60/210,008 |  |
| 308. | Jun. 1, 2001 | 09/870,664 which claims priority to |  |
| 309. | Jun. 1, 2000 | 60/208,312 and |  |
| 310. | Jun. 5, 2000 | 60/208,918 and |  |
| 311. | Jun. 5, 2000 | 60/208,920 and |  |
| 312. | Jun. 8, 2000 | 60/210,006 and |  |
| 313. | Jun. 9, 2000 | 60/210,564 and |  |
| 314. | Jun. 13, 2000 | 60/211,214 and |  |
| 315. | Jun. 22, 2000 | 60/213,249 and |  |
| 316. | Jun. 27, 2000 | 60/214,535 and |  |
| 317. | Jun. 28, 2000 | 60/214,799 and |  |
| 318. | Jun. 30, 2000 | 60/215,127 |  |
| 319. | Jun. 13, 2001 | 09/878,974 which claims priority to |  |
| 320. | Jun. 13, 2000 | 60/211,210 and |  |
| 321. | Jun. 15, 2000 | 60/211,539 and |  |
| 322. | Jun. 19, 2000 | 60/212,414 and |  |
| 323. | Jun. 20, 2000 | 60/212,677 and |  |
| 324. | Jun. 20, 2000 | 60/212,713 and |  |

-continued

| | Filing Date | Appln. No. | |
|---|---|---|---|
| 325. | Jun. 22, 2000 | 60/213,195 | and |
| 326. | Jun. 22, 2000 | 60/213,221 | and |
| 327. | Jun. 27, 2000 | 60/214,760 | |
| 328. | Jul. 12, 2001 | 09/902,613 | which claims priority to |
| 329. | Aug. 1, 2000 | 60/223,114 | |
| 330. | Jul. 13, 2001 | 09/903,497 | which claims priority to |
| 331. | Jul. 13, 2000 | 60/217,846 | and |
| 332. | Aug. 3, 2000 | 60/223,099 | |
| 333. | Aug. 1, 2001 | 09/918,556 | which claims priority to |
| 334. | Aug. 1, 2000 | 60/223,115 | |
| 335. | Aug. 3, 2001 | 09/920,626 | which claims priority to |
| 336. | Aug. 3, 2000 | 60/223,100 | and |
| 337. | Aug. 18, 2000 | 60/226,325 | and |
| 338. | Aug. 31, 2000 | 60/237,361 | |
| 339. | Aug. 7, 2001 | 09/922,661 | which claims priority to |
| 340. | Aug. 7, 2000 | 60/223,329 | and |
| 341. | Aug. 31, 2000 | 60/229,521 | and |
| 342. | Aug. 18, 2000 | 60/226,381 | |
| 343. | Aug. 9, 2001 | 09/924,702 | which claims priority to |
| 344. | Aug. 9, 2000 | 60/224,390 | |
| 345. | Aug. 16, 2001 | 09/930,244 | which claims priority to |
| 346. | Aug. 31, 2000 | 60/237,362 | and |
| 347. | Aug. 16, 2000 | 60/225,848 | |
| 348. | Aug. 16, 2001 | 09/930,231 | which claims priority to |
| 349. | Aug. 16, 2000 | 60/225,849 | |
| 350. | Aug. 16, 2001 | 09/930,223 | which claims priority to |
| 351. | Aug. 16, 2000 | 60/225,847 | |
| 352. | Aug. 20, 2001 | 09/931,911 | which claims priority to |
| 353. | Aug. 31, 2000 | 60/229,520 | |
| 354. | Feb. 26, 2002 | 10/082,096 | which is a 1.53(b) continuation of |
| 355. | Mar. 1, 2001 | 09/795,347 | which claims priority to |
| 356. | Mar. 2, 2000 | 60/186,390 | and |
| 357. | Mar. 1, 2000 | 60/186,283 | and |
| 358. | Mar. 1, 2000 | 60/186,296 | and |
| 359. | Mar. 2, 2000 | 60/187,178 | and |
| 360. | Mar. 2, 2000 | 60/186,386 | and |
| 361. | Mar. 2, 2000 | 60/186,387 | and |
| 362. | Mar. 3, 2000 | 60/186,748 | and |
| 363. | Mar. 3, 2000 | 60/186,669 | and |
| 364. | Mar. 7, 2000 | 60/187,378 | and |
| 365. | Mar. 8, 2000 | 60/187,896 | and |
| 366. | Mar. 8, 2000 | 60/187,888 | and |
| 367. | Mar. 10, 2000 | 60/188,187 | and |
| 368. | Mar. 10, 2000 | 60/188,186 | and |
| 369. | Mar. 10, 2000 | 60/188,185 | and |
| 370. | Mar. 10, 2000 | 60/188,175 | and |
| 371. | Mar. 14, 2000 | 60/189,080 | and |
| 372. | Mar. 14, 2000 | 60/189,052 | and |
| 373. | Mar. 15, 2000 | 60/189,461 | and |
| 374. | Mar. 15, 2000 | 60/189,462 | and |
| 375. | Mar. 16, 2000 | 60/189,953 | and |
| 376. | Mar. 16, 2000 | 60/189,959 | and |
| 377. | Mar. 20, 2000 | 60/190,069 | and |
| 378. | Mar. 20, 2000 | 60/190,070 | and |
| 379. | Mar. 20, 2000 | 60/190,545 | and |
| 380. | Mar. 20, 2000 | 60/190,089 | and |
| 381. | Mar. 22, 2000 | 60/191,084 | and |
| 382. | Mar. 22, 2000 | 60/191,097 | and |
| 383. | Mar. 23, 2000 | 60/191,543 | and |
| 384. | Mar. 23, 2000 | 60/191,545 | and |
| 385. | Mar. 24, 2000 | 60/191,823 | and |
| 386. | Mar. 24, 2000 | 60/191,825 | and |
| 387. | Mar. 27, 2000 | 60/192,421 | and |
| 388. | Mar. 27, 2000 | 60/192,308 | and |
| 389. | Mar. 29, 2000 | 60/192,940 | and |
| 390. | Mar. 29, 2000 | 60/192,941 | and |
| 391. | Mar. 30, 2000 | 60/193,244 | and |
| 392. | Mar. 30, 2000 | 60/193,245 | and |
| 393. | Mar. 31, 2000 | 60/193,453 | and |
| 394. | Mar. 31, 2000 | 60/193,455 | |
| 395. | Feb. 28, 2002 | 10/084,376 | which is a 1.53(b) continuation of |
| 396. | Aug. 9, 2001 | 09/924,701 | which claims priority to |
| 397. | Aug. 9, 2000 | 60/224,391 | |
| 398. | Mar. 4, 2002 | 10/086,239 | which is a 1.53(b) continuation of |
| 399. | May 1, 2001 | 09/845,206 | which claims priority to |
| 400. | May 2, 2000 | 60/201,275 | and |
| 401. | May 1, 2000 | 60/200,879 | and |
| 402. | May 2, 2000 | 60/201,305 | and |
| 403. | May 4, 2000 | 60/201,740 | and |
| 404. | May 4, 2000 | 60/201,750 | and |
| 405. | May 5, 2000 | 60/202,112 | and |
| 406. | May 5, 2000 | 60/202,180 | and |
| 407. | May 9, 2000 | 60/202,914 | and |
| 408. | May 9, 2000 | 60/202,636 | and |
| 409. | May 9, 2000 | 60/202,919 | and |
| 410. | May 9, 2000 | 60/202,634 | and |
| 411. | May 10, 2000 | 60/202,968 | and |
| 412. | May 10, 2000 | 60/202,963 | and |
| 413. | May 11, 2000 | 60/203,457 | and |
| 414. | May 11, 2000 | 60/203,279 | and |
| 415. | May 12, 2000 | 60/203,916 | and |
| 416. | May 12, 2000 | 60/203,915 | and |
| 417. | May 15, 2000 | 60/204,388 | and |
| 418. | May 15, 2000 | 60/204,122 | and |
| 419. | May 16, 2000 | 60/204,568 | and |
| 420. | May 16, 2000 | 60/204,569 | and |
| 421. | May 17, 2000 | 60/204,830 | and |
| 422. | May 17, 2000 | 60/204,829 | and |
| 423. | May 18, 2000 | 60/205,201 | and |
| 424. | May 18, 2000 | 60/205,058 | and |
| 425. | May 19, 2000 | 60/205,242 | and |
| 426. | May 19, 2000 | 60/205,243 | and |
| 427. | May 22, 2000 | 60/205,572 | and |
| 428. | May 22, 2000 | 60/205,576 | and |
| 429. | May 23, 2000 | 60/206,316 | and |
| 430. | May 23, 2000 | 60/206,319 | and |
| 431. | May 24, 2000 | 60/206,553 | and |
| 432. | May 24, 2000 | 60/206,545 | and |
| 433. | May 26, 2000 | 60/207,367 | and |
| 434. | May 26, 2000 | 60/207,243 | and |
| 435. | May 26, 2000 | 60/207,239 | and |
| 436. | May 26, 2000 | 60/207,354 | and |
| 437. | May 30, 2000 | 60/207,452 | and |
| 438. | May 30, 2000 | 60/207,329 | |
| 439. | Mar. 7, 2002 | 10/091,527 | which is a 1.53(b) continuation of |
| 440. | Apr. 26, 2001 | 09/842,088 | which claims priority to |
| 441. | Apr. 26, 2000 | 60/200,031 | |
| 442. | Mar. 13, 2002 | 10/095,465 | which is a 1.53(b) continuation of |
| 443. | Apr. 4, 2001 | 09/824,882 | which claims priority to |
| 444. | Apr. 4, 2000 | 60/194,404 | and |
| 445. | Apr. 4, 2000 | 60/194,398 | and |
| 446. | Apr. 5, 2000 | 60/194,683 | and |
| 447. | Apr. 5, 2000 | 60/194,697 | and |
| 448. | Apr. 6, 2000 | 60/194,874 | and |
| 449. | Apr. 6, 2000 | 60/194,872 | and |
| 450. | Apr. 6, 2000 | 60/194,885 | and |
| 451. | Apr. 6, 2000 | 60/195,045 | and |
| 452. | Apr. 7, 2000 | 60/195,283 | and |
| 453. | Apr. 7, 2000 | 60/195,257 | and |
| 454. | Apr. 11, 2000 | 60/196,169 | and |
| 455. | Apr. 11, 2000 | 60/196,089 | and |
| 456. | Apr. 12, 2000 | 60/196,487 | and |

-continued

| | Filing Date | Appln. No. | |
|---|---|---|---|
| 457. | Apr. 12, 2000 | 60/196,289 | and |
| 458. | Apr. 12, 2000 | 60/196,485 | and |
| 459. | Apr. 12, 2000 | 60/196,486 | and |
| 460. | Apr. 17, 2000 | 60/197,687 | and |
| 461. | Apr. 17, 2000 | 60/197,678 | and |
| 462. | Apr. 17, 2000 | 60/198,133 | and |
| 463. | Apr. 17, 2000 | 60/197,671 | and |
| 464. | Apr. 19, 2000 | 60/198,386 | and |
| 465. | Apr. 19, 2000 | 60/198,373 | and |
| 466. | Apr. 20, 2000 | 60/198,619 | and |
| 467. | Apr. 20, 2000 | 60/198,623 | and |
| 468. | Apr. 21, 2000 | 60/198,767 | and |
| 469. | Apr. 21, 2000 | 60/198,763 | and |
| 470. | Apr. 24, 2000 | 60/199,124 | and |
| 471. | Apr. 24, 2000 | 60/199,122 | and |
| 472. | Apr. 26, 2000 | 60/199,828 | and |
| 473. | Apr. 26, 2000 | 60/199,818 | and |
| 474. | Apr. 27, 2000 | 60/200,103 | and |
| 475. | Apr. 27, 2000 | 60/200,102 | |
| 476. | Mar. 15, 2002 | 10/097,600 | which is a 1.53(b) continuation of |
| 477. | Apr. 12, 2001 | 09/832,934 | which is a 1.53(b) continuation of |
| 478. | Aug. 11, 2000 | 09/637,820 | which claims priority to |
| 479. | Aug. 12, 1999 | 60/148,347 | |
| 480. | Mar. 15, 2002 | 10/097,295 | which is a 1.53(b) continuation of |
| 481. | Jun. 15, 2001 | 09/881,096 | which claims priority to |
| 482. | Jun. 15, 2000 | 60/211,538 | and |
| 483. | Jun. 19, 2000 | 60/212,623 | and |
| 484. | Jun. 20, 2000 | 60/212,727 | and |
| 485. | Jun. 22, 2000 | 60/213,270 | and |
| 486. | Jun. 27, 2000 | 60/214,524 | |
| 487. | Mar. 18, 2002 | | which is a 1.53(b) continuation of |
| 488. | Jun. 1, 2001 | 09/870,699 | which claims priority to |
| 489. | Jun. 1, 2000 | 60/208,421 | |
| 490. | Mar. 18, 2002 | 10/098,506 | which is a 1.53(b) continuation of |
| 491. | Jun. 1, 2001 | 09/870,713 | which claims priority to |
| 492. | Jun. 2, 2000 | 60/209,338 | |
| 493. | Mar. 25, 2002 | 10/103,845 | which is a 1.53(b) continuation of |
| 494. | Jul. 5, 2001 | 09/898,063 | which claims priority to |
| 495. | Jul. 5, 2000 | 60/216,362 | and |
| 496. | Jul. 11, 2000 | 60/217,384 | and |
| 497. | Jul. 18, 2000 | 60/219,033 | and |
| 498. | Jul. 25, 2000 | 60/220,811 | and |
| 499. | Jul. 25, 2000 | 60/220,652 | |
| 500. | Mar. 27, 2002 | 10/106,718 | which is a 1.53(b) continuation of |
| 501. | Jul. 5, 2001 | 09/898,064 | which claims priority to |
| 502. | Jul. 5, 2000 | 60/216,361 | and |
| 503. | Jul. 11, 2000 | 60/217,476 | and |
| 504. | Jul. 18, 2000 | 60/219,004 | and |
| 505. | Jul. 25, 2000 | 60/220,647 | and |
| 506. | Jul. 25, 2000 | 60/220,484 | |
| 507. | Apr. 1, 2002 | | which is a 1.53(b) continuation of |
| 508. | Jul. 12, 2001 | 09/902,614 | which claims priority to |
| 509. | Jul. 12, 2000 | 60/218,548 | and |
| 510. | Aug. 3, 2000 | 60/223,116 | |
| 511. | Apr. 10, 2002 | | which is a 1.53(b) continuation of |
| 512. | Aug. 16, 2001 | 09/930,214 | which claims priority to |
| 513. | Aug. 31, 2000 | 60/229,520 | and |
| 514. | Aug. 16, 2000 | 60/225,850 | |

-continued

| | Filing Date | Appln. No. | |
|---|---|---|---|
| 515. | Apr. 17, 2002 | | which is a 1.53(b) continuation of |
| 516. | Aug. 3, 2001 | 09/921,135 | which claims priority to |
| 517. | Aug. 3, 2000 | 60/223,101 | and |
| 518. | Aug. 31, 2000 | 60/229,519 | and |
| 519. | Aug. 18, 2000 | 60/226,323 | |
| 520. | Apr. 17, 2002 | | which is a 1.53(b) continuation of |
| 521. | Jul. 11, 2001 | 09/902,093 | which claims priority to |
| 522. | Jul. 11, 2000 | 60/217,385 | and |
| 523. | Jul. 18, 2000 | 60/219,021 | and |
| 524. | Jul. 25, 2000 | 60/220,814 | and |
| 525. | Aug. 14, 2000 | 60/224,516 | and |
| 526. | Aug. 15, 2000 | 60/225,302 | and |
| 527. | Aug. 21, 2000 | 60/226,725 | and |
| 528. | Aug. 23, 2000 | 60/227,026 | and |
| 529. | Aug. 30, 2000 | 60/228,897 | |
| 530. | Apr. 17, 2002 | | which is a 1.53(b) continuation of |
| 531. | Jul. 13, 2001 | 09/903,988 | which claims priority to |
| 532. | Jul. 14, 2000 | 60/218,566 | and |
| 533. | Aug. 3, 2000 | 60/223,098 | |
| 534. | Apr. 17, 2002 | | which is a 1.53(b) continuation of |
| 535. | Aug. 14, 2001 | 09/928,372 | which claims priority to |
| 536. | Aug. 14, 2000 | 60/224,517 | and |
| 537. | Aug. 15, 2000 | 60/225,303 | and |
| 538. | Aug. 21, 2000 | 60/226,452 | and |
| 539. | Aug. 23, 2000 | 60/227,024 | and |
| 540. | Aug. 30, 2000 | 60/228,898 | |
| 541. | Apr. 18, 2002 | | which is a 1.53(b) continuation of |
| 542. | Aug. 17, 2001 | 09/931,043 | which claims priority to |
| 543. | Aug. 18, 2000 | 60/226,324 | |
| 544. | Apr. 29, 2002 | | which is a 1.53(b) continuation of |
| 545. | Jan. 31, 2001 | 09/774,340 | |
| 546. | Apr. 29, 2002 | | which is a 1.53(b) continuation of |
| 547. | Oct. 19, 2000 | 09/691,039 | |
| 548. | Apr. 29, 2002 | | which is a 1.53(b) continuation of |
| 549. | Dec. 21, 2000 | 09/741,043 | |
| 550. | Apr. 29, 2002 | | which is a 1.53(b) continuation of |
| 551. | Oct. 19, 2000 | 09/691,045 | |
| 552. | Apr. 29, 2002 | | which is a 1.53(b) continuation of |
| 553. | Oct. 19, 2000 | 09/691,019 | |
| 554. | Apr. 29, 2002 | | which is a 1.53(b) continuation of |
| 555. | Jun. 1, 2001 | 09/870,675 | which claims priority to |
| 556. | Jun. 2, 2000 | 60/208,649 | |
| 557. | May 6, 2002 | | 53(b) continuation of |
| 558. | Jan. 4, 2000 | 09/478,081 | which claims priority to |
| 559. | Jan. 4, 1999 | 60/114,740 | and |
| 560. | Jan. 6, 1999 | 60/114,866 | and |
| 561. | Jan. 7, 1999 | 60/115,154 | and |
| 562. | Jan. 8, 1999 | 60/115,365 | and |
| 563. | Jan. 11, 1999 | 60/115,339 | and |
| 564. | Jan. 12, 1999 | 60/115,518 | and |
| 565. | Jan. 13, 1999 | 60/115,847 | and |
| 566. | Jan. 14, 1999 | 60/115,905 | and |
| 567. | Jan. 15, 1999 | 60/116,383 | and |
| 568. | Jan. 15, 1999 | 60/116,384 | and |
| 569. | Jan. 19, 1999 | 60/116,329 | and |
| 570. | Jan. 19, 1999 | 60/116,340 | and |
| 571. | Jan. 21, 1999 | 60/116,674 | and |

-continued

| | Filing Date | Appln. No. |
|---|---|---|
| 572. | Jan. 21, 1999 | 60/116,672 and |
| 573. | Jan. 22, 1999 | 60/116,962 and |
| 574. | Jan. 28, 1999 | 60/117,756 |
| 575. | Aug. 25, 2000 | 60/228,025 |
| 576. | Aug. 25, 2000 | 60/227,781 |
| 577. | Aug. 25, 2000 | 60/227,783 |
| 578. | Aug. 25, 2000 | 60/227,731 |
| 579. | Aug. 25, 2000 | 60/227,732 |
| 580. | Aug. 25, 2000 | 60/227,729 |
| 581. | Aug. 25, 2000 | 60/228,167 |
| 582. | Aug. 25, 2000 | 60/227,734 |
| 583. | Aug. 25, 2000 | 60/227,792 |
| 584. | Aug. 25, 2000 | 60/227,733 |
| 585. | Aug. 25, 2000 | 60/227,730 |
| 586. | Aug. 25, 2000 | 60/227,770 |
| 587. | Aug. 25, 2000 | 60/227,728 |
| 588. | Aug. 25, 2000 | 60/227,773 |
| 589. | Aug. 25, 2000 | 60/228,033 |
| 590. | Aug. 25, 2000 | 60/228,024 |
| 591. | Aug. 25, 2000 | 60/227,769 |
| 592. | Aug. 25, 2000 | 60/227,780 |
| 593. | Aug. 25, 2000 | 60/227,725 |
| 594. | Aug. 25, 2000 | 60/227,774 |
| 595. | Aug. 25, 2000 | 60/228,163 |
| 596. | Aug. 25, 2000 | 60/228,046 |
| 597. | Aug. 25, 2000 | 60/228,098 |
| 598. | Aug. 25, 2000 | 60/228,047 |
| 599. | Aug. 25, 2000 | 60/228,052 |
| 600. | Aug. 25, 2000 | 60/228,049 |
| 601. | Aug. 25, 2000 | 60/228,132 |
| 602. | Aug. 25, 2000 | 60/228,152 |
| 603. | Aug. 25, 2000 | 60/228,135 |
| 604. | Aug. 25, 2000 | 60/228,322 |
| 605. | Aug. 25, 2000 | 60/228,156 |
| 606. | Aug. 25, 2000 | 60/228,323 |
| 607. | Aug. 25, 2000 | 60/228,133 |
| 608. | Aug. 25, 2000 | 60/228,320 |
| 609. | Aug. 25, 2000 | 60/228,159 |
| 610. | Aug. 25, 2000 | 60/228,151 |
| 611. | Aug. 25, 2000 | 60/228,202 |
| 612. | Aug. 25, 2000 | 60/228,208 |
| 613. | Aug. 25, 2000 | 60/228,153 |
| 614. | Aug. 25, 2000 | 60/228,179 |
| 615. | Aug. 25, 2000 | 60/228,180 |
| 616. | Aug. 25, 2000 | 60/228,209 |
| 617. | Aug. 25, 2000 | 60/228,178 |
| 618. | Aug. 25, 2000 | 60/228,177 |
| 619. | Aug. 25, 2000 | 60/227,976 |
| 620. | Aug. 25, 2000 | 60/228,207 |
| 621. | Aug. 25, 2000 | 60/228,048 |
| 622. | Aug. 25, 2000 | 60/228,096 |
| 623. | Aug. 25, 2000 | 60/227,932 |
| 624. | Aug. 25, 2000 | 60/227,936 |
| 625. | Aug. 25, 2000 | 60/228,044 |
| 626. | Aug. 25, 2000 | 60/228,216 |
| 627. | Aug. 25, 2000 | 60/228,065 |
| 628. | Aug. 25, 2000 | 60/227,975 |
| 629. | Aug. 25, 2000 | 60/228,181 |
| 630. | Aug. 25, 2000 | 60/228,063 |
| 631. | Aug. 25, 2000 | 60/228,064 |
| 632. | Aug. 25, 2000 | 60/228,055 |
| 633. | Aug. 25, 2000 | 60/228,074 |
| 634. | Aug. 25, 2000 | 60/227,939 |
| 635. | Aug. 25, 2000 | 60/227,955 |
| 636. | Aug. 25, 2000 | 60/228,053 |
| 637. | Aug. 25, 2000 | 60/227,978 |
| 638. | Aug. 25, 2000 | 60/227,982 |
| 639. | Aug. 25, 2000 | 60/228,189 |
| 640. | Aug. 25, 2000 | 60/228,054 |
| 641. | Aug. 25, 2000 | 60/228,164 |
| 642. | Aug. 25, 2000 | 60/228,161 |
| 643. | Aug. 25, 2000 | 60/228,165 |
| 644. | Aug. 25, 2000 | 60/228,221 |
| 645. | Aug. 25, 2000 | 60/228,240 |
| 646. | Aug. 25, 2000 | 60/227,979 |
| 647. | Aug. 25, 2000 | 60/227,954 |
| 648. | Aug. 25, 2000 | 60/228,217 |
| 649. | Aug. 25, 2000 | 60/227,929 |
| 650. | Aug. 25, 2000 | 60/228,043 |
| 651. | Aug. 25, 2000 | 60/227,931 |
| 652. | Aug. 25, 2000 | 60/228,187 |
| 653. | Aug. 25, 2000 | 60/228,061 |
| 654. | Aug. 25, 2000 | 60/228,150 |
| 655. | Aug. 25, 2000 | |
| 656. | Aug. 25, 2000 | 60/227,793 |
| 657. | Aug. 25, 2000 | 60/228,031 |
| 658. | Aug. 25, 2000 | 60/228,028 |
| 659. | Aug. 25, 2000 | 60/228,027 |
| 660. | Aug. 25, 2000 | 60/228,026 |
| 661. | Aug. 25, 2000 | 60/228,038 |
| 662. | Aug. 25, 2000 | 60/228,036 |
| 663. | Aug. 25, 2000 | 60/227,790 |
| 664. | Aug. 25, 2000 | 60/228,039 |
| 665. | Aug. 25, 2000 | 60/228,030 |
| 666. | Aug. 25, 2000 | 60/228,032 |
| 667. | Aug. 25, 2000 | 60/228,149 |
| 668. | Aug. 25, 2000 | 60/228,040 |
| 669. | Aug. 25, 2000 | 60/227,777 |
| 670. | Aug. 25, 2000 | 60/228,037 |
| 671. | Aug. 25, 2000 | 60/227,791 |
| 672. | Aug. 25, 2000 | 60/228,041 |
| 673. | Sept. 06, 2000 | 60/231,840 |
| 674. | Sept. 06, 2000 | 60/231,837 |
| 675. | Sept. 06, 2000 | 60/231,833 |
| 676. | Sept. 06, 2000 | 60/231,835 |
| 677. | Sept. 06, 2000 | 60/231,834 |
| 678. | Sept. 06, 2000 | 60/230,430 |
| 679. | Sept. 06, 2000 | 60/230,434 |
| 680. | Sept. 13, 2000 | 60/232,044 |
| 681. | Sept. 13, 2000 | 60/232,043 |
| 682. | Sept. 15, 2000 | 60/232,858 |
| 683. | Sept. 15, 2000 | 60/232,865 |
| 684. | Sept. 18, 2000 | 60/233,621 |
| 685. | Sept. 18, 2000 | 60/233,634 |
| 686. | Sept. 20, 2000 | 60/234,179 |
| 687. | Sept. 20, 2000 | 60/234,178 |
| 688. | Sept. 21, 2000 | 60/234,233 |
| 689. | Sept. 21, 2000 | 60/234,217 |
| 690. | Sept. 21, 2000 | 60/234,220 |
| 691. | Sept. 25, 2000 | 60/234,968 |
| 692. | Sept. 25, 2000 | 60/234,979 |
| 693. | Sept. 25, 2000 | 60/234,974 |
| 694. | Sept. 25, 2000 | 60/235,118 |
| 695. | Sept. 26, 2000 | 60/234,949 |
| 696. | Sept. 27, 2000 | 60/235,577 |
| 697. | Sept. 28, 2000 | 60/235,934 |
| 698. | Sept. 29, 2000 | 60/236,380 |
| 699. | Oct. 02, 2000 | 60/236,732 |
| 700. | Oct. 02, 2000 | 60/237,035 |
| 701. | Oct. 04, 2000 | 60/237,379 |
| 702. | Oct. 04, 2000 | 60/237,505 |
| 703. | Oct. 05, 2000 | 60/237,686 |
| 704. | Oct. 10, 2000 | 60/238,473 |
| 705. | Oct. 10, 2000 | 60/238,472 |
| 706. | Oct. 10, 2000 | 60/238,456 |
| 707. | Oct. 10, 2000 | 60/238,421 |
| 708. | Oct. 11, 2000 | 60/239,091 |
| 709. | Oct. 11, 2000 | 60/239,245 |
| 710. | Oct. 17, 2000 | 60/240,862 |
| 711. | Oct. 17, 2000 | 60/240,863 |
| 712. | Oct. 19, 2000 | 60/241,368 |
| 713. | Oct. 19, 2000 | 60/241,367 |
| 714. | Oct. 19, 2000 | 09/691,020 |
| 715. | Oct. 19, 2000 | 09/691,044 |
| 716. | Oct. 19, 2000 | 09/691,028 |
| 717. | Oct. 19, 2000 | 09/691,056 |
| 718. | Oct. 19, 2000 | 09/691,038 |
| 719. | Oct. 19, 2000 | 09/691,031 |
| 720. | Oct. 19, 2000 | 09/691,018 |
| 721. | Oct. 20, 2000 | 60/241,751 |
| 722. | Oct. 20, 2000 | 60/241,750 |
| 723. | Oct. 23, 2000 | 60/242,065 |

-continued

| | Filing Date | Appln. No. |
|---|---|---|
| 724. | Oct. 23, 2000 | 60/242,072 |
| 725. | Oct. 24, 2000 | 60/242,686 |
| 726. | Oct. 25, 2000 | 60/242,705 |
| 727. | Oct. 25, 2000 | 60/242,706 |
| 728. | Oct. 26, 2000 | 60/243,289 |
| 729. | Oct. 26, 2000 | 60/243,288 |
| 730. | Oct. 27, 2000 | 60/243,398 |
| 731. | Oct. 27, 2000 | 60/243,478 |
| 732. | Oct. 30, 2000 | 60/243,723 |
| 733. | Oct. 30, 2000 | 60/243,735 |
| 734. | Nov. 01, 2000 | 60/244,691 |
| 735. | Nov. 01, 2000 | 60/244,747 |
| 736. | Nov. 02, 2000 | 60/244,923 |
| 737. | Nov. 02, 2000 | 60/244,920 |
| 738. | Nov. 03, 2000 | 60/245,164 |
| 739. | Nov. 03, 2000 | 60/245,165 |
| 740. | Nov. 06, 2000 | 60/245,676 |
| 741. | Nov. 06, 2000 | 60/245,576 |
| 742. | Nov. 09, 2000 | 60/246,732 |
| 743. | Nov. 13, 2000 | 60/247,010 |
| 744. | Nov. 13, 2000 | 60/247,051 |
| 745. | Nov. 13, 2000 | 60/247,050 |
| 746. | Nov. 13, 2000 | 60/247,049 |
| 747. | Nov. 15, 2000 | 60/248,198 |
| 748. | Nov. 15, 2000 | 60/248,197 |
| 749. | Nov. 16, 2000 | 60/248,555 |
| 750. | Nov. 17, 2000 | 60/249,256 |
| 751. | Nov. 17, 2000 | 60/249,257 |
| 752. | Nov. 20, 2000 | 60/249,454 |
| 753. | Nov. 20, 2000 | 60/249,453 |
| 754. | Nov. 21, 2000 | 60/252,080 |
| 755. | Nov. 22, 2000 | 60/252,464 |
| 756. | Nov. 22, 2000 | 60/252,465 |
| 757. | Nov. 24, 2000 | 60/252,598 |
| 758. | Nov. 24, 2000 | 60/252,590 |
| 759. | Nov. 28, 2000 | 60/253,140 |
| 760. | Nov. 29, 2000 | 60/253,722 |
| 761. | Nov. 29, 2000 | 60/253,748 |
| 762. | Dec. 01, 2000 | 60/250,356 |
| 763. | Dec. 04, 2000 | 60/250,464 |
| 764. | Dec. 06, 2000 | 60/251,387 |
| 765. | Dec. 07, 2000 | 60/251,504 |
| 766. | Dec. 07, 2000 | 60/251,508 |
| 767. | Dec. 08, 2000 | 60/251,853 |
| 768. | Dec. 08, 2000 | 60/251,854 |
| 769. | Dec. 11, 2000 | 60/254,174 |
| 770. | Dec. 11, 2000 | 60/254,196 |
| 771. | Dec. 13, 2000 | 60/254,891 |
| 772. | Dec. 15, 2000 | 60/256,503 |
| 773. | Dec. 15, 2000 | 60/255,415 |
| 774. | Dec. 18, 2000 | 60/255,891 |
| 775. | Dec. 18, 2000 | 60/255,892 |
| 776. | Dec. 19, 2000 | 60/256,306 |
| 777. | Dec. 21, 2000 | 60/256,929 |
| 778. | Dec. 27, 2000 | 60/257,978 |
| 779. | Dec. 29, 2000 | 09/750,044 |
| 780. | Jan. 02, 2001 | 60/258,880 |
| 781. | Jan. 02, 2001 | 09/750,910 |
| 782. | Jan. 03, 2001 | 09/752,823 |
| 783. | Jan. 05, 2001 | 09/754,184 |
| 784. | Jan. 05, 2001 | 09/754,185 |
| 785. | Jan, 19, 2001 | 60/262,389 |
| 786. | Jan. 19, 2001 | 60/262,359 |
| 787. | Jan. 26, 2001 | 60/264,026 |
| 788. | Jan. 26, 2001 | 60/264,027 |
| 789. | Jan. 29, 2001 | 60/264,282 |
| 790. | Jan. 29, 2001 | 60/264,257 |
| 791. | Jan. 31, 2001 | 09/774,106 |
| 792. | Jan. 31, 2001 | 09/774,089 |
| 793. | Jan. 31, 2001 | 09/774,090 |
| 794. | Feb. 01, 2001 | 09/775,870 |
| 795. | Feb. 01, 2001 | 09/776,014 |
| 796. | Feb. 06, 2001 | 60/266,468 |
| 797. | Feb. 06, 2001 | 60/266,469 |
| 798. | Feb. 07, 2001 | 60/266,863 |
| 799. | Feb. 08, 2001 | 09/778,734 |

-continued

| | Filing Date | Appln. No. |
|---|---|---|
| 800. | Feb. 09, 2001 | 60/267,425 |
| 801. | Feb. 09, 2001 | 60/267,430 |
| 802. | Feb. 09, 2001 | 60/267,426 |
| 803. | Feb. 12, 2001 | 60/267,707 |
| 804. | Feb. 12, 2001 | 60/267,706 |
| 805. | Feb. 14, 2001 | 60/268,366 |
| 806. | Feb. 16, 2001 | 60/268,921 |
| 807. | Feb. 21, 2001 | 60/269,890 |
| 808. | Feb. 21, 2001 | 60/269,891 |
| 809. | Feb. 21, 2001 | 60/269,892 |
| 810. | Feb. 21, 2001 | 60/269,893 |
| 811. | Feb. 22, 2001 | 60/270,122 |
| 812. | Feb. 26, 2001 | 60/270,913 |
| 813. | Feb. 26, 2001 | 60/270,912 |
| 814. | Feb. 28, 2001 | 60/271,724 |
| 815. | Feb. 28, 2001 | 60/271,725 |
| 816. | Mar. 02, 2001 | 60/272,467 |
| 817. | Mar. 05, 2001 | 60/272,783 |
| 818. | Mar. 07, 2001 | 60/273,554 |
| 819. | Mar. 07, 2001 | 60/273,553 |
| 820. | Mar. 07, 2001 | 60/273,552 |
| 821. | Apr. 02, 2001 | 09/823,082 |
| 822. | Aug. 24, 2001 | 09/940,230 |

W. Number 28

Application Ser. No. 10/376,785 listed above claims priority under 35 USC §119(e) of the following application:

| Country | application Ser. No. | Filed |
|---|---|---|
| U.S. | 60/361,089 | Mar. 1, 2002 |

X. Number 29

Application Ser. No. 10/376,797 listed above claims priority under 35 USC §119(e) of the following application:

| Country | application Ser. No. | Filed |
|---|---|---|
| U.S. | 60/361,110 | Mar. 1, 2002 |

Y. Number 30

Application Ser. No. 09/513,996 listed above is a continuation-in-part of the following provisional applications and the present application also claims priority of these provisional applications under 35 USC §119(e):

| Country | Filing Date | Client No. | application Ser. No. |
|---|---|---|---|
| U.S. | Feb. 25, 1999 | 80090.001 | 60/121,825 |
| U.S. | Mar. 5, 1999 | 80105.001 | 60/123,180 |
| U.S. | Mar. 9, 1999 | 80107.001 | 60/123,548 |
| U.S. | Mar. 23, 1999 | 80112.001 | 60/125,788 |
| U.S. | Mar. 25, 1999 | 80113.001 | 60/126,264 |
| U.S. | Mar. 29, 1999 | 80114.001 | 60/126,785 |
| U.S. | Apr. 1, 1999 | 80115.001 | 60/127,462 |
| U.S. | Apr. 6, 1999 | 91000.001 | 60/128,234 |
| U.S. | Apr. 8, 1999 | 91001.001 | 60/128,714 |
| U.S. | Apr. 16, 1999 | 80118.001 | 60/129,845 |
| U.S. | Apr. 19, 1999 | 80120.001 | 60/130,077 |
| U.S. | Apr. 21, 1999 | 80121.001 | 60/130,449 |
| U.S. | Apr. 23, 1999 | 80122.001 | 60/130,891 |
| U.S. | Apr. 23, 1999 | 80115.002 | 60/130,510 |
| U.S. | Apr. 28, 1999 | 80123.001 | 60/131,449 |
| U.S. | Apr. 30, 1999 | 80124.001 | 60/132,407 |
| U.S. | Apr. 30, 1999 | 80125.001 | 60/132,048 |
| U.S. | May 4, 1999 | 80126.001 | 60/132,484 |
| U.S. | May 5, 1999 | 80127.001 | 60/132,485 |

| Country | Filing Date | Client No. | application Ser. No. |
|---|---|---|---|
| U.S. | May 6, 1999 | 91002.001 | 60/132,487 |
| U.S. | May 6, 1999 | 80129.001 | 60/132,486 |
| U.S. | May 7, 1999 | 80130.001 | 60/132,863 |
| U.S. | May 11, 1999 | 80131.001 | 60/134,256 |
| U.S. | May 14, 1999 | 00025.001 | 60/134,221 |
| U.S. | May 14, 1999 | 80117.001 | 60/134,218 |
| U.S. | May 14, 1999 | 91006.001 | 60/134,370 |
| U.S. | May 14, 1999 | 80116.001 | 60/134,219 |
| U.S. | May 18, 1999 | 91007.001 | 60/134,768 |
| U.S. | May 19, 1999 | 91008.001 | 60/134,941 |
| U.S. | May 20, 1999 | 91009.001 | 60/135,124 |
| U.S. | May 21, 1999 | 91010.001 | 60/135,353 |
| U.S. | May 24, 1999 | 91011.001 | 60/135,629 |
| U.S. | May 25, 1999 | 91012.001 | 60/136,021 |
| U.S. | May 27, 1999 | 91013.001 | 60/136,392 |
| U.S. | May 28, 1999 | 91014.001 | 60/136,782 |
| U.S. | Jun. 1, 1999 | 91015.001 | 60/137,222 |
| U.S. | Jun. 3, 1999 | 91016.001 | 60/137,528 |
| U.S. | Jun. 4, 1999 | 91017.001 | 60/137,502 |
| U.S. | Jun. 7, 1999 | 91018.001 | 60/137,724 |
| U.S. | Jun. 8, 1999 | 91019.001 | 60/138,094 |
| U.S. | Jun. 10, 1999 | 00033.001 | 60/138,540 |
| U.S. | Jun. 10, 1999 | 00033.002 | 60/138,847 |
| U.S. | Jun. 14, 1999 | 00034.001 | 60/139,119 |
| U.S. | Jun. 16, 1999 | 80132.012 | 60/139,452 |
| U.S. | Jun. 16, 1999 | 80132.011 | 60/139,453 |
| U.S. | Jun. 17, 1999 | 00037.001 | 60/139,492 |
| U.S. | Jun. 18, 1999 | 80132.004 | 60/139,461 |
| U.S. | Jun. 18, 1999 | 00039.001 | 60/139,750 |
| U.S. | Jun. 18, 1999 | 80132.009 | 60/139,463 |
| U.S. | Jun. 18, 1999 | 80132.006 | 60/139,457 |
| U.S. | Jun. 18, 1999 | 80132.003 | 60/139,459 |
| U.S. | Jun. 18, 1999 | 80132.005 | 60/139,462 |
| U.S. | Jun. 18, 1999 | 80132.010 | 60/139,455 |
| U.S. | Jun. 18, 1999 | 80132.001 | 60/139,458 |
| U.S. | Jun. 18, 1999 | 80132.002 | 60/139,454 |
| U.S. | Jun. 18, 1999 | 80132.008 | 60/139,456 |
| U.S. | Jun. 18, 1999 | 80132.007 | 60/139,460 |
| U.S. | Jun. 18, 1999 | 00038.001 | 60/139,763 |
| U.S. | Jun. 21, 1999 | 00042.001 | 60/139,817 |
| U.S. | Jun. 22, 1999 | 00043.001 | 60/139,899 |
| U.S. | Jun. 23, 1999 | 00044.001 | 60/140,354 |
| U.S. | Jun. 23, 1999 | 00042.002 | 60/140,353 |
| U.S. | Jun. 24, 1999 | 00045.001 | 60/140,695 |
| U.S. | Jun. 28, 1999 | 00046.001 | 60/140,823 |
| U.S. | Jun. 29, 1999 | 00048.001 | 60/140,991 |
| U.S. | Jun. 30, 1999 | 00049.001 | 60/141,287 |
| U.S. | Jul. 1, 1999 | 00051.001 | 60/142,154 |
| U.S. | Jul. 1, 1999 | 00050.001 | 60/141,842 |
| U.S. | Jul. 2, 1999 | 00052.001 | 60/142,055 |
| U.S. | Jul. 6, 1999 | 00053.001 | 60/142,390 |
| U.S. | Jul. 8, 1999 | 00054.001 | 60/142,803 |
| U.S. | Jul. 9, 1999 | 00058.001 | 60/142,920 |
| U.S. | Jul. 12, 1999 | 00059.001 | 60/142,977 |
| U.S. | Jul. 13, 1999 | 00060.001 | 60/143,542 |
| U.S. | Jul. 14, 1999 | 00061.001 | 60/143,624 |
| U.S. | Jul. 15, 1999 | 00062.001 | 60/144,005 |
| U.S. | Jul. 16, 1999 | 80134.004 | 60/144,085 |
| U.S. | Jul. 16, 1999 | 80134.003 | 60/144,086 |
| U.S. | Jul. 19, 1999 | 80134.010 | 60/144,333 |
| U.S. | Jul. 19, 1999 | 80134.013 | 60/144,335 |
| U.S. | Jul. 19, 1999 | 00064.001 | 60/144,325 |
| U.S. | Jul. 19, 1999 | 80134.014 | 60/144,334 |
| U.S. | Jul. 19, 1999 | 80134.006 | 60/144,332 |
| U.S. | Jul. 19, 1999 | 80134.008 | 60/144,331 |
| U.S. | Jul. 20, 1999 | 80135.002 | 60/144,884 |
| U.S. | Jul. 20, 1999 | 80134.012 | 60/144,352 |
| U.S. | Jul. 20, 1999 | 00065.001 | 60/144,632 |
| U.S. | Jul. 21, 1999 | 00066.001 | 60/144,814 |
| U.S. | Jul. 21, 1999 | 80134.002 | 60/145,086 |
| U.S. | Jul. 21, 1999 | 80134.001 | 60/145,088 |
| U.S. | Jul. 22, 1999 | 00067.001 | 60/145,192 |
| U.S. | Jul. 22, 1999 | 80134.007 | 60/145,085 |
| U.S. | Jul. 22, 1999 | 80134.005 | 60/145,089 |
| U.S. | Jul. 22, 1999 | 80134.009 | 60/145,087 |
| U.S. | Jul. 23, 1999 | 80134.011 | 60/145,145 |
| U.S. | Jul. 23, 1999 | 80135.001 | 60/145,224 |
| U.S. | Jul. 23, 1999 | 00069.001 | 60/145,218 |
| U.S. | Jul. 26, 1999 | 00070.001 | 60/145,276 |
| U.S. | Jul. 27, 1999 | 80136.002 | 60/145,919 |
| U.S. | Jul. 27, 1999 | 00071.001 | 60/145,913 |
| U.S. | Jul. 27, 1999 | 80136.001 | 60/145,918 |
| U.S. | Jul. 28, 1999 | 00072.001 | 60/145,951 |
| U.S. | Aug. 2, 1999 | 80137.001 | 60/146,388 |
| U.S. | Aug. 2, 1999 | 80137.002 | 60/146,389 |
| U.S. | Aug. 2, 1999 | 00073.001 | 60/146,386 |
| U.S. | Aug. 3, 1999 | 00074.001 | 60/147,038 |
| U.S. | Aug. 4, 1999 | 80138.002 | 60/147,302 |
| U.S. | Aug. 4, 1999 | 00076.001 | 60/147,204 |
| U.S. | Aug. 5, 1999 | 00077.001 | 60/147,260 |
| U.S. | Aug. 5, 1999 | 80136.003 | 60/147,192 |
| U.S. | Aug. 6, 1999 | 80138.001 | 60/147,303 |
| U.S. | Aug. 6, 1999 | 00079.001 | 60/147,416 |
| U.S. | Aug. 9, 1999 | 00080.001 | 60/147,493 |
| U.S. | Aug. 9, 1999 | 80139.002 | 60/147,935 |
| U.S. | Aug. 10, 1999 | 80139.001 | 60/148,171 |
| U.S. | Aug. 11, 1999 | 00081.001 | 60/148,319 |
| U.S. | Aug. 12, 1999 | 00082.001 | 60/148,341 |
| U.S. | Aug. 13, 1999 | 00083.001 | 60/148,565 |
| U.S. | Aug. 13, 1999 | 80142.002 | 60/148,684 |
| U.S. | Aug. 16, 1999 | 80142.001 | 60/149,368 |
| U.S. | Aug. 17, 1999 | 00084.001 | 60/149,175 |
| U.S. | Aug. 18, 1999 | 00085.001 | 60/149,426 |
| U.S. | Aug. 20, 1999 | 00086.001 | 60/149,722 |
| U.S. | Aug. 20, 1999 | 80143.002 | 60/149,929 |
| U.S. | Aug. 20, 1999 | 00087.001 | 60/149,723 |
| U.S. | Aug. 23, 1999 | 00088.001 | 60/149,902 |
| U.S. | Aug. 23, 1999 | 80143.001 | 60/149,930 |
| U.S. | Aug. 25, 1999 | 00089.001 | 60/150,566 |
| U.S. | Aug. 26, 1999 | 00090.001 | 60/150,884 |
| U.S. | Aug. 27, 1999 | 80144.001 | 60/151,065 |
| U.S. | Aug. 27, 1999 | 80144.002 | 60/151,066 |
| U.S. | Aug. 27, 1999 | 00091.001 | 60/151,080 |
| U.S. | Aug. 30, 1999 | 00092.001 | 60/151,303 |
| U.S. | Aug. 31, 1999 | 00093.001 | 60/151,438 |
| U.S. | Sep. 1, 1999 | 00094.001 | 60/151,930 |
| U.S. | Sep. 7, 1999 | 00095.001 | 60/152,363 |
| U.S. | Sep. 10, 1999 | 00096.001 | 60/153,070 |
| U.S. | Sep. 13, 1999 | 00098.001 | 60/153,758 |
| U.S. | Sep. 15, 1999 | 00099.001 | 60/154,018 |
| U.S. | Sep. 16, 1999 | 00101.001 | 60/154,039 |
| U.S. | Sep. 20, 1999 | 00102.001 | 60/154,779 |
| U.S. | Sep. 22, 1999 | 00103.001 | 60/155,139 |
| U.S. | Sep. 23, 1999 | 00104.001 | 60/155,486 |
| U.S. | Sep. 24, 1999 | 00105.001 | 60/155,659 |
| U.S. | Sep. 28, 1999 | 00106.001 | 60/156,458 |
| U.S. | Sep. 29, 1999 | 00107.001 | 60/156,596 |
| U.S. | Oct. 4, 1999 | 00108.001 | 60/157,117 |
| U.S. | Oct. 5, 1999 | 00109.001 | 60/157,753 |
| U.S. | Oct. 6, 1999 | 00110.001 | 60/157,865 |
| U.S. | Oct. 7, 1999 | 00111.001 | 60/158,029 |
| U.S. | Oct. 8, 1999 | 00112.001 | 60/158,232 |
| U.S. | Oct. 12, 1999 | 00113.001 | 60/158,369 |
| U.S. | Oct. 13, 1999 | 80148.002 | 60/159,294 |
| U.S. | Oct. 13, 1999 | 80145.002 | 60/159,295 |
| U.S. | Oct. 13, 1999 | 80146.002 | 60/159,293 |
| U.S. | Oct. 14, 1999 | 80147.001 | 60/159,638 |
| U.S. | Oct. 14, 1999 | 80147.002 | 60/159,637 |
| U.S. | Oct. 14, 1999 | 80148.001 | 60/159,329 |
| U.S. | Oct. 14, 1999 | 80146.001 | 60/159,331 |
| U.S. | Oct. 14, 1999 | 80145.001 | 60/159,330 |
| U.S. | Oct. 18, 1999 | 00116.001 | 60/159,584 |
| U.S. | Oct. 21, 1999 | 00118.001 | 60/160,815 |
| U.S. | Oct. 21, 1999 | 80150.002 | 60/160,767 |
| U.S. | Oct. 21, 1999 | 80150.001 | 60/160,768 |
| U.S. | Oct. 21, 1999 | 00119.001 | 60/160,741 |
| U.S. | Oct. 21, 1999 | 80149.002 | 60/160,770 |
| U.S. | Oct. 21, 1999 | 80149.001 | 60/160,814 |
| U.S. | Oct. 22, 1999 | 80151.002 | 60/160,981 |
| U.S. | Oct. 22, 1999 | 00120.001 | 60/160,980 |
| U.S. | Oct. 22, 1999 | 80151.001 | 60/160,989 |
| U.S. | Oct. 25, 1999 | 00121.001 | 60/161,405 |
| U.S. | Oct. 25, 1999 | 80152.002 | 60/161,404 |
| U.S. | Oct. 25, 1999 | 80152.001 | 60/161,406 |

-continued

| Country | Filing Date | Client No. | application Ser. No. |
|---------|-------------|------------|----------------------|
| U.S. | Oct. 26, 1999 | 00122.001 | 60/161,361 |
| U.S. | Oct. 26, 1999 | 80153.001 | 60/161,360 |
| U.S. | Oct. 26, 1999 | 80153.002 | 60/161,359 |
| U.S. | Oct. 28, 1999 | 00123.001 | 60/161,920 |
| U.S. | Oct. 28, 1999 | 80154.001 | 60/161,992 |
| U.S. | Oct. 28, 1999 | 80154.002 | 60/161,993 |
| U.S. | Oct. 29, 1999 | 00124.001 | 60/162,143 |
| U.S. | Oct. 29, 1999 | 80155.001 | 60/162,142 |
| U.S. | Oct. 29, 1999 | 80155.002 | 60/162,228 |
| U.S. | Nov. 1, 1999 | 80156.002 | 60/162,895 |
| U.S. | Nov. 1, 1999 | 80156.001 | 60/162,891 |
| U.S. | Nov. 1, 1999 | 00125.001 | 60/162,894 |
| U.S. | Nov. 2, 1999 | 00126.001 | 60/163,093 |
| U.S. | Nov. 2, 1999 | 80157.001 | 60/163,092 |
| U.S. | Nov. 2, 1999 | 80157.002 | 60/163,091 |
| U.S. | Nov. 3, 1999 | 00127.001 | 60/163,249 |
| U.S. | Nov. 3, 1999 | 80158.001 | 60/163,248 |
| U.S. | Nov. 3, 1999 | 80158.002 | 60/163,281 |
| U.S. | Nov. 4, 1999 | 80159.002 | 60/163,380 |
| U.S. | Nov. 4, 1999 | 80159.001 | 60/163,381 |
| U.S. | Nov. 4, 1999 | 00128.001 | 60/163,379 |
| U.S. | Nov. 8, 1999 | 80160.001 | 60/164,151 |
| U.S. | Nov. 8, 1999 | 80160.002 | 60/164,150 |
| U.S. | Nov. 8, 1999 | 00129.001 | 60/164,146 |
| U.S. | Nov. 9, 1999 | 80161.002 | 60/164,260 |
| U.S. | Nov. 9, 1999 | 80162.002 | 60/164,259 |
| U.S. | Nov. 10, 1999 | 80164.002 | 60/164,548 |
| U.S. | Nov. 10, 1999 | 80162.001 | 60/164,317 |
| U.S. | Nov. 10, 1999 | 80163.001 | 60/164,321 |
| U.S. | Nov. 10, 1999 | 80163.002 | 60/164,318 |
| U.S. | Nov. 10, 1999 | 00131.001 | 60/164,544 |
| U.S. | Nov. 10, 1999 | 80164.001 | 60/164,545 |
| U.S. | Nov. 10, 1999 | 80161.001 | 60/164,319 |
| U.S. | Nov. 12, 1999 | 00133.001 | 60/164,870 |
| U.S. | Nov. 12, 1999 | 80166.001 | 60/164,959 |
| U.S. | Nov. 12, 1999 | 80166.002 | 60/164,962 |
| U.S. | Nov. 12, 1999 | 80165.002 | 60/164,960 |
| U.S. | Nov. 12, 1999 | 80165.001 | 60/164,871 |
| U.S. | Nov. 12, 1999 | 00132.001 | 60/164,961 |
| U.S. | Nov. 15, 1999 | 00134.001 | 60/164,927 |
| U.S. | Nov. 15, 1999 | 80167.001 | 60/164,929 |
| U.S. | Nov. 15, 1999 | 80167.002 | 60/164,926 |
| U.S. | Nov. 16, 1999 | 00135.001 | 60/165,669 |
| U.S. | Nov. 16, 1999 | 80168.001 | 60/165,671 |
| U.S. | Nov. 16, 1999 | 80168.002 | 60/165,661 |
| U.S. | Nov. 17, 1999 | 00136.001 | 60/165,919 |
| U.S. | Nov. 17, 1999 | 80169.001 | 60/165,918 |
| U.S. | Nov. 17, 1999 | 80169.002 | 60/165,911 |
| U.S. | Nov. 18, 1999 | 80170.002 | 60/166,158 |
| U.S. | Nov. 18, 1999 | 00137.001 | 60/166,157 |
| U.S. | Nov. 18, 1999 | 80170.001 | 60/166,173 |
| U.S. | Nov. 19, 1999 | 80171.002 | 60/166,412 |
| U.S. | Nov. 19, 1999 | 00139.001 | 60/166,419 |
| U.S. | Nov. 19, 1999 | 80171.001 | 60/166,411 |
| U.S. | Nov. 22, 1999 | 00140.001 | 60/166,733 |
| U.S. | Nov. 22, 1999 | 80172.001 | 60/166,750 |
| U.S. | Nov. 23, 1999 | 80173.002 | 60/167,362 |
| U.S. | Nov. 24, 1999 | 80173.001 | 60/167,382 |
| U.S. | Nov. 24, 1999 | 00141.001 | 60/167,233 |
| U.S. | Nov. 24, 1999 | 80174.001 | 60/167,234 |
| U.S. | Nov. 24, 1999 | 80174.002 | 60/167,235 |
| U.S. | Nov. 30, 1999 | 00142.001 | 60/167,904 |
| U.S. | Nov. 30, 1999 | 80175.001 | 60/167,908 |
| U.S. | Nov. 30, 1999 | 80175.002 | 60/167,902 |
| U.S. | Dec. 1, 1999 | 00143.001 | 60/168,232 |
| U.S. | Dec. 1, 1999 | 80176.001 | 60/168,233 |
| U.S. | Dec. 1, 1999 | 80176.002 | 60/168,231 |
| U.S. | Dec. 2, 1999 | 00144.001 | 60/168,546 |
| U.S. | Dec. 2, 1999 | 80177.001 | 60/168,549 |
| U.S. | Dec. 2, 1999 | 80177.002 | 60/168,548 |
| U.S. | Dec. 3, 1999 | 80178.001 | 60/168,673 |
| U.S. | Dec. 3, 1999 | 00145.001 | 60/168,675 |
| U.S. | Dec. 3, 1999 | 80178.002 | 60/168,674 |
| U.S. | Dec. 7, 1999 | 80179.001 | 60/169,278 |
| U.S. | Dec. 7, 1999 | 80179.002 | 60/169,302 |
| U.S. | Dec. 7, 1999 | 00147.001 | 60/169,298 |
| U.S. | Dec. 8, 1999 | 80180.001 | 60/169,692 |

-continued

| Country | Filing Date | Client No. | application Ser. No. |
|---------|-------------|------------|----------------------|
| U.S. | Dec. 8, 1999 | 80180.002 | 60/169,691 |
| U.S. | Dec. 16, 1999 | 00149.001 | 60/171,107 |
| U.S. | Dec. 16, 1999 | 80181.002 | 60/171,098 |
| U.S. | Dec. 16, 1999 | 80181.001 | 60/171,114 |
| U.S. | Jan. 19, 2000 | 80182.002 | 60/176,866 |
| U.S. | Jan. 19, 2000 | 80183.002 | 60/176,867 |
| U.S. | Jan. 19, 2000 | 80184.002 | 60/176,910 |
| U.S. | Jan. 26, 2000 | 00152.001 | 60/178,166 |
| U.S. | Jan. 27, 2000 | 00153.002 | 60/178,547 |
| U.S. | Jan. 27, 2000 | 80185.001 | 60/177,666 |
| U.S. | Jan. 27, 2000 | 80183.001 | 60/178,546 |
| U.S. | Jan. 27, 2000 | 80182.001 | 60/178,544 |
| U.S. | Jan. 27, 2000 | 80184.001 | 60/178,545 |
| U.S. | Jan. 28, 2000 | 80186.001 | 60/178,755 |
| U.S. | Jan. 28, 2000 | 00155.001 | 60/178,754 |
| U.S. | Feb. 1, 2000 | 00157.001 | 60/179,395 |
| U.S. | Feb. 1, 2000 | 80187.001 | 60/179,388 |
| U.S. | Feb. 3, 2000 | 00158.001 | 60/180,039 |
| U.S. | Feb. 3, 2000 | 80188.001 | 60/180,139 |
| U.S. | Feb. 4, 2000 | 80189.001 | 60/180,207 |
| U.S. | Feb. 4, 2000 | 00159.001 | 60/180,206 |
| U.S. | Feb. 7, 2000 | 00160.001 | 60/180,695 |
| U.S. | Feb. 7, 2000 | 80190.001 | 60/180,696 |
| U.S. | Feb. 9, 2000 | 00161.001 | 60/181,228 |
| U.S. | Feb. 9, 2000 | 80191.001 | 60/181,214 |
| U.S. | Feb. 10, 2000 | 00162.001 | 60/181,476 |
| U.S. | Feb. 10, 2000 | 80192.002 | 60/181,551 |
| U.S. | Feb. 15, 2000 | 00163.001 | 60/182,477 |
| U.S. | Feb. 15, 2000 | 80193.001 | 60/182,516 |
| U.S. | Feb. 15, 2000 | 00164.001 | 60/182,512 |
| U.S. | Feb. 15, 2000 | 80194.001 | 60/182,478 |
| U.S. | Feb. 17, 2000 | 80195.001 | 60/183,165 |
| U.S. | Feb. 17, 2000 | 00165.001 | 60/183,166 |

Z. Number 31

Application Ser. No. 09/935,625 listed above is a continuation-in-part of the following applications:

| Country | application Ser. No. | Filed |
|---------|----------------------|-------|
| U.S. | 60/228,279 | Aug. 25, 2000 |
| U.S. | 60/228,247 | Aug. 25, 2000 |
| U.S. | 60/228,246 | Aug. 25, 2000 |
| U.S. | 60/228,224 | Aug. 25, 2000 |

AA. Number 32

Application Ser. No. 10/375,265 listed above is a continuation of application Ser. No. 10/156,052, filed May 29, 2002, which is a continuation of application Ser. No. 09/935,350, filed on Aug. 23, 2001.

Moreover, application Ser. No. 09/935,350 is a conversion of the following provisional applications, to which the present application claims priority under 35 USC §119(e):

| Country | Filed | application Ser. No. |
|---------|-------|----------------------|
| U.S. | Aug. 23, 2000 | 60/228,095 |
| U.S. | Aug. 23, 2000 | 60/228,094 |
| U.S. | Aug. 23, 2000 | 60/228,126 |
| U.S. | Aug. 25, 2000 | 60/228,029 |
| U.S. | Aug. 25, 2000 | 60/227,779 |
| U.S. | Aug. 25, 2000 | 60/227,782 |
| U.S. | Aug. 23, 2000 | 60/228,092 |
| U.S. | Aug. 23, 2000 | 60/228,125 |
| U.S. | Aug. 23, 2000 | 60/228,127 |
| U.S. | Aug. 24, 2000 | 60/228,091 |
| U.S. | Aug. 25, 2000 | 60/227,771 |
| U.S. | Aug. 25, 2000 | 60/227,727 |
| U.S. | Aug. 25, 2000 | 60/227,726 |
| U.S. | Aug. 24, 2000 | 60/228,090 |

BB. Number 33

Application Ser. No. 10/376,766 listed above claims priority under 35 USC §119(e) of the following application:

| Country | application Ser. No. | Filed |
| --- | --- | --- |
| United States | 60/361,109 | Mar. 1, 2002 |

CC. Number 34

Application Ser. No. 09/686,093 listed above claims priority under 35 USC §119(e) of the following application:

| Country | Filing Date | Client No. | application Ser. No. |
| --- | --- | --- | --- |
| U.S. | Oct. 12, 1999 | 00113.001 | 60/158,369 |

DD. Number 35

Application Ser. No. 09/680,498 listed above claims priority under 35 USC §119(e) of the following application:

| Country | Filing Date | Client No. | application Ser. No. |
| --- | --- | --- | --- |
| U.S. | Oct. 8, 1999 | 00112.001 | 60/158,232 |

EE. Number 36

Application Ser. No. 09/671,635 listed above claims priority under 35 USC §119(e) of the following application:

| Country | Filing Date | Client No. | application Ser. No. |
| --- | --- | --- | --- |
| U.S. | Sep. 28, 1999 | 00106.001 | 60/156,458 |

FF. Number 37

Application Ser. No. 09/667,517 listed above claims priority under 35 USC §119(e) of the following application:

| Country | Filing Date | Client No. | application Ser. No. |
| --- | --- | --- | --- |
| U.S. | Sep. 23, 1999 | 00104.001 | 60/155,486 |

GG. Number 38

Application Ser. No. 09/665,714 listed above claims priority under 35 USC §119(e) of the following application:

| Country | Filing Date | Client No. | application Ser. No. |
| --- | --- | --- | --- |
| U.S. | Sep. 20, 1999 | 00102.001 | 60/154,779 |

HH. Number 39

Application Ser. No. 09/621,323 listed above claims priority under 35 USC §119(e) of the following application:

| Country | Filing Date | Client No. | application Ser. No. |
| --- | --- | --- | --- |
| U.S. | Jul. 20, 1999 | 00065.001 | 60/144,632 |

II. Number 40

Application Ser. No. 09/633,191 listed above claims priority under 35 USC §119(e) of the following application:

| Country | Filing Date | Client No. | application Ser. No. |
| --- | --- | --- | --- |
| U.S. | Aug. 5, 1999 | 00077.001 | 60/147,260 |

JJ. Number 41

Application Ser. No. 09/651,370 listed above claims priority under 35 USC §119(e) of the following application:

| Country | Filing Date | Client No. | application Ser. No. |
| --- | --- | --- | --- |
| U.S. | Aug. 30, 1999 | 00092.001 | 60/151,303 |

KK. Number 42

Application Ser. No. 10/426,837 listed above claims priority under 35 USC §119(e) of provisional application nos: 60/376,553 filed May 1, 2002 and 60/376,517 filed May 1, 2002.

LL. Number 43

Application Ser. No. 09/702,841 listed above claims priority under 35 USC §119(e) of the following application:

| Country | Filing Date | Client No. | application Ser. No. |
| --- | --- | --- | --- |
| U.S. | Nov. 1, 1999 | 80156.001 | 60/162,891 |

MM. Number 44

Application Ser. No. 09/696,751 listed above claims priority under 35 USC §119(e) of the following application:

| Country | Filing Date | Client No. | application Ser. No. |
| --- | --- | --- | --- |
| U.S. | Oct. 25, 1999 | 80152.001 | 60/161,406 |

NN. Number 45

Application Ser. No. 10/356,562 is a continuation of application Ser. No. 10/132,279, filed on Apr. 26, 2002.

Application Ser. No. 10/132,279 is a continuation-in-part of the following nonprovisional applications, to which the present application claims priority under §120:

| | Country | Client No. | application Ser. No. | | Status |
| --- | --- | --- | --- | --- | --- |
| 1. | U.S. | 80001.006 | 09/391,631 | Sep. 3, 1999 | Pending at the time of filing |
| 2. | U.S. | 80010.003 | 09/412,922 | Oct. 5, 1999 | Pending at the time of filing |
| 3. | U.S. | 80010.002 | 09/413,198 | Oct. 5, 1999 | Pending at the time of filing |
| 4. | U.S. | 80026.002 | 09/428,944 | Oct. 28, 1999 | Pending at the time of filing |

-continued

| Country | Filed | application Ser. No. |
| --- | --- | --- |
| U.S. | Aug. 24, 2000 | 60/227,776 |
| U.S. | Aug. 23, 2000 | 60/228,093 |
| U.S. | Aug. 23, 2000 | 60/227,778 |

-continued

| | Country | Client No. | application Ser. No. | | Status |
|---|---|---|---|---|---|
| 5. | U.S. | 80042.002 | 09/451,320 | Dec. 1, 1999 | Pending at the time of filing |
| 6. | U.S. | 80060.002 | 09/478,081 | Jan. 4, 2000 | Pending at the time of filing |
| 7. | U.S. | 80084.002 | 09/497,191 | Feb. 3, 2000 | Pending at the time of filing |
| 8. | U.S. | 80141.008 | 09/637,792 | Aug. 11, 2000 | Pending at the time of filing |
| 9. | U.S. | 80141.007 | 09/637,564 | Aug. 11, 2000 | Pending at the time of filing |
| 10. | U.S. | 80141.006 | 09/637,565 | Aug. 11, 2000 | Pending at the time of filing |
| 11. | U.S. | 80141.010 | 10/097,600 | Mar. 15, 2002 | Pending at the time of filing |

Through the eleven nonprovisional applications listed above, the present application also claims priority under 35 USC §119(e) of the following provisional applications:

1. Application Ser. No. 09/391,631 filed Sep. 3, 1999 claims priority under 35 USC §119(e) of the following provisional applications:

| | Country | application Ser. No. | Filing Date |
|---|---|---|---|
| 1. | U.S. | 60/099,671 | Sep. 4, 1998 |
| 2. | U.S. | 60/099,672 | Sep. 4, 1998 |
| 3. | U.S. | 60/099,933 | Sep. 11, 1998 |
| 4. | U.S. | 60/100,864 | Sep. 17, 1998 |
| 5. | U.S. | 60/101,042 | Sep. 18, 1998 |
| 6. | U.S. | 60/101,682 | Sep. 24, 1998 |
| 7. | U.S. | 60/102,533 | Sep. 30, 1998 |
| 8. | U.S. | 60/102,460 | Sep. 30, 1998 |
| 9. | U.S. | 60/103,116 | Oct. 5, 1998 |
| 10. | U.S. | 60/103,141 | Oct. 5, 1998 |
| 11. | U.S. | 60/103,574 | Oct. 9, 1998 |
| 12. | U.S. | 60/103,907 | Oct. 13, 1998 |
| 13. | U.S. | 60/106,105 | Oct. 29, 1998 |
| 14. | U.S. | 60/106,218 | Oct. 30, 1998 |
| 15. | U.S. | 60/107,282 | Nov. 6, 1998 |
| 16. | U.S. | 60/107,836 | Nov. 10, 1998 |
| 17. | U.S. | 60/108,526 | Nov. 16, 1998 |
| 18. | U.S. | 60/108,901 | Nov. 17, 1998 |
| 19. | U.S. | 60/109,267 | Nov. 20, 1998 |
| 20. | U.S. | 60/109,594 | Nov. 23, 1998 |
| 21. | U.S. | 60/110,263 | Nov. 30, 1998 |
| 22. | U.S. | 60/110,495 | Dec. 1, 1998 |
| 23. | U.S. | 60/110,626 | Dec. 2, 1998 |
| 24. | U.S. | 60/110,701 | Dec. 3, 1998 |
| 25. | U.S. | 60/111,339 | Dec. 7, 1998 |
| 26. | U.S. | 60/111,589 | Dec. 9, 1998 |
| 27. | U.S. | 60/112,096 | Dec. 14, 1998 |
| 28. | U.S. | 60/112,224 | Dec. 15, 1998 |
| 29. | U.S. | 60/112,624 | Dec. 16, 1998 |
| 30. | U.S. | 60/112,862 | Dec. 17, 1998 |
| 31. | U.S. | 60/115,152 | Jan. 7, 1999 |
| 32. | U.S. | 60/115,156 | Jan. 7, 1999 |
| 33. | U.S. | 60/115,365 | Jan. 8, 1999 |
| 34. | U.S. | 60/115,339 | Jan. 11, 1999 |
| 35. | U.S. | 60/115,847 | Jan. 13, 1999 |
| 36. | U.S. | 60/116,674 | Jan. 21, 1999 |
| 37. | U.S. | 60/116,962 | Jan. 22, 1999 |
| 38. | U.S. | 60/120,583 | Feb. 18, 1999 |
| 39. | U.S. | 60/121,072 | Feb. 22, 1999 |
| 40. | U.S. | 60/122,568 | Mar. 2, 1999 |
| 41. | U.S. | 60/123,941 | Mar. 12, 1999 |

2. Application Ser. No. 09/412,922 filed Oct. 5, 1999 claims priority under 35 USC §119(e) of the following provisional applications:

| | Country | Appln. No. | Filing Date |
|---|---|---|---|
| 1. | U.S. | 60/103,116 | Oct. 5, 1998 |
| 2. | U.S. | 60/103,141 | Oct. 5, 1998 |
| 3. | U.S. | 60/103,215 | Oct. 6, 1998 |
| 4. | U.S. | 60/103,554 | Oct. 8, 1998 |
| 5. | U.S. | 60/103,574 | Oct. 9, 1998 |
| 6. | U.S. | 60/103,907 | Oct. 13, 1998 |
| 7. | U.S. | 60/104,268 | Oct. 14, 1998 |
| 8. | U.S. | 60/104,680 | Oct. 16, 1998 |
| 9. | U.S. | 60/104,828 | Oct. 19, 1998 |
| 10. | U.S. | 60/105,008 | Oct. 20, 1998 |
| 11. | U.S. | 60/105,142 | Oct. 21, 1998 |
| 12. | U.S. | 60/105,533 | Oct. 22, 1998 |
| 13. | U.S. | 60/105,571 | Oct. 26, 1998 |
| 14. | U.S. | 60/105,815 | Oct. 27, 1998 |
| 15. | U.S. | 60/106,105 | Oct. 29, 1998 |
| 16. | U.S. | 60/106,218 | Oct. 30, 1998 |
| 17. | U.S. | 60/106,685 | Nov. 2, 1998 |
| 18. | U.S. | 60/107,282 | Nov. 6, 1998 |
| 19. | U.S. | 60/107,720 | Nov. 9, 1998 |
| 20. | U.S. | 60/107,719 | Nov. 9, 1998 |
| 21. | U.S. | 60/107,836 | Nov. 10, 1998 |
| 22. | U.S. | 60/108,190 | Nov. 12, 1998 |
| 23. | U.S. | 60/108,526 | Nov. 16, 1998 |
| 24. | U.S. | 60/108,901 | Nov. 17, 1998 |
| 25. | U.S. | 60/109,124 | Nov. 19, 1998 |
| 26. | U.S. | 60/109,127 | Nov. 19, 1998 |
| 27. | U.S. | 60/109,267 | Nov. 20, 1998 |
| 28. | U.S. | 60/109,594 | Nov. 23, 1998 |
| 29. | U.S. | 60/110,053 | Nov. 25, 1998 |
| 30. | U.S. | 60/110,050 | Nov. 25, 1998 |
| 31. | U.S. | 60/110,158 | Nov. 27, 1998 |
| 32. | U.S. | 60/110,263 | Nov. 30, 1998 |
| 33. | U.S. | 60/110,495 | Dec. 1, 1998 |
| 34. | U.S. | 60/110,626 | Dec. 2, 1998 |
| 35. | U.S. | 60/110,701 | Dec. 3, 1998 |
| 36. | U.S. | 60/111,339 | Dec. 7, 1998 |
| 37. | U.S. | 60/111,589 | Dec. 9, 1998 |
| 38. | U.S. | 60/111,782 | Dec. 10, 1998 |
| 39. | U.S. | 60/111,812 | Dec. 11, 1998 |
| 40. | U.S. | 60/112,096 | Dec. 14, 1998 |
| 41. | U.S. | 60/112,224 | Dec. 15, 1998 |
| 42. | U.S. | 60/112,624 | Dec. 16, 1998 |
| 43. | U.S. | 60/112,862 | Dec. 17, 1998 |
| 44. | U.S. | 60/112,912 | Dec. 18, 1998 |
| 45. | U.S. | 60/113,248 | Dec. 21, 1998 |
| 46. | U.S. | 60/113,522 | Dec. 22, 1998 |
| 47. | U.S. | 60/113,826 | Dec. 23, 1998 |
| 48. | U.S. | 60/113,998 | Dec. 28, 1998 |
| 49. | U.S. | 60/114,384 | Dec. 29, 1998 |
| 50. | U.S. | 60/114,455 | Dec. 30, 1998 |
| 51. | U.S. | 60/114,740 | Jan. 4, 1999 |
| 52. | U.S. | 60/114,866 | Jan. 6, 1999 |
| 53. | U.S. | 60/115,153 | Jan. 7, 1999 |
| 54. | U.S. | 60/115,152 | Jan. 7, 1999 |
| 55. | U.S. | 60/115,151 | Jan. 7, 1999 |
| 56. | U.S. | 60/115,155 | Jan. 7, 1999 |
| 57. | U.S. | 60/115,156 | Jan. 7, 1999 |
| 58. | U.S. | 60/115,154 | Jan. 7, 1999 |
| 59. | U.S. | 60/115,364 | Jan. 8, 1999 |
| 60. | U.S. | 60/115,365 | Jan. 8, 1999 |
| 61. | U.S. | 60/115,339 | Jan. 11, 1999 |
| 62. | U.S. | 60/115,518 | Jan. 12, 1999 |
| 63. | U.S. | 60/115,847 | Jan. 13, 1999 |
| 64. | U.S. | 60/115,905 | Jan. 14, 1999 |
| 65. | U.S. | 60/116,383 | Jan. 15, 1999 |
| 66. | U.S. | 60/116,384 | Jan. 15, 1999 |
| 67. | U.S. | 60/116,329 | Jan. 19, 1999 |
| 68. | U.S. | 60/116,340 | Jan. 19, 1999 |
| 69. | U.S. | 60/116,674 | Jan. 21, 1999 |
| 70. | U.S. | 60/116,672 | Jan. 21, 1999 |
| 71. | U.S. | 60/116,960 | Jan. 22, 1999 |
| 72. | U.S. | 60/116,962 | Jan. 22, 1999 |
| 73. | U.S. | 60/117,756 | Jan. 28, 1999 |
| 74. | U.S. | 60/118,672 | Feb. 3, 1999 |

-continued

|  | Country | Appln. No. | Filing Date |
|---|---|---|---|
| 75. | U.S. | 60/118,808 | Feb. 4, 1999 |
| 76. | U.S. | 60/118,778 | Feb. 5, 1999 |
| 77. | U.S. | 60/119,029 | Feb. 8, 1999 |
| 78. | U.S. | 60/119,332 | Feb. 9, 1999 |
| 79. | U.S. | 60/119,462 | Feb. 10, 1999 |
| 80. | U.S. | 60/119,922 | Feb. 12, 1999 |
| 81. | U.S. | 60/120,196 | Feb. 16, 1999 |
| 82. | U.S. | 60/120,198 | Feb. 16, 1999 |
| 83. | U.S. | 60/120,583 | Feb. 18, 1999 |
| 84. | U.S. | 60/121,072 | Feb. 22, 1999 |
| 85. | U.S. | 60/121,334 | Feb. 23, 1999 |
| 86. | U.S. | 60/121,470 | Feb. 24, 1999 |
| 87. | U.S. | 60/121,704 | Feb. 25, 1999 |
| 88. | U.S. | 60/122,107 | Feb. 26, 1999 |
| 89. | U.S. | 60/122,266 | Mar. 1, 1999 |
| 90. | U.S. | 60/122,568 | Mar. 2, 1999 |
| 91. | U.S. | 60/122,611 | Mar. 3, 1999 |
| 92. | U.S. | 60/121,775 | Mar. 4, 1999 |
| 93. | U.S. | 60/123,534 | Mar. 5, 1999 |
| 94. | U.S. | 60/123,680 | Mar. 9, 1999 |
| 95. | U.S. | 60/123,715 | Mar. 10, 1999 |
| 96. | U.S. | 60/123,726 | Mar. 10, 1999 |
| 97. | U.S. | 60/124,263 | Mar. 11, 1999 |
| 98. | U.S. | 60/123,941 | Mar. 12, 1999 |

3. Application Ser. No. 09/413,198 filed Oct. 5, 1999 claims priority under 35 USC §119(e) of the following provisional applications:

|  | Country | Appln. No. | Filing Date |
|---|---|---|---|
| 1. | U.S. | 60/103,116 | Oct. 5, 1998 |
| 2. | U.S. | 60/103,141 | Oct. 5, 1998 |
| 3. | U.S. | 60/103,215 | Oct. 6, 1998 |
| 4. | U.S. | 60/103,554 | Oct. 8, 1998 |
| 5. | U.S. | 60/103,574 | Oct. 9, 1998 |
| 6. | U.S. | 60/103,907 | Oct. 13, 1998 |
| 7. | U.S. | 60/104,268 | Oct. 14, 1998 |
| 8. | U.S. | 60/104,680 | Oct. 16, 1998 |
| 9. | U.S. | 60/104,828 | Oct. 19, 1998 |
| 10. | U.S. | 60/105,008 | Oct. 20, 1998 |
| 11. | U.S. | 60/105,142 | Oct. 21, 1998 |
| 12. | U.S. | 60/105,533 | Oct. 22, 1998 |
| 13. | U.S. | 60/105,571 | Oct. 26, 1998 |
| 14. | U.S. | 60/105,815 | Oct. 27, 1998 |
| 15. | U.S. | 60/106,105 | Oct. 29, 1998 |
| 16. | U.S. | 60/106,218 | Oct. 30, 1998 |

4. Application Ser. No. 09/428,944 filed Oct. 28, 1999 claims priority under 35 USC §119(e) of the following provisional applications:

|  | Country | Appln. No. | Filing Date |
|---|---|---|---|
| 1. | U.S. | 60/106,685 | Nov. 12, 1998 |
| 2. | U.S. | 60/107,282 | Nov. 6, 1998 |
| 3. | U.S. | 60/107,720 | Nov. 9, 1998 |
| 4. | U.S. | 60/107,719 | Nov. 9, 1998 |
| 5. | U.S. | 60/107,836 | Nov. 10, 1998 |
| 6. | U.S. | 60/108,190 | Nov. 12, 1998 |
| 7. | U.S. | 60/108,526 | Nov. 16, 1998 |
| 8. | U.S. | 60/108,901 | Nov. 17, 1998 |
| 9. | U.S. | 60/109,124 | Nov. 19, 1998 |
| 10. | U.S. | 60/109,127 | Nov. 19, 1998 |
| 11. | U.S. | 60/109,267 | Nov. 20, 1998 |
| 12. | U.S. | 60/109,594 | Nov. 23, 1998 |
| 13. | U.S. | 60/110,053 | Nov. 25, 1998 |
| 14. | U.S. | 60/110,050 | Nov. 25, 1998 |
| 15. | U.S. | 60/110,158 | Nov. 27, 1998 |
| 16. | U.S. | 60/110,263 | Nov. 30, 1998 |

5. Application Ser. No. 09/451,320 filed Dec. 1, 1999 claims priority under 35 USC §119(e) of the following provisional applications:

|  | Country | Appln. No. | Filing Date |
|---|---|---|---|
| 1. | U.S. | 60/110,495 | Dec. 1, 1998 |
| 2. | U.S. | 60/110,626 | Dec. 2, 1998 |
| 3. | U.S. | 60/110,701 | Dec. 3, 1998 |
| 4. | U.S. | 60/111,339 | Dec. 7, 1998 |
| 5. | U.S. | 60/111,589 | Dec. 9, 1998 |
| 6. | U.S. | 60/111,782 | Dec. 10, 1998 |
| 7. | U.S. | 60/111,812 | Dec. 11, 1998 |
| 8. | U.S. | 60/112,096 | Dec. 14, 1998 |
| 9. | U.S. | 60/112,224 | Dec. 15, 1998 |
| 10. | U.S. | 60/112,624 | Dec. 16, 1998 |
| 11. | U.S. | 60/112,862 | Dec. 17, 1998 |
| 12. | U.S. | 60/112,912 | Dec. 18, 1998 |
| 13. | U.S. | 60/113,248 | Dec. 21, 1998 |
| 14. | U.S. | 60/113,522 | Dec. 22, 1998 |
| 15. | U.S. | 60/113,826 | Dec. 23, 1998 |
| 16. | U.S. | 60/113,998 | Dec. 28, 1998 |
| 17. | U.S. | 60/114,384 | Dec. 29, 1998 |
| 18. | U.S. | 60/114,455 | Dec. 30, 1998 |
| 19. | U.S. | 60/115,153 | Jan. 7, 1999 |
| 20. | U.S. | 60/115,152 | Jan. 7, 1999 |
| 21. | U.S. | 60/115,151 | Jan. 7, 1999 |
| 22. | U.S. | 60/115,155 | Jan. 7, 1999 |
| 23. | U.S. | 60/115,156 | Jan. 7, 1999 |
| 24. | U.S. | 60/115,364 | Jan. 8, 1999 |
| 25. | U.S. | 60/116,960 | Jan. 22, 1999 |

6. Application Ser. No. 09/478,081 filed Jan. 4, 2000 claims priority under 35 USC §119(e) of the following provisional applications:

|  | Country | Appln. No. | Filing Date |
|---|---|---|---|
| 1. | U.S. | 60/114,740 | Jan. 4, 1999 |
| 2. | U.S. | 60/114,866 | Jan. 6, 1999 |
| 3. | U.S. | 60/115,154 | Jan. 7, 1999 |
| 4. | U.S. | 60/115,365 | Jan. 8, 1999 |
| 5. | U.S. | 60/115,339 | Jan. 11, 1999 |
| 6. | U.S. | 60/115,518 | Jan. 12, 1999 |
| 7. | U.S. | 60/115,847 | Jan. 13, 1999 |
| 8. | U.S. | 60/115,905 | Jan. 14, 1999 |
| 9. | U.S. | 60/116,383 | Jan. 15, 1999 |
| 10. | U.S. | 60/116,384 | Jan. 15, 1999 |
| 11. | U.S. | 60/116,329 | Jan. 19, 1999 |
| 12. | U.S. | 60/116,340 | Jan. 19, 1999 |
| 13. | U.S. | 60/116,674 | Jan. 21, 1999 |
| 14. | U.S. | 60/116,672 | Jan. 21, 1999 |
| 15. | U.S. | 60/116,962 | Jan. 22, 1999 |
| 16. | U.S. | 60/117,756 | Jan. 28, 1999 |

7. Application Ser. No. 09/497,191 filed Feb. 3, 2000 claims priority under 35 USC §119(e) of the following provisional applications:

|  | Country | Appln. No. | Filing Date |
|---|---|---|---|
| 1. | U.S. | 60/118,672 | Feb. 3, 1999 |
| 2. | U.S. | 60/118,808 | Feb. 4, 1999 |
| 3. | U.S. | 60/118,778 | Feb. 5, 1999 |
| 4. | U.S. | 60/119,029 | Feb. 8, 1999 |
| 5. | U.S. | 60/119,332 | Feb. 9, 1999 |
| 6. | U.S. | 60/119,462 | Feb. 10, 1999 |
| 7. | U.S. | 60/119,922 | Feb. 12, 1999 |
| 8. | U.S. | 60/120,196 | Feb. 16, 1999 |
| 9. | U.S. | 60/120,198 | Feb. 16, 1999 |
| 10. | U.S. | 60/120,583 | Feb. 18, 1999 |
| 11. | U.S. | 60/121,072 | Feb. 22, 1999 |
| 12. | U.S. | 60/121,334 | Feb. 23, 1999 |
| 13. | U.S. | 60/121,470 | Feb. 24, 1999 |

-continued

|     | Country | Appln. No. | Filing Date   |
| --- | ------- | ---------- | ------------- |
| 14. | U.S.    | 60/121,704 | Feb. 25, 1999 |
| 15. | U.S.    | 60/122,107 | Feb. 26, 1999 |

8. Application Ser. No. 09/637,792 filed Aug. 11, 2000 claims priority under 35 USC §119(e) of the following provisional applications:

| Country | application Ser. No. | U.S.          |
| ------- | -------------------- | ------------- |
| U.S.    | 60/148,337           | Aug. 12, 1999 |

9. Application Ser. No. 09/637,564 filed Aug. 11, 2000 claims priority under 35 USC §119(e) of the following provisional applications:

|      | application Ser. No. | Filing Date   |
| ---- | -------------------- | ------------- |
| U.S. | 60/148,340           | Aug. 12, 1999 |

10. Application Ser. No. 09/637,565 filed Aug. 11, 2000 claims priority under 35 USC §119(e) of the following provisional applications:

|      | application Ser. No. | Filing Date   |
| ---- | -------------------- | ------------- |
| U.S. | 60/148,342           | Aug. 12, 1999 |

11. Application Ser. No. 10/097,600 filed Mar. 15, 2002 is a continuation of application Ser. No. 09/832,934 filed Apr. 12, 2001, which is a continuation of application Ser. No. 09/637,820 filed Aug. 11, 2000, through which it claims priority under 35 USC §119(e) of the following provisional applications:

|      | application Ser. No. | Filing Date   |
| ---- | -------------------- | ------------- |
| U.S. | 60/148,347           | Aug. 12, 1999 |

OO. Number 46

Application Ser. No. 10/336,799 listed above is a continuation of application Ser. No. 10/132,257, filed on Apr. 26, 2002.

Through application Ser. No. 10/132,257, the present application claims priority under 35 USC §119(e) and §120 of the following applications:

|     | Country | Client No. | Application No. | Filed         | Status                                |
| --- | ------- | ---------- | --------------- | ------------- | ------------------------------------- |
| 1.  | U.S.    | 91000.002  | 09/543,680      | Apr. 6, 2000  | Pending at the time of filing 10/132,257 |
| 2.  | U.S.    | 91002.002  | 09/565,308      | May 5, 2000   | Pending at the time of filing 10/132,257 |
| 3.  | U.S.    | 91007.002  | 09/573,655      | May 18, 2000  | Pending at the time of filing 10/132,257 |
| 4.  | U.S.    | 00033.003  | 09/592,459      | Jun. 9, 2000  | Pending at the time of filing 10/132,257 |
| 5.  | U.S.    | 00034.002  | 09/593,710      | Jun. 14, 2000 | Pending at the time of filing 10/132,257 |
| 6.  | U.S.    | 00045.002  | 09/602,016      | Jun. 23, 2000 | Pending at the time of filing 10/132,257 |
| 7.  | U.S.    | 00048.002  | 09/606,181      | Jun. 29, 2000 | Pending at the time of filing 10/132,257 |
| 8.  | U.S.    | 00050.002  | 09/607,081      | Jun. 30, 2000 | Pending at the time of filing 10/132,257 |
| 9.  | U.S.    | 00051.002  | 09/610,157      | Jun. 30, 2000 | Pending                               |
| 10. | U.S.    | 00052.002  | 09/609,198      | Jun. 30, 2000 | Pending at the time of filing 10/132,257 |
| 11. | U.S.    | 00053.002  | 09/611,409      | Jul. 6, 2000  | Pending                               |
| 12. | U.S.    | 00054.002  | 09/612,645      | Jul. 7, 2000  | Pending at the time of filing 10/132,257 |
| 13. | U.S.    | 00058.002  | 09/613,547      | Jul. 7, 2000  | Pending at the time of filing 10/132,257 |

Through the applications listed above, the present application also claims priority under 35 USC §119(e) of the following applications:

|     | Country | Client No. | application Ser. No. | Filed         | Status    |
| --- | ------- | ---------- | -------------------- | ------------- | --------- |
| 14. | U.S.    | 91000.001  | 60/128,234           | Apr. 6, 1999  | Converted |
| 15. | U.S.    | 91001.001  | 60/128,714           | Apr. 8, 1999  | Converted |
| 16. | U.S.    | 91002.001  | 60/132,487           | May 6, 1999   | Converted |
| 17. | U.S.    | 91007.001  | 60/134,768           | May 18, 1999  | Converted |
| 18. | U.S.    | 91008.001  | 60/134,941           | May 19, 1999  | Converted |
| 19. | U.S.    | 91009.001  | 60/135,124           | May 20, 1999  | Converted |
| 20. | U.S.    | 91010.001  | 60/135,353           | May 21, 1999  | Converted |
| 21. | U.S.    | 91011.001  | 60/135,629           | May 24, 1999  | Converted |
| 22. | U.S.    | 91012.001  | 60/136,021           | May 25, 1999  | Converted |
| 23. | U.S.    | 91013.001  | 60/136,392           | May 27, 1999  | Converted |
| 24. | U.S.    | 91014.001  | 60/136,782           | May 28, 1999  | Converted |
| 25. | U.S.    | 91015.001  | 60/137,222           | Jun. 1, 1999  | Converted |
| 26. | U.S.    | 91016.001  | 60/137,528           | Jun. 3, 1999  | Converted |
| 27. | U.S.    | 91017.001  | 60/137,502           | Jun. 4, 1999  | Converted |
| 28. | U.S.    | 91018.001  | 60/137,724           | Jun. 7, 1999  | Converted |
| 29. | U.S.    | 91019.001  | 60/138,094           | Jun. 8, 1999  | Converted |
| 30. | U.S.    | 00033.001  | 60/138,540           | Jun. 10, 1999 | Converted |
| 31. | U.S.    | 00033.002  | 60/138,847           | Jun. 10, 1999 | Converted |
| 32. | U.S.    | 00034.001  | 60/139,119           | Jun. 14, 1999 | Converted |
| 33. | U.S.    | 00045.001  | 60/140,695           | Jun. 24, 1999 | Converted |
| 34. | U.S.    | 00048.001  | 60/140,991           | Jun. 29, 1999 | Converted |
| 35. | U.S.    | 00050.001  | 60/141,842           | Jul. 1, 1999  | Converted |
| 36. | U.S.    | 00051.001  | 60/142,154           | Jul. 1, 1999  | Converted |
| 37. | U.S.    | 00052.001  | 60/142,055           | Jul. 2, 1999  | Converted |
| 38. | U.S.    | 00053.001  | 60/142,390           | Jul. 6, 1999  | Converted |
| 39. | U.S.    | 00054.001  | 60/142,803           | Jul. 8, 1999  | Converted |
| 40. | U.S.    | 00058.001  | 60/142,920           | Jul. 9, 1999  | Converted |

PP. Number 47

Application Ser. No. 10/347,322 is a continuation of application Ser. No. 10/132,256, filed on Apr. 26, 2002.

Application Ser. No. 10/132,256 is a continuation-in-part of the following nonprovisional applications, to which the present application claims priority under §120:

| | Appln. | Filed | Status |
|---|---|---|---|
| 1. | 09/595,326 | Jun. 16, 2000 | Pending at the time of filing 10/132,256 |
| 2. | 09/692,696 | Oct. 20, 2000 | Pending at the time of filing 10/132,256 |
| 3. | 09/692,154 | Oct. 20, 2000 | Pending at the time of filing 10/132,256 |
| 4. | 09/692,714 | Oct. 20, 2000 | Pending at the time of filing 10/132,256 |
| 5. | 09/692,148 | Oct. 20, 2000 | Pending at the time of filing 10/132,256 |
| 6. | 09/692,717 | Oct. 20, 2000 | Pending at the time of filing 10/132,256 |
| 7. | 09/692,152 | Oct. 20, 2000 | Pending at the time of filing 10/132,256 |
| 8. | 09/696,751 | Oct. 25, 2000 | Pending at the time of filing 10/132,256 |
| 9. | 09/695,387 | Oct. 25, 2000 | Pending at the time of filing 10/132,256 |
| 10. | 09/696,284 | Oct. 26, 2000 | Pending at the time of filing 10/132,256 |
| 11. | 09/696,017 | Oct. 26, 2000 | Pending at the time of filing 10/132,256 |
| 12. | 09/697,056 | Oct. 27, 2000 | Pending at the time of filing 10/132,256 |
| 13. | 09/697,145 | Oct. 27, 2000 | Pending at the time of filing 10/132,256 |
| 14. | 09/697,081 | Oct. 27, 2000 | Pending at the time of filing 10/132,256 |
| 15. | 09/697,076 | Oct. 27, 2000 | Pending at the time of filing 10/132,256 |
| 16. | 09/702,873 | Nov. 01, 2000 | Pending at the time of filing 10/132,256 |
| 17. | 09/702,841 | Nov. 1, 2000 | Pending at the time of filing 10/132,256 |
| 18. | 09/703,619 | Nov. 2, 2000 | Pending at the time of filing 10/132,256 |
| 19. | 09/703,627 | Nov. 2, 2000 | Pending at the time of filing 10/132,256 |
| 20. | 09/704,550 | Nov. 3, 2000 | Pending at the time of filing 10/132,256 |
| 21. | 09/704,836 | Nov. 3, 2000 | Pending at the time of filing 10/132,256 |
| 22. | 09/704,541 | Nov. 3, 2000 | Pending at the time of filing 10/132,256 |
| 23. | 09/704,540 | Nov. 3, 2000 | Pending at the time of filing 10/132,256 |
| 24. | 09/708,092 | Nov. 8, 2000 | Pending at the time of filing 10/132,256 |
| 25. | 09/726,578 | Dec. 1, 2000 | Pending at the time of filing 10/132,256 |
| 26. | 09/769,525 | Jan. 26, 2001 | Pending at the time of filing 10/132,256 |
| 27. | 09/774,806 | Feb. 1, 2001 | Pending at the time of filing 10/132,256 |
| 28. | 09/870,664 | Jun. 1, 2001 | Pending at the time of filing 10/132,256 |
| 29. | 10/082,096 | Feb. 26, 2002 | Pending at the time of filing 10/132,256 |
| 30. | 10/086,239 | Mar. 4, 2002 | Pending at the time of filing 10/132,256 |
| 31. | 10/094,538 | Mar. 11, 2002 | Pending at the time of filing 10/132,256 |
| 32. | 10/095,465 | Mar. 13, 2002 | Pending at the time of filing 10/132,256 |
| 33. | 10/097,295 | Mar. 15, 2002 | Pending at the time of filing 10/132,256 |
| 34. | 10/103,845 | Mar. 25, 2002 | Pending at the time of filing 10/132,256 |
| 35. | 10/123,111 | Apr. 17, 2002 | Pending at the time of filing 10/132,256 |

Through the thirty-five nonprovisional applications listed above, the present application also claims priority under 35 USC §119(e) of the following provisional applications:

1. Application Ser. No. 09/595,326 filed Jun. 16, 2000 claims priority under 35 USC §119(e) of the following provisional applications:

| Country | application Ser. No. | Filing Date |
|---|---|---|
| U.S. | 60/139,763 | Jun. 18, 1999 |

2. Application Ser. No. 09/692,696 filed Oct. 20, 2000 claims priority under 35 USC §119(e) of the following provisional applications:

| Country | application Ser. No. | Filing Date |
|---|---|---|
| U.S. | 60/160,981 | Oct. 22, 1999 |

3. Application Ser. No. 09/692,154 filed Oct. 20, 2000 claims priority under 35 USC §119(e) of the following provisional applications:

| Country | application Ser. No. | Filing Date |
|---|---|---|
| U.S. | 60/160,814 | Oct. 21, 1999 |

4. Application Ser. No. 09/692,714 filed Oct. 20, 2000 claims priority under 35 USC §119(e) of the following provisional applications:

| Country | application Ser. No. | Filing Date |
|---|---|---|
| U.S. | 60/160,770 | Oct. 21, 1999 |

5. Application Ser. No. 09/692,148 filed Oct. 20, 2000 claims priority under 35 USC §119(e) of the following provisional applications:

| Country | application Ser. No. | Filing Date |
|---|---|---|
| U.S. | 60/160,768 | Oct. 21, 1999 |

6. Application Ser. No. 09/692,717 filed Oct. 20, 2000 claims priority under 35 USC §119(e) of the following provisional applications:

| Country | application Ser. No. | Filing Date |
|---|---|---|
| U.S. | 60/160,767 | Oct. 21, 1999 |

7. Application Ser. No. 09/692,152 filed Oct. 20, 2000 claims priority under 35 USC §119(e) of the following provisional applications:

| Country | application Ser. No. | Filing Date |
|---|---|---|
| U.S. | 60/160,989 | Oct. 22, 1999 |

8. Application Ser. No. 09/696,751 filed Oct. 25, 2000 claims priority under 35 USC §119(e) of the following provisional applications:

| Country | application Ser. No. | Filing Date |
|---|---|---|
| U.S. | 60/161,406 | Oct. 25, 1999 |

9. Application Ser. No. 09/695,387 filed Oct. 25, 2000 claims priority under 35 USC §119(e) of the following provisional applications:

| Country | application Ser. No. | Filing Date |
|---|---|---|
| U.S. | 60/161,404 | Oct. 25, 1999 |

10. Application Ser. No. 09/696,284 filed Oct. 26, 2000 claims priority under 35 USC §119(e) of the following provisional applications:

| Country | application Ser. No. | Filing Date |
|---|---|---|
| U.S. | 60/161,360 | Oct. 26, 1999 |

11. Application Ser. No. 09/696,017 filed Oct. 26, 2000 claims priority under 35 USC §119(e) of the following provisional applications:

| Country | application Ser. No. | Filing Date |
|---|---|---|
| U.S. | 60/161,359 | Oct. 26, 1999 |

12. Application Ser. No. 09/697,056 filed Oct. 27, 2000 claims priority under 35 USC §119(e) of the following provisional applications:

| Country | application Ser. No. | Filing Date |
|---|---|---|
| U.S. | 60/161,992 | Oct. 28, 1999 |

13. Application Ser. No. 09/697,145 filed Oct. 27, 2000 claims priority under 35 USC §119(e) of the following provisional applications:

| Country | application Ser. No. | Filing Date |
|---|---|---|
| U.S. | 60/161,993 | Oct. 28, 1999 |

14. Application Ser. No. 09/697,081 filed Oct. 27, 2000 claims priority under 35 USC §119(e) of the following provisional applications:

| Country | application Ser. No. | Filing Date |
|---|---|---|
| U.S. | 60/162,142 | Oct. 29, 1999 |

15. Application Ser. No. 09/697,076 filed Oct. 27, 2000 claims priority under 35 USC §119(e) of the following provisional applications:

| Country | application Ser. No. | Filing Date |
|---|---|---|
| U.S. | 60/162,228 | Oct. 29, 1999 |

16. Application Ser. No. 09/702,873 filed Nov. 1, 2000 claims priority under 35 USC §119(e) of the following provisional applications:

| Country | application Ser. No. | Filing Date |
|---|---|---|
| U.S. | 60/162,895 | Nov. 1, 1999 |

17. Application Ser. No. 09/702,841 filed Nov. 1, 2000 claims priority under 35 USC §119(e) of the following provisional applications:

| Country | application Ser. No. | Filing Date |
|---|---|---|
| U.S. | 60/162,891 | Nov. 1, 1999 |

18. Application Ser. No. 09/703,619 filed Nov. 2, 2000 claims priority under 35 USC §119(e) of the following provisional applications:

| Country | application Ser. No. | Filing Date |
|---|---|---|
| U.S. | 60/163,091 | Nov. 2, 1999 |

19. Application Ser. No. 09/703,627 filed Nov. 2, 2000 claims priority under 35 USC §119(e) of the following provisional applications:

| Country | application Ser. No. | Filing Date |
|---|---|---|
| U.S. | 60/163,092 | Nov. 2, 1999 |

20. Application Ser. No. 09/704,550 filed Nov. 3, 2000 claims priority under 35 USC §119(e) of the following provisional applications:

| Country | application Ser. No. | Filing Date |
|---|---|---|
| U.S. | 60/163,248 | Nov. 3, 1999 |

21. Application Ser. No. 09/704,836 filed Nov. 3, 2000 claims priority under 35 USC §119(e) of the following provisional applications:

| Country | application Ser. No. | Filing Date |
|---|---|---|
| U.S. | 60/163,281 | Nov. 3, 1999 |

22. Application Ser. No. 09/704,541 filed Nov. 3, 2000 claims priority under 35 USC §119(e) of the following provisional applications:

| Country | application Ser. No. | Filing Date |
|---|---|---|
| U.S. | 60/163,381 | Nov. 4, 1999 |

23. Application Ser. No. 09/704,540 filed Nov. 3, 2000 claims priority under 35 USC §119(e) of the following provisional applications:

| Country | application Ser. No. | Filing Date |
|---|---|---|
| U.S. | 60/163,380 | Nov. 4, 1999 |

24. Application Ser. No. 09/708,092 filed Nov. 8, 2000 claims priority under 35 USC §119(e) of the following provisional applications:

| | Country | Appln. No. | Filing Date |
|---|---|---|---|
| 1. | U.S. | 60/165,918 | Nov. 17, 1999 |
| 2. | U.S. | 60/166,733 | Nov. 22, 1999 |
| 3. | U.S. | 60/165,661 | Nov. 16, 1999 |
| 4. | U.S. | 60/165,919 | Nov. 17, 1999 |
| 5. | U.S. | 60/165,911 | Nov. 17, 1999 |
| 6. | U.S. | 60/166,173 | Nov. 18, 1999 |
| 7. | U.S. | 60/166,158 | Nov. 18, 1999 |
| 8. | U.S. | 60/166,419 | Nov. 19, 1999 |
| 9. | U.S. | 60/166,157 | Nov. 18, 1999 |
| 10. | U.S. | 60/166,412 | Nov. 19, 1999 |
| 11. | U.S. | 60/165,669 | Nov. 16, 1999 |
| 12. | U.S. | 60/166,750 | Nov. 22, 1999 |
| 13. | U.S. | 60/167,233 | Nov. 24, 1999 |
| 14. | U.S. | 60/167,234 | Nov. 24, 1999 |
| 15. | U.S. | 60/167,235 | Nov. 24, 1999 |
| 16. | U.S. | 60/167,904 | Nov. 30, 1999 |
| 17. | U.S. | 60/167,908 | Nov. 30, 1999 |
| 18. | U.S. | 60/166,411 | Nov. 19, 1999 |
| 19. | U.S. | 60/164,960 | Nov. 12, 1999 |
| 20. | U.S. | 60/164,146 | Nov. 8, 1999 |
| 21. | U.S. | 60/164,151 | Nov. 8, 1999 |
| 22. | U.S. | 60/164,150 | Nov. 8, 1999 |
| 23. | U.S. | 60/164,544 | Nov. 10, 1999 |
| 24. | U.S. | 60/164,545 | Nov. 10, 1999 |
| 25. | U.S. | 60/164,548 | Nov. 10, 1999 |
| 26. | U.S. | 60/165,671 | Nov. 16, 1999 |
| 27. | U.S. | 60/164,871 | Nov. 12, 1999 |
| 28. | U.S. | 60/167,902 | Nov. 30, 1999 |
| 29. | U.S. | 60/164,870 | Nov. 12, 1999 |
| 30. | U.S. | 60/164,959 | Nov. 12, 1999 |
| 31. | U.S. | 60/164,962 | Nov. 12, 1999 |
| 32. | U.S. | 60/164,927 | Nov. 15, 1999 |
| 33. | U.S. | 60/164,929 | Nov. 15, 1999 |
| 34. | U.S. | 60/164,926 | Nov. 15, 1999 |
| 35. | U.S. | 60/164,961 | Nov. 12, 1999 |

25. Application Ser. No. 09/726,578 filed Dec. 1, 2000 claims priority under 35 USC §119(e) of the following provisional applications:

| | Country | Appln. No. | Filing Date |
|---|---|---|---|
| 1. | U.S. | 60/169,302 | Dec. 7, 1999 |
| 2. | U.S. | 60/168,231 | Dec. 1, 1999 |
| 3. | U.S. | 60/168,549 | Dec. 2, 1999 |
| 4. | U.S. | 60/168,548 | Dec. 2, 1999 |
| 5. | U.S. | 60/168,675 | Dec. 3, 1999 |
| 6. | U.S. | 60/168,673 | Dec. 3, 1999 |
| 7. | U.S. | 60/168,674 | Dec. 3, 1999 |
| 8. | U.S. | 60/168,232 | Dec. 1, 1999 |
| 9. | U.S. | 60/169,278 | Dec. 7, 1999 |
| 10. | U.S. | 60/168,233 | Dec. 1, 1999 |
| 11. | U.S. | 60/171,107 | Dec. 16, 1999 |
| 12. | U.S. | 60/171,114 | Dec. 16, 1999 |
| 13. | U.S. | 60/171,098 | Dec. 16, 1999 |
| 14. | U.S. | 60/169,298 | Dec. 7, 1999 |
| 15. | U.S. | 60/168,546 | Dec. 2, 1999 |

26. Application Ser. No. 09/769,525 filed Jan. 26, 2001 claims priority under 35 USC §119(e) of the following provisional applications:

| | Country | Appln. No. | Filing Date |
|---|---|---|---|
| 1. | U.S. | 60/178,547 | Jan. 27, 2000 |
| 2. | U.S. | 60/178,755 | Jan. 28, 2000 |
| 3. | U.S. | 60/177,666 | Jan. 27, 2000 |
| 4. | U.S | 60/178,754 | Jan. 28, 2000 |

27. Application Ser. No. 09/774,806 filed Feb. 1, 2001 claims priority under 35 USC §119(e) of the following provisional applications:

| | Country | Appln. No. | Filing Date |
|---|---|---|---|
| 1. | U.S. | 60/182,477 | Feb. 15, 2000 |
| 2. | U.S. | 60/180,696 | Feb. 7, 2000 |
| 3. | U.S. | 60/183,166 | Feb. 17, 2000 |
| 4. | U.S. | 60/183,165 | Feb. 17, 2000 |
| 5. | U.S. | 60/182,512 | Feb. 15, 2000 |
| 6. | U.S. | 60/182,516 | Feb. 15, 2000 |
| 7. | U.S. | 60/181,551 | Feb. 10, 2000 |
| 8. | U.S. | 60/181,476 | Feb. 10, 2000 |
| 9. | U.S. | 60/184,667 | Feb. 24, 2000 |
| 10. | U.S. | 60/181,228 | Feb. 9, 2000 |
| 11. | U.S. | 60/185,397 | Feb. 28, 2000 |
| 12. | U.S. | 60/180,695 | Feb. 7, 2000 |
| 13. | U.S. | 60/180,207 | Feb. 4, 2000 |
| 14. | U.S. | 60/181,214 | Feb. 9, 2000 |
| 15. | U.S. | 60/180,139 | Feb. 3, 2000 |
| 16. | U.S. | 60/179,388 | Feb. 1, 2000 |
| 17. | U.S. | 60/179,395 | Feb. 1, 2000 |
| 18. | U.S. | 60/185,119 | Feb. 25, 2000 |
| 19. | U.S. | 60/180,039 | Feb. 3, 2000 |
| 20. | U.S. | 60/184,658 | Feb. 24, 2000 |
| 21. | U.S. | 60/185,396 | Feb. 28, 2000 |
| 22. | U.S. | 60/180,206 | Feb. 4, 2000 |
| 23. | U.S. | 60/185,118 | Feb. 25, 2000 |

28. Application Ser. No. 09/870,664 filed Jun. 1, 2001 claims priority under 35 USC §119(e) of the following provisional applications:

| | Country | Appln. No. | Filing Date |
|---|---|---|---|
| 1. | U.S. | 60/208,918 | Jun. 5, 2000 |
| 2. | U.S. | 60/214,535 | Jun. 27, 2000 |
| 3. | U.S. | 60/208,920 | Jun. 5, 2000 |
| 4. | U.S. | 60/215,127 | Jun. 30, 2000 |
| 5. | U.S. | 60/214,799 | Jun. 28, 2000 |
| 6. | U.S. | 60/213,249 | Jun. 22, 2000 |
| 7. | U.S. | 60/210,564 | Jun. 9, 2000 |
| 8. | U.S. | 60/210,006 | Jun. 8, 2000 |
| 9. | U.S. | 60/208,312 | Jun. 1, 2000 |
| 10. | U.S. | 60/211,214 | Jun. 13, 2000 |

29. Application Ser. No. 10/082,096 filed Feb. 26, 2002 is a continuation of application Ser. No. 09/795,347 filed Mar. 1, 2001 and claims priority under 35 USC §119(e) of the following provisional applications claims priority under 35 USC §119(e) of the following provisional applications:

|     | Country | Appln. No. | Filing Date |
|-----|---------|------------|-------------|
| 1.  | U.S.    | 60/192,308 | Mar. 27, 2000 |
| 2.  | U.S.    | 60/189,959 | Mar. 16, 2000 |
| 3.  | U.S.    | 60/190,069 | Mar. 20, 2000 |
| 4.  | U.S.    | 60/190,070 | Mar. 20, 2000 |
| 5.  | U.S.    | 60/190,545 | Mar. 20, 2000 |
| 6.  | U.S.    | 60/190,089 | Mar. 20, 2000 |
| 7.  | U.S.    | 60/191,084 | Mar. 22, 2000 |
| 8.  | U.S.    | 60/191,097 | Mar. 22, 2000 |
| 9.  | U.S.    | 60/191,543 | Mar. 23, 2000 |
| 10. | U.S.    | 60/191,545 | Mar. 23, 2000 |
| 11. | U.S.    | 60/191,823 | Mar. 24, 2000 |
| 12. | U.S.    | 60/192,421 | Mar. 27, 2000 |
| 13. | U.S.    | 60/189,461 | Mar. 15, 2000 |
| 14. | U.S.    | 60/192,940 | Mar. 29, 2000 |
| 15. | U.S.    | 60/192,941 | Mar. 29, 2000 |
| 16. | U.S.    | 60/193,244 | Mar. 30, 2000 |
| 17. | U.S.    | 60/193,245 | Mar. 30, 2000 |
| 18. | U.S.    | 60/193,453 | Mar. 31, 2000 |
| 19. | U.S.    | 60/193,455 | Mar. 31, 2000 |
| 20. | U.S.    | 60/191,825 | Mar. 24, 2000 |
| 21. | U.S.    | 60/187,378 | Mar. 7, 2000 |
| 22. | U.S.    | 60/186,390 | Mar. 2, 2000 |
| 23. | U.S.    | 60/186,283 | Mar. 1, 2000 |
| 24. | U.S.    | 60/186,296 | Mar. 1, 2000 |
| 25. | U.S.    | 60/187,178 | Mar. 2, 2000 |
| 26. | U.S.    | 60/186,386 | Mar. 2, 2000 |
| 27. | U.S.    | 60/186,387 | Mar. 2, 2000 |
| 28. | U.S.    | 60/189,953 | Mar. 16, 2000 |
| 29. | U.S.    | 60/186,669 | Mar. 3, 2000 |
| 30. | U.S.    | 60/189,462 | Mar. 15, 2000 |
| 31. | U.S.    | 60/187,896 | Mar. 8, 2000 |
| 32. | U.S.    | 60/187,888 | Mar. 8, 2000 |
| 33. | U.S.    | 60/188,187 | Mar. 10, 2000 |
| 34. | U.S.    | 60/188,186 | Mar. 10, 2000 |
| 35. | U.S.    | 60/188,185 | Mar. 10, 2000 |
| 36. | U.S.    | 60/188,175 | Mar. 10, 2000 |
| 37. | U.S.    | 60/189,080 | Mar. 14, 2000 |
| 38. | U.S.    | 60/189,052 | Mar. 14, 2000 |
| 39. | U.S.    | 60/186,748 | Mar. 3, 2000 |

30. Application Ser. No. 10/086,239 filed Mar. 4, 2002 is a continuation of application Ser. No. 09/845,206 filed May 1, 2001 and claims priority under 35 USC §119(e) of the following provisional applications:

|     | Country | Appln. No. | Filing Date |
|-----|---------|------------|-------------|
| 1.  | U.S.    | 60/201,305 | May 2, 2000 |
| 2.  | U.S.    | 60/206,319 | May 23, 2000 |
| 3.  | U.S.    | 60/204,829 | May 17, 2000 |
| 4.  | U.S.    | 60/201,275 | May 2, 2000 |
| 5.  | U.S.    | 60/205,058 | May 18, 2000 |
| 6.  | U.S.    | 60/205,242 | May 19, 2000 |
| 7.  | U.S.    | 60/205,243 | May 19, 2000 |
| 8.  | U.S.    | 60/205,572 | May 22, 2000 |
| 9.  | U.S.    | 60/204,569 | May 16, 2000 |
| 10. | U.S.    | 60/206,316 | May 23, 2000 |
| 11. | U.S.    | 60/204,830 | May 17, 2000 |
| 12. | U.S.    | 60/206,553 | May 24, 2000 |
| 13. | U.S.    | 60/206,545 | May 24, 2000 |
| 14. | U.S.    | 60/207,367 | May 26, 2000 |
| 15. | U.S.    | 60/207,243 | May 26, 2000 |
| 16. | U.S.    | 60/207,239 | May 26, 2000 |
| 17. | U.S.    | 60/207,354 | May 26, 2000 |
| 18. | U.S.    | 60/207,452 | May 30, 2000 |
| 19. | U.S.    | 60/207,329 | May 30, 2000 |
| 20. | U.S.    | 60/205,576 | May 22, 2000 |
| 21. | U.S.    | 60/202,636 | May 9, 2000 |

-continued

|     | Country | Appln. No. | Filing Date |
|-----|---------|------------|-------------|
| 22. | U.S.    | 60/200,879 | May 1, 2000 |
| 23. | U.S.    | 60/201,740 | May 4, 2000 |
| 24. | U.S.    | 60/201,750 | May 4, 2000 |
| 25. | U.S.    | 60/202,112 | May 5, 2000 |
| 26. | U.S.    | 60/205,201 | May 18, 2000 |
| 27. | U.S.    | 60/202,914 | May 9, 2000 |
| 28. | U.S.    | 60/204,568 | May 16, 2000 |
| 29. | U.S.    | 60/202,919 | May 9, 2000 |
| 30. | U.S.    | 60/202,634 | May 9, 2000 |
| 31. | U.S.    | 60/202,968 | May 10, 2000 |
| 32. | U.S.    | 60/202,963 | May 10, 2000 |
| 33. | U.S.    | 60/203,457 | May 11, 2000 |
| 34. | U.S.    | 60/203,279 | May 11, 2000 |
| 35. | U.S.    | 60/203,916 | May 12, 2000 |
| 36. | U.S.    | 60/203,915 | May 12, 2000 |
| 37. | U.S.    | 60/204,388 | May 15, 2000 |
| 38. | U.S.    | 60/204,122 | May 15, 2000 |
| 39. | U.S.    | 60/202,180 | May 5, 2000 |

31. Application Ser. No. 10/094,538 filed Mar. 11, 2002 is a continuation of application Ser. No. 09/783,606 filed Feb. 15, 2001 and claims priority under 35 USC §119(e) of the following provisional applications:

| Country | application Ser. No. | Filing Date |
|---------|----------------------|-------------|
| U.S.    | 60/182,478           | Feb. 15, 2000 |

32. Application Ser. No. 10/095,465 filed Mar. 13, 2002 is a continuation of application Ser. No. 09/824,882 filed Apr. 4, 2001 and claims priority under 35 USC §119(e) of the following provisional applications:

|     | Country | Appln. No. | Filing Date |
|-----|---------|------------|-------------|
| 1.  | U.S.    | 60/199,828 | Apr. 26, 2000 |
| 2.  | U.S.    | 60/198,619 | Apr. 20, 2000 |
| 3.  | U.S.    | 60/195,045 | Apr. 6, 2000 |
| 4.  | U.S.    | 60/194,404 | Apr. 4, 2000 |
| 5.  | U.S.    | 60/196,486 | Apr. 12, 2000 |
| 6.  | U.S.    | 60/196,487 | Apr. 12, 2000 |
| 7.  | U.S.    | 60/196,169 | Apr. 11, 2000 |
| 8.  | U.S.    | 60/196,089 | Apr. 11, 2000 |
| 9.  | U.S.    | 60/196,485 | Apr. 12, 2000 |
| 10. | U.S.    | 60/194,874 | Apr. 6, 2000 |
| 11. | U.S.    | 60/197,671 | Apr. 17, 2000 |
| 12. | U.S.    | 60/194,872 | Apr. 6, 2000 |
| 13. | U.S.    | 60/194,697 | Apr. 5, 2000 |
| 14. | U.S.    | 60/194,683 | Apr. 5, 2000 |
| 15. | U.S.    | 60/199,122 | Apr. 24, 2000 |
| 16. | U.S.    | 60/198,623 | Apr. 20, 2000 |
| 17. | U.S.    | 60/197,678 | Apr. 17, 2000 |
| 18. | U.S.    | 60/198,133 | Apr. 17, 2000 |
| 19. | U.S.    | 60/197,687 | Apr. 17, 2000 |
| 20. | U.S.    | 60/198,386 | Apr. 19, 2000 |
| 21. | U.S.    | 60/198,373 | Apr. 19, 2000 |
| 22. | U.S.    | 60/194,398 | Apr. 4, 2000 |
| 23. | U.S.    | 60/200,102 | Apr. 27, 2000 |
| 24. | U.S.    | 60/195,283 | Apr. 7, 2000 |
| 25. | U.S.    | 60/196,289 | Apr. 12, 2000 |
| 26. | U.S.    | 60/199,124 | Apr. 24, 2000 |
| 27. | U.S.    | 60/195,257 | Apr. 7, 2000 |
| 28. | U.S.    | 60/199,818 | Apr. 26, 2000 |
| 29. | U.S.    | 60/200,103 | Apr. 27, 2000 |
| 30. | U.S.    | 60/198,767 | Apr. 21, 2000 |
| 31. | U.S.    | 60/198,763 | Apr. 21, 2000 |
| 32. | U.S.    | 60/194,885 | Apr. 6, 2000 |

33. Application Ser. No. 10/097,295 filed Mar. 15, 2002 is a continuation of application Ser. No. 09/881,096 filed Jun. 15, 2001 and claims priority under 35 USC §119(e) of the following provisional applications:

|     | Country | Appln. No. | Filing Date |
|-----|---------|------------|-------------|
| 1.  | U.S.    | 60/212,727 | Jun. 20, 2000 |
| 2.  | U.S.    | 60/212,623 | Jun. 19, 2000 |
| 3.  | U.S.    | 60/213,270 | Jun. 22, 2000 |
| 4.  | U.S.    | 60/214,524 | Jun. 27, 2000 |
| 5.  | U.S.    | 60/211,538 | Jun. 15, 2000 |

34. Application Ser. No. 10/103,845 filed Mar. 25, 2002 is a continuation of application Ser. No. 09/898,063 filed Jul. 5, 2001 and claims priority under 35 USC §119(e) of the following provisional applications:

|     | Country | Appln. No. | Filing Date |
|-----|---------|------------|-------------|
| 1.  | U.S.    | 60/219,033 | Jul. 18, 2000 |
| 2.  | U.S.    | 60/216,362 | Jul. 5, 2000 |
| 3.  | U.S.    | 60/217,384 | Jul. 11, 2000 |
| 4.  | U.S.    | 60/220,811 | Jul. 25, 2000 |
| 5.  | U.S.    | 60/220,652 | Jul. 25, 2000 |

35. Application Ser. No. 10/123,111 filed Apr. 17, 2002 is a continuation of application Ser. No. 09/928,372 filed Aug. 14, 2001 and claims priority under 35 USC §119(e) of the following provisional applications:

|     | Country | Appln. No. | Filing Date |
|-----|---------|------------|-------------|
| 1.  | U.S.    | 60/225,303 | Aug. 15, 2000 |
| 2.  | U.S.    | 60/227,024 | Aug. 23, 2000 |
| 3.  | U.S.    | 60/228,898 | Aug. 30, 2000 |
| 4.  | U.S.    | 60/224,517 | Aug. 14, 2000 |
| 5.  | U.S.    | 60/226,452 | Aug. 21, 2000 |

QQ. Number 48

Application Ser. No. 10/406,556 listed above is a continuation application Ser. No. 10/132,277, filed on Apr. 26, 2002.

Application Ser. No. 10/132,277 is a continuation-in-part of the following nonprovisional applications, to which the present application also claims priority:

|     | Country | Client No. | Appln. No. | Filed |
|-----|---------|------------|------------|-------|
| 1.  | U.S.    | 91006.002  | 09/570,581 | May 12, 2000 |
| 2.  | U.S.    | 00037.002  | 09/595,334 | Jun. 16, 2000 |
| 3.  | U.S.    | 00039.002  | 09/596,577 | Jun. 16, 2000 |
| 4.  | U.S.    | 00042.003  | 09/602,660 | Jun. 21, 2000 |
| 5.  | U.S.    | 00043.002  | 09/602,152 | Jun. 22, 2000 |
| 6.  | U.S.    | 00044.002  | 09/602,025 | Jun. 23, 2000 |
| 7.  | U.S.    | 00046.002  | 09/605,843 | Jun. 28, 2000 |
| 8.  | U.S.    | 00049.002  | 09/608,960 | Jun. 30, 2000 |
| 9.  | U.S.    | 00059.002  | 09/615,007 | Jul. 12, 2000 |
| 10. | U.S.    | 00060.002  | 09/615,748 | Jul. 13, 2000 |
| 11. | U.S.    | 00061.002  | 09/617,525 | Jul. 14, 2000 |
| 12. | U.S.    | 00062.002  | 09/617,203 | Jul. 14, 2000 |
| 13. | U.S.    | 00064.002  | 09/620,421 | Jul. 19, 2000 |
| 14. | U.S.    | 00065.002  | 09/621,323 | Jul. 20, 2000 |
| 15. | U.S.    | 00066.002  | 09/621,630 | Jul. 21, 2000 |
| 16. | U.S.    | 00067.002  | 09/621,660 | Jul. 21, 2000 |
| 17. | U.S.    | 00069.002  | 09/621,902 | Jul. 21, 2000 |
| 18. | U.S.    | 00070.002  | 09/616,628 | Jul. 26, 2000 |
| 19. | U.S.    | 00071.002  | 09/628,986 | Jul. 27, 2000 |
| 20. | U.S.    | 00072.002  | 09/628,552 | Jul. 28, 2000 |
| 21. | U.S.    | 00073.002  | 09/632,340 | Aug. 2, 2000 |
| 22. | U.S.    | 00074.002  | 09/632,349 | Aug. 3, 2000 |
| 23. | U.S.    | 00076.002  | 09/633,051 | Aug. 4, 2000 |
| 24. | U.S.    | 00077.002  | 09/633,191 | Aug. 4, 2000 |
| 25. | U.S.    | 00079.002  | 09/633,239 | Aug. 4, 2000 |
| 26. | U.S.    | 00080.002  | 09/635,277 | Aug. 9, 2000 |
| 27. | U.S.    | 00081.002  | 09/637,837 | Aug. 11, 2000 |
| 28. | U.S.    | 00082.002  | 09/636,555 | Aug. 11, 2000 |
| 29. | U.S.    | 00083.002  | 09/637,563 | Aug. 11, 2000 |
| 30. | U.S.    | 00084.002  | 09/641,198 | Aug. 17, 2000 |
| 31. | U.S.    | 00087.002  | 09/640,695 | Aug. 18, 2000 |
| 32. | U.S.    | 00085.002  | 09/641,359 | Aug. 18, 2000 |
| 33. | U.S.    | 00086.002  | 09/641,375 | Aug. 18, 2000 |
| 34. | U.S.    | 00088.002  | 09/643,854 | Aug. 23, 2000 |
| 35. | U.S.    | 00089.002  | 09/645,440 | Aug. 25, 2000 |
| 36. | U.S.    | 00090.002  | 09/648,708 | Aug. 25, 2000 |
| 37. | U.S.    | 00091.002  | 09/645,441 | Aug. 25, 2000 |
| 38. | U.S.    | 00092.002  | 09/651,370 | Aug. 30, 2000 |
| 39. | U.S.    | 00093.002  | 09/653,466 | Aug. 31, 2000 |
| 40. | U.S.    | 00094.002  | 09/654,547 | Sep. 1, 2000 |
| 41. | U.S.    | 00095.002  | 09/657,454 | Sep. 7, 2000 |
| 42. | U.S.    | 00096.002  | 09/657,569 | Sep. 8, 2000 |
| 43. | U.S.    | 00098.002  | 09/660,883 | Sep. 13, 2000 |
| 44. | U.S.    | 00099.002  | 09/663,196 | Sep. 15, 2000 |
| 45. | U.S.    | 00101.002  | 09/663,195 | Sep. 15, 2000 |
| 46. | U.S.    | 00102.002  | 09/665,714 | Sep. 20, 2000 |
| 47. | U.S.    | 00103.002  | 09/667,597 | Sep. 22, 2000 |
| 48. | U.S.    | 00104.002  | 09/667,517 | Sep. 22, 2000 |
| 49. | U.S.    | 00105.002  | 09/667,229 | Sep. 22, 2000 |
| 50. | U.S.    | 00106.002  | 09/671,635 | Sep. 28, 2000 |
| 51. | U.S.    | 00107.002  | 09/672,075 | Sep. 29, 2000 |
| 52. | U.S.    | 00108.002  | 09/679,203 | Oct. 4, 2000 |
| 53. | U.S.    | 00109.002  | 09/678,223 | Oct. 5, 2000 |
| 54. | U.S.    | 00110.002  | 09/680,499 | Oct. 6, 2000 |
| 55. | U.S.    | 00111.002  | 09/680,490 | Oct. 6, 2000 |
| 56. | U.S.    | 00112.002  | 09/680,498 | Oct. 6, 2000 |
| 57. | U.S.    | 00113.002  | 09/686,093 | Oct. 12, 2000 |
| 58. | U.S.    | 00116.002  | 09/690,745 | Oct. 18, 2000 |
| 59. | U.S.    | 00120.002  | 09/692,108 | Oct. 20, 2000 |
| 60. | U.S.    | 00119.002  | 09/692,153 | Oct. 20, 2000 |
| 61. | U.S.    | 00118.002  | 09/692,157 | Oct. 20, 2000 |
| 62. | U.S.    | 00121.002  | 09/695,391 | Oct. 25, 2000 |
| 63. | U.S.    | 00122.002  | 09/696,305 | Oct. 26, 2000 |
| 64. | U.S.    | 00123.002  | 09/697,080 | Oct. 27, 2000 |
| 65. | U.S.    | 00124.002  | 09/697,718 | Oct. 27, 2000 |
| 66. | U.S.    | 00125.002  | 09/702,840 | Nov. 1, 2000 |
| 67. | U.S.    | 00126.002  | 09/703,932 | Nov. 2, 2000 |
| 68. | U.S.    | 00127.002  | 09/704,559 | Nov. 3, 2000 |
| 69. | U.S.    | 00128.002  | 09/704,542 | Nov. 3, 2000 |
| 70. | U.S.    | 00129.002  | 09/708,092 | Nov. 8, 2000 |
| 71. | U.S.    | 00143.002  | 09/726,578 | Dec. 1, 2000 |
| 72. | U.S.    | 00153.002  | 09/769,525 | Jan. 26, 2001 |
| 73. | U.S.    | 00157.002  | 09/774,806 | Feb. 1, 2001 |
| 74. | U.S.    | 00231.002  | 09/870,652 | Jun. 1, 2001 |
| 75. | U.S.    | 91072.002  | 09/878,974 | Jun. 13, 2001 |
| 76. | U.S.    | 00170.003  | 10/082,096 | Feb. 26, 2002 |
| 77. | U.S.    | 00211.003  | 10/086,239 | Mar. 4, 2002 |
| 78. | U.S.    | 00191.003  | 10/095,465 | Mar. 13, 2002 |
| 79. | U.S.    | 00252.003  | 10/106,718 | Mar. 27, 2002 |
| 80. | U.S.    | 80298.003  | 10/132,111 | Apr. 17, 2002 |

Through the applications listed above, the present application also claims priority under 35 USC §119(e), §119(a-d) and §120 of the following applications:

|     | Country | Client No. | Appln. | Filed |
|-----|---------|------------|--------|-------|
| 81. | U.S.    | 91006.001  | 60/134,370 | May 14, 1999 |
| 82. | U.S.    | 00037.001  | 60/139,492 | Jun. 17, 1999 |
| 83. | U.S.    | 00038.001  | 60/139,763 | Jun. 18, 1999 |
| 84. | U.S.    | 00039.001  | 60/139,750 | Jun. 18, 1999 |
| 85. | U.S.    | 00042.001  | 60/139,817 | Jun. 21, 1999 |
| 86. | U.S.    | 00043.001  | 60/139,899 | Jun. 22, 1999 |
| 87. | U.S.    | 00042.002  | 60/140,353 | Jun. 23, 1999 |
| 88. | U.S.    | 00044.001  | 60/140,354 | Jun. 23, 1999 |

|  | Country | Client No. | Appln. | Filed |
|---|---|---|---|---|
| 89. | U.S. | 00046.001 | 60/140,823 | Jun. 28, 1999 |
| 90. | U.S. | 00049.001 | 60/141,287 | Jun. 30, 1999 |
| 91. | U.S. | 00059.001 | 60/142,977 | Jul. 12, 1999 |
| 92. | U.S. | 00060.001 | 60/143,542 | Jul. 13, 1999 |
| 93. | U.S. | 00061.001 | 60/143,624 | Jul. 14, 1999 |
| 94. | U.S. | 00062.001 | 60/144,005 | Jul. 15, 1999 |
| 95. | U.S. | 00064.001 | 60/144,325 | Jul. 19, 1999 |
| 96. | U.S. | 00065.001 | 60/144,632 | Jul. 20, 1999 |
| 97. | U.S. | 00066.001 | 60/144,814 | Jul. 21, 1999 |
| 98. | U.S. | 00067.001 | 60/145,192 | Jul. 22, 1999 |
| 99. | U.S. | 00069.001 | 60/145,218 | Jul. 23, 1999 |
| 100. | U.S. | 00070.001 | 60/145,276 | Jul. 26, 1999 |
| 101. | U.S. | 00071.001 | 60/145,913 | Jul. 27, 1999 |
| 102. | U.S. | 00072.001 | 60/145,951 | Jul. 28, 1999 |
| 103. | U.S. | 00073.001 | 60/146,386 | Aug. 2, 1999 |
| 104. | U.S. | 00074.001 | 60/147,038 | Aug. 3, 1999 |
| 105. | U.S. | 00076.001 | 60/147,204 | Aug. 4, 1999 |
| 106. | U.S. | 00077.001 | 60/147,260 | Aug. 5, 1999 |
| 107. | U.S. | 00079.001 | 60/147,416 | Aug. 6, 1999 |
| 108. | U.S. | 00080.001 | 60/147,493 | Aug. 9, 1999 |
| 109. | U.S. | 00081.001 | 60/148,319 | Aug. 11, 1999 |
| 110. | U.S. | 00082.001 | 60/148,341 | Aug. 12, 1999 |
| 111. | U.S. | 00083.001 | 60/148,565 | Aug. 13, 1999 |
| 112. | U.S. | 00084.001 | 60/149,175 | Aug. 17, 1999 |
| 113. | U.S. | 00085.001 | 60/149,426 | Aug. 18, 1999 |
| 114. | U.S. | 00086.001 | 60/149,722 | Aug. 20, 1999 |
| 115. | U.S. | 00087.001 | 60/149,723 | Aug. 20, 1999 |
| 116. | U.S. | 00088.001 | 60/149,902 | Aug. 23, 1999 |
| 117. | U.S. | 00089.001 | 60/150,566 | Aug. 25, 1999 |
| 118. | U.S. | 00090.001 | 60/150,884 | Aug. 26, 1999 |
| 119. | U.S. | 00091.001 | 60/151,080 | Aug. 27, 1999 |
| 120. | U.S. | 00092.001 | 60/151,303 | Aug. 30, 1999 |
| 121. | U.S. | 00093.001 | 60/151,438 | Aug. 31, 1999 |
| 122. | U.S. | 00094.001 | 60/151,930 | Sep. 1, 1999 |
| 123. | U.S. | 00095.001 | 60/152,363 | Sep. 7, 1999 |
| 124. | U.S. | 00096.001 | 60/153,070 | Sep. 10, 1999 |
| 125. | U.S. | 00098.001 | 60/153,758 | Sep. 13, 1999 |
| 126. | U.S. | 00099.001 | 60/154,018 | Sep. 15, 1999 |
| 127. | U.S. | 00101.001 | 60/154,039 | Sep. 16, 1999 |
| 128. | U.S. | 00102.001 | 60/154,779 | Sep. 20, 1999 |
| 129. | U.S. | 00103.001 | 60/155,139 | Sep. 22, 1999 |
| 130. | U.S. | 00104.001 | 60/155,486 | Sep. 23, 1999 |
| 131. | U.S. | 00105.001 | 60/155,659 | Sep. 24, 1999 |
| 132. | U.S. | 00106.001 | 60/156,458 | Sep. 28, 1999 |
| 133. | U.S. | 00107.001 | 60/156,596 | Sep. 29, 1999 |
| 134. | U.S. | 00108.001 | 60/157,117 | Oct. 4, 1999 |
| 135. | U.S. | 00109.001 | 60/157,753 | Oct. 5, 1999 |
| 136. | U.S. | 00110.001 | 60/157,865 | Oct. 6, 1999 |
| 137. | U.S. | 00111.001 | 60/158,029 | Oct. 7, 1999 |
| 138. | U.S. | 00112.001 | 60/158,232 | Oct. 8, 1999 |
| 139. | U.S. | 00113.001 | 60/158,369 | Oct. 12, 1999 |
| 140. | U.S. | 00116.001 | 60/159,584 | Oct. 18, 1999 |
| 141. | U.S. | 00119.001 | 60/160,741 | Oct. 21, 1999 |
| 142. | U.S. | 00118.001 | 60/160,815 | Oct. 21, 1999 |
| 143. | U.S. | 00120.001 | 60/160,980 | Oct. 22, 1999 |
| 144. | U.S. | 00121.001 | 60/161,405 | Oct. 25, 1999 |
| 145. | U.S. | 00122.001 | 60/161,361 | Oct. 26, 1999 |
| 146. | U.S. | 00123.001 | 60/161,920 | Oct. 28, 1999 |
| 147. | U.S. | 00124.001 | 60/162,143 | Oct. 29, 1999 |
| 148. | U.S. | 00125.001 | 60/162,894 | Nov. 1, 1999 |
| 149. | U.S. | 00126.001 | 60/163,093 | Nov. 2, 1999 |
| 150. | U.S. | 00127.001 | 60/163,249 | Nov. 3, 1999 |
| 151. | U.S. | 00128.001 | 60/163,379 | Nov. 4, 1999 |
| 152. | U.S. | 00129.001 | 60/164,146 | Nov. 8, 1999 |
| 153. | U.S. | 00131.001 | 60/164,544 | Nov. 10, 1999 |
| 154. | U.S. | 00133.001 | 60/164,870 | Nov. 12, 1999 |
| 155. | U.S. | 00132.001 | 60/164,961 | Nov. 12, 1999 |
| 156. | U.S. | 00134.001 | 60/164,927 | Nov. 15, 1999 |
| 157. | U.S. | 00135.001 | 60/165,669 | Nov. 16, 1999 |
| 158. | U.S. | 00136.001 | 60/165,919 | Nov. 17, 1999 |
| 159. | U.S. | 00137.001 | 60/166,157 | Nov. 18, 1999 |
| 160. | U.S. | 00139.001 | 60/166,419 | Nov. 19, 1999 |
| 161. | U.S. | 00140.001 | 60/166,733 | Nov. 22, 1999 |
| 162. | U.S. | 00141.001 | 60/167,233 | Nov. 24, 1999 |
| 163. | U.S. | 00142.001 | 60/167,904 | Nov. 30, 1999 |
| 164. | U.S. | 00143.001 | 60/168,232 | Dec. 1, 1999 |
| 165. | U.S. | 00144.001 | 60/168,546 | Dec. 2, 1999 |
| 166. | U.S. | 00145.001 | 60/168,675 | Dec. 3, 1999 |
| 167. | U.S. | 00147.001 | 60/169,298 | Dec. 7, 1999 |
| 168. | U.S. | 00149.001 | 60/171,107 | Dec. 16, 1999 |
| 169. | U.S. | 00153.001 | 60/178,547 | Jan. 27, 2000 |
| 170. | U.S. | 00155.001 | 60/178,754 | Jan. 28, 2000 |
| 171. | U.S. | 00157.001 | 60/179,395 | Feb. 1, 2000 |
| 172. | U.S. | 00158.001 | 60/180,039 | Feb. 3, 2000 |
| 173. | U.S. | 00159.001 | 60/180,206 | Feb. 4, 2000 |
| 174. | U.S. | 00160.001 | 60/180,695 | Feb. 7, 2000 |
| 175. | U.S. | 00161.001 | 60/181,228 | Feb. 9, 2000 |
| 176. | U.S. | 00162.001 | 60/181,476 | Feb. 10, 2000 |
| 177. | U.S. | 00163.001 | 60/182,477 | Feb. 15, 2000 |
| 178. | U.S. | 00164.001 | 60/182,512 | Feb. 15, 2000 |
| 179. | U.S. | 00165.001 | 60/183,166 | Feb. 17, 2000 |
| 180. | U.S. | 00167.001 | 60/184,667 | Feb. 24, 2000 |
| 181. | U.S. | 00168.001 | 60/185,118 | Feb. 25, 2000 |
| 182. | U.S. | 00169.001 | 60/185,396 | Feb. 28, 2000 |
| 183. | U.S. | 00170.001 | 60/186,283 | Mar. 1, 2000 |
| 184. | U.S. | 00172.001 | 60/186,386 | Mar. 2, 2000 |
| 185. | U.S. | 00171.001 | 60/186,390 | Mar. 2, 2000 |
| 186. | U.S. | 00173.001 | 60/186,748 | Mar. 3, 2000 |
| 187. | U.S. | 00174.001 | 60/187,378 | Mar. 7, 2000 |
| 188. | U.S. | 00175.001 | 60/187,896 | Mar. 8, 2000 |
| 189. | U.S. | 00177.001 | 60/188,187 | Mar. 10, 2000 |
| 190. | U.S. | 00178.001 | 60/188,185 | Mar. 10, 2000 |
| 191. | U.S. | 00179.001 | 60/189,080 | Mar. 14, 2000 |
| 192. | U.S. | 00180.001 | 60/189,461 | Mar. 15, 2000 |
| 193. | U.S. | 00181.001 | 60/189,953 | Mar. 16, 2000 |
| 194. | U.S. | 00182.001 | 60/190,069 | Mar. 20, 2000 |
| 195. | U.S. | 00183.001 | 60/190,545 | Mar. 20, 2000 |
| 196. | U.S. | 00184.001 | 60/191,084 | Mar. 22, 2000 |
| 197. | U.S. | 00185.001 | 60/191,543 | Mar. 23, 2000 |
| 198. | U.S. | 00186.001 | 60/191,823 | Mar. 24, 2000 |
| 199. | U.S. | 00187.001 | 60/192,421 | Mar. 27, 2000 |
| 200. | U.S. | 00188.001 | 60/192,940 | Mar. 29, 2000 |
| 201. | U.S. | 00189.001 | 60/193,244 | Mar. 30, 2000 |
| 202. | U.S. | 00190.001 | 60/193,453 | Mar. 31, 2000 |
| 203. | U.S. | 00191.001 | 60/194,404 | Apr. 4, 2000 |
| 204. | U.S. | 00192.001 | 60/194,683 | Apr. 5, 2000 |
| 205. | U.S. | 00193.001 | 60/194,874 | Apr. 6, 2000 |
| 206. | U.S. | 00194.001 | 60/194,885 | Apr. 6, 2000 |
| 207. | U.S. | 00195.001 | 60/195,283 | Apr. 7, 2000 |
| 208. | U.S. | 00196.001 | 60/196,169 | Apr. 11, 2000 |
| 209. | U.S. | 00197.001 | 60/196,487 | Apr. 12, 2000 |
| 210. | U.S. | 00200.001 | 60/196,485 | Apr. 12, 2000 |
| 211. | U.S. | 00201.001 | 60/197,687 | Apr. 17, 2000 |
| 212. | U.S. | 00202.001 | 60/198,133 | Apr. 17, 2000 |
| 213. | U.S. | 00203.001 | 60/198,386 | Apr. 19, 2000 |
| 214. | U.S. | 00204.001 | 60/198,619 | Apr. 20, 2000 |
| 215. | U.S. | 00206.001 | 60/198,767 | Apr. 21, 2000 |
| 216. | U.S. | 00207.001 | 60/199,124 | Apr. 24, 2000 |
| 217. | U.S. | 00208.001 | 60/199,828 | Apr. 26, 2000 |
| 218. | U.S. | 00210.001 | 60/200,103 | Apr. 27, 2000 |
| 219. | U.S. | 00211.001 | 60/201,275 | May 2, 2000 |
| 220. | U.S. | 00212.001 | 60/201,740 | May 4, 2000 |
| 221. | U.S. | 00213.001 | 60/202,112 | May 5, 2000 |
| 222. | U.S. | 00214.001 | 60/202,914 | May 9, 2000 |
| 223. | U.S. | 00215.001 | 60/202,919 | May 9, 2000 |
| 224. | U.S. | 00216.001 | 60/202,968 | May 10, 2000 |
| 225. | U.S. | 00217.001 | 60/203,457 | May 11, 2000 |
| 226. | U.S. | 00219.001 | 60/203,916 | May 12, 2000 |
| 227. | U.S. | 00220.001 | 60/204,388 | May 15, 2000 |
| 228. | U.S. | 00221.001 | 60/204,568 | May 16, 2000 |
| 229. | U.S. | 00222.001 | 60/204,830 | May 17, 2000 |
| 230. | U.S. | 00223.001 | 60/205,201 | May 18, 2000 |
| 231. | U.S. | 00224.001 | 60/205,242 | May 19, 2000 |
| 232. | U.S. | 00225.001 | 60/205,572 | May 22, 2000 |
| 233. | U.S. | 00226.001 | 60/206,316 | May 23, 2000 |
| 234. | U.S. | 00227.001 | 60/206,553 | May 24, 2000 |
| 235. | U.S. | 00228.001 | 60/207,367 | May 26, 2000 |
| 236. | U.S. | 00229.001 | 60/207,239 | May 26, 2000 |
| 237. | U.S. | 00230.001 | 60/207,452 | May 30, 2000 |
| 238. | U.S. | 00231.001 | 60/208,329 | Jun. 1, 2000 |
| 239. | U.S. | 00232.001 | 60/208,910 | Jun. 5, 2000 |
| 240. | U.S. | 00233.001 | 60/208,921 | Jun. 5, 2000 |
| 241. | U.S. | 00234.001 | 60/210,012 | Jun. 8, 2000 |
| 242. | U.S. | 00235.001 | 60/210,670 | Jun. 9, 2000 |

|     | Country | Client No. | Appln. | Filed |
|-----|---------|------------|--------|-------|
| 243. | U.S. | 00237.001 | 60/211,213 | Jun. 13, 2000 |
| 244. | U.S. | 80274.001 | 60/211,540 | Jun. 15, 2000 |
| 245. | U.S. | 80275.001 | 60/212,649 | Jun. 19, 2000 |
| 246. | U.S. | 80276.001 | 60/212,713 | Jun. 20, 2000 |
| 247. | U.S. | 80276.001 | 60/212,713 | Jun. 20, 2000 |
| 248. | U.S. | 80278.001 | 60/213,220 | Jun. 22, 2000 |
| 249. | U.S. | 00242.001 | 60/213,271 | Jun. 22, 2000 |
| 250. | U.S. | 00248.001 | 60/214,534 | Jun. 27, 2000 |
| 251. | U.S. | 80279.001 | 60/214,762 | Jun. 27, 2000 |
| 252. | U.S. | 00249.001 | 60/214,800 | Jun. 28, 2000 |
| 253. | U.S. | 00250.001 | 60/215,775 | Jun. 30, 2000 |
| 254. | U.S. | 00252.001 | 60/216,361 | Jul. 5, 2000 |
| 255. | U.S. | 00253.001 | 60/217,476 | Jul. 11, 2000 |
| 256. | U.S. | 00254.001 | 60/219,004 | Jul. 18, 2000 |
| 257. | U.S. | 00255.001 | 60/220,647 | Jul. 25, 2000 |
| 258. | U.S. | 00256.001 | 60/220,484 | Jul. 25, 2000 |
| 259. | U.S. | 80298.001 | 60/224,517 | Aug. 14, 2000 |
| 260. | U.S. | 80300.001 | 60/225,303 | Aug. 15, 2000 |
| 261. | U.S. | 80301.001 | 60/226,452 | Aug. 21, 2000 |
| 262. | U.S. | 80307.001 | 60/227,024 | Aug. 23, 2000 |
| 263. | U.S. | 80308.001 | 60/228,898 | Aug. 30, 2000 |
| 264. | U.S. | 80309.001 | 60/230,430 | Sep. 6, 2000 |
| 265. | U.S. | 80310.001 | 60/232,044 | Sep. 13, 2000 |
| 266. | U.S. | 80311.001 | 60/232,858 | Sep. 15, 2000 |
| 267. | U.S. | 80312.001 | 60/233,621 | Sep. 18, 2000 |
| 268. | U.S. | 80313.001 | 60/234,179 | Sep. 20, 2000 |
| 269. | U.S. | 80314.001 | 60/234,233 | Sep. 21, 2000 |
| 270. | U.S. | 80315.001 | 60/234,968 | Sep. 25, 2000 |
| 271. | U.S. | 80316.001 | 60/234,974 | Sep. 25, 2000 |
| 272. | U.S. | 80317.001 | 60/234,949 | Sep. 26, 2000 |
| 273. | U.S. | 80318.001 | 60/236,732 | Oct. 2, 2000 |
| 274. | U.S. | 80319.001 | 60/237,379 | Oct. 4, 2000 |
| 275. | U.S. | 80320.001 | 60/237,686 | Oct. 5, 2000 |
| 276. | U.S. | 80321.001 | 60/238,473 | Oct. 10, 2000 |
| 277. | U.S. | 80322.001 | 60/238,456 | Oct. 10, 2000 |
| 278. | U.S. | 80323.001 | 60/239,091 | Oct. 11, 2000 |
| 279. | U.S. | 80324.001 | 60/240,862 | Oct. 17, 2000 |
| 280. | U.S. | 80325.001 | 60/241,368 | Oct. 19, 2000 |
| 281. | U.S. | 80331.001 | 60/241,751 | Oct. 20, 2000 |
| 282. | U.S. | 80332.001 | 60/242,065 | Oct. 23, 2000 |
| 283. | U.S. | 80334.001 | 60/242,686 | Oct. 24, 2000 |
| 284. | U.S. | 80335.001 | 60/242,705 | Oct. 25, 2000 |
| 285. | U.S. | 80336.001 | 60/243,289 | Oct. 26, 2000 |
| 286. | U.S. | 80337.001 | 60/243,398 | Oct. 27, 2000 |
| 287. | U.S. | 80338.001 | 60/243,723 | Oct. 30, 2000 |
| 288. | U.S. | 80339.001 | 60/244,691 | Nov. 1, 2000 |
| 289. | U.S. | 80340.001 | 60/244,923 | Nov. 2, 2000 |
| 290. | U.S. | 80341.001 | 60/245,164 | Nov. 3, 2000 |
| 291. | U.S. | 80342.001 | 60/245,676 | Nov. 6, 2000 |
| 292. | U.S. | 80343.001 | 60/246,732 | Nov. 9, 2000 |
| 293. | U.S. | 80344.001 | 60/247,010 | Nov. 13, 2000 |
| 294. | U.S. | 80346.001 | 60/247,050 | Nov. 13, 2000 |
| 295. | U.S. | 80347.001 | 60/248,198 | Nov. 15, 2000 |
| 296. | U.S. | 80348.001 | 60/249,256 | Nov. 17, 2000 |
| 297. | U.S. | 80349.001 | 60/249,454 | Nov. 20, 2000 |
| 298. | U.S. | 80350.001 | 60/252,464 | Nov. 22, 2000 |
| 299. | U.S. | 80351.001 | 60/252,598 | Nov. 24, 2000 |
| 300. | U.S. | 80352.001 | 60/253,722 | Nov. 29, 2000 |
| 301. | U.S. | 80353.001 | 60/251,504 | Dec. 7, 2000 |
| 302. | U.S. | 80354.001 | 60/251,853 | Dec. 8, 2000 |
| 303. | U.S. | 80355.001 | 60/254,174 | Dec. 11, 2000 |
| 304. | U.S. | 80356.001 | 60/256,503 | Dec. 15, 2000 |
| 305. | U.S. | 80357.001 | 60/255,891 | Dec. 18, 2000 |
| 306. | U.S. | 80359.001 | 60/258,880 | Jan. 2, 2001 |
| 307. | U.S. | 80362.001 | 60/262,389 | Jan. 19, 2001 |
| 308. | U.S. | 80363.001 | 60/264,026 | Jan. 26, 2001 |
| 309. | U.S. | 80364.001 | 60/264,282 | Jan. 29, 2001 |
| 310. | U.S. | 3001-55300-US-P-30946.01 | 60/266,468 | Feb. 6, 2001 |
| 311. | U.S. | 3001-55300-US-P-31053.01 | 60/267,425 | Feb. 9, 2001 |
| 312. | U.S. | 3001-55300-US-P-31070.01 | 60/267,707 | Feb. 12, 2001 |
| 313. | U.S. | 3001-55300-US-P-31112.01 | 60/269,890 | Feb. 21, 2001 |
| 314. | U.S. | 3001-55300-US-P-31130.01 | 60/269,892 | Feb. 21, 2001 |
| 315. | U.S. | 3001-55300-US-P-31162.01 | 60/271,724 | Feb. 28, 2001 |
| 316. | U.S. | 00170.002 | 09/795,347 | Mar. 1, 2001 |
| 317. | U.S. | 3001-55300-US-P-31197.01 | 60/273,553 | Mar. 7, 2001 |
| 318. | U.S. | 00191.002 | 09/824,882 | Apr. 4, 2001 |
| 319. | U.S. | 00211.002 | 09/845,206 | May 1, 2001 |
| 320. | U.S. | 00252.002 | 09/898,064 | Jul. 5, 2001 |
| 321. | U.S. | 80298.002 | 09/928,372 | Aug. 14, 2001 |

RR. Number 49

Application Ser. No. 10/340,820 listed above is a continuation of application Ser. No. 10/132,287, filed on Apr. 26, 2002.

Application Ser. No. 10/132,287 is a continuation-in-part of the following nonprovisional applications, to which the present application claims priority under 35 U.S.C. §120:

|    | Country | Client No. | Appln. | Filed | Status |
|----|---------|-----------|--------|-------|--------|
| 1. | U.S. | 91022.002 | 09/790,663 | Feb. 23, 2001 | Pending at the time of filing 10/132,287 |
| 2. | U.S. | 91025.002 | 09/795,359 | Mar. 1, 2001 | Pending at the time of filing 10/132,287 |
| 3. | U.S. | 91042.002 | 09/824,790 | Apr. 4, 2001 | Pending at the time of filing 10/132,287 |
| 4. | U.S. | 91055.002 | 09/845,311 | May 1, 2001 | Pending at the time of filing 10/132,287 |
| 5. | U.S. | 91068.002 | 09/870,476 | Jun. 1, 2001 | Pending at the time of filing 10/132,287 |
| 6. | U.S. | 91072.002 | 09/878,974 | Jun. 13, 2001 | Pending at the time of filing 10/132,287 |
| 7. | U.S. | 91081.003 | 10/123,222 | Apr. 17, 2002 | Pending at the time of filing 10/132,287 |

Through the seven applications listed above, the present application also claims priority under 35 USC §119(e) of the following applications:

1. Application Ser. No. 09/790,663 filed Feb. 23, 2001 claims priority under 35 USC §119(e) of the following provisional applications:

|    | Country | Appln. No. | Filing Date |
|----|---------|------------|-------------|
| a) | U.S. | 60/185,140 | Feb. 25, 2000 |
| b) | U.S. | 60/185,398 | Feb. 28, 2000 |
| c) | U.S. | 60/185,750 | Feb. 29, 2000 |

2. Application Ser. No. 09/795,359 filed Mar. 1, 2001 claims priority under 35 USC §119(e) of the following provisional applications:

|    | Country | Appln. No. | Filing Date |
|----|---------|------------|-------------|
| a) | U.S. | 60/186,277 | Mar. 1, 2000 |
| b) | U.S. | 60/186,670 | Mar. 3, 2000 |
| c) | U.S. | 60/187,379 | Mar. 7, 2000 |
| d) | U.S. | 60/187,985 | Mar. 9, 2000 |
| e) | U.S. | 60/188,174 | Mar. 10, 2000 |
| f) | U.S. | 60/188,687 | Mar. 13, 2000 |
| g) | U.S. | 60/189,460 | Mar. 15, 2000 |
| h) | U.S. | 60/189,958 | Mar. 16, 2000 |
| i) | U.S. | 60/189,965 | Mar. 17, 2000 |
| j) | U.S. | 60/190,090 | Mar. 20, 2000 |
| k) | U.S. | 60/191,549 | Mar. 23, 2000 |
| l) | U.S. | 60/191,826 | Mar. 24, 2000 |
| m) | U.S. | 60/192,420 | Mar. 27, 2000 |

| | Country | Appln. No. | Filing Date |
|---|---|---|---|
| n) | U.S. | 60/192,855 | Mar. 29, 2000 |
| o) | U.S. | 60/193,243 | Mar. 30, 2000 |
| p) | U.S. | 60/193,469 | Mar. 31, 2000 |

3. Application Ser. No. 09/824,790 filed Apr. 4, 2001 claims priority under 35 USC §119(e) of the following provisional applications:

| | Country | Appln. No. | Filing Date |
|---|---|---|---|
| a) | U.S. | 60/194,385 | Apr. 4, 2000 |
| b) | U.S. | 60/194,682 | Apr. 5, 2000 |
| c) | U.S. | 60/194,698 | Apr. 5, 2000 |
| d) | U.S. | 60/194,884 | Apr. 6, 2000 |
| e) | U.S. | 60/195,258 | Apr. 7, 2000 |
| f) | U.S. | 60/196,168 | Apr. 11, 2000 |
| g) | U.S. | 60/196,483 | Apr. 12, 2000 |
| h) | U.S. | 60/197,397 | Apr. 14, 2000 |
| i) | U.S. | 60/198,268 | Apr. 17, 2000 |
| j) | U.S. | 60/198,400 | Apr. 19, 2000 |
| k) | U.S. | 60/198,629 | Apr. 20, 2000 |
| l) | U.S. | 60/198,765 | Apr. 21, 2000 |
| m) | U.S. | 60/199,123 | Apr. 24, 2000 |

4. Application Ser. No. 09/845,311 filed May 1, 2001 claims priority under 35 USC §119(e) of the following provisional applications:

| | Country | Appln. No. | Filing Date |
|---|---|---|---|
| a) | U.S. | 60/200,885 | May 1, 2000 |
| b) | U.S. | 60/201,279 | May 2, 2000 |
| c) | U.S. | 60/201,751 | May 4, 2000 |
| d) | U.S. | 60/202,178 | May 5, 2000 |
| e) | U.S. | 60/202,915 | May 9, 2000 |
| f) | U.S. | 60/202,969 | May 10, 2000 |
| g) | U.S. | 60/203,458 | May 11, 2000 |
| h) | U.S. | 60/203,911 | May 12, 2000 |
| i) | U.S. | 60/204,395 | May 15, 2000 |
| j) | U.S. | 60/205,574 | May 22, 2000 |
| k) | U.S. | 60/206,988 | May 25, 2000 |
| l) | U.S. | 60/207,242 | May 26, 2000 |
| m) | U.S. | 60/207,291 | May 30, 2000 |

5. Application Ser. No. 09/870,476 filed Jun. 1, 2001 claims priority under 35 USC §119(e) of the following provisional applications:

| | Country | Appln. No. | Filing Date |
|---|---|---|---|
| a) | U.S. | 60/208,324 | Jun. 1, 2000 |
| b) | U.S. | 60/208,919 | Jun. 5, 2000 |
| c) | U.S. | 60/208,917 | Jun. 5, 2000 |
| d) | U.S. | 60/210,008 | Jun. 8, 2000 |

6. Application Ser. No. 09/878,974 filed Jun. 13, 2001 claims priority under 35 USC §119(e) of the following provisional applications:

| | Country | Appln. No. | Filing Date |
|---|---|---|---|
| a) | U.S. | 60/211,210 | Jun. 13, 2000 |
| b) | U.S. | 60/211,539 | Jun. 15, 2000 |
| c) | U.S. | 60/212,414 | Jun. 19, 2000 |
| d) | U.S. | 60/212,677 | Jun. 20, 2000 |
| e) | U.S. | 60/212,713 | Jun. 20, 2000 |
| f) | U.S. | 60/213,195 | Jun. 22, 2000 |
| g) | U.S. | 60/213,221 | Jun. 22, 2000 |
| h) | U.S. | 60/214,760 | Jun. 27, 2000 |

7. Application Ser. No. 10/123,222 filed Apr. 17, 2002 is a continuation of application Ser. No. 09/902,093 filed Jul. 11, 2001 and claims priority under 35 USC §119(e) of the following provisional applications:

| | Country | Appln. No. | Filing Date |
|---|---|---|---|
| a) | U.S. | 60/217,385 | Jul. 11, 2000 |
| b) | U.S. | 60/219,021 | Jul. 18, 2000 |
| c) | U.S. | 60/220,814 | Jul. 25, 2000 |
| d) | U.S. | 60/224,516 | Aug. 14, 2000 |
| e) | U.S. | 60/225,302 | Aug. 15, 2000 |
| f) | U.S. | 60/226,725 | Aug. 21, 2000 |
| g) | U.S. | 60/227,026 | Aug. 23, 2000 |
| h) | U.S. | 60/228,897 | Aug. 30, 2000 |

SS. Number 50

Application Ser. No. 10/621,442 listed above is a continuation of application Ser. No. 10/281,347, filed on Oct. 28, 2002.

Through application Ser. No. 10/281,347, the present application also claims priority of U.S. application Ser. No. 09/935,631 filed on Aug. 24, 2001:

Through application Ser. No. 09/935,631, the present application claims priority under 35 USC §119(e) of the following application:

| Country | Filed | Application No. |
|---|---|---|
| U.S. | Aug. 25, 2000 | 60/237,363 |

This application contains a CDR, the entire contents of which are hereby incorporated by reference. The CDR contains the following files:

| Create Date: | File Size: | File Name: |
|---|---|---|
| 09/26/2002 09:19p | 2,366,953 | 2750-1399P Table A-1.txt |
| 09/26/2002 09:19p | 1,938,556 | 2750-1399P Table A-2.txt |
| 09/26/2002 09:19p | 74,754,025 | 2750-1399P Table B.txt |
| 09/26/2002 09:19p | 7,670,452 | 2750-1399P Table C.txt |
| 09/26/2002 06:08p | 65,168,204 | 2750-1469P.txt |
| 09/26/2002 05:46p | 4,052,876 | cdna_clusters.txt |
| 09/26/2002 05:46p | 399,505 | cDNA_GI_pos.txt |
| 09/26/2002 05:46p | 35,153 | Cluster Functions and Utilities (01).txt |
| 09/26/2002 05:46p | 40,447 | Cluster Functions and Utilities (02).txt |
| 09/26/2002 05:46p | 4,473 | Cluster Functions and Utilities (03).txt |
| 09/26/2002 05:46p | 7,820 | Cluster Functions and Utilities (04).txt |
| 09/26/2002 05:46p | 24,047 | Cluster Functions and Utilities (05).txt |
| 09/26/2002 05:46p | 18,490 | Cluster Functions and Utilities (06).txt |
| 09/26/2002 05:46p | 36,273 | Cluster functions and utilities (07).txt |
| 09/26/2002 05:46p | 33,962 | Cluster Functions and Utilities (08).txt |
| 09/26/2002 05:46p | 23,000 | Cluster functions and utilities (09).txt |
| 09/26/2002 05:46p | 2,691 | Cluster functions and utilities (10).txt |
| 09/26/2002 05:46p | 2,290 | Cluster functions and utilities (11).txt |
| 09/26/2002 05:46p | 23,740 | Cluster Funtions and Utilities (12).txt |
| 09/26/2002 05:46p | 6,642,415 | cluster_info_50.dat |
| 09/26/2002 05:46p | 2,946,892 | cluster_info_60.dat |
| 09/26/2002 05:46p | 913,656 | cluster_info_70.dat |
| 09/26/2002 05:46p | 432,906 | cluster_info_75.dat |
| 09/26/2002 05:46p | 392,675 | knock_in.710-0024-55300-US-U-00007_01.txt |
| 09/26/2002 05:46p | 831,736 | knock_out.710-0024-55300-US-U-00007.01 |
| 09/26/2002 05:46p | 5,328,883 | MATRIX.001 |
| 09/26/2002 05:46p | 5,335,846 | MATRIX.002 |
| 09/26/2002 05:46p | 5,330,456 | MATRIX.003 |
| 09/26/2002 05:46p | 5,317,696 | MATRIX.004 |
| 09/26/2002 05:46p | 605,072 | MATRIX.005 |
| 09/26/2002 05:46 | 16,635,460 | ma_clusters.710-0024-55300-US-U-00007.01 |
| 09/26/2002 05:46p | 55,307 | ma_diff Aluminum.txt |
| 09/26/2002 05:46p | 27,557 | ma_diff Axel.txt |
| 09/26/2002 05:46p | 41,505 | ma_diff Cadium .txt |
| 09/26/2002 05:46p | 53,938 | ma_diff Cauliflower .txt |
| 09/26/2002 05:46p | 98,775 | ma_diff Chloroplast.txt |
| 09/26/2002 05:46p | 141,971 | ma_diff Circadian 1-01.txt |
| 09/26/2002 05:46p | 160,542 | ma_diff Circadian 1-02.txt |
| 09/26/2002 05:46p | 127,498 | ma_diff Circadian 1-03.txt |
| 09/26/2002 05:46p | 166,158 | ma_diff Circadian 1-04.txt |
| 09/26/2002 05:46p | 56,536 | ma_diff Circadian 1-05.txt |
| 09/26/2002 05:46p | 121,178 | ma_diff Circadian 1-06.txt |
| 09/26/2002 05:46p | 133,389 | ma_diff Circadian 1-07.txt |
| 09/26/2002 05:46p | 259,096 | ma_diff Circadian 1-08.txt |
| 09/26/2002 05:46p | 228,222 | ma_diff Circadian 1-09.txt |
| 09/26/2002 05:46p | 54,526 | ma_diff Circadian 1-10.txt |
| 09/26/2002 05:46p | 134,759 | ma_diff CO2 1-1.txt |
| 09/26/2002 05:46p | 241,865 | ma_diff CO2 1-2.txt |
| 09/26/2002 05:46p | 63,264 | ma_diff CO2 1-3.txt |
| 09/26/2002 05:46p | 59,530 | ma_diff CO2 1-4.txt |
| 09/26/2002 05:46p | 372,633 | ma_diff CO2 1-5.txt |
| 09/26/2002 05:46p | 9,220 | ma_diff Disease .txt |
| 09/26/2002 05:46p | 25,114 | ma_diff H2O2 .txt |
| 09/26/2002 05:46p | 4,073 | ma_diff Iol .txt |
| 09/26/2002 05:46p | 283,026 | ma_diff Iron 1-1.txt |
| 09/26/2002 05:46p | 90,890 | ma_diff Iron 1-2.txt |
| 09/26/2002 05:46p | 51,342 | ma_diff Mitochondria-Electron Transp.txt |
| 09/26/2002 05:46p | 107,920 | ma_diff NAA (Auxin) 1-1.txt |
| 09/26/2002 05:46p | 50,267 | ma_diff NAA (Auxin) 1-2.txt |
| 09/26/2002 05:46p | 67,291 | ma_diff Nitrogen.txt |
| 09/26/2002 05:46p | 6,441 | ma_diff Phototropism 1-1.txt |
| 09/26/2002 05:46p | 22,229 | ma_diff Phototropism 1-2.txt |
| 09/26/2002 05:46p | 28,270 | ma_diff Phototropism 1-3.txt |
| 09/26/2002 05:46p | 45,620 | ma_diff Shade.txt |
| 09/26/2002 05:46p | 73,438 | ma_diff Sqn.txt |
| 09/26/2002 05:46p | 3,828 | ma_diff Sulfur.txt |
| 09/26/2002 05:46p | 67,949 | ma_diff Wounding.txt |
| 09/26/2002 05:46p | 30,836 | ma_diff Zinc.txt |
| 09/26/2002 05:46p | 4,318,956 | ma_diff.710-0024-55300-US-U-00007.01 |
| 09/26/2002 05:46p | 1,071,693 | RESULT.001 |
| 09/26/2002 05:46p | 1,072,021 | RESULT.002 |
| 09/26/2002 05:46p | 1,072,022 | RESULT.003 |
| 09/26/2002 05:46p | 1,071,371 | RESULT.004 |
| 09/26/2002 05:46p | 1,071,155 | RESULT.005 |
| 09/26/2002 05:46p | 459,530 | RESULT.006 |
| 09/26/2002 05:46p | 1,476 | Single gene functions and utilities (1).txt |
| 09/26/2002 05:46p | 2,223 | Single gene functions and utilities (2).txt |
| 09/26/2002 05:46p | 905 | Single gene functions and utilities (3).txt |
| 09/26/2002 05:46p | 1,517 | Single gene functions and utilities (4).txt |

-continued

| Create Date: | File Size: | File Name: |
| --- | --- | --- |
| 09/26/2002 05:46p | 4,626 | Single gene functions and utilities (5).txt |
| 09/26/2002 05:46p | 4,887 | Single gene functions and utilities (6).txt |
| 09/26/2002 05:46p | 7,456 | Single gene functions and utilities (7).txt |
| 09/26/2002 05:46p | 9,339 | Single gene functions and utilities (8).txt |
| 09/26/2002 05:46p | 228,792 | stanford_old_new_cdna_map.txt |

FIELD OF THE INVENTION

The present invention relates to over 100,000 isolated polynucleotides from plants that include a complete coding sequence, or a fragment thereof, that is expressed. In addition, the present invention relates to the polypeptide or protein corresponding to the coding sequence of these polynucleotides. The present invention also relates to isolated polynucleotides that represent regulatory regions of genes. The present invention also relates to isolated polynucleotides that represent untranslated regions of genes. The present invention further relates to the use of these isolated polynucleotides and polypeptides and proteins.

BACKGROUND OF THE INVENTION

There are more than 300,000 species of plants. They show a wide diversity of forms, ranging from delicate liverworts, adapted for life in a damp habitat, to cacti, capable of surviving in the desert. The plant kingdom includes herbaceous plants, such as corn, whose life cycle is measured in months, to the giant redwood tree, which can live for thousands of years. This diversity reflects the adaptations of plants to survive in a wide range of habitats. This is seen most clearly in the flowering plants (phylum Angiospermophyta), which are the most numerous, with over 250,000 species. They are also the most widespread, being found from the tropics to the arctic.

The process of plant breeding involving man's intervention in natural breeding and selection is some 20,000 years old. It has produced remarkable advances in adapting existing species to serve new purposes. The world's economics was largely based on the successes of agriculture for most of these 20,000 years.

Plant breeding involves choosing parents, making crosses to allow recombination of gene (alleles) and searching for and selecting improved forms. Success depends on the genes/alleles available, the combinations required and the ability to create and find the correct combinations necessary to give the desired properties to the plant. Molecular genetics technologies are now capable of providing new genes, new alleles and the means of creating and selecting plants with the new, desired characteristics.

When the molecular and genetic basis for different plant characteristics are understood, a wide variety of polynucleotides, both endogenous polynucleotides and created variants, polypeptides, cells, and whole organisms, can be exploited to engineer old and new plant traits in a vast range of organisms including plants. These traits can range from the observable morphological characteristics, through adaptation to specific environments to biochemical composition and to molecules that the plants (organisms) exude. Such engineering can involve tailoring existing traits, such as increasing the production of taxol in yew trees, to combining traits from two different plants into a single organism, such as inserting the drought tolerance of a cactus into a corn plant. Molecular and genetic knowledge also allows the creation of new traits. For example, the production of chemicals and pharmaceuticals that are not native to particular species or the plant kingdom as a whole.

The application reports the inventions Applicants have discovered to build a foundation of scientific understanding of plant genomes to achieve these aims. These inventions include polynucleotide and polypeptide sequences, and data relating to where and when the genes are differentially expressed and phenotypic observations resulting from either aberrant gene activation or disruption. How these data are transformed into a scientific understanding of plant biology and the control of traits from a genetic perspective also is explained by the instant application. Applications of these discoveries to create new prototypes and products in the field of chemical, pharmaceutical, food, feed, and fiber production are described herein as well.

The achievements described in this application were possible because of the results from a cluster of technologies, a genomic engine, depicted below in Schematic 1, that allows information on each gene to be integrated to provide a more comprehensive understanding of gene structure and function and the deployment of genes and gene components to make new products.

I. The Discoveries of the Instant Application

Applicants have isolated and identified over one hundred thousand genes, gene components and their products and thousands of promoters. Specific genes were isolated and/or characterized from *arabidopsis*, soybean, maize, wheat and rice. These species were selected because of their economic value and scientific importance and were deliberately chosen to include representatives of the evolutionary divergent dicotyledonous and monocotyledonous groups of the plant kingdom. The number of genes characterized in this application represents a large proportion of all the genes in these plant species.

The techniques used initially to isolate and characterize most of the genes, namely sequencing of full-length cDNAs, were deliberately chosen to provide information on complete coding sequences and on the complete sequences of their protein products.

Gene components and products the Applicants have identified include exons, introns, promoters, coding sequences, antisense sequences, terminators and other regulatory sequences. The exons are characterized by the proteins they encode and *arabidopsis* promoters are characterized by their position in the genomic DNA relative to where mRNA synthesis begins and in what cells and to what extent they promote mRNA synthesis.

Further exploitation of molecular genetics technologies has helped the Applicants to understand the functions and characteristics of each gene and their role in a plant. Three powerful molecular genetics approaches were used to this end:

(a) Analyses of the phenotypic changes when the particular gene sequence is interrupted or activated differentially; (*arabidopsis*)

(b) Analyses of in what plant organs, to what extent, and in response to what environmental signals mRNA is synthesized from the gene; (*arabidopsis* and maize) and (c) Analysis of the gene sequence and its relatives. (all species)

These were conducted using the genomics engine depicted in FIG. 1 that allows information on each gene to be integrated to provide a more comprehensive understanding of gene structure and function and linkage to potential products.

The species *arabidopsis* was used extensively in these studies for several reasons: (1) the complete genomic sequence, though poorly annotated in terms of gene recognition, was being produced and published by others and (2) genetic experiments to determine the role of the genes in planta are much quicker to complete.

The phenotypic tables, MA tables, and reference tables and sequence tables indicate the results of these analyses and thus the specific functions and characteristics that are ascribed to the genes and gene components and products.

II. Integration of Discoveries to Provide Scientific Understanding

From the discoveries made, Applicants have deduced the biochemical activities, pathways, cellular roles, and developmental and physiological processes that can be modulated using these components. These are discussed and summarized in sections based on the gene functions characteristics from the analyses and role in determining phenotypes. These sections illustrate and emphasize that each gene, gene component or product influences biochemical activities, cells or organisms in complex ways, from which there can be many phenotypic consequences.

Figure 2:
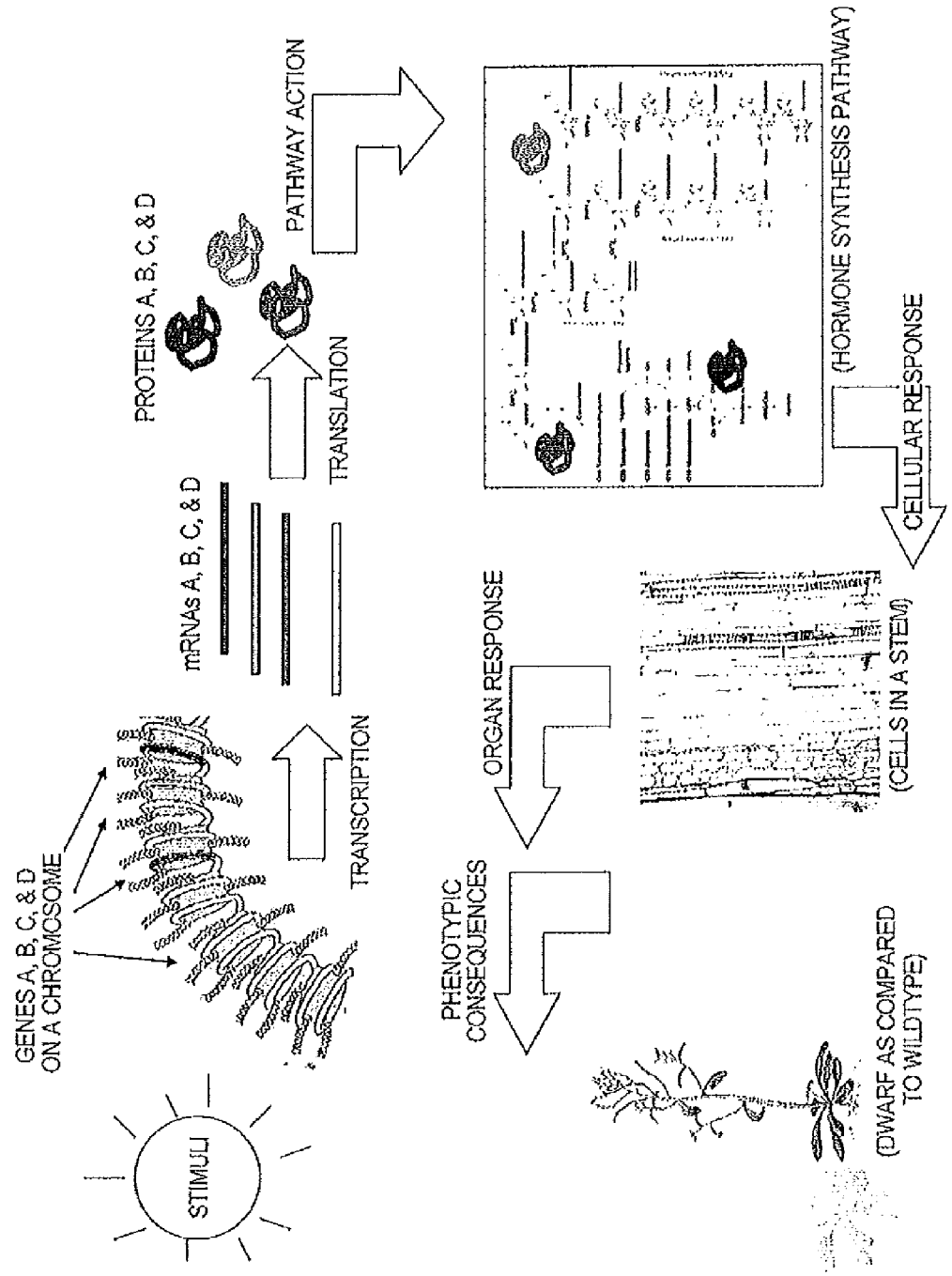

An illustration of how the discoveries on gene structure, function, expression and phenotypic observation can be integrated together to understand complex phenotypes is provided in FIG. 2. This sort of understanding enables conclusions to be made as to how the genes, gene components and product are useful for changing the properties of plants and other organisms. This example also illustrates how single gene changes in, for example, a metabolic pathway can cause gross phenotypic changes.

Furthermore, the development and properties of one part of plant can be interconnected with other parts. The dependence of shoot and leaf development on root cells is a classic example. Here, shoot growth and development require nutrients supplied from roots, so the protein complement of root cells can affect plant development, including flowers and seed production. Similarly, root development is dependent on the products of photosynthesis from leaves. Therefore, proteins in leaves can influence root developmental physiology and biochemistry.

Thus, the following sections describe both the functions and characteristics of the genes, gene components and products and also the multiplicity of biochemical activities, cellular functions, and the developmental and physiological processes influenced by them. The sections also describe examples of commercial products that can be realized from the inventions.

A. Analyses to Reveal Function and In Vivo Roles of Single Genes in One Plant Species The genomics engine has focused on individual genes to reveal the multiple functions or characteristics that are associated to each gene, gene components and products of the instant invention in the living plant. For example, the biochemical activity of a protein is deduced based on its similarity to a protein of known function. In this case, the protein may be ascribed with, for example, an oxidase activity. Where and when this same protein is active can be uncovered from differential expression experiments, which show that the mRNA encoding the protein is differentially expressed in response to drought and in seeds but not roots. The gene disruption experiments reveal that absence of the same protein causes embryo lethality.

Thus, this protein is characterized as a seed protein and drought-responsive oxidase that is critical for embryo viability.

B. Analyses to Reveal Function and Roles of Single Genes in Different Species

The genomics engine has also been used to extrapolate knowledge from one species to many plant species. For example, proteins from different species, capable of performing identical or similar functions, preserve many features of amino acid sequence and structure during evolution. Complete protein sequences have been compared and contrasted within and between species to determine the functionally vital domains and signatures characteristic of each of the proteins that is the subject of this application. Thus, functions and characteristics of *arabidopsis* proteins have been extrapolated to proteins containing similar domains and signatures of corn, soybean, rice and wheat and by implication to all other (plant) species.

Figure 3:
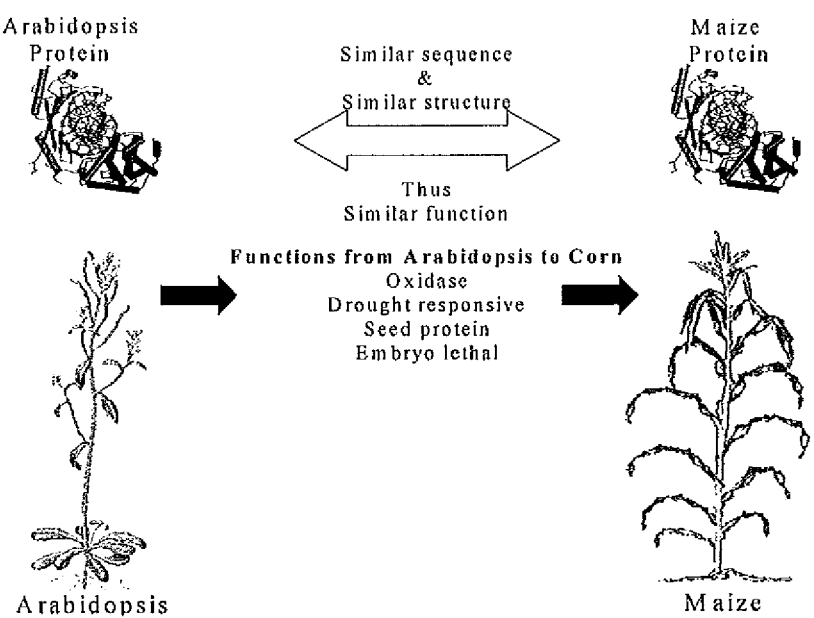

FIG. 3 provides an example. Two proteins with related structures, one from corn, a monocot, and one from *arabidopsis*, a dicot, have been concluded to be orthologs. The known characteristics of the *arabidopsis* protein (seed protein, drought responsive oxidase) can then be attributed to the corn protein.

C. Analyses Over Multiple Experiments to Reveal Gene Networks and Links Across Species The genomics engine can identify networks or pathways of genes concerned with the same process and hence linked to the same phenotype(s). Genes specifying functions of the same pathway or developmental environmental responses are frequently co-regulated i.e. they are regulated by mechanisms that result in coincident increases or decreases for all gene members in the group. The Applicants have divided the genes of *arabidopsis* and maize into such co-regulated groups on the basis of their expression patterns and the function of each group has been deduced. This process has provided considerable insight into the function and role of thousands of the plant genes in diverse species included in this application.

D. Applications Of Applicant's Discoveries

It will be appreciated while reading the sections that the different experimental molecular genetic approaches focused on different aspects of the pathway from gene and gene product through to the properties of tissues, organs and whole organisms growing in specific environments. For each endogenous gene, these pathways are delineated within the existing biology of the species. However, Applicants' inventions allow gene components or products to be mixed and matched to create new genes and placed in other cellular contexts and species, to exhibit new combinations of functions and characteristics not found in nature, or to enhance and modify existing ones. For instance, gene components can be used to achieve expression of a specific protein in a new cell type to introduce new biochemical activities, cellular attributes or developmental and physiological processes. Such cell-specific targeting can be achieved by combining polynucleotides encoding proteins with any one of a large array of promoters to facilitate synthesis of proteins in a selective set of plant cells. This emphasizes that each gene, component and protein can be used to cause multiple and different phenotypic effects depending on the biological context. The utilities are therefore not limited to the existing in vivo roles of the genes, gene components, and gene products.

While the genes, gene components and products disclosed herein can act alone, combinations are useful to modify or modulate different traits. Useful combinations include different polynucleotides and/or gene components or products that have (1) an effect in the same or similar developmental or biochemical pathways; (2) similar biological activities; (3) similar transcription profiles; or (4) similar physiological consequences.

Of particular interest are the transcription factors and key factors in regulatory transduction pathways, which are able to control entire pathways, segments of pathways or large groups of functionally related genes. Therefore, manipulation of such proteins, alone or in combination is especially useful for altering phenotypes or biochemical activities in plants. Because interactions exist between hormone, nutrition, and developmental pathways, combinations of genes and/or gene products from these pathways also are useful to produce more complex changes. In addition to using polynucleotides having similar transcription profiles and/or biological activities, useful combinations include polynucleotides that may exhibit different transcription profiles but which participate in common or overlapping pathways. Also, polynucleotides encoding selected enzymes can be combined in novel ways in a plant to create new metabolic pathways and hence new metabolic products.

The utilities of the various genes, gene components and products of the Application are described below in the sections entitled as follows:

I. Organ Affecting Genes, Gene Components, Products (Including Differentiation Function)
    I.A. Root Genes, Gene Components And Products
    I.A.1. Root Genes, Gene Components And Products
    I.A.2. Root Hair Genes, Gene Components And Products
    I.B. Leaf Genes, Gene Components And Products
    I.B.1. Leaf Genes, Gene Components And Products
    I.B.2. Trichome Genes And Gene Components
    I.B.3. Chloroplast Genes And Gene Components
    I.C. Reproduction Genes, Gene Components And Products
    I.C.1. Reproduction Genes, Gene Components And Products
    I.C.2. Ovule Genes, Gene Components And Products
    I.C.3. Seed And Fruit Development Genes, Gene Components And Products
    I.D. Development Genes, Gene Components And Products
    I.D.1. Imbibition and Germination Responsive Genes, Gene Components And Products
    I.D.2. Early Seedling Phase Genes, Gene Components And Products
    I.D.3. Size and Stature Genes, Gene Components And Products
    I.D.4. Shoot-Apical Meristem Genes, Gene Components And Products
    I.D.5. Vegetative-Phase Specific Responsive Genes, Gene Components And Products
II. Hormones Responsive Genes, Gene Components And Products
    II.A. Abscissic Acid Responsive Genes, Gene Components And Products
    II.B. Auxin Responsive Genes, Gene Components And Products
    II.C. Brassinosteroid Responsive Genes, Gene Components And Products
    II.D. Cytokinin Responsive Genes, Gene Components And Products
    II.E. Gibberellic Acid Responsive Genes, Gene Components And Products
III. Metabolism Affecting Genes, Gene Components And Products
    III.A. Nitrogen Responsive Genes, Gene Components And Products
    III.B. Circadian Rhythm Responsive Genes, Gene Components And Products
    III.C. Blue Light (Phototropism) Responsive Genes, Gene Components And Products
    III.D. Co2 Responsive Genes, Gene Components And Products
    III.E. Mitochondria Electron Transport Genes, Gene Components And Products
    III.F. Protein Degradation Genes, Gene Components And Products
    III.G. Carotenogenesis Responsive Genes, Gene Components And Products
IV. Viability Genes, Gene Components And Products
    IV.A. Viability Genes, Gene Components And Products
    IV.B. Histone Deacetylase (Axel) Responsive Genes, Gene Components And Products
V. Stress Responsive Genes, Gene Components And Products
    V.A. Cold Responsive Genes, Gene Components And Products
    V.B. Heat Responsive Genes, Gene Components And Products
    V.C. Drought Responsive Genes, Gene Components And Products
    V.D. Wounding Responsive Genes, Gene Components And Products
    V.E. Methyl Jasmonate Responsive Genes, Gene Components And Products
    V.F. Reactive Oxygen Responsive Genes, Gene Components And H2O2 Products
    V.G. Salicylic Acid Responsive Genes, Gene Components And Products
    V.H. Nitric Oxide Responsive Genes, Gene Components And Products
    V.I. Osmotic Stress Responsive Genes, Gene Components And Products
    V.J. Aluminum Responsive Genes, Gene Components And Products
    V.K. Cadmium Responsive Genes, Gene Components And Products
    V.L. Disease Responsive Genes, Gene Components And Products
    V.M. Defense Responsive Genes, Gene Components And Products
    V.N. Iron Responsive Genes, Gene Components And Products
    V.O. Shade Responsive Genes, Gene Components And Products
    V.P. Sulfur Responsive Genes, Gene Components And Products
    V.Q. Zinc Responsive Genes, Gene Components And Products
VI. Enhanced Foods
VII. Pharmaceutical Products
VIII. Precursors Of Industrial Scale Compounds
IX. Promoters As Sentinels

SUMMARY OF THE INVENTION

The present invention comprises polynucleotides, such as complete cDNA sequences and/or sequences of genomic DNA encompassing complete genes, fragments of genes, and/or regulatory elements of genes and/or regions with other functions and/or intergenic regions, hereinafter collectively referred to as Sequence-Determined DNA Fragments (SDFs) or sometimes collectively referred to as "genes or gene components", or sometimes as "genes, gene components or products", from different plant species, particularly corn, wheat, soybean, rice and *Arabidopsis thaliana*, and other plants and or mutants, variants, fragments or fusions of said SDFs and polypeptides or proteins derived therefrom. In some instances, the SDFs span the entirety of a protein-coding segment. In some instances, the entirety of an mRNA is represented. Other objects of the invention that are also represented by SDFs of the invention are control sequences, such as, but not limited to, promoters. Complements of any sequence of the invention are also considered part of the invention.

Other objects of the invention are polynucleotides comprising exon sequences, polynucleotides comprising intron sequences, polynucleotides comprising introns together with exons, intron/exon junction sequences, 5' untranslated sequences, and 3' untranslated sequences of the SDFs of the present invention. Polynucleotides representing the joinder of any exons described herein, in any arrangement, for example, to produce a sequence encoding any desirable amino acid sequence are within the scope of the invention.

The present invention also resides in probes useful for isolating and identifying nucleic acids that hybridize to an SDF of the invention. The probes can be of any length, but more typically are 12-2000 nucleotides in length; more typically, 15 to 200 nucleotides long; even more typically, 18 to 100 nucleotides long.

Yet another object of the invention is a method of isolating and/or identifying nucleic acids using the following steps:

(a) contacting a probe of the instant invention with a polynucleotide sample under conditions that permit hybridization and formation of a polynucleotide duplex; and (b) detecting and/or isolating the duplex of step (a).

The conditions for hybridization can be from low to moderate to high stringency conditions. The sample can include a polynucleotide having a sequence unique in a plant genome. Probes and methods of the invention are useful, for example, without limitation, for mapping of genetic traits and/or for positional cloning of a desired fragment of genomic DNA.

Probes and methods of the invention can also be used for detecting alternatively spliced messages within a species. Probes and methods of the invention can further be used to detect or isolate related genes in other plant species using genomic DNA (gDNA) and/or cDNA libraries. In some instances, especially when longer probes and low to moderate stringency hybridization conditions are used, the probe will hybridize to a plurality of cDNA and/or gDNA sequences of a plant. This approach is useful for isolating representatives of gene families which are identifiable by possession of a common functional domain in the gene product or which have common cis-acting regulatory sequences. This approach is also useful for identifying orthologous genes from other organisms.

The present invention also resides in constructs for modulating the expression of the genes comprised of all or a fragment of an SDF. The constructs comprise all or a fragment of the expressed SDF, or of a complementary sequence. Examples of constructs include ribozymes comprising RNA encoded by an SDF or by a sequence complementary thereto, antisense constructs, constructs comprising coding regions or parts thereof, constructs comprising promoters, introns, untranslated regions, scaffold attachment regions, methylating regions, enhancing or reducing regions, DNA and chromatin conformation modifying sequences, etc. Such constructs can be constructed using viral, plasmid, bacterial artificial chromosomes (BACs), plasmid artificial chromosomes (PACs), autonomous plant plasmids, plant artificial chromosomes or other types of vectors and exist in the plant as autonomous replicating sequences or as DNA integrated into the genome. When inserted into a host cell the construct is, preferably, functionally integrated with, or operatively linked to, a heterologous polynucleotide. For instance, a coding region from an SDF might be operably linked to a promoter that is functional in a plant.

The present invention also resides in host cells, including bacterial or yeast cells or plant cells, and plants that harbor constructs such as described above. Another aspect of the invention relates to methods for modulating expression of specific genes in plants by expression of the coding sequence of the constructs, by regulation of expression of one or more endogenous genes in a plant or by suppression of expression of the polynucleotides of the invention in a plant. Methods of modulation of gene expression include without limitation (1) inserting into a host cell additional copies of a polynucleotide comprising a coding sequence; (2) modulating an endogenous promoter in a host cell; (3) inserting antisense or ribozyme constructs into a host cell and (4) inserting into a host cell a polynucleotide comprising a sequence encoding a variant, fragment, or fusion of the native polypeptides of the instant invention.

DETAILED DESCRIPTION OF THE INVENTION

I. Description of the Tables

As noted above, the Applicants have obtained and analyzed an extensive amount of information on a large number of genes by use of the Ceres Genomic Engine to determine. This information can be categorized into three basic types:

A. Sequence Information for the Inventions
B. Transcriptional Information for the Inventions
C. Phenotypic Information for the Inventions
I.A. Sequence Information To harness the potential of the plant genome, Applicants began by elucidating a large number gene sequences, including the sequences of gene components and products, and analyzing the data. The list of sequences and associated data are presented in the Reference and Sequence Tables of the present application (sometimes referred to as the "REF" and "SEQ" Tables). The Reference and Sequence tables include:

cDNA sequence;
coding sequence;
5' & 3' UTR;
transcription start sites;
exon and intron boundaries in genomic sequence; and
protein sequence.

The Reference and Sequence Tables also include computer-based, comparative analyses between the protein sequences of the invention and sequences with known function. Proteins with similar sequences typically exhibit similar biochemical activities. The Reference table notes:

sequences of known function that are similar to the Applicants' proteins; and
biochemical activity that is associated with Applicants' proteins.

Also, by analyzing the protein sequences, Applicants were able to group the protein sequences into groups, wherein all the sequences in the group contain a signature sequence. The groups are presented in the Protein Group Table. The signature sequences are reported in the Protein Group Table. More detailed analyses of the signature sequences are shown in the Protein Group Matrix Table.

To identify gene components and products, Applicants took a cDNA/coding sequence approach. That is, Applicants initiated their studies either by isolating cDNAs and determining their sequences experimentally, or by identifying the coding sequence from genomic sequence with the aid of predictive algorithms. The cDNA sequences and coding sequences also are referred to as "Maximum Length Sequences" in the Reference tables. The cDNA and coding sequences were given this designation to indicate these were the maximum length of coding sequences identified by Applicants.

Due to this cDNA/coding sequence focus of the present application, the Reference and Sequence Tables were organized around cDNA and coding sequences. Each of these Maximum Length Sequences was assigned a unique identifier: Ceres Sequence ID NO, which is reported in the Tables.

All data that relate to these Maximum Length Sequences are grouped together, including 5' & 3' UTRs; transcription start sites; exon and intron boundaries in genomic sequence; protein sequence, etc.

Below, a more detailed explanation of the organization of the Reference and Sequence Tables and how the data in the tables were generated is provided.

a. cDNA

Applicants have ascertained the sequences of mRNAs from different organisms by reverse transcription of mRNA to DNA, which was cloned and then sequenced. These complementary DNA or cDNA sequences also are referred to as Maximum Length Sequences in the Reference Tables, which contain details on each of the sequences in the Sequence Tables.

Each sequence was assigned a Pat. Appln. Sequence ID NO: and an internal Ceres Sequence ID NO: as reported in the Reference Table, the section labeled "(Ac) cDNA Sequence." An example is shown below:

Max Len. Seq.:

(Ac) cDNA Sequence

Pat. Appln. Sequence ID NO: 174538

Ceres Sequence ID NO: 5673127

Both numbers are included in the Sequence Table to aid in tracking of information, as shown below:

```
<210> 174538 (Pat. Appln. Sequence ID NO:)
<211> 1846
<212> DNA (genomic)
<213> Arabidopsis thaliana <220>
<221> misc feature
<222> (1)..(1846)
<223> Ceres Seq. ID no. 5673127

<220>
<221> misc_feature
<222> ( )..( )
<223> n is a, c, t, g, unknown, or other <400> 174538
                                        (SEQ ID NO: 200513)
acaagaacaa caaaacagag gaagaagaag aagaagatga agcttctggc tctgtttcca 60
tttctagcga tcgtgatcca actcagctgt... etc.
```

The Sequence and Reference Tables are divided into sections by organism: *Arabidopsis thaliana, Brassica napus, Glycine max, Zea mays, Triticum aestivum*; and *Oryza sativa*.

b. Coding Sequence

The coding sequence portion of the cDNA was identified by using computer-based algorithms and comparative biology. The sequence of each coding sequence of the cDNA is reported in the "PolyP Sequence" section of the Reference Tables, which are also divided into sections by organism. An example shown below for the peptides that relate to the cDNA sequence above PolyP Sequence Pat. Appln. Sequence ID NO 174539

Ceres Sequence ID NO 5673128

Loc. Sequence ID NO 174538: @ 1 nt.

Loc. Sig. P. Sequence ID NO 174539: @ 37 aa.

The polypeptide sequence can be found in the Sequence Tables by either the Pat. Appln. Sequence ID NO or by the Ceres Sequence ID NO: as shown below:

```
<210> 174539 (Pat. Appln. Sequence ID NO)
<211> 443
<212> PRT
<213> Arabidopsis thaliana
<220>
<221> peptide
<222> (1)..(443)
<223> Ceres Seq. ID no. 5673128

<220>
<221> misc feature
<222> ( )..( )
<223> xaa is any aa, unknown or other

<400> 174539
                                        (SEQ ID NO: 200513)
Thr Arg Thr Thr Lys Gln Arg Lys Lys Lys Lys Lys
1               5                  10              15

Met Lys Leu Leu Ala Leu Phe Pro Phe
                                    25

Leu Ala Ile... etc.
```

The PolyP section also indicates where the coding region begins in the Maximum Length Sequence. More than one coding region may be indicated for a single polypeptide due to multiple potential translation start codons. Coding sequences were identified also by analyzing genomic sequence by predictive algorithms, without the actual cloning of a cDNA molecule from a mRNA. By default, the cDNA sequence was considered the same as the coding sequence, when Maximum Length Sequence was spliced together from a genomic annotation.

c. 5' and 3' UTR

The 5' UTR can be identified as any sequence 5' of the initiating codon of the coding sequence in the cDNA sequence. Similarly, the 3' UTR is any sequence 3' of the terminating codon of the coding sequence.

d. Transcription Start Sites

Applicants cloned a number of cDNAs that encompassed the same coding sequence but comprised 5' UTRs of different lengths. These different lengths revealed the multiple transcription start sites of the gene that corresponded to the cDNA. These multiple transcription start sites are reported in the "Sequence # w. TSS" section" of the Reference Tables.

e. Exons & Introns

Alignment of the cDNA sequences and coding portions to genomic sequence permitted Applicants to pinpoint the exon/intron boundaries. These boundaries are identified in the Reference Table under the "Pub gDNA" section. That section reports the gi number of the public BAC sequence that contains the introns and exons of interest. An example is shown below:
Max Len. Seq.:
Pub gDNA:
gi No: 1000000005
Gen. seq. in cDNA:
115777 . . . 115448 by Method #1
115105 . . . 114911 by Method #1
114822 . . . 114700 by Method #1
114588 . . . 114386 by Method #1
114295 . . . 113851 by Method #1
115777 . . . 115448 by Method #2
115105 . . . 114911 by Method #2
114822 . . . 114700 by Method #2
114588 . . . 114386 by Method #2
114295 . . . 113851 by Method #2
115813 . . . 115448 by Method #3
115105 . . . 114911 by Method #3
114822 . . . 114700 by Method #3
114588 . . . 114386 by Method #3
114295 . . . 113337 by Method #3
(Ac) cDNA Sequence All the gi numbers were assigned by Genbank to track the public genomic sequences except:
gi 1000000001
gi 1000000002
gi 1000000003
gi 1000000004; and
gi 1000000005.

These gi numbers were assigned by Applicants to the five *Arabidopsis* chromosome sequences that were published by the Institute of Genome Research (TIGR). Gi 1000000001 corresponds to chromosome 1, Gi 1000000002 to chromosome 2, etc.

The method of annotation is indicated as well as any similar public annotations.

f. Promoters & Terminators

Promoter sequences are 5' of the translational start site in a gene; more typically, 5' of the transcriptional start site or sites. Terminator sequences are 3' of the translational terminator codon; more typically, 3' of the end of the 3' UTR.

For even more specifics of the Reference and Sequence Tables, see the section below titled "Brief Description of the Tables."

I.B. Transcriptional (Differential Expression) Information-Introduction to Differential Expression Data & Analyses A major way that a cell controls its response to internal or external stimuli is by regulating the rate of transcription of specific genes. For example, the differentiation of cells during organogenesis into forms characteristic of the organ is associated with the selective activation and repression of large numbers of genes. Thus, specific organs, tissues and cells are functionally distinct due to the different populations of mRNAs and protein products they possess. Internal signals program the selective activation and repression programs. For example, internally synthesized hormones produce such signals. The level of hormone can be raised by increasing the level of transcription of genes encoding proteins concerned with hormone synthesis.

To measure how a cell reacts to internal and/or external stimuli, individual mRNA levels can be measured and used as an indicator for the extent of transcription of the gene. Cells can be exposed to a stimulus, and mRNA can be isolated and assayed at different time points after stimulation. The mRNA from the stimulated cells can be compared to control cells that were not stimulated. The mRNA levels of particular Maximum Length Sequences that are higher in the stimulated cell versus the control indicate a stimulus-specific response of the cell. The same is true of mRNA levels that are lower in stimulated cells versus the control condition.

Similar studies can be performed with cells taken from an organism with a defined mutation in their genome as compared with cells without the mutation. Altered mRNA levels in the mutated cells indicate how the mutation causes transcriptional changes. These transcriptional changes are associated with the phenotype that the mutated cells exhibit that is different from the phenotype exhibited by the control cells.

Applicants have utilized microarray techniques to measure the levels of mRNAs in cells from mutant plants, stimulated plants, and/or selected from specific organs. The differential expression of various genes in the samples versus controls are listed in the MA_diff Tables. Applicants have analyzed the differential data to identify genes whose mRNA transcription levels are positively correlated. From these analyses, Applicants were able to group different genes together whose transcription patterns are correlated. The results of the analyses are reported in the MA_clust Tables.

a. Experimental Detail

A microarray is a small solid support, usually the size of a microscope slide, onto which a number of polynucleotides have been spotted onto or synthesized in distinct positions on the slide (also referred to as a chip). Typically, the polynucleotides are spotted in a grid formation. The polynucleotides can either be Maximum Length Sequences or shorter synthetic oligonucleotides, whose sequence is complementary to specific Maximum Length Sequence entities. A typical chip format is as follows:

| Oligo #1 | Oligo #2 | Oligo #3 |
|---|---|---|
| Oligo #4 | Oligo #5 | Oligo #6 |
| Oligo #7 | Oligo #8 | Oligo #9 |

For Applicants' experiments, samples were hybridized to the chips using the "two-color" microarray procedure. A fluorescent dye was used to label cDNA reverse-transcribed from mRNA isolated from cells that had been stimulated, mutated, or collected from a specific organ or developmental stage. A second fluorescent dye of another color was used to label cDNA prepared from control cells.

The two differentially-labeled cDNAs were mixed together. Microarray chips were incubated with this mixture. For Applicants' experiments the two dyes that are used are Cy3, which fluoresces in the red color range, and Cy5, which fluoresces in the green/blue color range. Thus, if:
cDNA#1 binds to Oligo #1;
cDNA#1 from the sample is labeled red;
cDNA#1 from the control is labeled green, and
cDNA#1 is in both the sample and control,
then cDNA#1 from both the sample and control will bind to Oligo#1 on the chip. If the sample has 10 times more cDNA#1 than the control, then 10 times more of the cDNA#1 would be hybridized to Oligo#1. Thus, the spot on the chip with Oligo#1 spot would look red.

|  | Oligo #2 | Oligo #3 |
|---|---|---|
| Oligo #4 | Oligo #5 | Oligo #6 |
| Oligo #7 | Oligo #8 | Oligo #9 |

If the situation were reversed, the spot would appear green. If the sample has approximately the same amount of cDNA#1 as the control, then the Oligo#1 spot on the chip would look yellow. These color differentials are measured quantitatively and used to deduce the relative concentration of mRNAs from individual genes in particular samples.

b. MA_Diff Data Table

To generate data, Applicants labeled and hybridized the sample and control mRNA in duplicate experiments. One chip was exposed to a mixture of cDNAs from both a sample and control, where the sample cDNA was labeled with Cy3, and the control was labeled with Cy5 dye. For the second labeling and chip hybridization experiments, the fluorescent labels were reversed; that is, the Cy5 dye for the sample, and the Cy3 dye for the control.

Whether Cy5 or Cy3 was used to label the sample, the fluorescence produced by the sample was divided by the fluorescence of the control. A cDNA was determined to be differentially expressed in response to the stimulus in question if a statistically-significantly ration difference in the sample versus the control was measured by both chip hybridization experiments.

The MA_diff tables show which cDNA were significantly up-regulated as designated by a "+" and which were significantly down-regulated as designated by a "−" for each pair of chips using the same sample and control.

I.C. Phenotypic Information

One means of determining the phenotypic effect of a gene is either to insert extra active copies of the gene or coding sequence, or to disrupt an existing copy of the gene in a cell or organism and measure the effects of the genetic change on one or more phenotypic characters or traits. "Knock-in" is used herein to refer to insertion of additional active copies of a gene or coding sequence. "Knock-out" refers to a plant where an endogenous gene(s) is disrupted. Applicants have used both methods of addition or disruption to determine the phenotypic effects of gene or gene components or products, and have thereby discovered the function of the genes and their utilities.

1. Knock-in Results

The coding sequence of a desired protein can be functionally linked to a heterologous promoter to facilitate expression. Here, Applicants have operably linked a number of coding sequences to either one of the promoters listed below:

| GFP Pattern | Specific Promoter activity | Plant Line Descriptor |
|---|---|---|
| Root epidermis/mostly toward the lower region of root (more intense than CS9094) | Specific to the root basal region. | Root basal |
| Root-endodermis/cortex (initials sharp); shoot-mesophyll of one leaf, sharp guard cell marking. New leaf petioles near tip of primary inflorescence; floral stems; in flowers at base of sepal, anther stems, and pistil | Specific to the root endodermis-cortex region, leaf petiole, and flowers. | Root/Petiole/Flowers |
| Broad root exp. (some dermal, some cortical, some vascular); shoot apex. Faintly in petiole; stem | Specific to root and stem. | Root/Stem1 |
| High expression in stem, excluded from 1st true leaves/High in root. Faint expression in stem | Specific to stem and root. | Root/Stem2 |
| Shoot meristem/whole root region; little bit on cotyledons. Base of leaves(axillary meristem?); base of sepals; inflorescence meristem; small amount in unfertilized pistil. | Specific to roots, shoot meristem, base of leaves and flowers. | Root/Stem/Leaves/Flowers |
| root tip vascular initials; vascular system throughout plant; Bud petal vasculature and pistil septum; Flower petal vascualture; Flower pistil septum; Pre fertilization ovules; Post fertilization ovule at chalazal end; Developing seed (young, maturing siliques); Seed coat and young embryos. GFP not observed in mature embryos. | Specific to vascular systems. | Vascular/Ovule/Young Seed/Embryo |
| Flower, sepal/vascular tissue of root, stem, and cotyledons. Stems of new flowers; vasculature or petals, anthers, sepals, and pistil/silique; Vasculature throughtout seedling: root, hypocotyl, petioles, stem, cotyledons, first true leaves; Rosette vasculature; Cauline leaf vasculature; Bud pedicel vasculature; Flower vasculature: (sepals, petals, filaments, pistil); Bud vasculature (sepal, petal, filament, pistil); Funiculus in both flower and bud; Some possible seed coat expression; Silique funiculus; Very faint fluorescence in mature embryo (auto fluorescence perhaps); | Specific to flowers, seed and vasculature. | Flowers/Seed/Vasculature/Embryo |
| Root expression - primarily in cortex (upper refion of the root). No shoot expression | Specific to root. | Roots2 |
| Root expression - less intense in whole root of young seedling. Shoot apical meristem; organ primordia in SAM region. | Specific to root and shoot apical meristem. | Root/SAM |
| Root epidermis/tip; shoot epidermis/vascular; leaf epidermis; expression in developing seed/ovule - mature embryo; Primary and lateral root cortex; Very strong in root cap; Base of flower bud and epidermis of carpels; | Specific to seed and to epidermal layers of roots, shoots and leaves. | Seed/Epidermis/Ovary/Fruit |

-continued

| GFP Pattern | Specific Promoter activity | Plant Line Descriptor |
|---|---|---|
| Base of flower, epidermis of filaments, epidermis of carpels; Trichomes; Weak (hardly detectable) gfp expression in vasculature throughout seedling; Strong expression in trichomes; POST-fertilization SEED only; GFP strength increases as silique matures; Weak at suspensor end of the embryo; GFP observed in seed coat; Root and post fertilization seed specific gfp expression; Expression in seed coat. | | |
| Young root dermis; dermal/cortical?/vascular in older root; general (epidermal?) shoot expression; ovules. some in sepals; vasculature of stem | Specific to roots, shoots, and ovules. | Roots/Shoots/Ovule |
| Vascular tissue of root; Meristem tissues: axillary meristems, floral meristems, base of flowers/sepals; Weak expression in hypocotyl, petiole and cotyledon vasculature.. | Specific to root structural leaf vascular region and to floral buds and axillary meristem | Vasculature/Meristem |

The chimeric constructs were transformed into *Arabidopsis thaliana*. The resulting transformed lines were screened to determine what phenotypes were changed due to introduced transgene. The phenotype changes, relative to the control, are reported in the Knock-in tables.

2. Knock-Out Results

Knock-out plants in *Arabidopsis thaliana* were created by inserting a polynucleotide tag into the genome. The location of the tag was identified using primers to the tag sequence and isolation of the plant genomic sequence that flanks the tag using a variation of the polymerase chain reaction. The plants were generated using the procedure described in Feldmann et al., (1987) Molec. Gen. Genet. 208: 1-9; Feldmann (1991) Plant Journal, 1:71-83 and Forsthoefel et al., (1992) Aust. J. Plant Physiol. 19:353-366. On average, the population of plants that was screened had ~1.5 to 2 tags. Generally, the number of tags ranged from 1 to greater than 5.

The polynucleotide tags were classified as either incorporated within a gene, or between two genes. The data in the Knock-out Table indicates which plants have a tag(s) causing a disruption in a gene, or a disruption between genes.

a. Disruption in a Gene

For the sake of this analysis, the tag was considered to be causing a disruption in a gene when the tag was located:

1) less than 501 upstream of the transcriptional start site;
2) less than 701 upstream of the translational initiation codon;
3) between the translational initiation and termination codons of the gene,
4) less than 301 downstream of the translational stop codon; or
5) less than 151 downstream of a transcriptional termination site.

By this definition, a tag can be inserted in two genes. For example, if two genes have only 700 nucleotides between the translational termination codon of one gene and the translational initiation codon of the other gene, the tag can be inserted into the terminator of one gene and the promoter of the other gene according to the definition above.

Genomic annotations by the method OCKHAM-OCDNA identify the transcriptional start and stop site of a gene.

b. Disruption Between Genes

When a tag causes a disruption between two genes, either or both genes can be affected. Typically, a tag can affect a gene if it disrupts the genome at a location 3000 nt downstream to the start codon of a gene. More typically, insertions found 1000-2000 nt upstream (5'), or 750-1000 nt downstream (3') could be expected to disrupt expression.

c. More than One Insert

A plant can have multiple tags. If a mutant phenotype is observed, then it can be attributed to any one or all of the tags.

I.D. BRIEF DESCRIPTION OF THE FIGURES AND INDIVIDUAL TABLES

Figures

Figure 4:
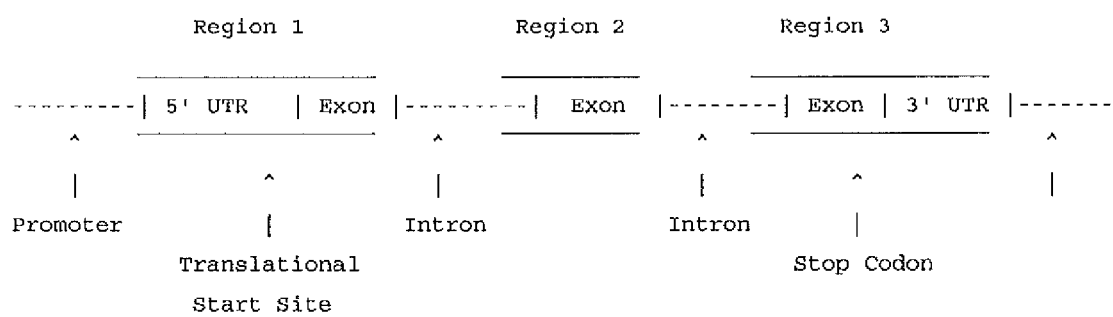
Figure 5:
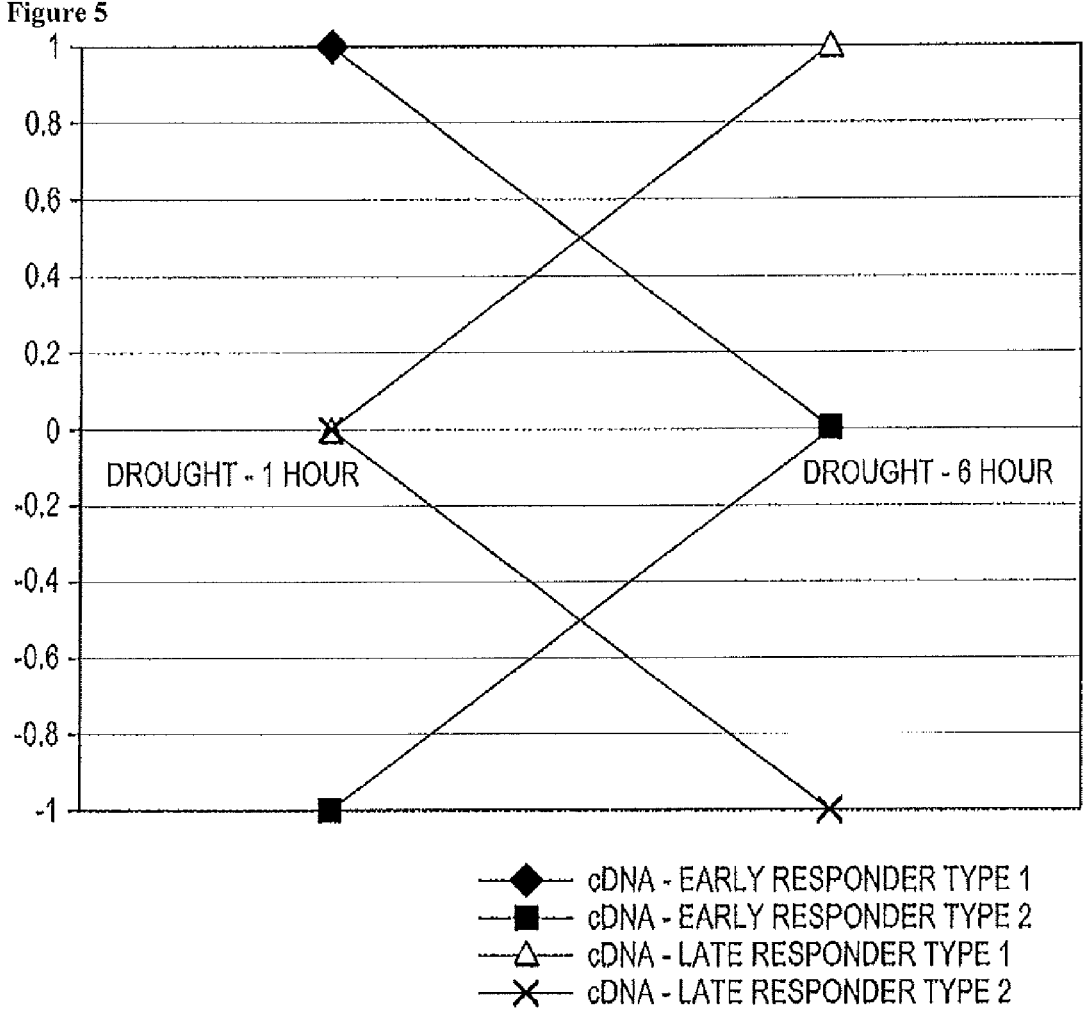
Figure 6:
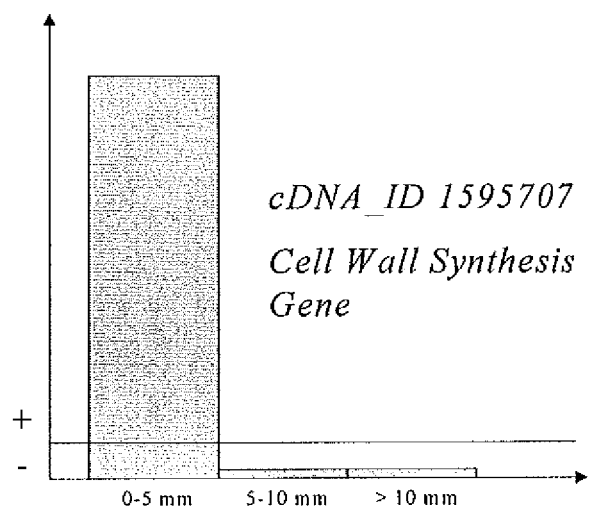
Figure 7:
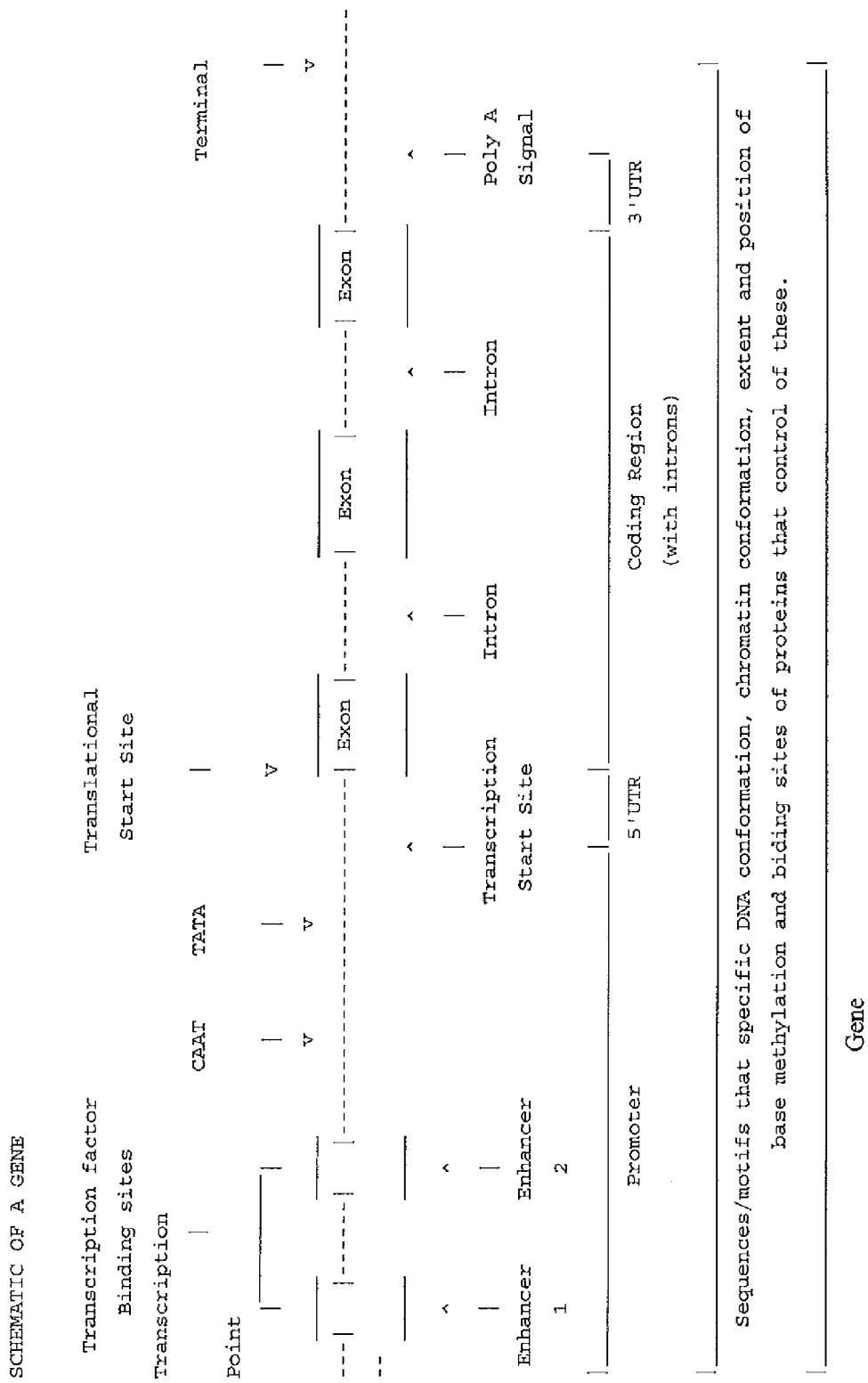

1. FIG. 1 illustrates the Genomics Engine used by Applicants and depicts how gene sequences were determined using five different types of technologies.
2. FIG. 2 illustrates how genes are activated by internal stimuli and protein is produced from them.
3. FIG. 3 illustrates the integration of data across species to link gene products and phenotypes.
4. FIG. 4 illustrates the regions found in a typical MLS.
5. FIG. 5 is a graph illustrating how the genes, gene components and products were classified as either early or late responders following a specific treatment.
6. FIG. 6 shows expression pattern of a cell wall synthesis gene, cDNAID 1595707, during fruit development.
7. FIG. 7 shows the different regions of a typical gene.

TABLES

1. Reference and Sequence Tables

The sequences of exemplary SDFs and polypeptides corresponding to the coding sequences of the instant invention are described in the Reference and Sequence Tables (sometimes referred to as the REF and SEQ Tables. The Reference Table refers to a number of "Maximum Length Sequences" or "MLS." Each MLS corresponds to the longest cDNA obtained, either by cloning or by the prediction from genomic sequence. The sequence of the MLS is the cDNA sequence as described in the Av subsection of the Reference Table.

The Reference Table includes the following information relating to each MLS:

> I. cDNA Sequence
>     A. 5' UTR
>     B. Coding Sequence
>     C. 3' UTR
> II. Genomic Sequence
>     A. Exons
>     B. Introns
>     C. Promoters
> III. Link of cDNA Sequences to Clone IDs
> IV. Multiple Transcription Start Sites
> V. Polypeptide Sequences
>     A. Signal Peptide
>     B. Domains
>     C. Related Polypeptides
> VI. Related Polynucleotide Sequences I. cDNA Sequence The Reference Table indicates which sequence in the Sequence Table represents the sequence of each MLS. The MLS sequence can comprise 5' and 3' UTR as well as coding sequences. In addition, specific cDNA clone numbers also are included in the Reference Table when the MLS sequence relates to a specific cDNA clone.

A. 5' UTR

The location of the 5' UTR can be determined by comparing the most 5' MLS sequence with the corresponding genomic sequence as indicated in the Reference Table. The sequence that matches, beginning at any of the transcriptional start sites and ending at the last nucleotide before any of the translational start sites corresponds to the 5' UTR.

B. Coding Region

The coding region is the sequence in any open reading frame found in the MLS. Coding regions of interest are indicated in the PolyP SEQ subsection of the Reference Table.

C. 3' UTR

The location of the 3' UTR can be determined by comparing the most 3' MLS sequence with the corresponding genomic sequence as indicated in the Reference Table. The sequence that matches, beginning at the translational stop site and ending at the last nucleotide of the MLS corresponds to the 3' UTR.

II. Genomic Sequence

Further, the Reference Table indicates the specific "gi" number of the genomic sequence if the sequence resides in a public databank. For each genomic sequence, Reference tables indicate which regions are included in the MLS. These regions can include the 5' and 3' UTRs as well as the coding sequence of the MLS. See, for example, FIG. 4.

The Reference Table reports the first and last base of each region that are included in an MLS sequence. An example is shown below:

gi No. 47000:
37102 . . . 37497
37593 . . . 37925

The numbers indicate that the MLS contains the following sequences from two regions of gi No. 47000; a first region including bases 37102-37497, and a second region including bases 37593-37925.

A. Exon Sequences

The location of the exons can be determined by comparing the sequence of the regions from the genomic sequences with the corresponding MLS sequence as indicated by the Reference Table.

I. Initial Exon

To determine the location of the initial exon, information from the
(1) polypeptide sequence section;
(2) cDNA polynucleotide section; and
(3) the genomic sequence section
of the Reference Table is used. First, the polypeptide section will indicate where the translational start site is located in the MLS sequence. The MLS sequence can be matched to the genomic sequence that corresponds to the MLS. Based on the match between the MLS and corresponding genomic sequences, the location of the translational start site can be determined in one of the regions of the genomic sequence. The location of this translational start site is the start of the first exon.

Generally, the last base of the exon of the corresponding genomic region, in which the translational start site was located, will represent the end of the initial exon. In some cases, the initial exon will end with a stop codon, when the initial exon is the only exon.

In the case when sequences representing the MLS are in the positive strand of the corresponding genomic sequence, the last base will be a larger number than the first base. When the sequences representing the MLS are in the negative strand of the corresponding genomic sequence, then the last base will be a smaller number than the first base.

ii. Internal Exons

Except for the regions that comprise the 5' and 3' UTRs, initial exon, and terminal exon, the remaining genomic regions that match the MLS sequence are the internal exons. Specifically, the bases defining the boundaries of the remaining regions also define the intron/exon junctions of the internal exons.

iii. Terminal Exon

As with the initial exon, the location of the terminal exon is determined with information from the
(1) polypeptide sequence section;
(2) cDNA polynucleotide section; and
(3) the genomic sequence section
of the Reference Table. The polypeptide section will indicate where the stop codon is located in the MLS sequence. The MLS sequence can be matched to the corresponding genomic sequence. Based on the match between MLS and corresponding genomic sequences, the location of the stop codon can be determined in one of the regions of the genomic sequence. The location of this stop codon is the end of the terminal exon. Generally, the first base of the exon of the corresponding genomic region that matches the cDNA sequence, in which the stop codon was located, will represent the beginning of the terminal exon. In some cases, the translational start site will represent the start of the terminal exon, which will be the only exon.

In the case when the MLS sequences are in the positive strand of the corresponding genomic sequence, the last base will be a larger number than the first base. When the MLS sequences are in the negative strand of the corresponding genomic sequence, then the last base will be a smaller number than the first base.

B. Intron Sequences

In addition, the introns corresponding to the MLS are defined by identifying the genomic sequence located between the regions where the genomic sequence comprises exons. Thus, introns are defined as starting one base downstream of a genomic region comprising an exon, and end one base upstream from a genomic region comprising an exon.

C. Promoter Sequences

As indicated below, promoter sequences corresponding to the MLS are defined as sequences upstream of the first exon; more usually, as sequences upstream of the first of multiple transcription start sites; even more usually as sequences about 2,000 nucleotides upstream of the first of multiple transcription start sites.

III. LINK of cDNA SEQUENCES to CLONE IDs

As noted above, the Reference Table identifies the cDNA clone(s) that relate to each MLS. The MLS sequence can be longer than the sequences included in the cDNA clones. In such a case, the Reference Table indicates the region of the MLS that is included in the clone. If either the 5' or 3' termini of the cDNA clone sequence is the same as the MLS sequence, no mention will be made.

IV. Multiple Transcription Start Sites

Initiation of transcription can occur at a number of sites of the gene. The Reference Table indicates the possible multiple transcription sites for each gene. In the Reference Table, the location of the transcription start sites can be either a positive or negative number.

The positions indicated by positive numbers refer to the transcription start sites as located in the MLS sequence. The negative numbers indicate the transcription start site within the genomic sequence that corresponds to the MLS.

To determine the location of the transcription start sites with the negative numbers, the MLS sequence is aligned with the corresponding genomic sequence. In the instances when a public genomic sequence is referenced, the relevant corresponding genomic sequence can be found by direct reference to the nucleotide sequence indicated by the "gi" number shown in the public genomic DNA section of the Reference Table. When the position is a negative number, the transcription start site is located in the corresponding genomic sequence upstream of the base that matches the beginning of the MLS sequence in the alignment. The negative number is relative to the first base of the MLS sequence which matches the genomic sequence corresponding to the relevant "gi" number.

In the instances when no public genomic DNA is referenced, the relevant nucleotide sequence for alignment is the nucleotide sequence associated with the amino acid sequence designated by "gi" number of the later PolyP SEQ subsection.

V. Polypeptide Sequences

The PolyP SEQ subsection lists SEQ ID NOs and Ceres SEQ ID NO for polypeptide sequences corresponding to the coding sequence of the MLS sequence and the location of the translational start site with the coding sequence of the MLS sequence.

The MLS sequence can have multiple translational start sites and can be capable of producing more than one polypeptide sequence.

A. Signal Peptide

The Reference tables also indicate in subsection (B) the cleavage site of the putative signal peptide of the polypeptide corresponding to the coding sequence of the MLS sequence. Typically, signal peptide coding sequences comprise a sequence encoding the first residue of the polypeptide to the cleavage site residue.

B. Domains

Subsection (C) provides information regarding identified domains (where present) within the polypeptide and (where present) a name for the polypeptide domain.

C. Related Polypeptides

Subsection (Dp) provides (where present) information concerning amino acid sequences that are found to be related and have some percentage of sequence identity to the polypeptide sequences of the Reference and Sequence Tables. These related sequences are identified by a "gi" number.

VI. Related Polynucleotide Sequences

Subsection (Dn) provides polynucleotide sequences (where present) that are related to and have some percentage of sequence identity to the MLS or corresponding genomic sequence.

| Abbreviation | Description |
| --- | --- |
| Max Len. Seq. | Maximum Length Sequence |
| rel to | Related to |
| Clone Ids | Clone ID numbers |
| Pub gDNA | Public Genomic DNA |
| gi No. | gi number |
| Gen. Seq. in Cdna | Genomic Sequence in cDNA (Each region for a single gene prediction is listed on a separate line. In the case of multiple gene predictions, the group of regions relating to a single prediction are separated by a blank line) |
| (Ac) cDNA SEQ | cDNA sequence |
| Pat. Appln. SEQ ID NO | Patent Application SEQ ID NO: |
| Ceres SEQ ID NO: 1673877 | Ceres SEQ ID NO: |
| SEQ # w. TSS | Location within the cDNA sequence, SEQ ID NO:, of Transcription Start Sites which are listed below |
| Clone ID #: # -> # | Clone ID comprises bases # to # of the cDNA Sequence |
| PolyP SEQ | Polypeptide Sequence |
| Pat. Appln. SEQ ID NO: | Patent Application SEQ ID NO: |
| Ceres SEQ ID NO | Ceres SEQ ID NO: |
| Loc. SEQ ID NO: @ nt. | Location of translational start site in cDNA of SEQ ID NO: at nucleotide number |
| (C) Pred. PP Nom. & Annot. | Nomination and Annotation of Domains within Predicted Polypeptide(s) |
| (Title) | Name of Domain |
| Loc. SEQ ID NO #: # -> # aa. | Location of the domain within the polypeptide of SEQ ID NO: from # to # amino acid residues. |
| (Dp) Rel. AA SEQ | Related Amino Acid Sequences |
| Align. NO | Alignment number |
| gi No | Gi number |
| Desp. | Description |
| % Idnt. | Percent identity |
| Align. Len. | Alignment Length |
| Loc. SEQ ID NO: # -> # aa | Location within SEQ ID NO: from # to # amino acid residue. |

2. Protein Group Table

This table indicates groups of proteins that share a signature sequence (also referred to as a consensus sequence). The Protein group also referred to as the Ortholog group is named by the peptide ID with which all members were compared. Each group contains sequences that were included at the $10^{-50}$, $10^{-30}$, and $10^{-10}$ p-value cutoffs. For each group, the peptide ID and at which cutoff the peptide was included into the group. The same peptide ID may be included in the group three times as peptide ID 50, peptide ID 30 and peptide ID 10. The data indicates that peptide ID was included in the group when the threshold was either $10^{-50}$, $10^{-30}$, or $10^{-10}$. All the peptide IDs that are followed by "50" were included in the protein group when the e-value cutoff was $10^{-50}$. All the peptide IDs that are followed by either "30" or "50" were included in the protein group when the threshold e-value was $10^{-30}$. All the peptide IDs that are followed by "10", "30" or "50" were included in the protein group when $10^{-10}$ was used as the e-value cutoff. At the end of each protein group is a list of the consensus sequence that proteins share at the $10^{-50}$, $10^{-30}$, or $10^{-10}$. The consensus sequence contains both lower-case and upper-case letters. The upper-case letters represent the standard one-letter amino acid abbreviations. The lower case letters represent classes of amino acids:
"t" refers to tiny amino acids, which are specifically alanine, glycine, serine and threonine.
"p" refers to polar amino acids, which are specifically, asparagine and glutamine
"n" refers to negatively charged amino acids, which are specifically, aspartic acid and glutamic acid
"+" refers to positively charged residues, which are specifically, lysine, arginine, and histidine
"r" refers to aromatic residues, which are specifically, phenylalanine, tyrosine, and tryptophan,
"a" refers to aliphatic residues, which are specifically, isoleucine, valine, leucine, and methionine 3. Protein Group Matrix Table In addition to each consensus sequence, Applicants have generated a scoring matrix to provide further description of the consensus sequence. The first row of each matrix indicates the residue position in the consensus sequence. The matrix reports number of occurrences of all the amino acids that were found in the group members for every residue position of the signature sequence. The matrix also indicates for each residue position, how many different organisms were found to have a polypeptide in the group that included a residue at the relevant position. The last line of the matrix indicates all the amino acids that were found at each position of the consensus.

4. MA_Diff Table

The MA_diff Table presents the results of the differential expression experiments for the mRNAs, as reported by their corresponding cDNA ID number, that were differentially transcribed under a particular set of conditions as compared to a control sample. The cDNA ID numbers correspond to those utilized in the Reference and Sequence Tables. Increases in mRNA abundance levels in experimental plants versus the controls are denoted with the plus sign (+). Likewise, reductions in mRNA abundance levels in the experimental plants are denoted with the minus (−) sign.

The Table is organized according to each set of experimental conditions, which are denoted by the term "Expt ID:" followed by a particular number. The table below links each Expt ID with a short description of the experiment and the parameters.

For each experiment ID a method of the normalization is specified. "Method: 2" represents normalization by median the goal of the method is to adjust the ratios by a factor so that the median of the ratio distribution is 1. Method 3 is the normalization procedure conducted by Agilent Technologies, Inc. Palo Alto, Calif., USA.

The MA_diff Table also specifies the specific parameters and the experiment number (e.g. 107871) used in compiling the data. The experiment numbers are referenced in the appropriate utility/functions sections herein. The background threshold was set to "BKG_Threshold=X" to reduce the effect of the background on the signal.

Finally, the Table includes reference to an "Organism_ID" number. This number refers to the cDNA spotted on the chip were similar to *Arabidopsis thaliana* (3769) sequences or whether the oligo used for the chips were similar to *Zea mays* (311987) sequences.

5. MA_diff (Experiment) Table

The following Table summarizes the experimental procedures utilized for the differential expression experiments, each experiment being identified by a unique "Expt ID" number.

| Example No. | Experiment short name | genome | EXPT_ID | Value | PARAMETER | UNITS |
|---|---|---|---|---|---|---|
| 3ii | 3642-1 | *Arabidopsis* | 108512 | 3746-1 | Plant Line | Hours |
| 3n | Arab_0.001%_MeJA_1 | *Arabidopsis* | 108568 | Aerial | Tissue | Tissue |
| | | | | 0.001%_MeJA | Treatment | Compound |
| | | | | 1 | Timepoint | Hours |
| 3n | Arab_0.001%_MeJA_1 | *Arabidopsis* | 108569 | Aerial | Tissue | Tissue |
| | | | | 6 | Timepoint | Hours |
| | | | | 0.001%_MeJA | Treatment | Compound |
| 3j | Arab_0.1uM_Epi-Brass_1 | *Arabidopsis* | 108580 | Aerial | Tissue | Tissue |
| | | | | 1 | Timepoint | Hours |
| | | | | 0.1uM_Brassino_Steroid | Treatment | Compound |
| 3j | Arab_0.1uM_Epi-Brass_1 | *Arabidopsis* | 108581 | Aerial | Tissue | Tissue |
| | | | | 6 | Timepoint | Hours |
| | | | | 0.1uM_Brassino_Steroid | Treatment | Compound |
| 3g | Arab_100uM_ABA_1 | *Arabidopsis* | 108560 | Aerial | Tissue | Tissue |
| | | | | 1 | Timepoint | Hours |
| | | | | 100uM_ABA | Treatment | Compound |
| 3g | Arab_100uM_ABA_1 | *Arabidopsis* | 108561 | Aerial | Tissue | Tissue |
| | | | | 100uM_ABA | Treatment | Compound |
| | | | | 6 | Timepoint | Hours |
| 3I | Arab_100uM_BA_1 | *Arabidopsis* | 108566 | Aerial | Tissue | Tissue |
| | | | | 1 | Timepoint | Hours |
| | | | | 100uM_BA | Treatment | Compound |
| 3I | Arab_100uM_BA_1 | *Arabidopsis* | 108567 | Aerial | Tissue | Tissue |
| | | | | 100uM_BA | Treatment | Compound |
| | | | | 6 | Timepoint | Hours |
| 3k | Arab_100uM_GA3_1 | *Arabidopsis* | 108562 | Aerial | Tissue | Tissue |
| | | | | 1 | Timepoint | Hours |
| | | | | 100 uM GA3 | Treatment | Compound |
| 3k | Arab_100uM_GA3_1 | *Arabidopsis* | 108563 | Aerial | Tissue | Tissue |
| | | | | 100 uM GA3 | Treatment | Compound |
| | | | | 6 | Timepoint | Hours |
| 3h | Arab_100uM_NAA_1 | *Arabidopsis* | 108564 | Aerial | Tissue | Tissue |
| | | | | 1 | Timepoint | Hours |
| | | | | 100uM_NAA | Treatment | Compound |

-continued

| Example No. | Experiment short name | genome | EXPT_ID | Value | PARAMETER | UNITS |
|---|---|---|---|---|---|---|
| 3h | Arab_100uM_NAA_1 | *Arabidopsis* | 108565 | Aerial | Tissue | Tissue |
| | | | | 100uM_NAA | Treatment | Compound |
| | | | | 6 | Timepoint | Hours |
| 3r | Arab_20%_PEG_1 | *Arabidopsis* | 108570 | Aerial | Tissue | Tissue |
| | | | | 1 | Timepoint | Hours |
| | | | | 20% PEG | Treatment | Compound |
| 3r | Arab_20%_PEG_1 | *Arabidopsis* | 108571 | Aerial | Tissue | Tissue |
| | | | | 20% PEG | Treatment | Compound |
| | | | | 6 | Timepoint | Hours |
| 3o | Arab_2mM_SA_1 | *Arabidopsis* | 108586 | Aerial | Tissue | Tissue |
| | | | | 2mM_SA | Treatment | Compound |
| | | | | 1 | Timepoint | Hours |
| 3o | Arab_2mM_SA_1 | *Arabidopsis* | 108587 | Aerial | Tissue | Tissue |
| | | | | 6 | Timepoint | Hours |
| | | | | 2mM_SA | Treatment | Compound |
| 3u | Arab_5mM_H2O2_1 | *Arabidopsis* | 108582 | Aerial | Tissue | Tissue |
| | | | | 1 | Timepoint | Hours |
| | | | | 5mM_H2O2 | Treatment | Compound |
| 3u | Arab_5mM_H2O2_1 | *Arabidopsis* | 108583 | Aerial | Tissue | Tissue |
| | | | | 5mM_H2O2 | Treatment | Compound |
| | | | | 6 | Timepoint | Hours |
| 3v | Arab_5mM_NaNP_1 | *Arabidopsis* | 108584 | Aerial | Tissue | Tissue |
| | | | | 1 | Timepoint | Hours |
| | | | | 5mM_NaNP | Treatment | Compound |
| 3v | Arab_5mM_NaNP_1 | *Arabidopsis* | 108585 | Aerial | Tissue | Tissue |
| | | | | 5mM_NaNP | Treatment | Compound |
| | | | | 6 | Timepoint | Hours |
| 3t | Arab_Cold_1 | *Arabidopsis* | 108578 | Aerial | Tissue | Tissue |
| | | | | Cold | Treatment | Compound |
| | | | | 1 | Timepoint | Hours |
| 3t | Arab_Cold_1 | *Arabidopsis* | 108579 | Aerial | Tissue | Tissue |
| | | | | 6 | Timepoint | Hours |
| | | | | Cold | Treatment | Compound |
| 3g | Arab_Drought_1 | *Arabidopsis* | 108572 | Aerial | Tissue | Tissue |
| | | | | 1 | Timepoint | Hours |
| | | | | Drought | Treatment | Compound |
| 3g | Arab_Drought_1 | *Arabidopsis* | 108573 | Aerial | Tissue | Tissue |
| | | | | Drought | Treatment | Compound |
| | | | | 6 | Timepoint | Hours |
| 3s | Arab_Heat_1 | *Arabidopsis* | 108576 | Aerial | Tissue | Tissue |
| | | | | 1 | Timepoint | Hours |
| | | | | Heat (42 deg C.) | Treatment | Compound |
| 3s | Arab_Heat_1 | *Arabidopsis* | 108577 | Aerial | Tissue | Tissue |
| | | | | Heat (42 deg C.) | Treatment | Compound |
| | | | | 6 | Timepoint | Hours |
| 3aa (ovule) | Arab_Ler-pi_ovule_1 | *Arabidopsis* | 108595 | Ler_pi | Plant Line | Hours |
| | | | | Ovule | Tissue | Tissue |
| 3b | Arab_Ler-rhl_root_1 | *Arabidopsis* | 108594 | Ler_rhl | Plant Line | Hours |
| | | | | Root | Tissue | Tissue |
| 3l | Arab_NO3_H-to-L_1 | *Arabidopsis* | 108592 | Aerial | Tissue | Tissue |
| | | | | Low Nitrogen | Treatment | Compound |
| | | | | 12 | Timepoint | Hours |
| 3l | Arab_NO3_H-to-L_1 | *Arabidopsis* | 108593 | Aerial | Tissue | Tissue |
| | | | | 24 | Timepoint | Hours |
| | | | | Low Nitrogen | Treatment | Compound |
| 3l | Arab_NO3_L-to-H_1 | *Arabidopsis* | 108588 | Aerial | Tissue | Tissue |
| | | | | 2 | Timepoint | Hours |
| | | | | Nitrogen | Treatment | Compound |
| 3l | Arab_NO3_L-to-H_1 | *Arabidopsis* | 108589 | Aerial | Tissue | Tissue |
| | | | | Nitrogen | Treatment | Compound |
| | | | | 6 | Timepoint | Hours |
| 3l | Arab_NO3_L-to-H_1 | *Arabidopsis* | 108590 | Aerial | Tissue | Tissue |
| | | | | 9 | Timepoint | Hours |
| | | | | Nitrogen | Treatment | Compound |

-continued

| Example No. | Experiment short name | genome | EXPT_ID | Value | PARAMETER | UNITS |
|---|---|---|---|---|---|---|
| 3l | Arab_NO3_L-to-H_1 | *Arabidopsis* | 108591 | Aerial | Tissue | Tissue |
| | | | | Nitrogen | Treatment | Compound |
| | | | | 12 | Timepoint | Hours |
| 3p | Arab_Wounding_1 | *Arabidopsis* | 108574 | Aerial | Tissue | Tissue |
| | | | | 1 | Timepoint | Hours |
| | | | | Wounding | Treatment | Compound |
| 3p | Arab_Wounding_1 | *Arabidopsis* | 108575 | Aerial | Tissue | Tissue |
| | | | | Wounding | Treatment | Compound |
| | | | | 6 | Timepoint | Hours |
| 3o | Columbia/CS3726 flower SA | *Arabidopsis* | 108475 | Columbia | species | Hours |
| | | | | SA | Treatment | Compound |
| | | | | 5 weeks | Timepoint | Hours |
| 3o | Columbia/CS3726 flower SA | *Arabidopsis* | 108476 | CS3726 | species | Hours |
| | | | | 5 weeks | Timepoint | Hours |
| | | | | SA | Treatment | Compound |
| 3p | Corn_0.001Percent_MeJA | *Zea Mays* | 108555 | Aerial | Tissue | Tissue |
| | | | | 24 | Timepoint | Hours |
| | | | | 0.001%_MeJA | Treatment | Compound |
| 3j | Corn_0.1uM_Brassino_Steroid | *Zea Mays* | 108557 | 24 | Timepoint | Hours |
| | | | | Aerial | Tissue | Tissue |
| | | | | 0.1uM_Brassino_Steroid | Treatment | Compound |
| 3g | Corn_100uM_ABA | *Zea Mays* | 108513 | Aerial | Tissue | Tissue |
| | | | | ABA | Treatment | Compound |
| | | | | 6 | Timepoint | Hours |
| 3g | Corn_100uM_ABA | *Zea Mays* | 108597 | Aerial | Tissue | Tissue |
| | | | | 24 | Timepoint | Hours |
| | | | | 100uM_ABA | Treatment | Compound |
| 3i | Corn_100uM_BA | *Zea Mays* | 108517 | Aerial | Tissue | Tissue |
| | | | | 6 | Timepoint | Hours |
| | | | | BA | Treatment | Compound |
| 3k | Corn_100uM_GA3 | *Zea Mays* | 108519 | Aerial | Tissue | Tissue |
| | | | | 100 uM Giberillic Acid | Treatment | Compound |
| | | | | 1 | Timepoint | Hours |
| 3k | Corn_100uM_GA3 | *Zea Mays* | 108520 | Aerial | Tissue | Tissue |
| | | | | 6 | Timepoint | Hours |
| | | | | 100 uM Giberillic Acid | Treatment | Compound |
| 3k | Corn_100uM_GA3 | *Zea Mays* | 108521 | Aerial | Tissue | Tissue |
| | | | | 100 uM Giberillic Acid | Treatment | Compound |
| | | | | 12 | Timepoint | Hours |
| 3h | Corn_100uM_NAA | *Zea Mays* | 108516 | Aerial | Tissue | Tissue |
| | | | | NAA | Treatment | Compound |
| | | | | 6 | Timepoint | Hours |
| 3h | Corn_100uM_NAA | *Zea Mays* | 108554 | Aerial | Tissue | Tissue |
| | | | | 24 | Timepoint | Hours |
| | | | | NAA | Treatment | Compound |
| 3hh | Corn_1400-6/S-17 | *Zea Mays* | 108598 | Shoot apices | Tissue | Tissue |
| 3r | Corn_150mM_NaCl | *Zea Mays* | 108541 | Aerial | Tissue | Tissue |
| | | | | 1 | Timepoint | Hours |
| | | | | 150mM_NaCl | Treatment | Compound |
| 3r | Corn_150mM_NaCl | *Zea Mays* | 108542 | Aerial | Tissue | Tissue |
| | | | | 150mM_NaCl | Treatment | Compound |
| | | | | 6 | Timepoint | Hours |
| 3r | Corn_150mM_NaCl | *Zea Mays* | 108553 | Aerial | Tissue | Tissue |
| | | | | 24 | Timepoint | Hours |
| | | | | 150mM_NaCl | Treatment | Compound |
| 3r | Corn_20%_PEG | *Zea Mays* | 108539 | Aerial | Tissue | Tissue |
| | | | | 1 | Timepoint | Hours |
| | | | | 20% PEG | Treatment | Compound |
| 3r | Corn_20%_PEG | *Zea Mays* | 108540 | Aerial | Tissue | Tissue |
| | | | | 20% PEG | Treatment | Compound |
| | | | | 6 | Timepoint | Hours |
| 3o | Corn_2mM_SA | *Zea Mays* | 108515 | Aerial | Tissue | Tissue |
| | | | | SA | Treatment | Compound |
| | | | | 12 | Timepoint | Hours |

| Example No. | Experiment short name | genome | EXPT_ID | Value | PARAMETER | UNITS |
|---|---|---|---|---|---|---|
| 3o | Corn_2mM_SA | *Zea Mays* | 108552 | Aerial<br>SA<br>24 | Tissue<br>Treatment<br>Timepoint | Tissue<br>Compound<br>Hours |
| 3u | Corn_5mM_H2O2 | *Zea Mays* | 108537 | Aerial<br>H2O2<br>1 | Tissue<br>Treatment<br>Timepoint | Tissue<br>Compound<br>Hours |
| 3u | Corn_5mM_H2O2 | *Zea Mays* | 108538 | Aerial<br>6<br>H2O2 | Tissue<br>Timepoint<br>Treatment | Tissue<br>Hours<br>Compound |
| 3u | Corn_5mM_H2O2 | *Zea Mays* | 108558 | Aerial<br>24<br>H2O2 | Tissue<br>Timepoint<br>Treatment | Tissue<br>Hours<br>Compound |
| 3v | Corn_5mM_NO | *Zea Mays* | 108526 | Aerial<br>NO<br>1 | Tissue<br>Treatment<br>Timepoint | Tissue<br>Compound<br>Hours |
| 3v | Corn_5mM_NO | *Zea Mays* | 108527 | Aerial<br>6<br>NO | Tissue<br>Timepoint<br>Treatment | Tissue<br>Hours<br>Compound |
| 3v | Corn_5mM_NO | *Zea Mays* | 108559 | Aerial<br>12<br>NO | Tissue<br>Timepoint<br>Treatment | Tissue<br>Hours<br>Compound |
| 3t | Corn_Cold | *Zea Mays* | 108533 | Aerial<br>1<br>Cold | Tissue<br>Timepoint<br>Treatment | Tissue<br>Hours<br>Compound |
| 3t | Corn_Cold | *Zea Mays* | 108534 | Aerial<br>Cold<br>6 | Tissue<br>Treatment<br>Timepoint | Tissue<br>Compound<br>Hours |
| 3q | Corn_Drought | *Zea Mays* | 108502 | Drought<br>1 | Treatment<br>Timepoint | Compound<br>Hours |
| 3q | Corn_Drought | *Zea Mays* | 108503 | Drought<br>6 | Treatment<br>Timepoint | Compound<br>Hours |
| 3q | Corn_Drought | *Zea Mays* | 108504 | Drought<br>12 | Treatment<br>Timepoint | Compound<br>Hours |
| 3q | Corn_Drought | *Zea Mays* | 108556 | Drought<br>24 | Treatment<br>Timepoint | Compound<br>Hours |
| 3s | Corn_Heat | *Zea Mays* | 108522 | Aerial<br>1<br>Heat (42 deg C.) | Tissue<br>Timepoint<br>Treatment | Tissue<br>Hours<br>Compound |
| 3s | Corn_Heat | *Zea Mays* | 108523 | Aerial<br>6<br>Heat (42 deg C.) | Tissue<br>Timepoint<br>Treatment | Tissue<br>Hours<br>Compound |
| 3gg | Corn_Imbibed Seeds | *Zea Mays* | 108518 | Imbibed<br>4<br>Roots | Treatment<br>Age<br>Tissue | Compound<br>days old<br>Tissue |
| 3gg | Corn_Imbibed Seeds | *Zea Mays* | 108528 | Imbibed<br>Aerial<br>5 | Treatment<br>Tissue<br>Age | Compound<br>Tissue<br>days old |
| 3gg | Corn_Imbibed Seeds | *Zea Mays* | 108529 | Imbibed<br>5<br>Root | Treatment<br>Age<br>Tissue | Compound<br>days old<br>Tissue |
| 3gg | Corn_Imbibed Seeds | *Zea Mays* | 108530 | Imbibed<br>Aerial<br>6 | Treatment<br>Tissue<br>Age | Compound<br>Tissue<br>days old |
| 3gg | Corn_Imbibed Seeds | *Zea Mays* | 108531 | Imbibed<br>6<br>root | Treatment<br>Age<br>Tissue | Compound<br>days old<br>Tissue |
| 3gg | Corn_Imbibed Seeds | *Zea Mays* | 108545 | Imbibed<br>Aerial<br>3 | Treatment<br>Tissue<br>Age | Compound<br>Tissue<br>days old |
| 3gg | Corn_Imbibed Seeds | *Zea Mays* | 108546 | Imbibed<br>3<br>Root | Treatment<br>Age<br>Tissue | Compound<br>days old<br>Tissue |
| 3gg | Corn_Imbibed Seeds | *Zea Mays* | 108547 | Imbibed<br>Aerial<br>4 | Treatment<br>Tissue<br>Age | Compound<br>Tissue<br>days old |

-continued

| Example No. | Experiment short name | genome | EXPT_ID | Value | PARAMETER | UNITS |
|---|---|---|---|---|---|---|
| 3gg | Corn_Imbibed_Embryo_Endosperm | *Zea Mays* | 108543 | 2 | Age | days old |
| | | | | Imbibed | Treatment | Compound |
| | | | | Embryo | Tissue | Tissue |
| 3gg | Corn_Imbibed_Embryo_Endosperm | *Zea Mays* | 108544 | 2 | Age | days old |
| | | | | Endosperm | Tissue | Tissue |
| | | | | Imbibed | Treatment | Compound |
| 3ee | Corn_Meristem | *Zea Mays* | 108535 | Root Meristem | Tissue | Tissue |
| | | | | 192 | Timepoint | Hours |
| 3ee | Corn_Meristem | *Zea Mays* | 108536 | Shoot Meristem | Tissue | Tissue |
| | | | | 192 | Timepoint | Hours |
| 3n | Corn_Nitrogen_H_to_L | *Zea Mays* | 108532 | Roots | Tissue | Tissue |
| | | | | Low Nitrogen | Treatment | Compound |
| | | | | 16 | Timepoint | Hours |
| 3n | Corn_Nitrogen_H_to_L | *Zea Mays* | 108548 | Root | Tissue | Tissue |
| | | | | Low Nitrogen | Treatment | Compound |
| | | | | 4 | Timepoint | Hours |
| 3m | Corn_Nitrogen_L_to_H | *Zea Mays* | 108549 | Aerial | Tissue | Tissue |
| | | | | 0.166 | Timepoint | Hours |
| | | | | Nitrogen | Treatment | Compound |
| 3m | Corn_Nitrogen_L_to_H | *Zea Mays* | 108550 | Aerial | Tissue | Tissue |
| | | | | Nitrogen | Treatment | Compound |
| | | | | 1.5 | Timepoint | Hours |
| 3m | Corn_Nitrogen_L_to_H | *Zea Mays* | 108551 | Aerial | Tissue | Tissue |
| | | | | 3 | Timepoint | Hours |
| | | | | Nitrogen | Treatment | Compound |
| 3ff | Corn_RT1 | *Zea Mays* | 108599 | Unknown | Plant Line | Hours |
| | | | | Root | Tissue | Tissue |
| 3p | Corn_Wounding | *Zea Mays* | 108524 | Aerial | Tissue | Tissue |
| | | | | Wounding | Treatment | Compound |
| | | | | 1 | Timepoint | Hours |
| 3p | Corn_Wounding | *Zea Mays* | 108525 | Aerial | Tissue | Tissue |
| | | | | 6 | Timepoint | Hours |
| | | | | Wounding | Treatment | Compound |
| 3g | Drought_Flowers | *Arabidopsis* | 108473 | Flowers | Tissue | Tissue |
| | | | | 7 d | Timepoint | Hours |
| | | | | Drought | Treatment | Compound |
| 3g | Drought_Flowers | *Arabidopsis* | 108474 | Flowers | Tissue | Tissue |
| | | | | Drought | Treatment | Compound |
| | | | | 8 d (1 d-post_re-watering) | Timepoint | Hours |
| 3k | GA Treated | *Arabidopsis* | 108484 | 1 | Timepoint | Hours |
| | | | | 1 | Timepoint | Hours |
| 3k | GA Treated | *Arabidopsis* | 108485 | 6 | Timepoint | Hours |
| | | | | 6 | Timepoint | Hours |
| 3k | GA Treated | *Arabidopsis* | 108486 | 12 | Timepoint | Hours |
| | | | | 12 | Timepoint | Hours |
| 3e | Germinating Seeds | *Arabidopsis* | 108461 | Day 1 | Timepoint | Hours |
| 3e | Germinating Seeds | *Arabidopsis* | 108462 | Day 2 | Timepoint | Hours |
| 3e | Germinating Seeds | *Arabidopsis* | 108463 | Day 3 | Timepoint | Hours |
| 3e | Germinating Seeds | *Arabidopsis* | 108464 | Day 4 | Timepoint | Hours |
| 3bb | Herbicide V3.1 | *Arabidopsis* | 108465 | Round up | Treatment | Compound |
| | | | | 12 | Timepoint | Hours |
| 3bb | Herbicide V3.1 | *Arabidopsis* | 108466 | Trimec | Treatment | Compound |
| | | | | 12 | Timepoint | Hours |
| 3bb | Herbicide V3.1 | *Arabidopsis* | 108467 | Finale | Treatment | Compound |
| | | | | 12 | Timepoint | Hours |
| 3bb | Herbicide V3.1 | *Arabidopsis* | 108468 | Glean | Treatment | Compound |
| | | | | 12 | Timepoint | Hours |
| 3bb | Herbicide_v2 | *Arabidopsis* | 107871 | Finale | Treatment | Compound |
| | | | | 4 | Timepoint | Hours |
| 3bb | Herbicide_v2 | *Arabidopsis* | 107876 | Finale | Treatment | Compound |
| | | | | 12 | Timepoint | Hours |
| 3bb | Herbicide_v2 | *Arabidopsis* | 107881 | Glean | Treatment | Compound |
| | | | | 4 | Timepoint | Hours |
| 3bb | Herbicide_v2 | *Arabidopsis* | 107886 | Trimec | Treatment | Compound |
| | | | | 4 | Timepoint | Hours |
| 3bb | Herbicide_v2 | *Arabidopsis* | 107891 | Trimec | Treatment | Compound |
| | | | | 12 | Timepoint | Hours |

-continued

| Example No. | Experiment short name | genome | EXPT_ID | Value | PARAMETER | UNITS |
|---|---|---|---|---|---|---|
| 3bb | Herbicide_v2 | Arabidopsis | 107896 | Round-up | Treatment | Compound |
|  |  |  |  | 4 | Timepoint | Hours |
| 3d | Trichome Inflorescences expt | Arabidopsis | 108452 | Hairy Influorescence #1 | Tissue | Tissue |
| 3o | SA treatment_1 hour | Arabidopsis | 108471 | Columbia | Species | Hours |
|  |  |  |  | 1 | Timepoint | Hours |
|  |  |  |  | SA | Treatment | Compound |
| 3o | SA treatment_1 hour | Arabidopsis | 108472 | CS3726 | Species | Hours |
|  |  |  |  | 1 | Timepoint | Hours |
|  |  |  |  | SA | Treatment | Compound |
| 3o | SA treatment_4 hour | Arabidopsis | 108469 | columbia | Species | Hours |
|  |  |  |  | 4 | Timepoint | Hours |
|  |  |  |  | SA | Treatment | Compound |
| 3o | SA treatment_4 hour | Arabidopsis | 108470 | CS3726 | Species | Hours |
|  |  |  |  | SA | Treatment | Compound |
|  |  |  |  | 4 | Timepoint | Hours |
| 3o | SA treatment_AJ | Arabidopsis | 107953 | 50 | Probe Amount | % of Standard Amount |
|  |  |  |  | SA | Treatment | Compound |
|  |  |  |  | 24 | Timepoint | Hours |
|  |  |  |  | Clontech | Probe Type | Probe method |
| 3o | SA treatment_AJ | Arabidopsis | 107960 | 50 | Probe Amount | % of Standard Amount |
|  |  |  |  | SA | Treatment | Compound |
|  |  |  |  | 24 | Timepoint | Hours |
|  |  |  |  | Operon | Probe Type | Probe method |
| 3o | SA_treatment 24 hour | Arabidopsis | 108443 | SA | Treatment | Compound |
|  |  |  |  | 24 | Timepoint | Hours |
| 3o | SA_treatment 6 hour | Arabidopsis | 108440 | SA treatment 6 hour | Treatment | Compound |
|  |  |  |  | CS3726 | species | Hours |
| 3o | SA_treatment 6 hour | Arabidopsis | 108441 | SA treatment 6 hour | Treatment | Compound |
|  |  |  |  | Columbia | species | Hours |
| 3l | Nitrogen High transition to Low | Arabidopsis | 108454 | 10 min | Timepoint | Hours |
| 3l | Nitrogen High transition to Low | Arabidopsis | 108455 | 1 hr | Timepoint | Hours |
| 3j | BR_Shoot Apices Expt | Arabidopsis | 108478 | dwf4-1 | Plant Line | Hours |
| 3j | BR_Shoot Apices Expt | Arabidopsis | 108479 | AOD4-4 | Plant Line | Hours |
| 3j | BR_Shoot Apices Expt | Arabidopsis | 108480 | Ws-2 | Plant Line | Hours |
|  |  |  |  | BL | Treatment | Compound |
| 3j | BR_Shoot Apices Expt | Arabidopsis | 108481 | Ws-2 | Plant Line | Hours |
|  |  |  |  | BRZ | Treatment | Compound |
| 3jj | Tissue Specific Expression | Arabidopsis | 108429 | green flower | Tissue | Tissue |
|  |  |  |  | operon | Probe Type | Probe method |
|  |  |  |  | 50 | Probe Amount | % of Standard Amount |
| 3jj | Tissue Specific Expression | Arabidopsis | 108430 | white flower | Tissue | Tissue |
|  |  |  |  | 50 | Probe Amount | % of Standard Amount |
|  |  |  |  | operon | Probe Type | Probe method |

-continued

| Example No. | Experiment short name | genome | EXPT_ID | Value | PARAMETER | UNITS |
|---|---|---|---|---|---|---|
| 3jj | Tissue Specific Expression | *Arabidopsis* | 108431 | flowers (bud) | Tissue | Tissue |
| | | | | operon | Probe Type | Probe method |
| | | | | 50 | Probe Amount | % of Standard Amount |
| 3c | Tissue Specific Expression | *Arabidopsis* | 108436 | 5-10 mm siliques | Tissue | Tissue |
| | | | | 33 | Probe Amount | % of Standard Amount |
| | | | | operon | Probe Type | Probe method |
| 3c | Tissue Specific Expression | *Arabidopsis* | 108437 | <5 mm siliques | Tissue | Tissue |
| | | | | operon | Probe Type | Probe method |
| | | | | 33 | Probe Amount | % of Standard Amount |
| 3c | Tissue Specific Expression | *Arabidopsis* | 108438 | 5 wk siliques | Tissue | Tissue |
| | | | | 33 | Probe Amount | % of Standard Amount |
| | | | | operon | Probe Type | Probe method |
| 3a | Tissue Specific Expression | *Arabidopsis* | 108439 | Roots (2 wk) | Tissue | Tissue |
| | | | | operon | Probe Type | Probe method |
| | | | | 33 | Probe Amount | % of Standard Amount |
| 3c | Tissue Specific Expression | *Arabidopsis* | 108497 | 3 week Rossette leaves | Tissue | Tissue |
| | | | | 100 | Probe Amount | % of Standard Amount |
| | | | | operon | Probe Type | Probe method |
| 3c | Tissue Specific Expression | *Arabidopsis* | 108498 | 3-week stems | Tissue | Tissue |
| | | | | operon | Probe Type | Probe method |
| | | | | 100 | Probe Amount | % of Standard Amount |
| 3dd | U.A.E. Knockout | *Arabidopsis* | 108451 | 13B12 | Plant Line | Hours |
| 3q | Ws *Arabidopsis* Drought 2 days | *Arabidopsis* | 108477 | stems and leaves | Tissue | Tissue |
| | | | | 2 days | Timepoint | Hours |
| 3q | Ws *Arabidopsis* Drought 4 days | *Arabidopsis* | 108482 | 4 days | Timepoint | Hours |
| 3q | Ws *Arabidopsis* Drought 6 days | *Arabidopsis* | 108483 | 6 days | Timepoint | Hours |
| 3cc | ap2-floral buds | *Arabidopsis* | 108501 | ap2 (Ler.) floral buds | Plant Line Tissue | Hours Tissue |
| 3m | nitrogen-seed set | *Arabidopsis* | 108487 | 0.5 | Timepoint | Hours |
| 3m | nitrogen-seed set | *Arabidopsis* | 108488 | 2 | Timepoint | Hours |
| 3m | nitrogen-seed set | *Arabidopsis* | 108489 | 4 | Timepoint | Hours |
| 3b | rhl mutant2 | *Arabidopsis* | 108433 | mutant | Tissue | Tissue |
| 3ee | root tips | *Arabidopsis* | 108434 | root tips | Tissue | Tissue |
| 3f | stm mutants Aluminum | *Arabidopsis* | 108435 SMD 7304, SMD 7305 | stem | Tissue | Tissue |
| | Axel | | SMD 6654, SMD 6655 | | | |

-continued

| Example No. | Experiment short name | genome | EXPT_ID | Value | PARAMETER | UNITS |
|---|---|---|---|---|---|---|
| | Cadium | | SMD 7427, SMD 7428 | | | |
| | Cauliflower | | SMD 5329, SMD 5330 | | | |
| | Chloroplast | | SMD 8093, SMD 8094 | | | |
| | Circadian | | SMD 2344, SMD 2359, SMD 2361, SMD 2362, SMD 2363, SMD 2364, SMD 2365, SMD 2366, SMD 2367, SMD 2368, SMD 3242 | | | |
| | CO2 | | SMD7561, SMD 7562, SMD 7261, SMD 7263, SMD 3710, SMD 4649, SMD 4650 | | | |
| | Disease | | SMD 7342, SMD 7343 | | | |
| | reactive oxygen | | SMD 7523 | | | |
| | Iron | | SMD 7114, SMD 7115, SMD 7125 | | | |
| | defense | | SMD 8031, SMD 8032 | | | |
| | Mitchondria-Electron Transport | | SMD 8061, SMD 8063 | | | |
| | NAA | | SMD 3743, SMD 3749, SMD 6338, SMD 6339 | | | |
| | Nitrogen | | SMD 3787, SMD 3789 | | | |
| | Phototropism | | SMD 4188, SMD 6617, SMD 6619 | | | |
| | Shade | | SMD 8130, SMD 7230 | | | |

-continued

| Example No. | Experiment short name | genome | EXPT_ID | Value | PARAMETER | UNITS |
|---|---|---|---|---|---|---|
| | Sqn | | SMD 7133, SMD 7137 | | | |
| | Sulfur | | SMD 8034, SMD 8035 | | | |
| | Wounding | | SMD 3714, SMD 3715 | | | |
| | Zinc | | SMD 7310, SMD 7311 | | | |

6. MA_Clusters Table

Microarray data was clustered using one of two methods: "complete linkage" or "nearest neighbor" analysis. These clustering methods are described in more detail elsewhere herein. The results of the clustering analysis are presented in the MA_clust table. The table is organized as follows:

"METHOD" refers to a method number which clustering method used. "CL_METHOD_TYPE=TRUE" refers to complete linkage method. "NN_METHOD_TYPE=TRUE" refers to the nearest neighbor method. "FULL_NN_METHOD_TYPE=TRUE" refers to the nearest neighbor method, where no size limitation was placed on the cluster.

"PARAMETERS" refers to the parameters utilized for the analysis. The nature of these is also described in more detail elsewhere herein.

"ORGANISM" refers to the cDNA spotted on the chip were similar to *Arabidopsis thaliana* (3769) sequences or whether the oligo used for the chips were similar to *Zea mays* (311987) sequences.

Each cluster or group of cDNA is identified by a "Group #", following which are the individual cDNA_Ids that are a member of that Group 7. Knock-in Table The Knock-In Table presents the results of knock-in experiments wherein plants are grown from tissues transformed with a marker gene-containing insert and phenotypes are ascertained from the transformed plants. Each section of the Table relating to information on a new transformant begins with a heading "Knock-in phenotype in gene (cDNA_id):" followed by a number which represents the Ceres internal code for a proprietary cDNA sequence. The described transformant was prepared by procedures described herein, wherein the identified Ceres proprietary cDNA_id (corresponding to the cDNA_id in the Reference and Sequence Tables) was interrupted by the marker gene-containing insert. The following information is presented for each section.

Parent plants used in cross—presents the id numbers of the parent plants which were crossed to produce the F1 generation plant for which a phenotype is described. The parent plant with the promoter is described by a plant line descriptor.

Clone ID—presents the clone number of the Ceres proprietary clone which was the source of the cDNA_id.

Phenotype ID—represents an internal identification code.

Unique F1 plant ID—represents the internal code for the F1 plant for which a phenotype is described.

Assay—presents the type of growth analyzed (e.g. soil gross morphology), followed by the assay name which corresponds to the type/location of the tissue that was observed, the name of the assay conducted for which the result provided the identified phenotype.

Phenotype—describes the phenotype noted for the F1 generation transformant.

Notes—may provide additional information on the described phenotype for the transformant.

Each knock-in representing a transformant with an interruption in the identified cDNA_id may be correlated with more than one identified phenotype.

8. Knock-Out Table

The Knock-Out Table presents the results of knock-out experiments wherein plants are grown from tissues transformed with a marker gene-containing insert wherein phenotypes are ascertained from the transformed plants. Each section of the Table relating to information on a new transformant begins with a heading "tail id:" representing an internal code. The following information is presented for each section.

br—provides another internal code for the experiment.

Phenotype_id—provides an identification number for the particular phenotype identified for the transformant.

assay—identifies the assay procedure utilized in the experiment to identify a phenotype for the transformant.

phenotype—represents an internatl identification code.

ratio—represents a segregation ratio.

notes—lists any notes relevant to the identified phenotype.

Knock-out in-genes—Identifies the genes in which the tag has inserted 6) the less than 501 upstream of the transcriptional start site;

7) less than 701 upstream of the translational initiation codon;

8) between the translational initiation and termination codons of the gene, 9) less than 301 downstream of the translational stop codon; or 10) less than 151 downstream of a transcriptional termination site or a gene.

In this table the gene is identified by its cDNA ID number, the Ceres SEQ ID that is indicated in the (Ac) portion of the Reference tables. For each cDNA_id, the following information is provided:

the cDNA_id number.

in parenthesis, the cluster number of which the identified cDNA is a member.

the "gDNA_Insert pos" representing the position of the insert in the corresponding gDNA sequence the gi number refers to the TIGR chromosome sequences for *Arabidopsis*.

Knock-out out of-genes: Identifies the Ceres cDNA proprietary sequences (noted by cDNA_id which are the same as those identified in the Reference and Sequence Tables) which are closest in position to the insert, both upstream and downstream from the insert. For each cDNA_id, the following information is provided:

In the first parentheses, R indicates that the gene is to the right of the tag, L indicates that the gene is to right of the tag as the sequences is read left to right the cDNA_id number in next parentheses, the cluster number of which the identified cDNA is a member.

the distance (in number of nucleotides) of the insert is upstream of the start of the gene annotation as described in the Reference Tables or downstream at the end the gene annotation.

the "gDNA_Insert pos" representing the position of the insert in the corresponding gDNA sequence the gi number refers to the TIGR chromosome sequences for *Arabidopsis*.

9. Protein Domain Table

The Protein Domain table provides details concerning the protein domains noted in the Reference Table. The majority of the protein domain descriptions given in the Protein Domain Table are obtained from Prosite, (available on the internet) and Pfam, (also available on the internet). Each description in The Table begins with the pfam and Prosite identifying numbers, the full name of the domain, and a detailed description, including biological and in vivo implications/functions for the domain, references which further describe such implications/functions, and references that describe tests/assays to measure the implications/functions.

10. Single Gene Functions & Utilities Table

The Single Gene Functions & Utilities Table describes particular utilities/functions of interest for individual genes. The Table identifies the cDNA_ID of interest, correlates to that cDNA the relevant phenotype, protein domain and microarray/differential expression data. The final column of the Table identifies the utilities/functions of particular interest for the identified cDNA.

11. Cluster Functions & Utilities Table

The Cluster Functions & Utilities Table describes particular utilities/functions of interest for identified clusters of genes. The Table provides the following information:

Record #—an internal identifier.

Group—identifies the group of clusters of interest, wherein each group is identified with the same utilities/functions as set forth in the right-hand most column.

CDNA—identifies the cDNA of interest with the noted utility/function.

CDNA_Cluster—identifies the cDNA Cluster ID of interest.

Gi No—refers to the public genomic sequence that matches to the cDNA

NR Hit—refers to the most relevant protein domain for the cDNA of interest.

Pfam and Pfam Desc—provide the protein domain name.

Notes/Annotations—provides some notes relevant to the data/information analysis.

Utilities/Functions—this rightmost column identifies utilities/functions of particular interest for the group of cDNAs and clusters.

12. cDNA_Clusters Table

The cDNA_Clusters Table correlates the Ceres cDNA_ID nos. (in numerical order) with the relevant cDNA cluster which contains each cDNA_ID.

13. Stanford_old_new_cDNA_map Table

During the course of the experiments reported herein, some of the cDNA sequences were assigned new Ceres internal cDNA_id numbers. The cDNA_map Table provides a list of the original "old" cDNA_ids and correlates those id numbers with any new cDNA_id which may have been assigned. Thus, any "old" and "new" cDNA ids which are on the same line in the Table are, in fact, the same sequence.

14. gb_Only_Peptides Table

In the Protein Group table, a number of proteins encoded by Genbank predictions are included. These proteins were referenced with a peptide ID number. The peptide ID number is linked to the amino acid sequence of the Genbank prediction in this table.

15. Stanford_Old_New_cDNA Table

During the course of the experiments reported herein, some of the cDNA sequences utilized in the Stanford Microarray differential expression analysis experiments were assigned new Ceres internal cDNA_id numbers. The Stanford_old_new_cDNA Table provides a list of the original "old" cDNA_ids and correlates those id numbers with any new cDNA_id which may have been assigned. Thus, any "old" and "new" cDNA ids which are on the same line in the Table are, in fact, the same sequence.

16. Enhanced_Amino Table

This table lists the peptide IDs of polypeptides with enhanced amino acid content. The table list the peptide ID following with the single letter code of the amino acid that is enhanced. The table also includes a frequency that the amino acid occurred. The frequency was calculated by dividing the total number of the desired amino acid indicated in the column by the number of residues in the peptide. For example, if amino acid A, occurred 50 times in a polypeptide that is 100 amino acid long, the frequency would be 50 divided by 100 or 0.5.

17. Stanford_old_new_cDNA_map Table

During the course of the experiments reported herein, some of the cDNA sequences were assigned new Ceres internal cDNA_id numbers. The docket_80090_101_cDNA_map provides a list of the original "old" cDNA_ids in the Reference and Sequence tables and correlates those id numbers with any new cDNA_id which may have been assigned and utilized in the remaining tables. Thus, any "old" and "new" cDNA ids which are on the same line in the Table are, in fact, the same sequence.

II. How the Inventions Reveal how Genes, Gene Components and Products Function

The different experimental molecular genetic approaches focused on different aspects of genes, gene components, and gene products of the inventions. The variety of the data demonstrates the multiple functions and characteristics of single genes, gene components, and products. The data also explain the pathways and networks in which individual genes and products participate and interact. As a result, the circumstances or conditions are now known when these genes and networks are active. These new understandings of biology are relevant for many plant species. The following section describes the process by which Applicants analyzed the inventions generated by the Ceres Genomic Engine:

II.A. Experimental Results Reveal Many Facets of a Single Gene

The experimental results are used to dissect the function of individual components and products of the genes. For example, the biochemical activity of the encoded protein could be surmised from sequence analyses, and promoter specificity could be identified through transcriptional analyses. Generally, the data presented herein can be used to functionally annotate either the protein sequence and/or the regulatory sequence that control transcription and translation.

II.A.1. Functions of Coding Sequences Revealed by the Ceres Genomic Engine

II.A.1.a. Sequence Similarity to Proteins of Known Function can be Used to Associate Biochemical Activities and Molecular Interaction to the Proteins of the Invention The protein sequences of the invention were analyzed to determine if they shared any sequence characteristics with proteins of known activity. Proteins can be grouped together based on sequence similarity, either localized or throughout the length of the proteins. Typically, such groups of proteins exhibit common biochemical activities or interact with similar molecules.

II.A.1.a.1. Presence of Amino Acid Motifs Indicates Biological Function

Localized protein sequence similarity, also referred to as amino acid motifs, have been attributed to enzyme or protein functions. A library of motifs, important for function, have been documented in PROSITE, a public database available on the internet. This library includes descriptions of the motifs and their functions. The zinc finger motif is one such entry in PROSITE, which reports that the zinc finger domain of DNA-binding proteins is typically defined by a 25-30 amino acid motif containing specific cysteine or histidine residues that are involved in the tetrahedral coordination of a zinc ion. Any protein comprising a sequence similar to the zinc finger amino acid motif will have similar functional activity (specific binding of DNA).

Protein sequences of the invention have been compared to a library of amino acid motifs in the pFAM database, which is linked to the PROSITE database. If any of Applicants' protein sequences exhibit similarity to these amino acid motifs or domains, the Reference Table notes the name and location of the motif in the "Pred. PP Nom. & Annot" section of the Reference tables. A description of any biochemical activities that are associated to these domains, and therefore associated with Applicants' proteins, is included in the Protein Domain table.

For example, polypeptide, CERES Sequence ID NO: 1545823 is associated with zinc finger motif as follows in the Reference Table:

(C) Pred. PP Nom. & Annot.
Zinc finger, C3HC4 type (RING finger)
Loc. Sequence ID NO 133059: 58→106 aa.

II.A.1.a.2. Related Amino Acid Sequences Share Similar Biological Functions

It is apparent, when studying protein sequence families, that some regions have been better conserved than others during evolution. These regions are generally important for the function of a protein and/or for the maintenance of its three-dimensional structure.

The Reference Table reports in section "(Dp) Rel. AA Sequence" when a protein shares amino acid similarity with a protein of known activity. The section reports the gi number of the protein of known activity, a brief description of the activity, and the location where it shares sequence similarity to Applicants' polypeptide sequence.

Using this analysis, biochemical activity of the known protein is associated with Applicants' proteins. An example for the polypeptide described above is as follows:

(Dp) Rel. AA Sequence
Align. NO 524716
gi No 2502079
Desp.: (AF022391) immediate early protein; ICP0 [Feline herpesvirus 1]
% Idnt.: 33.7
Align. Len.: 87
Loc. Sequence ID NO 133059: 52→137 aa.

II.A.1.b. Differential Expression Results Explain in which Cellular Responses the Proteins of the Invention are Involved Differential expression results show when the coding sequence is transcribed, and therefore when the activity of the protein is deployed by the cell. Similar coding sequences can have very different physiological consequences because the sequences are expressed at different times or places, rather than because of any differences in protein activity. Therefore, modified levels (increased or decreased) of expression as compared to a control provide an indication of the function of a corresponding gene, gene components, and gene products.

These experiments can determine which are genes "over-expressed" under a given stimulus. Such over-expressed genes give rise to higher transcript levels in a plant or cell that is stimulated as compared to the transcript levels of the same genes in a control organism or cell. Similarly, differential expression experiments can reveal "under-expressed" genes.

To increase the cellular response to a stimulus, additional copies of the coding sequences of a gene that is over-expressed are inserted into a cell. Increasing transcript levels of an over-expressed gene can either heighten or prolong the particular cellular response. A similar enhancement can occur when transcription of an under-expressed gene is inhibited. In contrast, the cellular response will be shortened or less severe when the over-expressed genes are inhibited or when expression of the under-expressed genes are increased.

In addition to analyzing the levels of transcription, the data were also analyzed to gain insight into the changes in transcription over time. That is, while the plants in the experiments were reacting to either an external or internal stimulus, a differential experiment takes a snapshot of the transcription levels in the cells at one specific time. However, a number of snap-shots can be taken at different time points during an external stimulus regime, or at different stages of development during an internal stimulus. These results show how the plant changes transcription levels over time, and therefore protein levels in response to specific stimuli to produce phenotypic changes. These results show that a protein can be implicated in a single, but more likely, in a number of cellular responses.

II.A.1.b.1. The Transcript Levels of a Protein Over Time in Response to a Stimuli are Revealed by Transcriptional Analyses Over Many Experiments Applicants produced data from plants at different times after a specific stimulus. These results show whether the expression level of a gene spikes at a key moment during the cellular response, or whether the transcript level remains constant. Thus, coding sequences not only can be determined to be over- or under-expressed, but also can be classified by the initial timing and duration of differential expression. This understanding of timing can be used to increase or decrease any desired cellular response.

Generally, Applicants have assayed plants at 2 to 4 different time points after exposing the plants to the desired stimuli. From these experiments, "early" and "late" responders were identified. These labels are applied to either the regulatory sequences driving transcription of the gene as well as to the protein encoded by the gene.

The example in FIG. 5 illustrates how the genes, gene components and products were classified as either early or late responders following a specific treatment. The mRNAs from plants exposed to drought conditions were isolated 1 hour and 6 hours after exposure to drought conditions. These mRNAs were tested utilizing microarray techniques. FIG. 5 illuminates possible transcription profiles over the time course, plotting all the (+) data points as +1 and all the (−) data points as −1 (the value for each time point was determined using a pair of microarray chips as described above).

(The value for each time point was determined using a pair of microarray chips as described above.)

Data acquired from this type of time course experiment are useful to understand how one may increase or decrease the speed of the cellular response. Inserting into a cell extra copies of the coding sequence of early responders in order to over-express the specific gene can trigger a faster cellular response. Alternatively, coding sequences of late responders that are over-expressed can be placed under the control of promoters of early responders as another means to increase the cellular response.

Inserting anti-sense or sense mRNA suppression constructs of the early responders that are over-expressed can retard action of the late responders, thereby delaying the desired cellular response. In another embodiment, extra copies of the promoters of both early and late responders can be added to inhibit expression of both types of over-expressed genes.

The experiments described herein can be grouped together to determine the time course of the transcript levels of different coding sequences in response to different stimuli. Examples of different groups are as follows (the examples include the IDs for both corn and *Arabidopsis* experiments):

NAA (EXPT IDs 108564, 108565, 108516, 108554)
BA (EXPT IDs 108566, 108567, 108517)
GA (EXPT IDs 108562, 108563, 108519, 108520, 108521, 108484, 108485, 108486)
BR (EXPT IDs 108580, 108581, 108557, 108478, 108479, 108480, 108481)
ABA (EXPT IDs 108560, 108561, 108513, 108597)
Drought (EXPT IDs 108572, 108573, 108502, 108503, 108504, 108556, 108482, 108483, 108473, 108474, 108477)
Cold (EXPT IDs 108578, 108579, 108533, 108534)
Heat (EXPT IDs 108576, 108577, 108522, 108523)
Osmotic stress (EXPT IDs 108570, 108571, 108541, 108542, 108553, 108539, 108540)
Reactive Oxygen (EXPT IDs 108582, 108583, 108537, 108538, 108558)
NO (EXPT IDs 108584, 108585, 108526, 108527, 108559)
Wounding (EXPT IDs 108574, 108575, 108524, 108525)
SA (EXPT IDs 108586, 108587, 108515, 108552, 108471, 108472, 108469, 108470, 107953, 107960, 108443, 108440, 108441, 108475, 108476)
MeJA (EXPT IDs 108568, 108569)
Finale (EXPT IDs 108467, 107871, 107876)
Trimec (EXPT IDs 108466, 107886, 107891)
ROUNDUP (EXPT IDs 108465, 107896)
GLEAN® (EXPT IDs 108468, 107881)

II.A.1.b.2. The Transcript Levels of a Protein Over Different Developmental Stages can be Identified by Transcriptional Analyses Over Many Experiments Differential expression data were produced for different development stages of various organs and tissues. Measurement of transcript levels can divulge whether specific genes give rise to spikes of transcription at specific times during development, or whether transcription levels remain constant. This understanding can be used to increase speed of development, or to arrest development at a specific stage.

Like the time-course experiments, the developmental stage data can classify genes as being transcribed at early or late stages of development. Generally, Applicants assayed different organs or tissues at 2-4 different stages.

Inhibiting under-expressed genes at either early or late stages can trigger faster development times. The overall development time also can be increased by this means to allow organs and tissue to grow to a larger size or to allow more organs or tissues to be produced. Alternatively, coding sequences of late stage genes that are under-expressed can be placed under the control of promoters of early stage genes to increase heighten development.

Inserting extra copies of the coding sequence early stage genes that are under-expressed can retard action of the late-stage genes and delay the desired development.

Fruit development of *Arabidopsis* is one example that can be studied. Siliques of varying sizes, which are representative of different stages, were assayed by microarray techniques. Specifically, mRNA was isolated from siliques between 0-5 mm, between 5-10 mm and >10 mm in length. FIG. 6 shows expression pattern of a cell wall synthesis gene, cDNAID 1595707, during fruit development.

The developmental course shows that the gene encoding a cell wall synthesis protein is up-regulated when the fruit is 0-5 mm but returns to normal levels at 5-10 mm and >10 mm. Increase of cell wall synthesis can lead to larger cells and/or greater number of cells. This type of increase can boost fruit yield. The coding sequence of the cell wall synthesis protein under the control of a strong early stage promoter would increase fruit size or number.

A pectinesterase gene was also differentially expressed during fruit development, cDNA ID 1396123. Pectinesterase catalyzes the hydrolysis of pectin into pectate and methanol. This biochemical activity plays an important role in cell wall metabolism during fruit ripening. To shorten the time for fruit ripening, extra copies of this gene with its endogenous promoter can be inserted into a desired plant. With its native promoter, the extra copies of the gene will be expressed at the normal time, to promote extra pectinesterase at the optimal stage of fruit development thereby shortening ripening time.

A number of Applicant's experiments can be grouped together to study changes of transcript levels over a number development stages. Below are examples of groups of experiments:

Root, Root Tip, and rhl mutant (EXPT IDs 108594, 108433, 108599, 108434, 108439)
Flowers Drought Exposed Flowers, SA Treated Flowers (EXPT IDs 108473, 108474, 108429, 108430, 108431, 108475, 108476, 108501)
BR Shoot Apices, Leaves, Stm (EXPT IDs 108478, 108479, 108480, 108481, 108598, 108535, 108536, 108435)
Leaf and Stm (EXPT IDs 108477, 108512, 108497, 108498, 108598108478, 108479, 108480, 108481, 108598, 108535, 108536, 108435)
Imbibded & Germinating Seeds 1, 2, 3, And 4 Days (EXPT IDs 108461, 108462, 108463, 108464, 108528, 108529, 108530, 108531, 108545, 108546, 108547, 108518, 108529, 108543, 108544)
Tissue Specific Expression (3 week rosette leaves, Tissue Specific Expression (3 week stems), Tissue Specific Expression (2 week roots) (EXPT IDs 108497, 108498, 108439)
Tissue Specific Expression (3 week rosette leaves), Germinating Seeds (EXPT IDs 108497, 108461)
Tissue Specific Expression (3 week rosette leaves, stm mutants, BR_Shoot Apices Expt, root tips, Tissue Specific Expression (2 week roots) (EXPT IDs 108497, 108435, 108480, 108434, 108439)

BR_Shoot Apices Expt, root tips, Tissue Specific Expression (flower buds) (EXPT IDs 108480, 108434, 108431)

Arab_Ler-pi_ovule_1, ap2-floral buds, Tissue Specific Expression (flower buds), Tissue Specific Expression (<5 mm siliques) (EXPT IDs 108595, 108501, 108431, 108437)

Tissue Specific Expression (2 week roots), rhl mutant2, BR_Shoot Apices Expt, Trichome Inflorescences (EXPT IDs 108439, 108433, 108480, 108452)

II.A.1.b.3. Proteins that are Common in a Number of Similar Responses can be Identified by Transcriptional Analyses Over a Number of Experiments The differential expression experiments also reveal the genes, and therefore the coding sequence, that are common to a number of cellular responses. By identifying the genes that are differentially expressed in a number of similar responses, the genes at the nexus of a range of responses are discovered. For example, genes that are differentially expressed in all the stress responses are at the hub of many of the stress response pathways.

These types of nexus genes, proteins, and pathways are differentially expressed in many or majority of the responses or developmental conditions of interest. Typically, a nexus gene, protein, or pathway is differentially expressed in generally the same direction in many or majority of all the desired experiments. By doing so, the nexus gene can be responsible for triggering the same or similar set of pathways or networks for various cellular responses. This type of gene is useful in modulating pleiotropic effects or triggering or inhibiting a general class of responses.

When nexus genes are differentially expressed in a set of responses, but in different directions, these data indicate that a nexus gene is responsible for creating the specificity in a response by triggering the same pathway but to a different degree. Placing such nexus genes under a constitutive promoter to express the proteins at a more constant level can remove the fluctuations. For example, a plant that is better drought adapted, but not cold adapted can be modified to be tolerant to both conditions by placing under the control of a constitutive promoter a nexus gene that is up-regulated in drought but down regulated in cold.

Applicants' experiments can be grouped together to identify such nexus genes. Examples of these groups are as follows:

Herbicide Response
Trimec, Finale, GLEAN®, ROUNDUP (EXPT IDs 108467, 107871, 107876, 108468, 107881, 108465, 107896, 108466, 107886, 107891)

Stress Response
Drought, Cold, Heat, Osmotic Stress (EXPT IDs 108578, 108579, 108533, 108534, 108572, 108573, 108502, 108503, 108504, 108556, 108482, 108483, 108473, 108474, 108477, 108576, 108577, 108522, 108523, 108570, 108571, 108541, 108542, 108553, 108539, 108540)

Drought, Cold, Heat, PEG, Trimec, Finale, GLEAN®, ROUNDUP (EXPT IDs 108578, 108579, 108533, 108534, 108572, 108573, 108502, 108503, 108504, 108556, 108482, 108483, 108473, 108474, 108477, 108576, 108577, 108522, 108523, 108570, 108571, 108541, 108542, 108553, 108539, 108540)

Wounding, SA, MeJA, Reactive Oxygen, NO (EXPT IDs 108568, 108569, 108555, 108584, 108585, 108526, 108527, 108559, 108582, 108583, 108537, 108538, 108558, 108586, 108587, 108515, 108552, 108471, 108472, 108469, 108470, 107953, 107960, 108443, 108440, 108441, 108475, 108476, 108574, 108575, 108524, 108525)

Hormone Responses
NAA, BA, BR, GA, TRIMEC (EXPT IDs 108566, 108567, 108517, 108580, 108581, 108557, 108478, 108479, 108480, 108481, 108562, 108563, 108519, 108520, 108521, 108484, 108485, 108486, 108564, 108565, 108516, 108554, 108466, 107886, 107891)

NAA, Trimec (EXPT IDs 108566, 108567, 108517, 108580, 108581, 108557, 108478, 108479, 108480, 108481, 108562, 108563, 108519, 108520, 108521, 108484, 108485, 108486, 108564, 108565, 108516, 108554, 108466, 107886, 107891)

II.A.1.b.4. Proteins that are Common to Disparate Responses can be Identified by Transcriptional Analyses Over a Number of Experiments Phenotypes and traits result from complex interactions between cellular pathways and networks. Which pathways are linked by expression of common genes to specify particular traits can be discerned by identifying the genes that show differential expression of seemingly disparate responses or developmental stages. For example, hormone fluxes in a plant can direct cell patterning and organ development. Genes that are differentially expressed both in the hormone experiments and organ development experiments would be of particular interest to control plant development.

Examples Of Such Pathway Interactions Include:
(i) The Interaction Between Stress Tolerance Pathways And Metabolism Pathways;
(ii) Interaction Between Hormone Responses And Developmental Changes In The Plant;
(iii) Interactions Between Nutrient Uptake And Developmental Changes;
(iv) Mediation Of Stress Response By Hormone Responses; And
(v) Interactions Between Stress Response And Development.

Applicant's experiments can be grouped together to identify proteins that participate in interacting pathways or networks. Specific groups of experiments include, for example:
(i) Stress & Metabolism
Germinating Seeds (Day 1), Arab_0.1 uM_Epi-Brass_1, Arab_NO3_H-to-L_1, Arab_100 uM_GA3_1 (EXPT IDs 108461, 108580, 108592, 108562)
(ii) Hormones & Development
NAA, BA & Root Tips (EXPT IDs 108566, 108567, 108517, 108564, 108565, 108516, 108554, 108434, 108466, 107886, 107891)
NAA, Roots & Root Tips (EXPT IDs 108564, 108565, 108516, 108554, 108599, 108434, 108439, 108466, 107886, 107891)
NAA, BA, Roots And/Or Root Tips (EXPT IDs 108564, 108565, 108516, 108554, 108599, 108434, 108439, 108466, 107886, 107891, 108566, 108567, 108517)
NAA, BA And Leaf (EXPT IDs 108566, 108567, 108517, 108518, 108529, 108512, 108497, 108498, 108598, 108564, 108565, 108516, 108554, 108466, 107886, 107891)
NAA, BA, Leaves, Roots And/Or Root Tips (EXPT IDs 108566, 108567, 108517, 108518, 108529, 108512, 108497, 108498, 108598, 108564, 108565, 108516, 108554, 108466, 107886, 107891, 108599, 108434, 108439)
ABA & Siliques (Of Any Size) (EXPT IDs 108560, 108561, 108513, 108597, 108436, 108437, 108438)

GA, Imbibed & Germinating Seeds, ABA & Siliques (Of Any Size) (EXPT IDs 108560, 108561, 108513, 108597, 108562, 108563, 108519, 108520, 108521, 108484, 108485, 108486, 108461, 108462, 108463, 108464, 108528, 108529, 108530, 108531, 108545, 108546, 108547, 108518, 108529, 108543, 108544, 108436, 108437, 108438)

Tissue Specific Expression (3 week rosette leaves), Arab_0.1 uM_Epi-Brass_1, Arab_100 uM_GA3_1, Germinating Seeds (Day 1), (EXPT IDs 108461, 108497, 108580, 108562, 108461)

(iii) Nutrient Uptake And Development

Any Or All Nitrogen Experiments With Siliques (Of Any Size) (EXPT IDs 108592, 108593, 108588, 108589, 108590, 108591, 108532, 108548, 108549, 108550, 108551, 108454, 108455, 108487, 108488, 108489, 108436, 108437, 108438)

Any Or All Nitrogen Experiments With Roots Or Root Tips (EXPT IDs 108518, 108529, 108592, 108593, 108588, 108589, 108590, 108591, 108532, 108548, 108549, 108550, 108551, 108454, 108455, 108487, 108488, 108489, 108594, 108433, 108599, 108434, 108439)

(iv) Stress & Hormones

ABA, Drought (EXPT IDs 108560, 108561, 108513, 108597, 108572, 108573, 108502, 108503, 108504, 108556, 108482, 108483, 108473, 108474, 108477)

ABA, Drought, Cold, Heat, & Wounding (EXPT IDs 108560, 108561, 108513, 108597, 108578, 108579, 108533, 108534, 108572, 108573, 108502, 108503, 108504, 108556, 108482, 108483, 108473, 108474, 108477, 108576, 108577, 108522, 108523, 108574, 108575, 108524, 108525)

Tissue Specific Expression (3 week rosette leaves), Arab_100 uM_ABA_1, Ws *Arabidopsis* Drought 2 days, Ws *Arabidopsis* Drought 4 days (EXPT IDs 108497, 108560, 108477, 108482)

(v) Stress & Hormones Stress & Hormones

Nitrogen High transition to Low, Arab_NO3_H-to-L_1, Tissue Specific

Expression (<5 mm siliques), Tissue Specific Expression (5-10 mm siliques) (EXPT IDs 108455, 108592, 108437, 108436)

II.A.1.c. Observations of Phenotypic Changes Show What Physiological Consequences Applicants' Proteins can Produce Another direct means of determining the physiological consequences of a protein is to make aberrant decreases or increases of its expression level in a cell. To this end, Applicants have produced plants where specific genes have been disrupted, or produced plants that include an extra expressed copy of the gene. The plants were then planted under various conditions to determine if any visible physiological changes are caused. These changes then are attributed to the changes in protein levels.

II.A.2. Differential Expression Results Explain which External or Internal Stimuli Trigger the Regulatory Sequences Transcriptional studies can reveal the time and place that genes are expressed. Typically, regulatory sequences, such as promoters, introns, UTRs, etc., control when and in which cells transcription occurs. Differential studies can explain the temporal- and location-specific regulatory sequences that control transcription.

Using the experiments that are provided herein, one skilled in the art can choose a promoter or any other regulatory sequence that is capable of facilitating the desired pattern of transcription. For example, if a promoter is needed to give rise to increased levels of transcription in response to Auxin, but little expression in response to cytokinin, then the promoters of cDNAs that were up-regulated in the Auxin experiments, but down-regulated the cytokinin experiments would be of interest.

Time Course Experiments—Time Sensitive

Evaluation of time-course data as described above is also useful to identify time-specific promoters. Promoters or regulatory sequences, like the coding sequences, can be classified as early or late responding according to the microarray data. Promoters that facilitate expression of early or late genes are useful to direct expression of heterologous coding sequences to modulate the cellular response. In the drought data, promoters from "early" responding genes can be selected to activate expression of any desired coding sequence. Thus, a coding sequence for a salt-tolerance protein that is not typically expressed early in response to drought could be linked to an "early" responding promoter to increase salt tolerance within one hour after exposure to drought conditions.

Developmental Experiments—Time Sensitive

Another class of time-sensitive promoters and other regulatory sequence can be identified from the experiments examining different developmental stages. These regulatory sequences can drive transcription of heterologous sequence at particular times during development. For example, expression of stress-responsive genes during fruit development can protect any gain in fruit yield.

Common to Many Pathways—Cause General Effects

Promoters and other regulatory sequence associated with cDNAs that are differentially expressed in a number of similar responses can be used to cause general effects. These types of regulatory sequences can be used to inhibit or increase expression of a desired coding sequence in a number circumstances. For example, protein that is capable of acting as an insecticide can be placed under the control a general "stress" promoter to increase expression, not only when the plant is wounded, but under other stress attack.

II.B. Experimental Results Also Reveal Pathways or Networks of Genes

II.B.1. Genes Whose Transcription are Well

Coordinated Generally Act Together to Produce Proteins that Participate in the Same Pathway or Network Patrick Brown, one of the pioneers of microarray chip technology, demonstrated that differential expression experiments can identify groups of genes that encode proteins that participate the same pathway or network. The work focused on phosphate accumulation and metabolism genes in yeast and was published in the paper Ogawa et al., *Mol Biol Cell* (2000) December; 11(12):4309-21. The authors identified by microarray analysis 22 genes whose transcription was regulated by phosphate concentration. Promoter analysis of these genes showed that 21 of them contained a sequence in their promoters that is recognized by a transcriptional activator that is regulated by phosphate. Further, phenotypic studies were completed by mutational analysis of many of these 22 genes in yeast. The mutants were shown to be either severely deficient in accumulation of inorganic polyphosphate (polyP) and P(i), or associated with normal catabolism of polyP in the yeast vacuole. This publication proves that genes with correlated transcriptional profiles do indeed participate in the same pathway or network.

II.B.1.a. Calculating the Correlation Coefficient Between Pairs of Genes Based on the Differential Expression Data The differential expression data obtained over many experiments reveal the global pattern of transcription of a gene. Transcription patterns, also referred to as profiles, of two different genes can be compared. From this comparison, a correlation coefficient can be calculated as a measure of the strength of the relationship between the two profiles.

Transcription profiles can be compared by plotting as a point, the differential expression of gene1 on the x-axis and gene 2 on the y-axis on one experiment. If all the pairs lie on a regression line the relationship and correlation between the two genes are strong. The correlation coefficient can be calculated using a number of methods. In the present case, the Spearman method was utilized.

The correlation coefficient can vary from −1 to 1. The coefficient indicates the strength of the relationship between two mRNA transcripts of any set of data that is examined. A zero coefficient indicates that no correlation exists between the transcription profiles of two genes in the samples examined.

Biologically, a high correlation coefficient indicates that a gene(s) triggers the activation or repression of the correlated genes, or have related functional roles. Thus, illumination of the activity of one gene can indicate the activities of the genes with highly correlated transcription profiles. This implication is true whether the activity is a biochemical activity, molecular interaction, cellular response, or physiological consequence.

II.B.1.b. The Complete Linkage Analyses of Differential Identity Genes with Similar Pattern of Transcription The complete linkage analysis can build groups (or "clusters") of genes whose transcription patterns are highly correlated or co-regulated.

Because genes with related functions are frequently expressed in similar patterns, utilities or roles can be ascribed for genes (without observation of transformed plants) based on their temporal association with other genes of known function (a "guilt-by-association" analysis). Ogawa et al. has used correlated mRNA transcription profiles to identify the function of proteins of unknown function.

The complete linkage analysis utilizes the correlation coefficients that are calculated for each pair of genes tested in the microarray experiments. A cluster is first seeded with any arbitrary transcript tested on the chip. The seed transcript, for this illustration, is designated mRNA#0. Next, a minimum threshold is chosen for all acceptable correlation coefficients. In this case, the threshold used was 0.75. A list of potential cluster members is compiled by choosing mRNA transcripts that have a correlation coefficient with mRNA#0 that is greater than the threshold. No limit is placed on the number of mRNAs that can be added to a cluster so long as the correlation coefficient meets the threshold limit criterion.

For this example, assume that four mRNAs were added to the cluster, mRNA__1 to mRNA__4. Once the potential cluster members are identified, the cDNA IDs of each member is added to the potential list in order its correlation coefficient to mRNA#1, the largest correlation coefficient first. For this example, let's suppose four mRNAs 1-4 are potential members, they would be ordered as follows:

| MRNA# | Correlation Coefficient with mRNA#0 |
|---|---|
| MRNA#1 | 0.9 |
| MRNA#2 | 0.8 |
| MRNA#3 | 0.78 |
| MRNA#4 | 0.75 |

A potential member is accepted into the group, if its correlation coefficients with all other potential members are all greater than the threshold. Thus, for mRNA#1 to remain in the group the correlation coefficient between mRNA#1 and mRNA#2 must be greater than 0.75; and mRNA#1 and #3>0.75; and mRNA#1 and mRNA#4>0.75. Potential cluster members are removed only after reviewing the correlation coefficients in a specific order where mRNAs are reviewed in the order that they appear on the list.

Consequently, review of the correlation coefficients does not begin with any random pair, such as mRNA#3 and mRNA#4. The review begins between mRNA#1 and mRNA#2, which are the top two on the list.

If correlation coefficient between mRNA#1 and mRNA#2 is less than the threshold, then mRNA#2 is removed from the cluster. mRNA#2 is removed because its correlation coefficient with mRNA#0 is 0.8 which is less than 0.9, the correlation coefficient of mRNA#1 and mRNA#0.

This illustrates the rule that if the correlation coefficient is less than the threshold, then only one of the pair not accepted as a cluster member, specifically, the one with the lower coefficient to the seed mRNA#0.

This process of iterative reviewing of correlation coefficients between potential members continues until all pairs are reviewed. In this case, the coefficient between mRNA#1 and mRNA#3 would be reviewed because these are the two highest ones on the list besides mRNA#1 and #2. The next pair to be reviewed would be mRNA#1 and #4, etc.

Applicants have analyzed the data using several sets of parameters for the complete linkage analysis as shown in the table below:

| Method | Correlation Coefficient Threshold | Max number of members in a cluster | Organism |
|---|---|---|---|
| CL_METHOD_TYPE = TRUE | 0.9 | MAX_SIZE = 15 | Arabidopsis |
| CL_METHOD_TYPE = TRUE | 0.75 | MAX_SIZE = 30000 | Arabidopsis |
| CL_METHOD_TYPE = TRUE | 0.70 | MAX_SIZE = 30000 | Arabidopsis |
| CL_METHOD_TYPE = TRUE | 0.9 | MAX_SIZE = 15 | Zea |
| CL_METHOD_TYPE = TRUE | 0.75 | MAX_SIZE = 30000 | Zea |
| CL_METHOD_TYPE = TRUE | 0.70 | MAX_SIZE = 30000 | Zea |
| CL_METHOD_TYPE = TRUE | 0.9 | MAX_SIZE = 15 | Arabidopsis |
| CL_METHOD_TYPE = TRUE | 0.75 | MAX_SIZE = 30000 | Arabidopsis |

| Method | Correlation Coefficient Threshold | Max number of members in a cluster | Organism |
| --- | --- | --- | --- |
| CL_METHOD_TYPE = TRUE | 0.70 | MAX_SIZE = 30000 | *Arabidopsis* |
| CL_METHOD_TYPE = TRUE | 0.9 | MAX_SIZE = 15 | *Zea* |
| CL_METHOD_TYPE = TRUE | 0.75 | MAX_SIZE = 30000 | *Zea* |
| CL_METHOD_TYPE = TRUE | 0.70 | MAX_SIZE = 30000 | *Zea* |

The results of these cluster analyses are reported in the MA_clust table.

II.B.1.c. The Nearest Neighbor Analyses of Differential Group Genes with Correlated but Dissimilar Transcription Profiles The nearest neighbor analysis differs from the complete linkage algorithm by not requiring all members to meet the correlation threshold with each other. Thus, a member of a nearest neighbor cluster need only be closely correlated to one other member of the cluster. It is not even required that all members be closely correlated to the seed mRNA transcript.

In a complete linkage cluster all the transcription profile of all members are correlated to a greater or lesser extent. In contrast, a cluster deduced by the nearest neighbor analysis may include members with differing transcription profiles. However, nearest neighbor brings to light clusters of interacting genes. In the nearest neighbor analysis, the seed mRNA may not have a very high correlation coefficient with the last mRNA added to the cluster.

The nearest neighbor analysis, like the complete linkage analysis, is initiated by seeding each cluster with a mRNA_0. The cluster size is determined by setting a threshold coefficient and setting a limit on the number of members that can be added to the cluster.

The cluster is expanded in an iterative fashion determining which mRNA has the highest correlation coefficient with mRNA_0. The additional member is labeled mRNA_1. Next, a list of potential candidates is generated by finding the mRNA that has the highest correlation to mRNA_0 (besides mRNA_1) and finding the mRNA that has the highest coefficient with mRNA_1. Whichever of the candidates has the highest correlation coefficient is added to the cluster. Then, a list of three potential candidates is generated similarly.

Addition of members continues until either (1) all the correlation coefficients of potential members is lower than the threshold or (2) number of members in the cluster meets the size limitation.

Applicants have analyzed the data using several sets of parameters for the nearest neighbor analysis as shown in the table below:

| Method | Correlation Coefficient Threshold | Max number of members in a cluster | Organism |
| --- | --- | --- | --- |
| NN_METHOD_TYPE = TRUE | 0.5 | MAX_HITS = 15 | *Arabidopsis* |
| FULL_NN_METHOD_TYPE = TRUE | 0.8 | NONE | *Arabidopsis* |
| FULL_NN_METHOD_TYPE = TRUE | 0.6 | NONE | *Arabidopsis* |
| NN_METHOD_TYPE = TRUE | 0.5 | MAX_HITS = 15 | *Zea* |
| FULL_NN_METHOD_TYPE = TRUE | 0.8 | NONE | *Zea* |
| FULL_NN_METHOD_TYPE = TRUE | 0.6 | NONE | *Zea* |
| NN_METHOD_TYPE = TRUE | 0.5 | MAX_HITS = 15 | *Arabidopsis* |
| FULL_NN_METHOD_TYPE = TRUE | 0.8 | NONE | *Arabidopsis* |
| FULL_NN_METHOD_TYPE = TRUE | 0.6 | NONE | *Arabidopsis* |
| NN_METHOD_TYPE = TRUE | 0.5 | MAX_HITS = 15 | *Zea* |
| FULL_NN_METHOD_TYPE = TRUE | 0.8 | NONE | *Zea* |
| FULL_NN_METHOD_TYPE = TRUE | 0.6 | NONE | *Zea* |

The results of these cluster analyses are reported in the MA_clust table.

II.C. Experimental Results Reveal the Functions and Characteristics of Genes, Pathways and Networks II.C.1. Linking Biochemical or Metabolic Activities of One Protein in a Cluster to the Other Proteins in the Same Microarray Cluster As shown in the Ogawa et al., *Mol Biol Cell* (2000), genes whose transcription profiles cluster together as being strongly correlated typically take part in the same pathway or network. Thus, the activity of one gene in the cluster can be associated to the other genes in the cluster with highly correlated transcription profiles. This association is true whether the activity is a biochemical activity, molecular interaction, cellular response or physiological consequence.

One example of this is cluster 420 of the report (shown below). In this cluster, a protein encoded by cDNA ID 1025791 did not match to any pFAM domain. However, through the microarray data, the gene that encodes that protein had a transcription profile that was correlated with other genes that encode ribosomal proteins. Thus, the activity of the ribosomal genes can be associated with the protein with no pFAM match. All the proteins in the same cluster would be associated with mRNA translation and protein synthesis.

| 405 | 4772428 pheno | 49012 | 4741952 | (AF134126) Lhcb3 protein [*Arabidopsis th* | chloroa_b-bind | Chlorophyll A-B binding proteins |
|---|---|---|---|---|---|---|
| 405 | 4901465 pheno | 49012 | 4741952 | (AF134126) Lhcb3 protein [*Arabidopsis th* | chloroa_b-bind | Chlorophyll A-B binding proteins |
| 405 | 4913083 pheno | | 1345698 | CHLOROPHYLL A-B BINDING PROTEIN 151 PREC | chloroa_b-bind | Chlorophyll A-B binding proteins |
| 405 | 5754134 pheno | 833168 | 1345698 | CHLOROPHYLL A-B BINDING PROTEIN 151 PREC | chloroa_b-bind | Chlorophyll A-B binding proteins |

| 406 | 1018755 pheno | 806154 | 1710549 | 60S RIBOSOMAL PROTEIN L39 | Ribosomal_L39 | Ribosomal L39 protein |
|---|---|---|---|---|---|---|
| 406 | 1032316 pheno | 811467 | 11276649 | RIBOSOMAL PROTEIN S28-like-*Arabidopsis* | Ribosomal_S28e | Ribosomal protein S28e |
| 406 | 3433904 pheno | 819486 | 11762182 | (AF325017) T21L8.120 [*Arabidopsis thalia* | Ribosomal_S10 | Ribosomal protein S10p/S20e |

| 405 | 4772428 pheno | 49012 | 4741952 | (AF134126) Lhcb3 protein [*Arabidopsis th* | chloroa_b-bind | Chlorophyll A-B binding proteins |
|---|---|---|---|---|---|---|
| 405 | 4901465 pheno | 49012 | 4741952 | (AF134126) Lhcb3 protein [*Arabidopsis th* | chloroa_b-bind | Chlorophyll A-B binding proteins |
| 405 | 4913083 pheno | | 1345698 | CHLOROPHYLL A-B BINDING PROTEIN 151 PREC | chloroa_b-bind | Chlorophyll A-B binding proteins |
| 405 | 5754134 pheno | 833168 | 1345698 | CHLOROPHYLL A-B BINDING PROTEIN 151 PREC | chloroa_b-bind | Chlorophyll A-B binding proteins |

| | | | | | | |
|---|---|---|---|---|---|---|
| 406 | 1018755 \| pheno | 806154 | 1710549 | 60S RIBOSOMAL PROTEIN L39 | Ribosomal_L39 | Ribosomal L39 protein |
| 406 | 1032316 \| pheno | 811467 | 11276649 | RIBOSOMAL PROTEIN S28-like-*Arabidopsis* | Ribosomal_S28e | Ribosomal protein S28e |
| 406 | 3433904 \| pheno | 819486 | 11762182 | (AF325017) T21L8.120 [*Arabidopsis thalia* | Ribosomal_S10 | Ribosomal protein S10p/S20e |
| 406 | 4772776 \| pheno | 512850 | 6521012 | (AB031739) cytoplasmic ribosomal protein | Ribosomal_S15 | Ribosomal protein S15 |
| 407 | 4283441 \| pheno | 822607 | 7670036 | (AB026636) gb\|AAD22658.1~gene_id: K14A17 | | |
| 407 | 4773015 \| pheno | 47667 | 7670036 | (AB026636) gb\|AAD22658.1~gene_id: K14A17 | | |
| 407 | 5776387 \| pheno | 834698 | 6006279 | (AB015859) photosystem II 22 kDa protein | | |
| 408 | 1023210 \| pheno | 306382 | 3882081 | (AJ012552) polyubiquitin [Vicia faba] gi | ubiquitin | Ubiquitin family |
| 408 | 5670300 \| pheno | | 7439572 | ubiquitin homolog T8F5.13-*Arabidopsis* | ubiquitin | Ubiquitin family |
| 408 | 5671852 \| pheno | 824621 | 7439572 | ubiquitin homolog T8F5.13-*Arabidopsis* | ubiquitin | Ubiquitin family |
| 409 | 1021923 \| pheno | 773758 | 7488279 | protein phosphatase 2C homolog F11C18.80 | PP2C | Protein phosphatase 2C |
| 409 | 2992261 \| pheno | | 7435459 | alpha-galactosidase (EC 3.2.1.22)-soyb | Melibiase | Melibiase |
| 409 | 4801635 \| pheno | 833808 | 2462761 | (AC002292) Highly similar to auxin-induc | aldo_ket_red | Aldo/keto reductase family |
| 41 | 1012078 \| pheno | 824731 | 8096347 | (AB042810) NAD-dependent sorbitol dehydr | adh_zinc | Zinc-binding dehydrogenases |
| 41 | 1377714 \| pheno | 790347 | 8096347 | (AB042810) NAD-dependent sorbitol dehydr | adh_zinc | Zinc-binding dehydrogenases |
| 41 | 1441460 \| pheno | 824732 | 8096347 | (AB042810) NAD-dependent sorbitol dehydr | adh_zinc | Zinc-binding dehydrogenases |

| | | | | | | |
|---|---|---|---|---|---|---|
| 410 pheno | 1008443 | 736633 | 9758519 | (AB024025) ribosomal protein S27 [Arabid | Ribosomal_S27e | Ribosomal protein S27 |
| 410 pheno | 1010094 | 804644 | 6174956 | 60S RIBOSOMAL PROTEIN L7A gi:7440707:pir | Ribosomal_L7Ae | Ribosomal protein L7Ae/L30e/S12e/Gadd45 |
| 410 pheno | 1024837 | 576803 | 7441024 | ribosomal protein L23a, cytosolic-*Arab* | Ribosomal_L23 | Ribosomal protein L23 |
| 410 pheno | 1031267 | 824697 | 9802763 | (AC008046) Putative ribosomal protein [*A* | Ribosomal_L35Ae | Ribosomal protein L35Ae |
| 410 pheno | 1032498 | | 730526 | 60S RIBOSOMAL PROTEIN L13 (BBC1 PROTEIN | Ribosomal_L13e | Ribosomal protein L13e |
| 410 pheno | 1383552 | 50902 | 7442279 | probable acyl carrier protein T8F5.6-*A* | pp-binding | Phosphopantetheine attachment site |
| 410 pheno | 4899830 | 720622 | 11276861 | 60S RIBOSOMAL PROTEIN-like-*Arabidopsis* | Ribosomal_L24 | KOW motif |
| 411 pheno | 1008443 | 736633 | 9758519 | (AB024025) ribosomal protein S27 [*Arabid* | Ribosomal_S27e | Ribosomal protein S27 |
| 411 pheno | 4899873 | | 10176963 | (AB008266) gene_id: MHJ24.13~ similar to u | Ribosomal_S28e | Ribosomal protein S28e |
| 411 pheno | 5776417 | 834706 | 7715609 | (AC010793) F20B17.4 [*Arabidopsis thalian* | Na_H_Exchanger | Sodium/hydrogen exchanger family |
| 412 pheno | 10144406 | | 6714454 | (AC011620) putative 60S ribosomal protei | Ribosomal_L22e | Ribosomal L22e protein family |
| 412 pheno | 4900035 | 763830 | 4678226 | (AC007135) 40S ribosomal protein S14 [*Ar* | Ribosomal_S11 | Ribosomal protein S11 |
| 412 pheno | 5773772 | 747111 | 12325151 | (AC016662) putative 60S ribosomal protei | Ribosomal_L6e | Ribosomal protein L6e |
| 413 pheno | 1809157 | 490070 | 7440305 | ribosomal protein S20, cytosilic-*Arabi* | Ribosomal_S10 | Ribosomal protein S10p/S20e |
| 413 pheno | 4900353 | 729532 | 4263826 | (AC006067) unknown protein [*Arabidopsis* | | |
| 413 pheno | 5756166 | 732086 | 11358793 | RNA binding protein-like-*Arabidopsis t* | rrm | RNA recognition motif (a.k.a. RRM, RBD, |
| 414 pheno | 3433862 | | 6225833 | PROLIFERATING CELL NUCLEAR ANTIGEN (PCNA | PCNA | Proliferating cell nuclear antigen |
| 414 pheno | 4901133 | 714959 | 7440568 | ribosomal protein S27, cytosilic-*Arabi* | Ribosomal_S27e | Ribosomal protein S27 |
| 414 pheno | 4978201 | 802742 | 3122753 | 60S RIBOSOMAL PROTEIN L44 gi:7440769:pir | Ribosomal_L44 | Ribosomal protein L44 |

| | | | | | | |
|---|---|---|---|---|---|---|
| 415 pheno | 1008443 | 736633 | 9758519 | (AB024025) ribosomal protein S27 [*Arabid* | Ribosomal_S27e | Ribosomal protein S27 |
| 415 pheno | 1031291 | 379314 | 12229933 | 40S RIBOSOMAL PROTEIN S12-B gi\|4263712\|g | Ribosomal_L7Ae | Ribosomal protein L7Ae/L30e/S12e/Gadd45 |
| 415 pheno | 1386998 | 47924 | 11066135 | (AF195545) putative histone deacetylase | zf-C2H2 | Zinc finger, C2H2 type |
| 415 pheno | 4772398 | 769390 | 9759463 | (AB006696) 40S ribosomal protein S19 [*Ar* | Ribosomal_S19e | Ribosomal protein S19e |
| 415 pheno | 4901736 | 111892 | 9758556 | (AB006703) gene_id: MRH10.8~ pir\|\|T00965~s | | |
| 416 pheno | 1008148 | 761370 | 8953720 | (AB025606) contains similarity to 40S ri | | |
| 416 pheno | 1024236 | 57022 | 3122673 | 60S RIBOSOMAL PROTEIN L15 gi\|7441105\|pir | Ribosomal_L15e | Ribosomal L15 |
| 416 pheno | 1387671 | 822158 | 1350664 | 60S RIBOSOMAL PROTEIN L13 (CLONE 6.2.1) | Ribosomal_L13e | Ribosomal protein L13e |
| 416 pheno | 1442476 | 706502 | 3123264 | 60S RIBOSOMAL PROTEIN L27 gi\|7441032\|pir | Ribosomal_L27e | Ribosomal L27e protein family |
| 416 pheno | 4282667 | 822768 | 7549643 | (AC023912) ribosomal protein L29, putati | Ribosomal_L29e | Ribosomal L29e protein family |
| 416 pheno | 4909449 | 833360 | 1173045 | 60S RIBOSOMAL PROTEIN L37A gi\|421866\|pir | Ribosomal_L37ae | Ribosomal L37ae protein family |
| 416 pheno | 5773091 | 834732 | 7262674 | (AC012188) Strong similarity, practicall | Ribosomal_L10e | Ribosomal L10 |
| 417 pheno | 1017282 | 666913 | 464707 | 40S RIBOSOMAL PROTEIN S18 gi\|480908\|pir | Ribosomal_S13 | Ribosomal protein S13/S18 |
| 417 pheno | 1022748 | 706504 | 3123264 | 60S RIBOSOMAL PROTEIN L27 gi\|7441032\|pir | Ribosomal_L27e | Ribosomal L27e protein family |
| 417 pheno | 1023297 | 781025 | 11276884 | 60S RIBOSOMAL PROTEIN L36 homolog-*Arab* | Ribosomal_L36e | Ribosomal protein L36e |
| 417 pheno | 1031799 | 706181 | 6714451 | (AC011620) putative 60S ribosomal protei | Ribosomal_L18e | Eukaryotic ribosomal protein L18 |
| 417 pheno | 3439213 | 437454 | 1173045 | 60S RIBOSOMAL PROTEIN L37A gi\|421866\|pir | Ribosomal_L37ae | Ribosomal L37ae protein family |
| 417 pheno | 4771334 | 802750 | 11762182 | (AF325017) T21L8.120 [*Arabidopsis thalia* | Ribosomal_S10 | Ribosomal protein S10p/S20e |
| 417 pheno | 4911380 | 576635 | 7488307 | ribosomal protein L14 homolog T24A18.40 | Ribosomal_L14e | Ribosomal protein L14 |
| 417 pheno | 5668292 | 820676 | 3122753 | 60S RIBOSOMAL PROTEIN L44 gi\|7440769\|pir | Ribosomal_L44 | Ribosomal protein L44 |

| | | | | | | |
|---|---|---|---|---|---|---|
| 418 | 1021968 pheno | 576661 | 2651314 | (AC002336) 40S ribosomal protein S26 [Ar | Ribosomal_S26e | Ribosomal protein S26e |
| 418 | 3438734 pheno | | 7549643 | (AC023912) ribosomal protein L29, putati | Ribosomal_L29e | Ribosomal L29e protein family |
| 418 | 4914438 pheno | 822558 | 7549645 | (AC023912) ribosomal protein L29, putati | Ribosomal_L29e | Ribosomal L29e protein family |
| 419 | 5662893 pheno | 818613 | 7269839 | (AL161574) putative protein [*Arabidopsis* | Ribosomal_L28e | Ribosomal L28e protein family |
| 419 | 5664311 pheno | 818503 | 3122724 | 60S RIBOSOMAL PROTEIN L38 gi\|11276909\|pi | Ribosomal_L38e | Ribosomal L38e protein family |
| 419 | 5758021 pheno | 833994 | 6714451 | (AC011620) putative 60S ribosomal protei | Ribosomal_L18e | Eukaryotic ribosomal protein L18 |
| 42 | 1012110 pheno | 778738 | 6503304 | (AC011713) Strong similarity to gb\|AF099 | DnaJ | DnaJ domain |
| 42 | 1383485 pheno | 379673 | 2129729 | senescence-associated protein sen1-*Ara* | Rhodanese | Rhodanese-like domain |
| 42 | 2187156 pheno | 796738 | 2129729 | senescence-associated protein sen1-*Ara* | Rhodanese | Rhodanese-like domain |
| 42 | 4577400 pheno | 576861 | | | | |
| 420 | 1025791 | 803433 | 4585878 | (AC005850) Unknown protein [*Arabidopsis* | | |
| 420 | 4608965 | 671877 | 8567795 | (AC013428) 40S ribosomal protein S17, pu | Ribosomal_S17e | Ribosomal S17 |
| 420 | 5663116 | 818554 | 7486478 | hypothetical protein F6E13.17-*Arabidop* | DapB | Dihydrodipicolinate reductase |
| 421 | 1030821 pheno | | 9757825 | (AB007651) 60S ribosomal protein L10A [A | Ribosomal_L1 | L1P family of ribosomal proteins |
| 421 | 1976457 pheno | 145369 | 166867 | (J05216) ribosomal protein S11 (probable | Ribosomal_S17 | Ribosomal protein S17 |
| 421 | 5663301 pheno | 822232 | 9757825 | (AB007651) 60S ribosomal protein L10A [A | Ribosomal_L1 | L1P family of ribosomal proteins |
| 421 | 5664362 pheno | 215197 | 9757825 | (AB007651) 60S ribosomal protein L10A [A | Ribosomal_L1 | L1P family of ribosomal proteins |

| | | | | | | |
|---|---|---|---|---|---|---|
| 422 pheno | 1007370 | 358288 | 7440340 | ribosomal protein S14, cytosolic-*Arabi* | Ribosomal_S11 | Ribosomal protein S11 |
| 422 pheno | 1012349 | | 7440636 | ribosomal protein L8, cytosolic-*Arabid* | Ribosomal_L2 | Ribosomal Proteins L2 |
| 422 pheno | 4767515 | 803201 | 5912424 | (AJ242970) BTF3b-like factor [*Arabidopsi* | NAC | NAC domain |
| 422 pheno | 4978201 | 802742 | 3122753 | 60S RIBOSOMAL PROTEIN L44 gi\|7440769\|pir | Ribosomal_L44 | Ribosomal protein L44 |
| 422 pheno | 5663862 | 56862 | 7440560 | ribosomal protein S25, cytosolic-*Arabi* | | |
| 422 pheno | 5677309 | 804632 | 464707 | 40S RIBOSOMAL PROTEIN S18 gi\|480908\|pir\| | Ribosomal_S13 | Ribosomal protein S13/S18 |
| 423 pheno | 1569568 | 57302 | 12323985 | (AC015450) unknown protein; 83277-83927 | | |
| 423 pheno | 5667720 | 436439 | 4314401 | (AC006232) putative beta-1,3-glucanase [ | Glyco_hydro_17 | Glycosyl hydrolases family 17 |
| 423 pheno | 5677344 | 735070 | 9758647 | (AB011485) gene_id:MXH1.11~ pir\|T10200~s | | |
| 424 pheno | 1442476 | 706502 | 3123264 | 60S RIBOSOMAL PROTEIN L27 gi\|7441032\|pir | Ribosomal_L27e | Ribosomal L27e protein family |
| 424 pheno | 2991489 | 674871 | 11276881 | ribosomal protein L35a, cytosolic [simil | Ribosomal_L35Ae | Ribosomal protein L35Ae |
| 424 pheno | 3438734 | | 7549643 | (AC023912) ribosomal protein L29, putati | Ribosomal_L29e | Ribosomal L29e protein family |
| 424 pheno | 3439472 | 803062 | 10176775 | (AB013392) 60S ribosomal protein L31 [Ar | Ribosomal_L31e | Ribosomal protein L31e |
| 424 pheno | 4282667 | 822768 | 7549643 | (AC023912) ribosomal protein L29, putati | Ribosomal_L29e | Ribosomal L29e protein family |
| 424 pheno | 5665234 | 819865 | 7441176 | ribosomal protein L35, cytosolic-*Arabi* | Ribosomal_L29 | Ribosomal L29 protein |
| 424 pheno | 5667812 | 786382 | 464638 | 60S RIBOSOMAL PROTEIN L41 gi\|481238\|pir\| | | |
| 424 pheno | 5668292 | 820676 | 3122753 | 60S RIBOSOMAL PROTEIN L44 gi\|7440769\|pir | Ribosomal_L44 | Ribosomal protein L44 |
| 424 pheno | 5669508 | | 6714451 | (AC011620) putative 60S ribosomal protei | Ribosomal_L18e | Eukaryotic ribosomal protein L18 |

| | | | | | | |
|---|---|---|---|---|---|---|
| 425 | 1379607 \| pheno | 53378 | 7486241 | hypothetical protein F27F23.18-*Arabido* | | |
| 425 | 1396354 \| pheno | 52394 | 4895185 | (AC007661) unknown protein [*Arabidopsis* | | |
| 425 | 5668427 \| pheno | 490908 | 7440779 | ribosomal protein L24 homolog T13E15.13 | Ribosomal_L24e | Ribosomal protein L24e |
| 426 | 1022748 \| pheno | 706504 | 3123264 | 60S RIBOSOMAL PROTEIN L27 gi\|7441032\|pir | Ribosomal_L27e | Ribosomal L27e protein family |
| 426 | 1032313 \| pheno | 48511 | 99771 | ubiquitin/ribosomal protein S27a.1-A | ubiquitin | Ubiquitin family |
| 426 | 5668720 \| pheno | 498038 | 10176841 | (AB005244) 40S ribosomal protien S11 [*Ar* | Ribosomal_S17 | Ribosomal protein S17 |
| 426 | 5754280 \| pheno | 835386 | 3860277 | (AC005824) 60S ribosomal protien L10A [*Ar* | Ribosomal_L1 | L1P family of ribosomal proteins |
| 426 | 5754419 \| pheno | 47796 | 11134742 | 40S RIBOSOMAL PROTEIN S24 gi\|12322851\|gb | Ribosomal_S24e | Ribosomal protein S24e |
| 427 | 1010385 \| pheno | 512919 | 11276730 | acidic ribosomal protein P2-like-*Arabi* | 60s_ribosomal | 60s Acidic ribosomal protein |
| 427 | 1384016 \| pheno | 51641 | 12322852 | (AC009465) putative 40S ribosomal protei | Ribosomal_S3Ae | Ribosomal S3Ae family |
| 427 | 4772398 \| pheno | 769390 | 9759463 | (AB006696) 40S ribosomal protein S19 [*Ar* | Ribosomal_S19e | Ribosomal protein S19e |
| 427 | 5669025 \| pheno | 513703 | 7484789 | acidic ribosomal protein P3a homolog F14 | 60s_ribosomal | 60s Acidic ribosomal protein |
| 428 | 3435646 \| pheno | | 4206765 | (AF104329) putative type 1 membrane prot | PsbP | PsbP |
| 428 | 3437710 \| pheno | 48667 | 1644289 | (X95727) chlorophyll a/b-binding protein | chloroa_b-bind | Chlorophyll A-B binding proteins |
| 428 | 5669724 \| pheno | | 7443149 | photosystem I chain IV homolog F16A16.14 | PSI_PsaE | Photosystem I reaction centre subunit IV |

| | | | | | | |
|---|---|---|---|---|---|---|
| 429 | 1010094 \| pheno | 804644 | 6174956 | 60S RIBOSOMAL PROTEIN L7A gi\|7440707\|pir | Ribosomal_L7Ae | Ribosomal protein L7Ae/L30e/S12e/ Gadd45 |
| 429 | 1024015 \| pheno | 820185 | 11276721 | 60S RIBOSOMAL PROTEIN L7A protein-*Arab* | Ribosomal_L7Ae | Ribosomal protein L7Ae/L30e/S12e/ Gadd45 |
| 429 | 1024236 \| pheno | 57022 | 3122673 | 60S RIBOSOMAL PROTEIN L15 gi\|7441105\|pir | Ribosomal_L15e | Ribosomal L15 |
| 429 | 1024993 \| pheno | 824724 | 12229932 | 40S RIBOSOMAL PROTEIN S12-A gi\|6587799\|g | Ribosomal_L7Ae | Ribosomal protein L7Ae/L30e/S12e/ Gadd45 |
| 429 | 3439213 \| pheno | 437454 | 11173045 | 60S RIBOSOMAL PROTEIN L37A gi\|421866\|pir | Ribosomal_L37ae | Ribosomal L37ae protein family |
| 429 | 4901171 \| pheno | 824724 | 12229932 | 40S RIBOSOMAL PROTEIN S12-A gi\|6587799\|g | Ribosomal_L7Ae | Ribosomal protein L7Ae/L30e/S12e/ Gadd45 |
| 429 | 5671204 \| pheno | 808980 | 1710587 | 60S ACIDIC RIBOSOMAL PROTEIN P0 gi\|74407 | Ribosomal_L10 | Ribosomal protein L10 |
| 429 | 5773091 \| pheno | 834732 | 7262674 | (AC012188) Strong similarity, practicall | Ribosomal_L10e | Ribosomal L10 |

| | | | | | | |
|---|---|---|---|---|---|---|
| 43 | 1012128 \| pheno | 796000 | 4678226 | (AC007135) 40S ribosomal protein S14 [*Ar* | Ribosomal_S11 | Ribosomal protein S11 |
| 43 | 1024126 \| pheno | 56624 | 464707 | 40S RIBOSOMAL PROTEIN S18 gi\|480908\|pir\| | Ribosomal_S13 | Ribosomal protein S13/S18 |
| 43 | 1024993 \| pheno | 824724 | 12229932 | 40S RIBOSOMAL PROTEIN S12-A gi\|6587799\|g | Ribosomal_L7Ae | Ribosomal protein L7Ae/L30e/S12e/ Gadd45 |
| 43 | 1714831 \| pheno | 306741 | 11994560 | (AP002038) 60S ribosomal protein L7 [*Ara* | Ribosomal_L30 | Ribosomal protein L30p/L7e |
| 43 | 4901171 \| pheno | 824724 | 12229932 | 40S RIBOSOMAL PROTEIN S12-A gi\|6587799\|g\| | Ribosomal_L7Ae | Ribosomal protein L7Ae/L30e/S12e/ Gadd45 |
| 43 | 5671204 \| pheno | 808980 | 1710587 | 60S ACIDIC RIBOSOMAL PROTEIN P0 gi\|74407 | Ribosomal_L10 | Ribosomal protein L10 |
| 43 | 5753942 \| pheno | 157527 | 3860277 | (AC005824) 60S ribosomal protein L10A [*A* | Ribosomal_L1 | L1P family of ribosomal proteins |
| 43 | 5754280 \| pheno | 835386 | 3860277 | (AC005824) 60S ribosomal protein L10A [*A* | Ribosomal_L1 | L1P family of ribosomal proteins |

-continued

| | | | | | | |
|---|---|---|---|---|---|---|
| 43 | 5758021 \| pheno | 833994 | 6714451 | (AC011620) putative 60S ribosomal protei | Ribosomal_L18e | Eukaryotic ribosomal protein L18 |
| 43 | 5773091 \| pheno | 834732 | 7262674 | (AC012188) Strong similarity, practicall | Ribosomal_L10e | Ribosomal L10 |
| 430 | 1030231 \| pheno | 721378 | 11276860 | ribosomal L23a-like protein-*Arabidopsi* | Ribosomal_L23 | Ribosomal protein L23 |
| 430 | 5663934 \| pheno | 819000 | 12323482 | (AC025781) 60S ribosomal protein L30, pu | Ribosomal_L7Ae | Ribosomal protein L7Ae/L30e/S12e/Gadd45 |
| 430 | 5671318 \| pheno | 823529 | 9294455 | (AB012247) gene_id: MSL1.12~unknown prote | Ribosomal_L37e | Ribosomal protein L37e |
| 431 | 1027590 \| pheno | | 6714285 | (AC017118) F6N18.2 [*Arabidopsis thaliana*] | | |
| 431 | 5671710 \| pheno | 721322 | 282865 | chlorophyll a/b-binding protein F28P10.1 | chloroa_b-bind | Chlorophyll A-B binding proteins |
| 431 | 5759467 \| pheno | 835747 | 12324161 | (AC022455) chlorophyll A-B-binding prote | chloroa_b-bind | Chlorophyll A-B binding proteins |
| 431 | 5773759 \| pheno | 460944 | 4741950 | (AF134125) Lhcb2 protein [*Arabidopsis th*] | chloroa_b-bind | Chlorophyll A-B binding proteins |
| 432 | 2106017 \| pheno | 490151 | 10177906 | (AB016886) 60S acidic ribosomal protein | 60s_ribosomal | 60s Acidic ribosomal protein |
| 432 | 5672842 \| pheno | 821491 | 10177906 | (AB016886) 60S acidic ribosomal protein | 60s_ribosomal | 60s Acidic ribosomal protein |
| 432 | 5773091 \| pheno | 834732 | 7262674 | (AC012188) Strong similarity, practicall | Ribosomal_L10e | Ribosomal L10 |
| 433 | 1023278 \| pheno | 706501 | 11994741 | (AP001306) 60S ribosomal protein L27 [*Ar*] | Ribosomal_L27e | Ribosomal L27e protein family |
| 433 | 1024236 \| pheno | 57022 | 3122673 | 60S RIBOSOMAL PROTEIN L15 gi\|7441105\|pir | Ribosomal_L15e | Ribosomal L15 |
| 433 | 1027760 \| pheno | 818470 | 11276653 | ribosomal protein S26, cytosolic [simila | Ribosomal_S26e | Ribosomal protein S26e |
| 433 | 1029485 \| pheno | 54167 | 10092293 | (AC021046) 60S ribosomal protein L34, pu | Ribosomal_L34e | Ribosomal protein L34e |
| 433 | 1387671 \| pheno | 822158 | 1350664 | 60S RIBOSOMAL PROTEIN L13 (CLONE 6.2.1) | Ribosomal_L13e | Ribosomal protein L13e |
| 433 | 1442476 \| pheno | 706502 | 3123264 | 60S RIBOSOMAL PROTEIN L27 gi\|7441032\|pir | Ribosomal_L27e | Ribosomal L27e protein family |
| 433 | 2781341 \| pheno | | 3860277 | (AC005824) 60S ribosomal protein L10A [*A*] | Ribosomal_L1 | L1P family of ribosomal proteins |
| 433 | 3445482 \| pheno | | 1173045 | 60S RIBOSOMAL PROTEIN L37A gi\|421866\|pir | Ribosomal_L37ae | Ribosomal L37ae protein family |
| 433 | 5668065 \| pheno | 884827 | 11276646 | 40S ribosomal protein S21 homolog-*Arab* | Ribosomal_S21e | Ribosomal protein S21e |
| 433 | 5674194 \| pheno | 818470 | 11276653 | ribosomal protein S26, cytosolic [simila | Ribosomal_S26e | Ribosomal protein S26e |

| | | | | | | |
|---|---|---|---|---|---|---|
| 434 | 4771334 | 802750 | 11762182 | (AF325017) T21L8.120 [Arabidopsis thalia] | Ribosomal_S10 | Ribosomal protein S10p/S20e |
| | pheno | | | | | |
| 434 | 5674666 | 780378 | 2459420 | (AC002332) 60S ribosomal protein L23 [4r | Ribosomal_L14 | Ribosomal protein L14p/L23e |
| | pheno | | | | | |
| 434 | 5754419 | 47796 | 11134742 | 40S RIBOSOMAL PROTEIN S24 gi|12322851|gb | Ribosomal_S24e | Ribosomal protein S2 |
| | pheno | | | | | |

II.C.2 Using Differential Expression Data to Determine when the Genes and Pathways are Active The differential expression data can be used to associate the cellular response that results when the clusters of genes are transcribed. For the complete linkage clusters, the genes in the cluster will produce similar transcription profiles. The experiments where the genes in the cluster are differentially expressed as compared to the control define the cellular responses that all the genes of the cluster are capable of modulating.

For example, for the cluster shown above, the mRNA levels for the genes were significantly different in the nitrogen response experiments. Thus, the data shows that this cluster of genes is associated with protein synthesis in response to nutrient uptake.

II.C.3. Using Phenotype Data to Determine when Genes and Pathways are Active

The phenotypic data can be used to demonstrate the physiological consequences of that result when a cluster of genes is active. Whether the clusters were generated by the complete linkage or the nearest neighbor analyses, if a single gene in the cluster has been implicated in phenotypic changes, then any one or combination of the other genes in the cluster can also modulate the same or similar phenotypic changes.

Utilities of Particular Interest

The following sections describe utilities/functions for the genes, gene components and products of the invention. The sequences of the invention, as discussed above, can be recognized as a particular type of gene (e.g. root gene, leaf gene, etc.) by means of particular terms utilized in the Knock-in and Knock-out Tables and by the results of the differential expression experiments. Combined analysis of those data also identify genes with utilities/functions of particular interest. The Single Gene Functions and Utilities Table correlates that data and specific genes with those utilities/functions of particular interest.

Utilities of Particular Interest for Clustered Sequences

As discussed further herein, the genes, gene components and products of the invention have been clustered together into groups. This enables one to understand the function/utility of one member of the cluster based upon knowledge about one or more other members of the cluster. In addition, this enables an understanding of some utilities/functions of a cluster that would be of particular interest. The Cluster Functions and Utilities Table lists some of the clusters of the invention and notes the functions/utilities that are of particular interest for each of the clusters. Of course, these functions/utilities are of particular interest for each member of each particular cluster.

II.D. Experimental Results Provide an Understanding of Genes, Pathways and Networks in Many Plant Species By analyzing the constant and variable properties of groups of similar sequences, it is possible to derive a structural and functional signature for a protein family, which distinguishes its members from all other proteins. This approach has allowed the Applicants to assign proteins into functional groups and identify orthologous proteins both within and between species. A pertinent analogy to be considered is the use of fingerprints by the police for identification purposes. A fingerprint is generally sufficient to identify a given individual. Similarly, a protein signature can be used to assign a newly sequenced protein to a specific family of proteins and thus to formulate hypotheses about its function.

Proteins can be grouped together because they share a single motif or many motifs. Typically, proteins that share a series of motifs share greater functional equivalence. Usually, signature sequences comprise more than one motif in a particular order from N-terminus to C-terminus.

A list of these groups can be found in the Protein Group Table. The sequences were grouped together using the iterative protein sequence local alignment software, PSI-BLAST. This software begins by aligning a number sequences where the probability that the alignment occurred by chance is set by a threshold e-value. In the Applicants' case, the threshold e-value was set at $10^{-50}$, $10^{-30}$, and $10^{-10}$. The algorithm generates a consensus sequence from the sequences that were aligned together. The consensus sequence was then used to find sequences that matched to it with a probability that was less than the set threshold. The algorithm performs the iterative tasks of aligning and generating a consensus sequence any number of times. Generally, Applicants performed one iteration for the $10^{-10}$ e-value threshold, two iterations for the $10^{-30}$ threshold, and three iterations for the $10^{-50}$ threshold.

Each group can contain sequences from one of more organisms. The groups included both Ceres polypeptides and public polypeptide sequences. The Ceres polypeptides are identified by their Ceres Sequence ID NO as listed in the Reference Table.

Each group contains sequences that were included at the $10^{-50}$, $10^{-30}$, and $10^{-10}$ e-value cutoffs. For each group, the peptide ID and at which cutoff the peptide was included into the group. The same peptide ID may be included in the group three times as peptide ID 50, peptide ID 30 and peptide ID 10. The data indicates that peptide ID was included in the group when the threshold was either $10^{-50}$, $10^{-30}$, or $10^{-10}$. All the peptide IDs that are followed by "50" were included in the protein group when the e-value cutoff was $10^{-50}$. All the peptide IDs that are followed by either "30" or "50" were included in the protein group when the threshold e-value was $10^{-30}$. All the peptide IDs that are followed by "10", "30" or "50" were included in the protein group when $10^{-10}$ was used as the e-value cutoff.

II.D.1. Conserved Sequences Between Proteins of Different Species Give Rise to a Signature Sequence The signature sequence for each group of proteins, also referred to as the consensus sequence. The signature sequence comprises the amino acids that are conserved throughout all the proteins in a particular protein group. The data are shown in the Protein Group table.

Not all the polypeptides in a group are the same length. Thus, some members of the group may not contain the entire signature sequence. However, throughout the length of any member protein, its sequence will match the signature sequence.

The consensus sequence contains both lower-case and upper-case letters. The upper-case letters represent the standard one-letter amino acid abbreviations. The lower case letters represent classes of amino acids:
"t" refers to tiny amino acids, which are specifically alanine, glycine, serine and threonine.
"p" refers to polar amino acids, which are specifically, asparagine and glutamine
"n" refers to negatively charged amino acids, which are specifically, aspartic acid and glutamic acid
"+" refers to positively charged residues, which are specifically, lysine, arginine, and histidine
"r" refers to aromatic residues, which are specifically, phenylalanine, tyrosine, and tryptophan,
"a" refers to aliphatic residues, which are specifically, isoleucine, valine, leucine, and methionine In addition to each consensus sequence, Applicants have generated a scoring matrix to provide further description of the consensus sequence. The matrix reports the identity and number of occurrences of all the amino acids that were found in the group members for every residue position of the signature sequence. The matrix also indicates for each residue position, how many different organisms were found to have a polypeptide in the group that included a residue at the relevant position. These results are reported in the Protein Group Matrix table.

Functional equivalents share similar (1) structural characteristics; (2) biochemical activities and molecular interactions; (3) cellular responses or activities; or (4) phenotypic effects.

II.D.2. Linking Signature Sequences to Conservation of Structural Characteristics Proteins with related functions show similar three-dimensional structures but may not show extensive amino acid sequence similarity. Typically, proteins need only share a single motif or low similarity in multiple domains to exhibit similar structural features, such as alpha helix, beta sheet, charge residues, stretches of hydrophobicity, etc. Conserved structural features have been implicated in ligand binding by receptor proteins, binding to a class of substrates, polynucleotide binding, or protein-protein interactions.

Based on the signature sequences and the Matrix Tables described herein, a number of motifs can be discerned. Motifs are identified as regions in the signature sequence which are constant in a majority of the members of the group. Example motifs can be found among Applicant's data which are shared in the range of 75% to 95% of group members Typically, a region of the consensus sequence is constant if, at each position of the region, the preferred amino acid is chosen from a single class of amino acids; even more typically, the preferred amino acid is a single amino acid. The region can contain a number of positions where an amino acid can be chosen. However, these variable positions are usually less than 15% of the total number of residues in the region; more usually, less than 10%; even more usually, less than 5%.

Generally, a domain is considered to be well defined if the consensus sequence is constructed from sequences from at least 2 organisms; more preferably, at least 3 organisms; even more preferably four organisms or greater.

Primary domains are best identified from the data presented for the $10^{-10}$ probability criteria. Using this parameter, the largest number of proteins is associated into a group. Consequently, the signature sequence exhibits the greatest amount of variability. The conserved regions, the domains or motifs of the signature contrast against the variable regions. These variable regions become obvious when sequences from more proteins are compared.

Signature sequences revealed in the $10^{-30}$ and $10^{-50}$ e-value classes show more conservation in the domains, and can even display a degree of conservation in what is considered the variable regions in the $10^{-10}$ analyses. These more extensively-conserved domains can reflect higher similarity in function—completely orthologous functions. Proteins that share a number of conserved domains, in the same relative order from N terminus to C terminus, are even more likely to be completely orthologous. Nevertheless, because of the natural divergence that occurs in non-conserved regions during evolution and species differentiation, orthologs can be proteins with only the domains conserved and therefore be present in the $10^{-30}$ and $10^{-10}$ p value classes of the Ortholog Table.

II.D.3. Linking Signature Sequences to Conservation of Biochemical Activities and Molecular Interactions Proteins that possess the same defined domains or motifs are likely to carry out the same biochemical activity or interact with a similar class of target molecule, e.g., DNA, RNA, proteins, etc. Thus, the pFAM domains listed in the Reference Tables are routinely used as predictors of these properties. Substrates and products for the specific reactions can vary from protein to protein. Where the substrates, ligands, or other molecules bound are identical the affinities may differ between the proteins. Typically, the affinities exhibited by different functional equivalents varies no more than 50%; more typically, no more than 25%; even more typically, no more than 10%; or even less.

Proteins with very similar biochemical activities or molecular interactions will share similar structural properties, such as substrate grooves, as well as sequence similarity in more than one motif. Usually, the proteins will share at least two motifs of the signature sequence; more usually, three motifs; even more usually four motifs or greater. Typically, the proteins exhibit 70% sequence identity in the shared motifs; more typically, 80% sequence identity; even more typically, 90% sequence identity or greater. These proteins also often share sequence similarity in the variable regions between the constant motif regions. Further, the shared motifs will be in the same order from amino- to carboxyl-termini. The length of the variable regions between the motifs in these proteins, generally, is similar. Specifically, the number of residues between the shared motifs in these proteins varies by less than 25%; more usually, does not vary by less than 20%; even more usually, less than 15%; even more usually less than 10% or even less.

II.D.4. Linking Signature Sequences to Conservation of Cellular Responses or Activities Proteins that exhibit similar cellular response or activities will possess the structural and conserved domain/motifs as described in the Biochemical Activities and Molecular Interactions above.

Proteins can play a larger role in cellular response than just their biochemical activities or molecular interactions suggest. A protein can initiate gene transcription, which is specific to the drought response of a cell. Other cellular responses and activities include: stress responses, hormonal responses, growth and differential of a cell, cell to cell interactions, etc.

The cellular role or activities of protein can be deduced by transcriptional analyses or phenotypic analyses as well as by determining the biochemical activities and molecular interactions of the protein. For example, transcriptional analyses can indicate that transcription of gene A is greatly increased during flower development. Such data would implicate protein A encoded by gene A, in the process of flower development. Proteins that shared sequence similarity in more than one motif would also act as functional equivalents for protein A during flower development.

II.D.5. Linking Signature Sequences to Conservation of Phenotypic Effects

Typically, proteins that are grouped together under the most stringent parameters, e-value $\leq 10^{-50}$, are likely orthologs and therefore, when present in the same or equivalent cells can cause similar phenotypic consequences. These proteins have very high sequence similarity. Typically, if one of the members of a group is an *Arabidopsis* protein, then the corn ortholog can rescue an *Arabidopsis* mutant plant that does not produce the *Arabidopsis* protein. The mutant plant would be rescued as the parental "wild-type" phenotype by expression of a coding sequence of the corn protein of the same orthologous group when present in the appropriate cell types of the plant.

Preferably, these functional equivalents have sequence motif identity throughout much of the length of the protein. However, proteins that share very high similarity between a number, usually more than two; even more usually, more than three motifs can act as functional equivalents to produce similar phenotypic effects.

A gene can have coding sequence similarity, i.e., is a homologous. The coding sequence can be sufficient to act as a functional equivalent, although the gene as a whole is not an ortholog. For example, two similar dwf4 coding sequences were found in the *Arabidopsis* genome. However, this pair of coding sequences had different promoters and hence different roles in *Plantae*. But when one of the pair was placed under the control of its mates' promoter, the phenotypic effects were similar to the effects produced by its mate coding sequence. Therefore, the coding sequence, but not the genes are orthologous.

III. Description of the Genes, Gene Components and Products, Together with their Use and Application As described herein, the results of Applicant's experiments provide an understanding of the function and phenotypic implications of the genes, gene components and products of the present invention. Bioinformatic analysis provides such information. The sections of the present application containing the bioinformatic analysis, together with the Sequence and Reference Tables, teach those skilled in the art how to use the genes, gene components and products of the present invention to provide plants with novel characteristics. Similarly, differential expression analysis provides additional such information and the sections of the present application on that analysis; together with the MA_Diff Tables and MA_Cluster Tables, describe the functions of the genes, gene components and products of the present invention which are understood from the results of the differential expression experiments. The same is true with respect to the phenotype data, wherein the results of the Knock-in and Knock-out experiments and the sections of the present application on those experiments provide the skilled artisan with further description of the functions of the genes, gene components and products of the present invention.

As a result, one reading each of these sections of the present application as an independent report will understand the function of the genes, gene components and products of the present invention. But those sections and descriptions can also be read in combination, in an integrated manner, to gain further insight into the functions and uses for the genes, gene components and products of the present invention. Such an integrated analysis does not require extending beyond the teachings of the present application, but rather combining and integrating the teachings depending upon the particular purpose of the reader.

Some sections of the present application describe the function of genes, gene components and products of the present invention with reference to the type of plant tissue (e.g. root genes, leaf genes, etc.), while other sections describe the function of the genes, gene components and products with respect to responses under certain conditions (e.g. Auxin-responsive genes, heat-responsive genes, etc.). Thus, if one desires to utilize a gene understood from the application to be a particular tissue-type of gene, then the condition-specific responsiveness of that gene can be understood from the differential expression tables, and very specific characteristics of actions of that gene in a transformed plant will be understood by recognizing the overlap or intersection of the gene functions as understood from the two different types of information. Thus, for example, if one desires to transform a plant with a root gene for enhancing root growth and performance, one can know the useful root genes from the results reported in the knock-in and knock-out tables. A review of the differential expression data may then show that a specific root gene is also over-expressed in response to heat and osmotic stress. The function of that gene is then described in (1) the section of the present application that discusses root genes, (2) the section of the present application that discusses heat-responsive genes, and (3) the section of the application that discusses osmotic stress-responsive genes. The function(s) which are commonly described in those three sections will then be particularly characteristic of a plant transformed with that gene. This type of integrated analysis of data can be viewed from the following schematic that summarizes, for one particular gene, the function of that gene as understood from the phenotype and differential expression experiments.

| Gene function known from phenotype experiments | Gene function known from first differential expression experiment | Gene function known from second differential expression experiment |
|---|---|---|
| Function A | Function A | Function A |
| Function B | | |
| | Function C | Function C |
| | Function D | |
| | | Function E |
| Function F | Function F | Function F |
| Function G | Function G | |
| | | Function H |
| Function I | | Function I |
| | Function J | |

In the above example, one skilled in the art will understand that a plant transformed with this particular gene will particularly exhibit functions A and F because those are the functions which are understood in common from the three different experiments.

Similar analyses can be conducted on various genes of the present invention, by which one skilled in the art can effectively modulate plant functions depending upon the particular use or conditions envisioned for the plant.

III.A. Organ-Affecting Genes, Gene Components, Products (Including Differentiation and Function)

III.A.1. Root Genes, Gene Components and Products

The economic values of roots arise not only from harvested adventitious roots or tubers, but also from the ability of roots to funnel nutrients to support growth of all plants and increase their vegetative material, seeds, fruits, etc. Roots have four main functions. First, they anchor the plant in the soil. Second, they facilitate and regulate the molecular signals and molecular traffic between the plant, soil, and soil fauna. Third, the root provides a plant with nutrients gained from the soil or growth medium. Fourth, they condition local soil chemical and physical properties.

III.A.1.a. Identification of Root Genes

Root genes identified herein are defined as genes, gene components and products capable of modulating one or more processes in or functions of the root as described below. They are active or potentially active to a greater extent in roots than in most other organs of the plant. These genes and gene products can regulate many plant traits from yield to stress tolerance. That single genes usually affect the development and function of roots and whole plants is a consequence of biological cellular complexity and the role roots play in supporting the growth of whole plants. Examples of such root genes and gene products are shown in the Reference and Sequence Reference and Sequence Tables and sequences encoding polypeptides of the Protein Group and Protein Group Matrix tables or fragments thereof, the Knock-In and Knock-Out Tables, and the MA-diff Tables. The function of many of the protein products gained from comparisons with proteins of known functions, are also given in the REF Tables.

Root Genes Identified By Phenotypic Observations

Root genes are active or potentially active to a greater extent in roots than in some other organs/tissue of the plant. Some of the root genes herein were discovered and characterized from a much larger set of genes in experiments designed to find genes that cause phenotypic changes in root morphology. Such morphological changes include primary and lateral root number, size and length, as well as phenotypic changes of other parts of that plant associated with changes in root morphology.

In these experiments, root genes were identified by either (1) ectopic expression of a cDNA in a plant or (2) mutagenesis of the plant genome. The plants were then cultivated under standardized conditions and any phenotypic differences recorded between the modified plants as compared with the parent plant. The gene(s) causing the changes were deduced from the cDNA inserted or disrupted gene. Phenotypic differences were observed in:

Primary Roots And Root System
  Size, Including Length And Girth
  Number
  Branching
  Root Waving/Curling Characteristics
  Gravitropism Changes
  Agravitropic
Lateral Roots
  Size, Including Length And Girth
  Number
  Branching Results from screening for these phenotypic changes are reported in the Knock-in and Knock-out Tables. Therefore, any sequence reported in those Tables with one of the above-noted observations is considered a "root gene". A "root gene" is also a sequence which, in the Ortholog Tables or in the MA-dust Tables, is grouped/clustered together with at least one sequence that is identified as such by means of the Knock-in and Knock-out Tables.

Root Genes Identified by Differential Expression

Root genes were also identified by measuring the relative levels of mRNA products in the root versus the aerial portion of a plant. Specifically, mRNA was isolated from roots and root tips of *Arabidopsis* plants and compared to mRNA isolated from the aerial portion of the plants utilizing microarray procedures. The MA_diff Table(s) reports the transcript levels of the experiment (see EXPT ID: 108594, 108433, 108599, 108434, 108439). For transcripts that had higher levels in the samples than the control, a "+" is shown. A "−" is shown for when transcript levels were reduced in root tips as compared to the control. For more experimental detail see the Example section below.

Roots genes are those sequences that showed differential expression as compared to controls, namely those sequences identified in the MA_diff tables with a "+" or "−" indication.

Roots Genes Identified by Cluster Analyses of Differential Expression

Roots Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Roots genes is any group in the MA_clust that comprises a cDNA ID that also appears in Expt ID 108594, 108433, 108599, 108434, 108439 of the MA_diff table(s).

Roots Genes Identified by Correlation to Genes that Cause Physiological Consequences Additionally, the differential expression data and the phenotypic observations can be merged to identify pathways or networks of Roots genes. A group in the MA_clust is considered a Roots pathway or network if the group comprises a cDNA ID that also appears in Knock-in or Knock-out tables that causes one or more of the phenotypes described in section above.

Roots Genes Identified by Amino Acid Sequence Similarity

Roots genes from other plant species typically encode polypeptides that share amino acid similarity to the sequences encoded by corn and *Arabidopsis* Roots genes. Groups of Roots genes are identified in the Protein Group table. In this table, any protein group that comprises a peptide ID that corresponds to a cDNA ID member of a Roots pathway or network is a group of proteins that also exhibits Roots functions/utilities.

Examples of phenotypes, biochemical activities, and transcription profiles that can be modulated by these genes and gene products are described above and below.

III.A.1.b. Use of Root Genes to Modulate Phenotypes

The root genes of the instant invention are capable of modulating one or more processes of root structure and/or function including (1) development; (2) interaction with the soil and soil contents; and (3) transport in the plant.

Root genes and gene products can be used to alter or modulate one or more of the following phenotypes.

1.) Development

Roots arise from meristem cells that are protected by a root cap during root elongation, but as the root grows out, the cap cells abscise and the remaining cells differentiate to the tip. Depending on the plant species, some surface cells of roots can develop into root hairs. Some roots persist for the life of the plant; others gradually shorten as the ends slowly die back; some may cease to function due to external influences. The root genes and gene products of this invention are useful to modulate any one or all of these growth and development processes generally, as in root density and root growth; including rate, timing, direction and size.

Root genes and gene products are useful to modulate either the growth and development or other processes in one or more of the following types of roots, including primary, lateral, and adventitious.

Root genes and gene products are useful to modulate cellular changes in cell size, cell division, rate direction and/or number, cell elongation, cell differentiation, lignified cell walls, epidermal cells, such as trichoblasts, and root apical meristem cells (growth and initiation).

Parts of roots (i.e. root architecture) can be modulated by these genes root and gene products to affect root architecture in, for example, the epidermis cortex (including the epidermis, hypodermis, endodermis, casparian strips, suberized secondary walls, parenchyma, and aerenchyma), stele (including vaculature, xylem, phloem, and pericycle), vasculature, xylem, phloem, root cap, root apical meristem, elongating region, and symmetry.

The polynucleotides and polypeptides of this invention can be used to control the responses to internal plant and root programs as well as to environmental stimuli in the seminal system, nodal system, hormone systems (including Auxin and cytokinin), root cap abscission, root senescence, gravitropism, coordination of root growth and development with that of other organs (including leaves, flowers, seeds, fruits, stems, and changes in soil environment (including water, minerals, ph, and microfauna and flora).

2.) Interaction with Soil and Soil Contents

Roots are sites of intense chemical and biological activities and as a result can strongly modify the soil they contact. Roots coat themselves with surfactants and mucilage to facilitate these activities. Specifically, roots are responsible for nutrient uptake by mobilizing and assimilating water, organic and inorganic compounds, ions and attracting and interacting with beneficial microfauna and flora. Roots also help to mitigate the effects of toxic chemicals, pathogens and stress. Examples of root properties and activities that the genes and gene products of this invention are useful to modulate are root surfactants and mucilage (including mucilage composition, secretion rate and time, surfactant); nutrient uptake of water, nitrate and other sources of nitrogen, phosphate, potassium, and micronutrients (e.g. iron, copper, etc.); microbes and nematodes associations (such as bacteria including nitrogen-fixing bacteria, mycorrhizae, and nodule-forming and other nematodes); oxygen (including transpiration); detoxification of iron, aluminum, cadium, mercury, salt, and other heavy metals and toxins); pathogen interactions/control (including chemical repellents (includes glucosinolates (GSL), which release pathogen-controlling isothiocyanates); and changes in soil properties, (such as Ph, mineral depletion, and rhizosheath).

3) Transport of Materials in Plants

Uptake of nutrients by roots produces a "source-sink" effect in a plant. The greater the source of nutrients, the larger "sinks," such as stems, leaves, flowers, seeds, fruits, etc. can grow. Thus, root genes and gene products are useful to modulate the vigor and yield of the plant overall as well as distinct cells, organs, or tissues. The root genes and gene products are, therefore, useful to modulate vigor (including plant nutrition, growth rate (such as whole plant, including height, flowering time, etc.), seedling, coleoptile elongation, young leaves, stems, flowers, seeds, fruit, and yield (including biomass (such as fresh and dry weight during any time in plant life, including maturation and senescence), root/tuber yield (such as number, size, weight, harvest index, content and composition, (i.e. amino acid, jasmonate, oil, protein and starch), number of flowers, seed yield, number, size, weight, harvest index, content and composition (e.g. amino acid, jasmonate, oil, protein and starch), and fruit yield (such as number, size, weight, harvest index, post harvest quality, content and composition, (e.g. amino acid, jasmonate, oil, protein and starch).

Additional Uses of Plants with Modified Roots

Plants with roots modified in one or more of the properties described above are used to provide:

A. Higher vigor and yield of plants and harvested products due to pathogen resistance from conditioning the soil with plant-derived chemicals and/or more tolerance to stresses such as drought, flooding and anoxia.

B. Better Animal (Including Human) Nutrition

C. Improved Dietary Mineral Nutrition

D. Better Plant Survival
   (a) Decreased Lodging
   (b) More Efficient Transport
   (c) More Efficient Physiology
   (d) More Efficient Metabolism E. Better Resistance To Plant Density Effects F. Increased Yield Of Valuable Molecules G. More Efficient Root Nodulation H. Better Access To Rhizobia Spray Application, For Anaerobic Soils I. Easier Crop Harvesting And Ground Tillage J. Decreased Soil Erosion To regulate any of the phenotype(s) above, activities of one or more of the root genes or gene products is modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Dolan et al. (1993, Development 119: 71-84), Dolan et al. (1997, Development 124: 1789-98), Crawford and Glass (1998, Trends Plant Science 3: 389-95), Wang et al. (1998, PNAS USA 95: 15134-39), Gaxiola et al. (1998, PNAS USA 95: 4046-50), Apse et al. (1999, Science 285: 1256-58), Fisher and Long (1992, Nature 357: 655-60), Schneider et al. (1998, Genes Devel 12: 2013-21) and Hirsch (1999, Curr Opin Plant Biol. 2: 320-326).

III.A.1.c. Use of Root Genes to Modulate Biochemical Activities

The activities of one or more of the root genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Association Of Root Morphology With Nitrogen Fixing Bacteria | Cell-Cell Recognition Cell Wall Degradation | Gage et al. (1996) J Bacteriol 178: 7159-66 |
| Primary Root, Lateral Root, And Root Hair Initiation Spacing Elongation Branching | Cell Division/Elongation Cell Differentiation Cell Expansion Auxin Mediated Response Pathways | Schneider et al. (1998) Genes Devel 12: 2013-21 Casimiro et al. (2001). Plant Cell 13: 843-852. Rogg et al. (2001). Plant Cell 13: 465-480. Gaedeke et al. (2001). EMBO J. 20: 1875-1887. Neuteboom et al. (1999). Plant Mol. Biol. 39: 273-287. Schindelman et al. (2001). Genes and Dev. 15: 1115-1127. Rashotte et al. (2001) Plant Cell 13: 1683-1697. Zhang et al. (2000). J Exp Bot 51: 51-59. Zhang et al. (1998) Science 279: 407-409. |
| Metabolism | Organic Molecule Export | Moody et al. (1988) Phytochemistry 27: 2857-61. |
| | Ion Export | Uozumi et al. (2000) Plant Physiol 122: 1249-59 Frachisse et al. (2000) Plant J 21: 361-71 |
| | Nutrient Uptake | Frachisse et al. (2000) Plant J 21: 361-71 Uozumio et al. (2000) Plant Physiol 122: 1249-59 Williamson et al. (2001). Plant Physiol. 126: 875-882. Zhang et al. (2000). J Exp Bot 51: 51-59. Zhang et al. (1998). Science 279: 407-409. Coruzzi et al. (2001). Plant Physiol. 125: 61-64. |
| Root Gravitropism And Waving | Reactive Oxygen Species (ROS) Such As Superoxide Anions And $H_2O_2$ Production Auxin Transport Pathways Flavonoid Inhibition Of Auxin Transport Function Changes In Root Cap Ph Starch Synthesis And Storage Cell Differentiation Cell Elongation | Joo et al. (2001) Plant Physiol. 126: 1055-60. Vitha et al. (2000). Plant Physiol. 122: 453-461. Tasaka et al. (2001) Int Rev Cytol 206: 135-54. Brown et al. (2001) Plant Physiol 126: 524-35. Fasano et al. (2001) Plant Cell 13: 907-22. MacCleery et al. (1999). Plant Physiol 120: 183-92 Blancaflor et al. (1998). Plant Physiol 116: 213-22 Schneider et al. (1998) Genes Devel 12: 2013-21 |

Other biological activities that can be modulated by the root genes and gene products are listed in the Reference tables. Assays for detecting such biological activities are described in the Protein Domain table.

III.A.1.d. Use of Root Genes to Modulate Transcription Levels of Plant Genes

Many genes are "up regulated" or "down regulated" because they belong to networks or cascades of genes. Thus some root genes are capable of regulating many other gene activities via these networks and hence complex phenotypes. Examples of transcription profiles of root genes are described in the Table below with associated biological activities. "Up-regulated" profiles are those where the concentrations of the mRNA in total mRNA are higher in roots as compared to aerial parts of a plant; and vice-versa for "down-regulated" profiles.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up Regulated Transcripts | Genes Expressed In Root Development Responders To Micro-Organismal Symbionts And Parasites Genes involved in polar Auxin transport Genes involved in starch deposition in the roots Genes involved in production of reactive oxygen species Genes involved in flavonoid synthesis | Primary Root, Lateral Root, and/or Root Hair Growth and Differentiation Microorganism Perception Entrapment Of Microorganismal Symbionts Nutrient Uptake Synthesis Of Metabolites And/Or Proteins Modulation Of Transduction Pathways Specific Gene Transcription Initiation Nutrient Uptake Enhancement Gravitropic growth of roots Associations with rhizobia are stimulated | Transporters Metabolic Enzymes Change In Cell Membrane Structure And Potential Kinases, Phosphatases, G-Proteins Transcription Activators Change In Chromatin Structure And/Or Localized DNA Topology Cell Wall Proteins $Ca^{++}$ Fluctuation Reactive Oxygen Species (ROS) production |
| Down-Regulated Transcripts | Genes Repressed In Root Development Responders To Micro-Organismal Symbionts And Parasites Genes With Discontinued Expression Or UnsTable mRNA In Presence Of Root And/Or Micro-Organismal Symbionts | Negative Regulation Of Primary Root, Lateral Root, and/or Root Hair Production Released Changes In Pathways And Processes Operating In Cells Changes In Metabolism Inhibition of root gravitropism | Transcription Factors Kinases, Phosphatases, G-Proteins Change In Chromatin Structure And/Or DNA Topology Stability Of Factors For Protein Synthesis And Degradation Metabolic Enzymes |

Changes in the function or development of roots are the result of modulation of the activities of one or more of these many root genes and gene products. These genes and/or products are responsible for effects on traits such as plant vigor and seed yield, especially when plants are growing in the presence of soil borne biotic or abiotic stresses or when they are growing in barren conditions or in soils depleted of certain minerals.

Root genes, gene components and gene products can act alone or in combination as described in the introduction. Of particular interest are combinations of these genes and gene products with those that modulate stress tolerance and/or metabolism. Stress tolerance and metabolism genes and gene products are described in more detail in the sections below.

Use of Promoters of Root Genes

Promoters of root genes, as described in the Reference tables, for example, can be used to modulate transcription that is induced by root development or any of the root biological processes or activities above. For example, when a selected polynucleotide sequence is operably linked to a promoter of a root gene, then the selected sequence is transcribed in the same or similar temporal, development or environmentally-specific patterns as the root gene from which the promoter was taken. The root promoters can also be used to activate antisense copies of any coding sequence to achieve down regulation of its protein product in roots. They can also be used to activate sense copies of mRNAs by RNA interference or sense suppression in roots.

III.A.2. Root Hair Genes, Gene Components and Products

Root hairs are specialized outgrowths of single epidermal cells termed trichoblasts. In many and perhaps all species of plants, the trichoblasts are regularly arranged around the perimeter of the root. In *Arabidopsis*, for example, trichoblasts tend to alternate with non-hair cells or atrichoblasts. This spatial patterning of the root epidermis is under genetic control, and a variety of mutants have been isolated in which this spacing is altered or in which root hairs are completely absent.

III.A.2.a. Identification of Root Hair Genes

Root hair genes identified herein are defined as genes, gene components and products capable of modulating one or more processes in or the function of root hairs as described below. Root hairs are capable of controlling or influencing many plant traits, also as shown below. Examples of such root hair development genes and gene products are shown in the Reference and Sequence Tables. The protein products of many of these genes are also identified in these Tables.

Root Hair Genes Identified by Differential Expression

These genes were discovered and characterized from a much larger set of genes by experiments designed to find genes whose mRNA products are associated specifically with root hairs. These experiments made use of the *arabidopsis* mutant "root hairless" (rhl), which does not develop root hairs. By comparing gene expression profiles of rhl roots with those of wild type roots grown in identical conditions, genes specifically expressed in root hairs were revealed. The MA_diff Table(s) reports the transcript levels of the experiment (see EXPT ID: 108594, 108433). For transcripts that had higher levels in the samples than the control, a "+" is shown. A "−" is shown for when transcript levels were reduced in root tips as compared to the control. For more experimental detail see the Example section below.

Root Hairs genes are those sequences that showed differential expression as compared to controls, namely those sequences identified in the MA_diff tables with a "+" or "−" indication.

Root Hairs Genes Identified by Cluster Analyses of Differential Expression

Root Hairs Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Root Hairs genes is any group in the MA_clust that comprises a cDNA ID that also appears in Expt ID 108594, 108433 the MA_diff table(s).

Root Hairs Genes Identified by Correlation to Genes that Cause Physiological Consequences Additionally, the differential expression data and the phenotypic observations can be merged to identify pathways or networks of Root Hairs genes. A group in the MA_clust is considered a Root Hairs pathway or network if the group comprises a cDNA ID that also appears in Knock-in or Knock-out tables that causes one or more of the phenotypes described in section above.

Root Hairs Genes Identified by Amino Acid Sequence Similarity

Root Hairs genes from other plant species typically encode polypeptides that share amino acid similarity to the sequences encoded by corn and *Arabidopsis* Root Hairs genes. Groups of Root Hairs genes are identified in the Protein Group table. In this table, any protein group that comprises a peptide ID that corresponds to a cDNA ID member of a Root Hairs pathway or network is a group of proteins that also exhibits Root Hairs functions/utilities.

Examples of phenotypes, biochemical activities, and transcript profiles that can be modulated by these genes and gene products are described above and below.

III.A.2.b. Use of Root Hair Development Genes to Modulate Phenotypes

The root hair development genes of the instant invention are useful to modulate one or more processes of root hair structure and/or function including (1) development; (2) interaction with the soil and soil contents; (3) uptake and transport in the plant; and (4) interaction with microorganisms.

1.) Development

The surface cells of roots can develop into single epidermal cells termed trichoblasts or root hairs. Some of the root hairs will persist for the life of the plant; others will gradually die back; some may cease to function due to external influences. The genes and gene products of this invention are useful to modulate any one or all of these growth and development process generally, as in root hair density or root hair growth; including rate, timing, direction, and size, for example. Processes that are regulated by these genes and gene products include cell properties such as cell size, cell division, rate and direction and number, cell elongation, cell differentiation, lignified cell walls, epidermal cells (including trichoblasts) and root apical meristem cells (growth and initiation); and root hair architecture such as leaf cells under the trichome, cells forming the base of the trichome, trichome cells, and root hair responses.

The genes and gene products of this invention are useful to modulate one or more of the growth and development processes in response to internal plant programs or environmental stimuli in, for example, the seminal system, nodal system, hormone responses, Auxin, root cap abscission, root senescence, gravitropism, coordination of root growth and development with that of other organs (including leaves, flowers, seeds, fruits, and stems), and changes in soil environment (including water, minerals, Ph, and microfauna and flora).

2.) Interaction with Soil and Soil Contents

Root hairs are sites of intense chemical and biological activity and as a result can strongly modify the soil they contact. Roots hairs can be coated with surfactants and mucilage to facilitate these activities. Specifically, roots hairs are responsible for nutrient uptake by mobilizing and assimilating water, reluctant ions, organic and inorganic compounds and chemicals. In addition, they attract and interact with beneficial microfauna and flora. Root hairs also help to mitigate the effects of toxic ions, pathogens and stress. Examples of root hair properties and activities that the genes and gene products of the invention are useful to modulate include root hair surfactant and mucilage (including composition and secretion rate and time); nutrient uptake (including water, nitrate and other sources of nitrogen, phosphate, potassium, and micronutrients (e.g. iron, copper, etc.); microbe and nematode associations (such as bacteria including nitrogen-fixing bacteria, mycorrhizae, nodule-forming and other nematodes, and nitrogen fixation); oxygen transpiration; detoxification effects of iron, aluminum, cadium, mercury, salt, and other soil constituents; pathogens (including chemical repellents) glucosinolates (GSL1), which release pathogen-controlling isothiocyanates; and changes in soil (such as Ph, mineral excess and depletion), and rhizosheath.

3.) Transport of Materials in Plants

Uptake of the nutrients by the root and root hairs contributes a source-sink effect in a plant. The greater source of nutrients, the more sinks, such as stems, leaves, flowers, seeds, fruits, etc. can draw sustenance to grow. Thus, root hair development genes and gene products are useful to modulate the vigor and yield of the plant overall as well as of distinct cells, organs, or tissues of a plant. The genes and gene products, therefore, can modulate Vigor, including plant nutrition, growth rate (such as whole plant, including height, flowering time, etc., seedling, coleoptile elongation, young leaves, stems, flowers, seeds and fruit) and yield, including biomass (fresh and dry weight during any time in plant life, including maturation and senescence), number of flowers, number of seeds, seed yield, number, size, weight and harvest index (content and composition, e.g. amino acid, jasmonate, oil, protein and starch) and fruit yield (number, size, weight, harvest index, and post harvest quality).

Additional Uses of Plants with Modified Root Hairs

Plants with root hairs modified in one or more of the properties described above are used to provide:

A. Higher vigor and yield of plant and harvested products due to pathogen resistance from conditioning the soil with plant-derived chemicals and/or more tolerance to stresses such as drought, flooding and anoxia
B. Better Animal (Including Human) Nutrition
C. Improved Dietary Mineral Nutrition
D. Increased Plant Survival By Decreasing Lodging
E. Better Plant Survival By:
  (a) Decreased Lodging
  (b) More Efficient Transport
  (c) More Efficient Physiology
  (d) More Efficient Metabolism F. Increased Yield Of Valuable Molecules Root Hair Modulation To regulate any of the phenotype(s) above, activities of one or more of the root hair genes or gene products is modulated and tested by screening for the desired trait. Specifically, the gene, mRNA levels, or protein levels are altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Dolan et al. (1993, Development 119: 71-84), Dolan et al. (1997, Development 124: 1789-98), Crawford and Glass (1998, Trends Plant Science 3: 389-95), Wang et al. (1998, PNAS USA 95: 15134-39), Gaxiola et al. (1998, PNAS USA 95: 4046-50), Apse et al. (1999, Science 285: 1256-58), Fisher and Long (1992, Nature 357: 655-60), Schneider et al. (1998, Genes Devel 12: 2013-21) and Hirsch (1999, Curr Opin Plant Biol. 2: 320-326).

III.A.2.c. Use of Root Hair Development Genes to Modulate Biochemical Activities The activities of one or more of the root hair development genes can be modulated to change biochemical or metabolic activities and/or pathways such as those noted below. Such biological activities can be measured according to the citations included in the table below:

| Process | Biochemical Or Metabolic Activities And/Or Pathways | Citations Including Assays |
| --- | --- | --- |
| Association Of Root Hair With Nitrogen Fixing Bacteria | Functions Associated With Root Hair Curling And Signal Transduction | Gage et al. (1996) J Bacteriol 178: 7159-66 |
| Root Hair Spacing Initiation |  | Schneider et al. (1998) Genes Devel 12: 2013-21 |
| Elongation Metabolism | Organic Molecule Export | Moody et al. (1988) Phytochemistry 27: 2857-61 |
|  | Ion Export | Uozumi et al. (2000) Plant Physiol 122: 1249-59 Frachisse et al. (2000) Plant J 21: 361-71 |
| Nutrient Uptake | Nutrient Uptake | Frachisse et al. (2000) Plant J 21: 361-71 Uozumio et al. (2000) Plant Physiol 122: 1249-59 |

Other biological activities that can be modulated by the root hair genes and gene products are listed in the Reference tables. Assays for detecting such biological activities are described in the Protein Domain table.

III.A.2.d. Use of Root Hair Genes, Gene Components and Product to Modulate Transcription Levels Many genes are "up regulated" or "down regulated" in root hairs or associated with root hair formation because genes are regulated in networks. Thus some root hairs genes are useful to regulate the activities of many other genes, directly or indirectly to influence complex phenotypes. Examples of transcription profiles of root genes are described in the Table below with associated biological activities. "Up regulated" profiles are those where the mRNA levels are higher when the rhl gene is inhibited as compared to when rhl gene is not inhibited; and vice-versa for "down-regulated" profiles.

| Transcript Levels | Type Of Genes | Physiological Consequences | Examples Of Biochemical Activity |
|---|---|---|---|
| Down Regulated Transcripts | Genes Expressed In Root Hair Development Responders To Micro-Organismal Symbionts And Parasites | Root Hair Formation Microorganism Perception Entrapment Of Microorganismal Symbionts Nutrient Uptake Synthesis Of Metabolites And/Or Proteins Modulation Of Transduction Pathways Specific Gene Transcription Initiation Nutrient Uptake Enhancement | Transporters Metabolic Enzymes Change In Cell Membrane Structure And Potential Kinases, Phosphatases, G-Proteins Transcription Activators Change In Chromatin Structure And/Or Localized DNA Topology Cell Wall Proteins |
| Up-Regulated Transcripts | Genes Repressed In Roots Making Hairs Responders To Micro-Organismal Symbionts And Parasites Genes With Discontinued Expression Or UnsTable mRNAIn Presence Of Root Hairs And/Or Micro-Organismal Symbionts | Negative Regulation Of Hair Production Released Changes In Pathways And Processes Operating In Cells Changes In Metabolism | Transcription Factors Kinases, Phosphatases, G-Proteins Change In Chromatin Structure And/Or DNA Topology Stability Of Factors For Protein Synthesis And Degradation Metabolic Enzymes Cell Wall Proteins |

Changes in the patterning or development of root hairs are the result of modulation of the activities of one or more of these many root hair genes and gene products. These genes and/or products are responsible for effects on traits such as plant vigor and seed yield, especially when plants are growing in the presence of biotic or abiotic stresses or when they are growing in barren conditions or in soils depleted of certain minerals.

Root hair genes and gene products can act alone or in combination as described in the introduction. Of particular interest are combination of these genes and gene products with those that modulate stress tolerance and/or metabolism. Stress tolerance and metabolism genes and gene products are described in more detail in the sections below.

Use of Promoters of Root Hair Genes

Promoters of root hair development genes, as described in the Reference tables, for example, are useful to modulate transcription that is induced by root hair development or any of the following phenotypes or biological activities above. For example, any desired sequence can be transcribed in similar temporal, tissue, or environmentally-specific patterns as the root hair genes when the desired sequence is operably linked to a promoter of a root hair responsive gene.

III.A.3. Leaf Genes, Gene Components and Products

Leaves are responsible for producing most of the fixed carbon in a plant and are critical to plant productivity and survival. Great variability in leaf shapes and sizes is observed in nature. Leaves also exhibit varying degrees of complexity, ranging from simple to multi-compound. Leaf genes as defined here, not only modulate morphology, but also influence the shoot apical meristem, thereby affecting leaf arrangement on the shoot, internodes, nodes, axillary buds, photosynthetic capacity, carbon fixation, photorespiration and starch synthesis. Leaf genes elucidated here can be used to modify a number of traits of economic interest from leaf shape to plant yield, including stress tolerance, and to modify the efficiency of synthesis and accumulation of specific metabolites and macromolecules.

III.A.3.a. Identification of Leaf Gene, Gene Components and Products

Leaf genes identified herein are defined as genes, active or potentially active to greater extent in leaves than in some other organs of the plant or as genes that affect leaf properties. These genes and gene components are useful for modulating one or more processes in or functions of leaves, as described below, to improve plant traits ranging from yield to stress tolerance. Examples of such leaf genes and gene products are shown in the Reference and Sequence Tables and sequences encoding polypeptides of the Protein Group and Protein Group Matrix tables or fragments thereof, Knock-In, Knock-Out and MA_diff Tables. The biochemical functions of the protein products of many of these genes determined from comparisons with known proteins are also given in the Reference tables.

Leaf Genes Identified by Phenotypic Observations

Some leaf genes were discovered and characterized from a much larger set of genes by experiments designed to find genes that cause phenotypic changes in leaf, petiole, internode, and cotyledon morphology.

In these experiments, leaf genes were identified by either (1) ectopic expression of a cDNA in a plant or (2) mutagenesis of the plant genome. The plants were then cultivated and one or more of the following leaf phenotypes, which varied from the parental "wild-type", were observed:

A. Changes In Seedling Stage Cotyledons
   Cup Shaped
   Curled
   Horizontally Oblong
   Long Petioles
   Short Petioles
   Silver
   Tricot
   Wilted
B. Changes In Rosette And Flowering Stage Leaf Shapes
   Cordate
   Cup-Shaped
   Curled
   Fused
   Lanceolate
   Lobed
   Long Petioles
   Short Petioles
   Oval
   Ovate
   Serrate
   Trident
   Undulate
   Vertically Oblong
C. Changes In Cauline, Flowering Leaf Shape
   Misshapen
   Other
D. Changes In Leaf Pigment
   Albino
   Dark Green Pigment
   High Anthocyanin
   Interveinal Chlorosis
   Yellow Pigment
E. Changes In Leaf Size
F. Changes In Seedling Stage Hypocotyl
   Long
   Short
G. Changes In Leaf Number
H. Changes In Wax Deposition
   Glossy Rosette And Flowering Stage Leaves
   Altered Wax Deposition On The Bolt Leaf Genes Identified by Differential Expression Also, leaf genes were identified in experiments in which the concentration of mRNA products in the leaf, or stem, or Knock-out mutant 3642-1 were compared with to a control. The MA_diff Table(s) reports the transcript levels of the experiment (see EXPT ID: 108477, 108512, 108497, 108498, 108598). For transcripts that had higher levels in the samples than the control, a "+" is shown. A "−" is shown for when transcript levels were reduced in root tips as compared to the control. For more experimental detail see the Example section below.

Leaf genes are those sequences that showed differential expression as compared to controls, namely those sequences identified in the MA_diff tables with a "+" or "−" indication.

Leaf Genes Identified by Cluster Analyses of Differential Expression

Leaf Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Leaf genes is any group in the MA_clust that comprises a cDNA ID that also appears in Expt ID 108477, 108512, 108497, 108498, 108598 of the MA_diff table(s).

Leaf Genes Identified by Correlation to Genes that Cause Physiological Consequences Additionally, the differential expression data and the phenotypic observations can be merged to identify pathways or networks of Leaf genes. A group in the MA_clust is considered a Leaf pathway or network if the group comprises a cDNA ID that also appears in Knock-in or Knock-out tables that causes one or more of the phenotypes described in section above.

Leaf Genes Identified by Amino Acid Sequence Similarity

Leaf genes from other plant species typically encode polypeptides that share amino acid similarity to the sequences encoded by corn and *Arabidopsis* Leaf genes. Groups of Leaf genes are identified in the Protein Group table. In this table, any protein group that comprises a peptide ID that corresponds to a cDNA ID member of a Leaf pathway or network is a group of proteins that also exhibits Leaf functions/utilities.

It is assumed that (i) the genes preferentially expressed in leaves are concerned with specifying leaf structures and the synthesis of all the constituent molecules and (ii) that the genes repressed in leaves specify products that are not required in leaves or that could inhibit normal leaf development and function.

Examples of phenotypes, biochemical activities, and transcription profiles that are modulated by using selected members of these genes and gene products, singly or in combination, are described below.

III.A.3.b. Use of Leaf Genes, Genes Components and Products to Modulate Phenotypes Leaves are critical for the performance and industrial utility of plants. There is extensive evidence that the number, size, shape, position, timing of synthesis, timing of senescence and chemical constitution are very important for agriculture, horticulture and uses of plants as chemical factories for making valuable molecules. Many improvements already demonstrated over past decades have involved genetic modifications to leaves. Therefore, the leaf genes and gene components of this invention offer considerable opportunities for further improving plants for industrial purposes. When the leaf genes and/or gene components are mutated or regulated differently, they are capable of modulating one or more of the processes determining leaf structure and/or function including (1) development; (2) interaction with the environment and (3) photosynthesis and metabolism.

1.) Development

The leaf genes, gene components and products of the instant invention are useful to modulate one or more processes of the stages of leaf morphogenesis including: stage 1—organogenesis that gives rise to the leaf primordium; stage 2—delimiting basic morphological domains; and stage 3—a coordinated processes of cell division, expansion, and differentiation. Leaf genes include those genes that terminate as well as initiate leaf development. Modulating any or all of the processes leads to beneficial effects either at specific locations or throughout the plant, such as in the cotyledons, major leaves, cauline leaves, or petioles.

Leaf genes, gene components and gene products are useful to modulate changes in leaf cell size, cell division (rate and direction), cell elongation, cell differentiation, stomata size, number, spacing and activity, trichome size and number, xylem and phloem cell numbers, cell wall composition, and all cell types. The leaf genes are also useful to modulate to change overall leaf architecture, including veination (such as improvements in photosynthetic efficiency, stress tolerance efficiency of solute and nutrient movement to and from the leaf are accomplished by increases or decreases in vein placement and number of cells in the vein); shape, either elongated versus rounded or symmetry, around either (e.g. abaxial-adaxial (dorsiventral) axis, apical-basal (proximodistal) axis, and margin-blade-midrib (lateral) axis; and branching (improved plant performance to biotic and abiotic stress in heavy density planting is achieved by increases or decreases in leaf branch position or leaf branch length).

Shoot apical meristem cells differentiate to become leaf primordia that eventually develop into leaves. The genes, gene components and gene products of this invention are useful to modulate any one or all of these growth and development processes, by affecting timing and rate or planes of cell divisions for example, in response to the internal plant stimuli and/or programs such as embryogenesis; germination; hormones like Auxin leaf senescence; phototropism; coordination of leaf growth and development with that of other organs (such as roots, flowers, seeds, fruits, and stems; and stress-related programs.

2.) Interaction with the Environment

Leaves are the main sites of photosynthesis and have various adaptations for that purpose. Flat laminae provide a large surface for absorbing sunlight; leaves are rich in chloroplasts and mitochondria; stomata in the lower surface of the laminae allow gases to pass into and out of the leaves including water; and an extensive network of veins brings water and minerals into the leaves and transports the sugar products produced by photosynthesis to the rest of the plant. examples of leaf properties or activities that are modulated by leaf genes, gene components and their products to facilitate interactions between a plant and the environment including pigment accumulation; wax accumulation on the surface of leaves (e.g. improved protection of young leaves from water borne pathogen attack such as downey mildew with increased wax production); oxygen gain/loss control; carbon dioxide gain/loss control; water gain/loss control; nutrient transport; light harvesting; chloroplast biogenesis; circadian rhythm control; light/dark adaptation; defense systems against biotic and abiotic stresses; metabolite accumulation; and secondary metabolite production in leaf mesophyl, epidermis and trichomes (such as increases in antifeeding secondary metabolites such as strictosiden reduce herbivory and decreases in secondary metabolites improve plants as forage by reducing allergens or undigestible compounds).

3.) Photosynthesis and Metabolism

Many of the uses for plants depend on the success of leaves as the powerhouses for plant growth, their ability to withstand stresses and their chemical composition. Leaves are organs with many different cell types and structures. Most genes of a plant are active in leaves and therefore leaves have very diverse of pathways and physiological processes. Pathways and processes that are modulated by leaf genes, gene components and products include photosynthesis, sugar metabolism, starch synthesis, starch degradation, nitrate and ammonia metabolism, amino acid biosynthesis, transport, protein biosynthesis, dna replication, repair, lipid biosynthesis and breakdown, protein biosynthesis, storage and breakdown, nucleotide transport and metabolism, cell envelope biogenesis, membrane formation, mitochondrial and chloroplast biogenesis, transcription and RNA metabolism, vitamin biosynthesis, steroid and terpenoid biosynthesis, devise secondary metabolite synthesis, co-enzyme metabolism, flavonoid biosynthesis and degradation, synthesis of waxes, glyoxylate metabolism, and hormone perception and response pathways.

Uses of Plants that are Modified as Described Above

Altering leaf genes or gene products in a plant modifies one or more plant traits, to make the plants more useful for specific purposes in agriculture, horticulture and for the production of valuable molecules. The modified plant traits include A higher yield of leaves and their molecular constituents (due to different number, size, weight, harvest index, composition including and amounts and types of carbohydrates, proteins, oils, waxes, etc.; photosynthetic efficiency (e.g. reduced photorespiration), absorption of water and nutrients to enhance yields, including under stresses such as high light, herbicides, and heat, pathways to accumulate new valuable molecules); more optimal leaf shape and architecture—enhancing photosynthesis and enhancing appeal in ornamental species (including size, number, pigment, and aroma; a better overall plant architecture—enhancing photosynthesis and enhancing appeal in ornamental species petals, sepals, stamens, and carpels; better shade avoidance for maximizing photosynthesis by, for example, altering leaf placement, to improve light capture and photosynthetic efficiency, thereby increasing yields; Reduced negative effects of high planting density, by altering leaf placement to be more vertical instead of parallel to the ground, for instance; More resistance to the deleterious effects of wind and mechanical damage; Better stress tolerance (including without limitation drought resistance, by decreasing water loss, and pathogen resistance, including, for instance, insect resistance through internal insecticide levels and optimizing the leaf shape to prevent runoff of insecticides); and better overall yield and vigor.

Plant yield of biomass and of constituent molecules and plant vigor are modulated to create benefits by genetically changing the growth rate of the whole plant, (including height, flowering time, etc.), seedling, coleoptile elongation, young leaves flowers, seeds, and/or fruit, or by changing the biomass, including fresh and dry weight during any time in plant life, (including maturation and senescence), number of flowers, seed yield including for example, number, size, weight, harvest index, content and composition (e.g. amino acid, jasmonate, oil, protein and starch0, and fruit yield (such as number, size, weight, harvest index, content and composition, e.g. amino acid, jasmonate, oil, protein and starch).

To change any of the phenotype(s) in I, II, or III above, activities of one or more of the leaf genes or gene products are modulated in an organism and the consequence evaluated by screening for the desired trait. Specifically, the gene, mRNA levels, or protein levels are altered in a plant utilizing the procedures described herein and the phenotypes can be assayed. As an example, a plant can be transformed according to Bechtold and Pelletier (Methods. Mol. Biol. 82:259-266 (1998)) with leaf gene constructs and/or screened for variants as in Winkler et al., Plant Physiol. 118: 743-50 (1998) and visually inspected for the desired phenotype and metabolically and/or functionally assayed for altered levels of relevant molecules.

III.A.3.c. Use of Leaf Genes, Gene Components and Products to Modulate Biochemical Activities Leaves are complex organs and their structure, function and properties result from the integration of many processes and biochemical activities. Some of these are known from the published literature and some can be deduced from the genes and their products described in this application. Leaf genes, and gene components are used singly or in combination to modify these processes and biochemical activities and hence modify the phenotypic and trait characteristics described above. Examples of the processes and metabolic activities are given in the Table

| PROCESS | BIOCHEMICAL OR METABOLIC ACTIVITIES AND/OR PATHWAYS | CITATIONS INCLUDING ASSAYS |
|---|---|---|
| Metabolism - anabolic and catabolic | Farnesylation Cell Wall Biosynthesis Nitrogen Metabolism Secondary Metabolite Biosynthesis and Degradation | Pei et al., *Science* 282: 287-290 (1998); Cutler et al., *Science* 273: 1239 (1996) Goupil et al., *J Exptl. Botany* 49: 1855-62 (1998) Walch-Liu et al., *J Exppt. Botany* 51, 227-237 (2000) |
| Water Conservation And Resistance To Drought And Other Related Stresses | Stomatal Development And Physiology Production of polyols Regulation of salt concentration ABA response(s) | Allen et al., *Plant Cell* 11: 1785-1798 (1999) Li et al., *Science* 287: 300-303 (2000) Burnett et al., *J Exptl. Botany* 51: 197-205 (2000) |
| Transport Anion and Cation Fluxes | Ca2+ Accumulation K+ Fluxes Na+ Fluxes Receptor - ligand binding Anion and Cation fluxes | Raschke, In: *Stomatal Function*, Zeiger et al. Eds., 253-279 (1987) Lacombe et al., *Plant Cell* 12: 837-51 (2000); Wang et al., *Plant Physiol.* 118: 1421-1429 (1998); Shi et al., *Plant Cell* 11: 2393-2406 (1999) Gaymard et al., *Cell* 94: 647-655 (1998) Jonak et al., *Proc. Natl. Acad. Sci.* 93: 11274-79 (1996); Sheen, *Proc. Natl. Acad. Sci.* 95: 975-80 (1998); Allen et al., *Plant Cell* 11: 1785-98 (1999) |
| Carbon Fixation | Calvin Cycle Photorespiration Oxygen evolution RuBisCO Chlorophyll metabolism Chloroplast Biogenesis and Metabolism Fatty Acid and Lipid Biosynthesis Glyoxylate metabolism Sugar Transport Starch Biosynthesis and Degradation | Wingler et al., *Philo Trans R Soe Lond B Biol Sci* 355, 1517-1529 (2000); Palecanda et al., *Plant Mol Biol* 46, 89-97 (2001); Baker et al., *J Exp Bot* 52, 615-621 (2001) Chen et al., *Acta Biochim Pol* 41, 447-457 (1999) Imlau et al., *PlantCell* II, 309-322 (1999) |
| Hormone Perception and Growth | Hormone Receptors and Downstream Pathways for ethylene jasmonic acid brassinosteroid gibberellin Auxin cytokinin Activation Of Specific Kinases And Phosphatases | Tieman et al., *Plant J* 26, 47-58 (2001) Hilpert et al., *Plant J* 26, 435-446 (2001) Wenzel et al., *Plant Phys* 124, 813-822 (2000) Dengler and Kang, *Curr Opin Plant Biol* 4, 50-56 (2001) Tantikanjana et al., *Genes Dev* 15, 1577-1580 (2001) |

Other biological activities that are modulated by the leaf genes and gene products are listed in the Reference tables. Assays for detecting such biological activities are described in the Protein Domain table, for example.

III.A.3.d. Use of Leaf Genes, Gene Components and Products to Modulate Transcription Levels The expression of many genes is "upregulated" or down-regulated" in leaves because some leaf genes and their products are integrated into complex networks that regulate transcription of many other genes. Some leaf genes, gene components and products are therefore useful for modifying the transcription of other genes and hence complex phenotypes, as described above. Profiles of leaf gene activities are described in the Table below with associated biological activities. "Up-regulated" profiles are those where the mRNA transcript levels are higher in leaves as compared to the plant as a whole. "Down-regulated" profiles represent higher transcript levels in the whole plant as compared to leaf tissue only.

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES OF GENE PRODUCTS WITH MODIFIED LEVELS |
|---|---|---|---|
| Up Regulated Transcripts | Genes Involved In Leaf Cell | Leaf Cells Proliferate And | Transcription Factors, Signal |

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES OF GENE PRODUCTS WITH MODIFIED LEVELS |
|---|---|---|---|
| | Differentiation, Cell Division, Cell Expansion | Differentiate; | Transduction Proteins, Kinase And Phosphatases |
| | Genes Involved In Positive Regulation Of Leaf Genes Repressors Of Root And Other Non Leaf Cell Types | Leaf Structures Form And Expand | Chromatin Remodeling Hormone Biosynthesis Enzymes Receptors |
| | Genes Involved In Photosynthesis | Photosynthesis And Plastid Differentiation | Light Harvesting Coupled To ATP Production Chlorophyll Biosynthesis |
| | | Calvin Cycle Activated Chloroplast Biogenesis And Plastid Differentiation Activated | Ribulose Bisphosphate Carboxylase Chloroplast Membranes Synthesis Chloroplast Ribosome Biogenesis |
| | Other Genes Involved In Metabolism | Starch Biosynthesis Lipid Biosynthesis Nitrogen Metabolism —NO$_3$ Reduced And Amino Acids Made Secondary Metabolites Produced | Starch Synthase Nitrate Reductase Terpenoid Biosynthesis Transcription Factors Transporters Kinases Phosphatases And Signal Transduction Protein Chromatin Structure Modulators |
| Down Regulated Genes | Genes Involved In Negative Regulation Of Leaf Genes | Leaf Genes Activated And Leaf Functions Induced; Dark-Adapted Metabolism Suppressed Meristematic Genes Suppressed Leaf Metabolic Pathways Induced | Transcription Factors Signal Transduction Proteins - Kinases And Phosphatases Metabolic Enzymes Chromatin Remodeling Proteins |

While leaf polynucleotides and gene products are used singly, combinations of these polynucleotides are often better to optimize new growth and development patterns. Useful combinations include different leaf polynucleotides and/or gene products with a hormone responsive polynucleotide. These combinations are useful because of the interactions that exist between hormone-regulated pathways, nutritional pathways and development.

Use of Leaf Gene Promoters

Promoters of leaf genes are useful for transcription of desired polynucleotides, both plant and non-plant. If the leaf gene is expressed only in leaves, or specifically in certain kinds of leaf cells, the promoter is used to drive the synthesis of proteins specifically in those cells. For example, extra copies of carbohydrate transporter cDNAs operably linked to a leaf gene promoter and inserted into a plant increase the "sink" strength of leaves. Similarly, leaf promoters are used to drive transcription of metabolic enzymes that alter the oil, starch, protein, or fiber contents of a leaf. Alternatively, leaf promoters direct expression of non-plant genes that can, for instance, confer insect resistance specifically to a leaf. Additionally the promoters are used to synthesize an antisense mRNA copy of a gene to inactivate the normal gene expression into protein. The promoters are used to drive synthesis of sense RNAs to inactivate protein production via RNA interference.

III.A.4. Trichome Genes and Gene Components

Trichomes, defined as hair-like structures that extend from the epidermis of aerial tissues, are present on the surface of most terrestrial plants. Plant trichomes display a diverse set of structures, and many plants contain several types of trichomes on a single leaf. The presence of trichomes can increase the boundary layer thickness between the epidermal tissue and the environment, and can reduce heat and water loss. In many species, trichomes are thought to protect the plant against insect or pathogen attack, either by secreting chemical components or by physically limiting insect access to or mobility on vegetative tissues. The stellate trichomes of *Arabidopsis* do not have a secretory anatomy, but at a functional level, they might limit herbivore access to the leaf in the field. In addition, trichomes are known to secrete economically valuable substances, such as menthol in mint plants.

III.A.4.a. Identification of Trichome Genes, Gene Components and Products

Trichome genes identified herein are defined as genes or gene components capable of modulating one or more processes in or functions of a trichome, as described below. These genes, their components and products are useful for modulating diverse plant traits from production of secondary metabolites to pathogen resistance. Examples of such trichome genes and gene products are shown in the Reference and Sequence Tables and sequences encoding polypeptides of the Protein Group and Protein Group Matrix tables or fragments thereof, Knock-in, Knock-out, MA-diff and MA-clust. The biochemical functions of the protein products of many of these genes determined from comparisons with known proteins are also given in the Reference tables.

Trichome Genes Identified by Phenotypic Observation

Trichome genes were discovered and characterized from a much larger set of genes by experiments designed to find genes that cause phenotypic changes in trichome number and morphology on leaf, internode, cotyledon, petiole, and inflorescence. In these experiments, trichome genes were identified by either (1) ectopic expression of a cDNA in a plant or (2) mutagenesis of the plant genome. The plants were then cultivated and one or more of the following phenotypes, which varied from parental "wild-type", were observed: (1) trichome number; (2) trichome spacing (clustering); or (3) trichome branching. The genes regulating trichome phenotypes are identified in the Knock-In and Knock-Out Tables.

Trichome Genes Identified by Differential Expression

Trichome genes were also discovered and characterized from a much larger set of genes by experiments designed to find genes whose mRNA products are associated specifically or preferentially with trichomes. These experiments made use of an *Arabidopsis glaborous* mutant and a hairy mutant. By comparing gene expression profiles of the glabrous mutant with those of the hairy mutant grown under identical conditions, genes specifically or preferentially expressed in trichomes were revealed. The MA_diff Table(s) reports the transcript levels of the experiment (see EXPT ID: 108452). For transcripts that had higher levels in the samples than the control, a "+" is shown. A "−" is shown for when transcript levels were reduced in root tips as compared to the control. For more experimental detail see the Example section below.

Trichome genes are those sequences that showed differential expression as compared to controls, namely those sequences identified in the MA_diff tables with a "+" or "−" indication.

Trichome Genes Identified by Cluster Analyses of Differential Expression

Trichome Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Trichome genes is any group in the MA_clust that comprises a cDNA ID that also appears in Expt ID 108452 of the MA_diff table(s).

Trichome Genes Identified by Correlation to Genes that Cause Physiological Consequences Additionally, the differential expression data and the phenotypic observations can be merged to identify pathways or networks of Trichome genes. A group in the MA_clust is considered a Trichome pathway or network if the group comprises a cDNA ID that also appears in Knock-in or Knock-out tables that causes one or more of the phenotypes described in section above.

Trichome Genes Identified by Amino Acid Sequence Similarity

Trichome genes from other plant species typically encode polypeptides that share amino acid similarity to the sequences encoded by corn and *Arabidopsis* Trichome genes. Groups of Trichome genes are identified in the Protein Group table. In this table, any protein group that comprises a peptide ID that corresponds to a cDNA ID member of a Trichome pathway or network is a group of proteins that also exhibits Trichome functions/utilities.

It is assumed that the genes differentially expressed in trichomes or leaves producing trichomes are concerned with specifying trichomes and their functions and therefore modulations of such genes and their products modify trichomes and their products.

Examples of phenotypes, biochemical activities, and transcription profiles that can be modulated by selected numbers of these genes and gene products singly or in combinations are described above and below.

III.A.4.b. Use of Trichome Genes, Gene Components and Products to Modulate Phenotypes Trichome genes of the instant invention, when mutated or activated differently, are useful for modulating one or more processes of trichome structure and/or function including: (1) development; (2) plant stress tolerance; and (3) biosynthesis or secretion of trichome-specific molecules. Trichome genes, components and gene products are useful to alter or modulate one or more of the following phenotypes:

1.) Development

Trichome differentiation is integrated with leaf development, hormone levels and the vegetative development phase. The first trichome at the leaf tip appears only after the leaf grows to ~100 μm in length. Subsequent events proceed basipetally as the leaf grows. As leaf development progresses, cell division patterns become less regular and islands of dividing cells can be observed among differentiated pavement cells with their characteristic lobed morphology. Trichome initiation in the expanding leaf occurs within these islands of cells and often defines points along the perimeter of a circle, with an existing trichome defining the center.

Once a cell enters the trichome pathway it undergoes an elaborate morphogenesis program that has been divided into different stages based on specific morphological hallmarks. The trichome genes, gene components and gene products of this invention are useful to modulate any one or all of these growth and development processes by affecting rate, timing, direction and size, for example. Trichome genes can also affect trichome number and the organs on which they occur, type of trichomes such as glandular trichomes and stellate trichomes; cell properties such as cell size, cell division rate and direction, cell elongation, cell differentiation, secretory cells, trichome number (average trichome number per leaf for mint: 13,500,000), cell walls, cell death, and response to reactive oxygen species; trichome architecture such as trichome cell structure, placement on leaf, and secretory systems; and trichome responses. Trichome genes, gene components and gene products of this invention are useful to modulate one or more of the growth and development processes above; as in timing and rate, for example. In addition, the polynucleotides and polypeptides of the invention can control the response of these processes to internal plant programs and signaling molecules such as leaf development, hormones (including abscisic acid, Auxin, cytokinin, gibberellins, and brassinosteroids, apoptosis; and coordinated trichome growth and development in flowers, stems, petioles, cotyledons, and hypocotyls.

2.) Plant Stress Tolerance

The physical characteristics of trichomes as well as the substances secreted by trichomes are useful in protecting the plant from both biotic and abiotic attacks. Thus, selected trichome genes and gene products can be used to help protect distinct cells, organs, or tissues as well as overall plant yield and vigor. Examples of stresses, tolerances to which are modulated by trichome genes and gene products are drought (e.g., trichome number variation can decrease the surface area that allows evaporation), heat (e.g., trichomes can produce shade and provide protection for meristems), salt, insects (e.g., trichomes can prevent insects from settling on plant surfaces), herbivory (e.g., trichomes can produce harmful chemicals), and ultraviolet light.

3.) Biosynthesis, Accumulation or Secretion of Metabolites

The glandular trichomes from various species are shown to secrete and, sometimes, locally synthesize a number of substances including salt, monoterpenes and sesquiterpenes, terpenoids, exudate, insect entrapping substances, antifeedants, pheromones, and others. Therefore, trichome genes can be used to modulate the synthesis, accumulation and secretion of a large number of metabolites especially related to trichome biology. Some are synthesized in response to biotic and abiotic stresses. For a more detailed description of these metabolites see the section "Use of Trichome Genes to Modulate Biochemical Activities" below.

Uses of Plants that are Modified as Described Above

Altering trichome properties is useful for modifying one or more plant traits making the plants more useful in agriculture, horticulture and for the production of valuable molecules. These plant traits include Production of specific carbohydrates, proteins, oils, aromas, flavors, pigments, secondary metabolites such as menthol (and other monoterpenes), etc., that can be used in situ or purified and used in a wide variety of industries; Increased production of molecules synthesized in trichomes by increasing the trichome number on different plant organs, such as cotyledons, leaves, hypocotyls, stems, petioles, etc.; Increased cotton fibers per boll due to decreased numbers of trichomes that reduces insect hiding and contamination; More optimal growth rate of a whole plant or specific parts of a plant due to more optimal trichome cellular development and the better resistance to biotic/abiotic stresses (including plant parts such as whole plant seedling, coleoptile elongation, young leaves, flowers, seeds, and fruit); increased harvested yield of plants, organs and their constituent molecules including biomass (such as fresh and dry weight during any time in plant life, including maturation and senescence, number of flowers, seed yield in terms of number, size, weight, harvest index, content and composition, e.g. amino acid, jasmonate, oil, protein and starch, and fruit yield in terms of number, size, weight, harvest index, post harvest quality, content and composition, e.g. amino acid, jasmonate, oil, protein and starch).

To regulate any of the phenotype(s) above, activities of one or more of the trichome genes or gene products can be modulated in an organism and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (*Methods. Mol. Biol.* 82:259-266 (1998)) and/or screened for variants as in Winkler et al., *Plant Physiol.* 118: 743-50 (1998) and visually inspected for the desired phenotype or metabolically and/or functionally assayed.

III.A.4.c. Use of Trichome Genes, Gene Components and Products to Modulate Biochemical Activities The phenotype traits outlined above result from the integration of many cellular trichome associated processes and biochemical activities. Some of these are known from published literature and some can be deduced from the genes discovered in the MA Tables, etc. One or more of these trichome genes, gene components and products are useful to modulate these cellular processes, biochemical or metabolic activities and/or pathways such as those noted below. Such biological activities can be measured according to the citations included in the table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation And Development | Cell wall biosynthetic enzymes<br>Cell fate determination proteins<br>Major pathways of carbon and nitrogen metabolism | Molhoj et. al. (2001). Plant Mol. Biol. 46, 263-275<br>Krishnakumar and Oppenheimer (1999). Development 1221, 3079-3088.<br>Kroumova et al. (1994). PNAS 91, 11437-11441 |
| Water Conservation And Resistance To Drought And Other Related Stresses | Cytoskeleton and Trichome morphology and spacing controls | Schnittger et al. (1999). Plant Cell 11, 1105-1116<br>Hulskamp et al (1994). Cell 76, 555-566 |
| Trichome exudate | Insect repellant | Insects and The Plant Surface, pp 151-172, Edward Arnold, London (1986) |
| Terpenoid biosynthesis including monoterpenes and sesquiterpenes | Terpenoid biosynthesis enzymes including:<br>Farnesyltranstransferase<br>Geranylgeranyl-diphosphate synthase<br>Geranyltranstransferase<br>Farnesyl-diphosphate synthase | Alonso et al. (1992). J. Biol. Chem. 267, 7582-7587<br>Rajonarivony et al (1992). Arch. Biochem. Biophys. 299, 77-82 |

-continued

| PROCESS | BIOCHEMICAL OR METABOLIC ACTIVITIES AND/OR PATHWAYS | CITATIONS INCLUDING ASSAYS |
|---|---|---|
| | Dimethylallyltranstransferase Geranyl-diphosphate synthase | |
| $H_2O_2$ accumulation and activation of SAR | NADPH oxidase (subunit) synthesis and function | Alverez et al (1998) Cell 92, 773-784<br>Grant Orozco-Cardenas and Ryan (1999) PNAS 96, 6553-6557 |
| Antifeedants biosynthesis and secretion | Lactone biosynthesis enzymes | Paruch et al. (2000). J. Agric. Food Chem. 48, 4973-4977 |
| Pheromone biosynthesis and secretion | Farnesine biosynthesis enzymes | Teal et al. (1999) Arch. Insect Biochem Physiol. 42, 225-232 |
| Endoreplication | Cyclin and cyclin dependant kinases | De Veylder et al. (2001) Plant Cell 13, 1653-1668<br>De Veylder et al. (2001) Plant J. 25, 617-626 |

Specific enzyme and other activities associated with the functions of individual trichome genes that can be modulated by the trichome genes and gene products are listed in the Reference tables where the functions of individual genes and their products are listed. Assays for detecting such biological activities are described in the Protein Domain table, for example.

III.A.4.d. Use of Trichome Genes, Gene Components and Products to Modulate Phenotypes by Modulating Transcription Levels of Other Genes Many of the genes are "up regulated" or "down regulated" in trichomes because they are regulated as members of networks or cascade of genes under the control of regulatory genes. Thus some trichome genes are useful to influence levels of other genes and so orchestrate the complex phenotypes. Examples of the types of genes with altered transcript levels in trichomes are described in the Table below, together with associated biological activities. "Up-regulated" profiles are those where the mRNA levels are higher in the glaborous plants as compared to the "hairy" plant. "Down-regulated" profiles represent higher transcript levels in the "hairy" plant as compared to the glaborous plant.

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES WHOSE TRANSCRIPTS ARE CHANGED |
|---|---|---|---|
| Up Regulated Transcripts | Genes active in suppressing trichome formation | Changes in Hormone Perception<br>Changes in Hormone Biosynthesis<br>Changes in Specific Gene Transcription Initiation<br>Changes in cytoskeleton and cell wall assembly and structure | Transcription Factors<br>Transporters<br>Change In Cell G-proteins<br>Kinases And Phosphatases<br>Transcription factors<br>Ca-binding proteins<br>Transcription Activators<br>Change In Chromatin Structure And/Or Localized DNA Topology<br>Specific Factors (Initiation And Elongation) For Protein Synthesis<br>Maintenance Of mRNA Stability<br>Maintenance Of Protein Stability<br>Maintenance Of Protein-Protein Interaction |

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES WHOSE TRANSCRIPTS ARE CHANGED |
|---|---|---|---|
| Down-Regulated Transcripts | Genes active in inducing formation of trichomes | Changes in Hormone Perception Changes in Hormone Biosynthesis Changes in Specific Gene Transcription Initiation Changes in cytoskeleton and cell wall assembly and structure | Transcription Factors Change In Protein Structure By Phosphorylation (Kinases) Or Dephosphorylation (Phosphatases) Change In Chromatin Structure And/Or DNA Topology G-proteins, Ca2+-binding proteins |
| | Genes associated with Trichome differentiation and structure | Changes in cell size, cell shape | |
| | Genes associated with trichome-specific metabolic pathways | Changes in terpenoid biosynthesis Changes in antifeedant and pheromone biosynthesis | |

While trichome polynucleotides and gene products can act alone, combinations of these polynucleotides also affect growth, development and leaf biochemistry. Combinations of trichome polynucleotide(s) and/or gene product(s) with genes or gene products involved in leaf development, hormone responses, or vegetative development are useful because trichome development is integrated with these processes.

Use of Promoters of Trichome Genes

Promoters of trichome genes are useful for facilitating transcription of desired polynucleotides, both plant and non-plant in trichomes. For example, extra copies of existing terpenoid synthesis coding sequences can be operably linked to a trichome gene promoter and inserted into a plant to increase the terpenoids in the trichome. Alternatively, trichome promoters can direct expression of non-plant genes or genes from another plant species that can, for instance, lead to new terpenoids being made. The promoters can also be operably linked to antisense copies of coding sequences to achieve down regulation of these gene products in cells.

III.A5. Chloroplast Genes, Gene Components and Products

The chloroplast is a complex and specialized organelle in plant cells. Its complexity comes from the fact that it has at least six suborganellar compartments subdivided by double-membrane envelope and internal thylakoid membranes. It is specialized to carry out different biologically important processes including photosynthesis and amino acid and fatty acid biosynthesis. The biogenesis and development of chloroplast from its progenitor (the proplasptid) and the conversion of one form of plastid to another (e.g., from chloroplast to amyloplast) depends on several factors that include the developmental and physiological states of the cells.

One of the contributing problems that complicate the biogenesis of chloroplast is the fact that some, if not most, of its components must come from the outside of the organelle itself. The import mechanisms must take into account to what part within the different sub-compartments the proteins are being targeted; hence the proteins being imported from the cytoplasm must be able to cross the different internal membrane barriers before they can reach their destinations. The import mechanism must also take into account how to tightly coordinate the interaction between the plastid and the nucleus such that both nuclear and plastidic components are expressed in a synchronous and orchestrated manner. Changes in the developmental and physiological conditions within or surrounding plant cells can consequently change this tight coordination and therefore change how import mechanisms are regulated as well. Manipulation of these conditions and modulation of expression of the import components and their function can have critical and global consequences to the development of the plant and to several biochemical pathways occurring outside the chloroplast. Expression patterns of such genes have been determined using microarray technology.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing about 10,000 non-redundant ESTs, selected from about 37,000 randomly sequenced ESTs generated from mRNA of different tissues and developmental stages.

The sequences of the ESTs showing at least two-fold increases or decreases in a mutant in a mutant (CiA2) of *Arabidopsis thaliana*, that is distributed in chloroplast biogenesis relative to wild type grown in the same conditions were identified, compared to the Ceres full length cDNA and genomic sequence databanks, and equivalent Ceres clones identified. The MA_diff table reports the results of this analysis, indicating those Ceres clones which are up or down regulated over controls, thereby indicating the Ceres clones that are involved in the import of proteins to chloroplast and chloroplast biogenesis.

Examples of genes and gene products that are involved in the import of proteins to chloroplast are shown in the Reference, Sequence, Protein Group, and Protein Group Matrix tables. While chloroplast protein import polynucleotides and gene products can act alone, combinations of these polynucleotides also affect growth and development. Useful combinations include different chloroplast protein import responsive polynucleotides and/or gene products that have similar transcription profiles or similar biological activities, and members of the same or functionally related biochemical pathways. Whole pathways or segments of pathways are controlled by transcription factor proteins and proteins controlling the activity of signal transduction pathways. Manipulation of one or more chloroplast protein import gene activities are useful to modulate the biological processes and/or phenotypes listed below. Chloroplast protein import responsive genes and gene products can act alone or in combination. Useful combinations include chloroplast protein import responsive genes and/or gene products with similar transcription profiles, similar biological activities, or members of the same or functionally related biochemical pathways. Here, in addition to polynucleotides having similar transcription profiles and/or biological activities, useful combinations include polynucleotides that may have different transcription profiles but which participate in common or overlapping pathways. Whole pathways or segments of pathways are controlled by transcription factor proteins and proteins controlling the activity of signal transduction pathways. Therefore, manipulation of such protein levels is especially useful for altering phenotypes and biochemical activities of plants. Manipulation of one or more chloroplast protein import gene activities are useful to modulate the biological processes and/or phenotypes listed below.

Such chloroplast protein import responsive genes and gene products can function to either increase or dampen the above phenotypes or activities in response to changes in the regulation of import mechanisms. Further, promoters of chloroplast protein transport responsive genes, as described in the Reference tables, for example, are useful to modulate transcription that is induced by chloroplast protein transport or any of the following phenotypes or biological activities below. Further, any desired sequence can be transcribed in similar temporal, tissue, or environmentally specific patterns as the chloroplast protein transport responsive genes when the desired sequence is operably linked to a promoter of a chloroplast protein transport responsive gene. The MA_diff Table(s) reports the transcript levels of the experiment (see EXPT ID: Chloroplast (relating to SMD 8093, SMD 8094)). For transcripts that had higher levels in the samples than the control, a "+" is shown. A "−" is shown for when transcript levels were reduced in root tips as compared to the control. For more experimental detail see the Example section below.

Chloroplast genes are those sequences that showed differential expression as compared to controls, namely those sequences identified in the MA_diff tables with a "+" or "−" indication.

Chloroplast Genes Identified by Cluster Analyses of Differential Expression Chloroplast Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Chloroplast genes is any group in the MA_clust that comprises a cDNA ID that also appears in Expt ID Chloroplast (relating to SMD 8093, SMD 8094) of the MA_diff table(s).

Chloroplast Genes Identified by Correlation to Genes that Cause Physiological Consequences Additionally, the differential expression data and the phenotypic observations can be merged to identify pathways or networks of Chloroplast genes. A group in the MA_clust is considered a Chloroplast pathway or network if the group comprises a cDNA ID that also appears in Knock-in or Knock-out tables that causes one or more of the phenotypes described in section above.

Chloroplast Genes Identified by Amino Acid Sequence Similarity

Chloroplast genes from other plant species typically encode polypeptides that share amino acid similarity to the sequences encoded by corn and *Arabidopsis* Chloroplast genes. Groups of Chloroplast genes are identified in the Protein Group table. In this table, any protein group that comprises a peptide ID that corresponds to a cDNA ID member of a Chloroplast pathway or network is a group of proteins that also exhibits Chloroplast functions/utilities.

III.A.5.a. Use of Chloroplast Protein Import Responsive Genes to Modulate Phenotypes Chloroplast protein import responsive genes and gene products are useful to or modulate one or more phenotypes, including growth, roots, stems, and leaves; development, including plastid biogenesis, plastid division, plastid development and thylakoid membrane structures differentiation including plastid/chloroplast differentiation; photosynthesis including carbon dioxide fixation; transport including transcription/translation regulation within transport complex, phosphate translocation, and targeted starch deposition and accumulation; and biosynthesis of essential compounds such as lipid biosynthesis, riboflavin biosynthesis, carotenoid biosynthesis, and amino acid biosynthesis.

To improve any of the phenotype(s) above, activities of one or more of the chloroplast protein import responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Saito et al. (1994, Plant Physiol. 106: 887-95), Takahashi et al (1997, Proc. Natl. Acad. Sci. USA 94: 11102-07) and Koprivova et al. (2000, Plant Physiol. 122: 737-46).

III.A.5.b. Use of Chloroplast Protein Import-Responsive Genes to Modulate Biochemical Activities The activities of one or more of the chloroplast protein import responsive genes can be modulated to change biochemical or metabolic activities and/or pathways such as those noted below. Such biological activities can be measured according to the citations included in the table below:

| GENERAL CATEGORY | BIOCHEMICAL OR METABOLIC ACTIVITIES AND/OR PATHWAYS | CITATIONS INCLUDING ASSAYS |
|---|---|---|
| Cell Growth and Differentiation | Regulation of Leaf Development Including Photosynthetic Apparatus | Reinbothe et al. (1997) Proc. Natl. Acad. Sci. USA. 94: 8890-8894<br>Eggink and Hoober (2000) J. Biol. Chem. 275: 9087-9090<br>Jagtap et al. (1998) J Exptl Botany 49: 1715-1721 |
| | Regulation of Plastid Biogenesis and Plastid Division | Lawrence and Kindle (1997) J. Biol. Chem. 272: 20357-20363<br>Lahiri and Allison (2000) Plant Physiol. 123: 883-894 |
| | Development of Plastid Inner/Outer and thylakoid Membrane Structures | Kouranov et al. (1999) J. Biol. Chem. 274: 25181-25186<br>Jackson et al. (1998) J. Biol. Chem. 273: 16583-16588<br>Li and Chen (1997) J. Biol. Chem. 272: 10968-10974<br>Lawrence and Kindle (1997) J. Biol. Chem. 272: 20357-20363<br>Silva-Filho et al. (1997) J. Biol. Chem. 272: 15264-15269 |
| | Regulation of transcription and/or translation related to maintenance of stability of protein-protein interaction within transport complex | May and Soll (2000) Plant Cell 12: 53-63<br>Caliebe et al. (1997) EMBO J. 16: 7342-7350 |
| Physiology | Modulation of Photosynthesis | Sung and Krieg (1979) Plant Physiol 64: 852-56 |
| | Regulation of Lipid Biosynthesis | Bourgis et al. (1999) Plant Physiol. 120: 913-922<br>Reverdatto et al. (1999) Plant Physiol. 119: 961-978<br>Roesler et al. (1997) Plant Physiol. 113: 75-81 |
| | Regulation of Riboflavin (Vitamin B) biosynthesis | Jordan et al. (1999) J. Biol. Chem. 274: 22114-22121 |
| | Regulation of phosphate translocation across chloroplast membrane | Flugge (1999) Annu. Rev. Plant Physiol. Plant Mol. Biol. 50: 27-45<br>Silva-Filho et al. (1997) J. Biol. Chem. 272: 15264-15269 |
| | Regulation of targeted starch depostion and accumulation | Yu et al. (1998) Plant Physiol. 116: 1451-1460 |
| | Modulation of protein targeting and translocation across chloroplast membrane | Summer and Cline (1999) Plant Physiol. 119: 575-584<br>Dabney-Smith et al. (1999) J. Biol. Chem. 274: 32351-32359<br>Hinnah et al. (1997) EMBO J. 16: 7351-7360 |
| | Regulation of carotenoid biosynthesis | Bonk et al. (1996) Plant Physiol. 111: 931-939 |
| | Regulation of amino acid biosynthesis | Flugge (1999) Annu. Rev. Plant Physiol. Plant Mol. Biol. 50: 27-45 |
| | Regulation of secondary metabolism | Flugge (1999) Annu. Rev. Plant Physiol. Plant Mol. Biol. 50: 27-45 |
| Signal Transduction | Regulation of gene transcriptional activity specific to chloroplast protein import | Chen et al. (2000) Plant Physiol. 122: 813-822.<br>Macasev et al. (2000) Plant Physiol. 123: 811-816 |
| | Regulation of protein target signal cleavage and protein degradation | Lang et al. (1998) J. Biol. Chem. 273: 30973-30978<br>Jackson et al. (1998) J. Biol. Chem. 273: 16583-16588<br>Richter and Lamppa (1998) Proc. Natl. Acad. Sci. USA. 95: 7463-7468 |
| | Regulation of ion channel conformation and activity | Van der Wijngaard and Vredenberg (1999) J. Biol. Chem. 274: 25201-25204 |

-continued

| GENERAL CATEGORY | BIOCHEMICAL OR METABOLIC ACTIVITIES AND/OR PATHWAYS | CITATIONS INCLUDING ASSAYS |
|---|---|---|
| | Regulation of kinase and phosphatases synthesis and activity | Waegemann and Soll (1996) J. Biol. Chem. 271: 6545-6554<br>Li et al. (2000) Science 287-300-303<br>Muller et al. (2000) J. Biol. Chem. 275: 19475-19481 |
| | Modulation of Molecular Chaperone and Other Protein Folding Activity | Bonk et al. (1996) Plant Physiol. 111: 931-939<br>Walker et al. (1996) J. Biol. Chem. 271: 4082-4085<br>Kessler and Blobel (1996). Proc. Natl. Acad. Sci. USA 93: 7684-7689<br>Jackson et al. (1998) J. Biol. Chem. 273: 16583-16588 |

Other biological activities that can be modulated by the chloroplast protein import responsive genes and gene products are listed in the Reference tables. Assays for detecting such biological activities are described in the Protein Domain table.

Chloroplast protein import responsive genes are characteristically differentially transcribed in response to fluctuating chloroplast protein import levels or concentrations, whether internal or external to an organism or cell. The MA_diff reports the changes in transcript levels of various chloroplast protein import responsive genes that are differentially expressed among the mutants and the wild type.

Profiles of some of these chloroplast protein import responsive genes are shown in the Table below together with examples of the kinds of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to defective chloroplast protein import<br>Genes induced by defective import | Chloroplast protein import regulation<br>Chloroplast protein import and transport<br>Chloroplast import metabolism<br>Synthesis of secondary metabolites and/or proteins<br>Modulation of chloroplast import response transduction pathways<br>Changes in chloroplast membranes<br>Specific gene transcription initiation<br>Chloroplast and non-chloroplast metabolic pathways | Transporters<br>Metabolic enzymes<br>Change in cell membrane structure and potential<br>Kinases and phosphatases<br>Transcription activators<br>Change in chromatin structure and/or localized DNA topology<br>Redox control<br>Metabolic enzymes concerned with chloroplast biochemistry<br>Organelle gene expression and translation |
| Down-regulated transcripts | Responders to defective chloroplast protein import.<br>Genes repressed by defective chloroplast protein import<br>Genes with unsTable mRNAs when chloroplast import is defective<br>Genes with discontinued expression or unsTable mRNA in presence of | Regulation of chloroplast protein import pathways released<br>Chloroplast protein import and transport<br>Chloroplast import metabolism<br>Changes in pathways and processes operating in chloroplasts | Transcription factors<br>Change in protein structure by phosphorylation (kinases) or dephosphoryaltion (phosphatases)<br>Change in chromatin structure and/or DNA topology<br>Stability factors for protein mRNA synthesis and |

-continued

| TRANSCRIPT LEVELS | TYPE OF GENES | PHYSIOLOGICAL CONSEQUENCES | EXAMPLES OF BIOCHEMICAL ACTIVITY |
|---|---|---|---|
| | chloroplast protein import | Changes in organelle membranes Loss of organelle gene expression, RNA and protein synthesis Changes in metabolism other than chloroplast protein import pathways Chloroplast import metabolism | degradation Organelle transcription and translation proteins Metabolic enzymes |

Use of Promoters of Chloroplast Genes

Promoters of Chloroplast genes are useful for transcription of any desired polynucleotide or plant or non-plant origin. Further, any desired sequence can be transcribed in a similar temporal, tissue, or environmentally specific patterns as the Chloroplast genes where the desired sequence is operably linked to a promoter of a Chloroplast gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression III.A.6. Reproduction Genes, Gene Components and Products Reproduction genes are defined as genes or components of genes capable of modulating any aspect of sexual reproduction from flowering time and inflorescence development to fertilization and finally seed and fruit development. These genes are of great economic interest as well as biological importance. The fruit and vegeTable industry grosses over $1 billion USD a year. The seed market, valued at approximately $15 billion USD annually, is even more lucrative.

Expression of many reproduction genes and gene products is orchestrated by internal programs or the surrounding environment of a plant, as described below. These genes and/or products have great importance in determining traits such as fruit and seed yield. Examples of such reproduction genes and gene products are shown in the Reference, Sequence, Protein Group, Protein Group Matrix tables, Knock-in, Knock-out, MA-diff and MA-dust. The biochemical functions of the protein products of many of these genes determined from comparisons with known proteins are also given in the Reference tables.

Reproduction Genes Identified by Phenotypic Observation

Reproduction genes were discovered and characterized from a much larger set of genes by experiments designed to find genes that cause phenotypic changes in flower, silique, and seed morphology. In these experiments, reproduction genes were identified by either (1) ectopic expression of a cDNA in a plant or (2) mutagenesis of the plant genome. The plants were then cultivated and phenotypes, which varied from the parental "wild-type", were observed.

One particular example of reproductive genes are those that are regulated by AP2. AP2 is a transcription factor that regulates many genes, both as a repressor of some genes and as an activator of others. Some of these genes are those which establish the floral meristem or those which regulate floral organ identity and development. As such, AP2 has an effect on reproduction. This is, loss of AP2 activity is correlated with decreased male and female reproduction. AP2 is also known to have an effect on seed mass, and therefore on yield. That is, overexpression of AP2 is correlated with smaller seeds or seedless fruit while repression of AP2 correlates with larger seeds (see, e.g. U.S. Pat. No. 5,994,622).

Another example of reproduction genes are those that are regulated by PISTILLATA (PI). PI is a transcription factor that regulates many genes both as a repressor and activator. Some of these genes are those which regulate floral organ identity and development, in conjunction with other transcription factors such as AP2 and AGAMOUS. As such, PI has an effect on reproduction in that loss of PI activity is correlated with decreased male reproduction. PI is also known to have an effect on carpel number, and therefore potentially on ovule/seed number and yield. Specifically, repression of PI results in increased carpel number and therefore ovule number.

Yet another example of reproductive genes are those that are regulated by MEDEA (MEA). MEA is a SET-domain containing protein that associates with other proteins to form complexes that affect chromatin structure and therefore gene expression. As such, loss of MEA function is correlated with global gene activation and repression leading to many phenotypes including decreased female reproduction and therefore reduced seed set and yield.

In the characterization of these and other reproduction genes, the following phenotypes were scored:
  I. Flower
  Size
    Large
    Small
  Shape
    Abnormal organ numbers
    Agamous
    AP-2 like
  Color
  Number
  Fused Sepals
  II. Silique
  Size
  Seed number
    Reduced
    Absent Seed color The identified genes regulating reproduction are identified in the Knock-in and Knock-out Tables.

Reproduction Genes Identified by Differential Expression

Reproduction genes were also identified in experiments designed to discover genes whose mRNA products were in different concentrations in whole flowers, flower parts, and siliques relative to the plant as a whole. The MA_diff Table(s) reports the transcript levels of the experiment (see EXPT ID: 108473, 108474, 108429, 108430, 108431, 108475, 108476, 108501). For transcripts that had higher levels in the samples than the control, a "+" is shown. A "−" is shown for when transcript levels were reduced in root tips as compared to the control. For more experimental detail see the Example section below.

Reproduction genes are those sequences that showed differential expression as compared to controls, namely those sequences identified in the MA_diff tables with a "+" or "−" indication.

Reproduction Genes Identified by Cluster Analyses of Differential Expression

Reproduction Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Reproduction genes is any group in the MA_clust that comprises a cDNA ID that also appears in Expt ID 108473, 108474, 108429, 108430, 108431, 108475, 108476, 108501 of the MA_diff table(s).

Reproduction Genes Identified by Correlation to Genes that Cause Physiological Consequences Additionally, the differential expression data and the phenotypic observations can be merged to identify pathways or networks of Reproduction genes. A group in the MA_clust is considered a Reproduction pathway or network if the group comprises a cDNA ID that also appears in Knock-in or Knock-out tables that causes one or more of the phenotypes described in section above.

Reproduction Genes Identified by Amino Acid Sequence Similarity

Reproduction genes from other plant species typically encode polypeptides that share amino acid similarity to the sequences encoded by corn and *Arabidopsis* Reproduction genes. Groups of Reproduction genes are identified in the Protein Group table. In this table, any protein group that comprises a peptide ID that corresponds to a cDNA ID member of a Reproduction pathway or network is a group of proteins that also exhibits Reproduction functions/utilities.

It is assumed that the reproduction genes differentially expressed in floral parts and seeds are concerned with specifying flowers and seeds and their functions, and therefore modulations of such genes produce variant flowers and seeds.

Reproductive genes and gene products can function to either increase or dampen the phenotypes, biochemical activities and transcription profiles, either in response to changes of internal plant programs or to external environmental fluctuations.

III.A.5.a. Use of Reproduction Genes, Gene Components and Products to Modulate Phenotypes The reproduction genes of the instant invention, when mutated or activated differently, are capable of modulating one or more processes of flower, seed and fruit development. They are thus useful for improving plants for agriculture and horticulture and for providing seeds with a better chemical composition for diverse industries including the food, feed and chemical industries. Reproduction genes, gene components and products are useful to alter the following traits and properties of plants, including development, such as flowering time and number of inflorescences, flower development (including anther, stamen, pollen, style, stigma, ovary, ovule, and gametes), pollination and fertilization (including sporogenesis gametogenesis, zygote formation, embryo development, endosperm development, and male sterility, hybrid breeding systems and heterosis); cellular properties, such as cell size, cell shape, cell death, cell division, cell elongation, cell differentiation, and meiosis; organ characteristics, such as flowers, receptacle, sepals, petals, and tepals color, shape, and size, number, and petal drop); androecium, such as stamen (including anther size, pollen sterile, size, shape, weight and color, number, and filament size), gynoecium, such as carpel, ovary. number. and length) and style (stigma, ovule, size, shape, and number); pedicel and peduncle (size and shape), seeds, such as placenta, embryo. cotyledon, endosperm, suspensor, seed coat (testa), aleurone, development, including apomixis (gametophytic, apospory, diplospory), dormancy and germination; fruits, such as pericarp—thickness, texture (exocarp, mesocarp, endocarp); development (seed set, fruit set, false fruit, fruit elongation and maturation, and dehiscence), and fruit drop; plant seed yield, such as increased biomass, better harvest index, attraction of favorable insects, better seed quality, and better yield of constituent chemicals; and plant population features, such as architecture (shade avoidance and planting density).

To regulate any of the phenotype(s) above, activities of one or more of the reproduction genes or gene products can be modulated in an organism and tested by screening for the desired trait. Specifically, the gene, mRNA levels or protein levels can be altered in a plant using the procedures described herein and the phenotypes can be assayed. As an example, a plant can be transformed according to Bechtold and Pelletier (*Methods Mol. Biol.* 82:259-266 (1998)) and/or screened for variants as in Winkler et al. (*Plant Physiol* 118:743-50 (1998)) and visually inspected for the desired phenotype or metabolically and/or functionally assayed.

III.A.5.b. Use of Reproduction Genes to Modulate Biochemical Activities

The activities of one or more of the reproduction genes can be modulated to change biochemical or metabolic activities and/or pathways such as those examples noted below. Such biological activities can be measured according to the citations included in the Table below:

| FUNCTION/PROCESS | EXAMPLES OF BIOCHEMICAL/MOLECULAR ACTIVITIES | Reference AND ASSAY |
|---|---|---|
| Metabolism | Energy production and conversion | Ap Rees, T. (1974). In "Plant Biochemistry. |

-continued

| FUNCTION/PROCESS | EXAMPLES OF BIOCHEMICAL/MOLECULAR ACTIVITIES | Reference AND ASSAY |
|---|---|---|
| | Glucosyl-transferase (CLONE_ID 1040) Heme-binding protein (putative cytochrom B5) (CLONE_ID 3743) Storage protein synthesis Inorganic ion transport and metabolism Peroxidase (CLONE_ID 100990) Cystathione beta synthase (CLONE_ID 21847) Amino acid transport and metabolism l-asparaginase (CLONE_ID 92780) Putative peptide/amino acid transporter (CLONE_ID 113723) Carbohydrate transport and metabolism Glucose transport protein (CLONE_ID 33727) Putative sugar transporter (CLONE_ID 3250) Starch biosynthesis Coenzyme metabolism Tyrosine aminotransferase (ROOTY/SUPERROOT1) (CLONE_ID 14570) Formate dehydrogenase (CLONE_ID 7530) Lipid metabolism Branched chain α-ketoacid dehydrogenase E2 subunit (CLONE_ID 25116) Acyl carrier protein-1 (CLONE_ID 14291) Lipid metabolic enzymes Secretion Sensor protein RcsC-like (CLONE_ID 16461) Signal recognition particle RP54 (CLONE_ID 22158) | Biochemistry, Series One", Vol. 11. (H. L. Kornberg and D. C. Phillips, eds.), Butterworths, London. Juliano, B. O. and Varner, J. E. (1969). Plant Physiol. 44, 886-892. Bewley et al. (1993). Plant Physiol. Biochem. 31, 483-490. Hills, M. J. and Beevers, H. (1987). Plant Physiol. 84, 272-276. Olsen, L. J. and Harada, J. J. (1991). In "Molecular Approaches to Compartmentalization and Metabolic Regulation (A. H. C. Huang and L. Taiz, eds.), ASPP, Rockville, Md. Mitsuhashi, W. and Oaks, A. (1994). Plant Physiol. 104, 401-407. Walker-Smith, D. J., and Payne, J. W. (1985). Planta 164, 550-556. Salmenkallio, M. and Sopanen, T. (1989). Plant Physiol. 89, 1285-1291. Baumgartner, B. and Chrispeels, M. J. (1976). Plant Physiol. 58, 1-6. Elpidina, E. N. et al. (1991). Planta 185, 46-52. Ericson, M. C. and Chrispeels, M. J. (1973). Plant Physiol. 52, 98-104. Kern, R. and Chrispeels, M. J. 1978) Plant Physiol. 62, 815-819. Dilworth, M. F. and Dure, L. III. (1978). Plant Physiol. 61, 698-702. Chrispeels, M. J. and Jones, R. L. (1980/81). Isr. J. Bot. 29, 222-245. Gould, S. E. B., and Rees, D. A. (1964). J. Sci. Food Agric. 16, 702-709. |
| Modulate floral organ number | Transcriptional control ANT (AP2-domain) DNA binding protein SUP (Zinc finger) | Elliot et al. (1996). Plant Cell 8, 155-168. Sakai et al. (2000). Plant Cell 12, 1607-1618. Jacobsen and Meyerowitz (1997). Science 277, 1100-1103. |
| Floral organ size | Transcriptional control ANT (AP2-domain) DNA binding protein | Mizukami et al. (2000). PNAS 97, 942-947. Krizek (1999). Developmental Genetics 25, 224-236. |
| Female organ number/Floral meristem size | Membrane receptor kinase signal transduction CLV1 (LRR domain and kinase domain) receptor CLV2 (LRR domain) receptor CLV3 (Receptor ligand) | Clark and Meyerowitz (1997). Cell 89, 575-585 Jeong et al. (1999). Plant Cell 11, 1925-1934. Fletcher et al. (1999). Science 283, 1911-1914. |

-continued

| FUNCTION/PROCESS | EXAMPLES OF BIOCHEMICAL/MOLECULAR ACTIVITIES | Reference AND ASSAY |
| --- | --- | --- |
| Female reproduction | DNA binding protein AG (MADS domain) DNA binding protein | Yanofsky et al. (1990). Nature 346, 35-39. |
| Female reproduction | Signal transduction CTR1 (Raf kinase) | Kieber et al. (1993). Cell 72, 427-441. |
| Male organ number | DNA methylation MET1 (DNA methyltransferase) | Jacobsen and Meyerowitz (1997). Science 277, 1100-1103. |
| Seed size control | DNA binding protein AP2 (AP2 domain) RAP2 (AP2 domain) | Jofuku et al. (1994). Plant Cell 6, 1211-1225. US Patent #6,093,874; #5,994,622 |
| Seed size control | Polycomb group protein complex FIE, FIS2, MEA | Luo et al. (2000). PNAS 97, 10637-10642. |
| Seed size control | DNA methylation MET1 | Scott et al. (2000). Development 127, 2493-2502. Vinkenoog et al. (2000). Plant Cell 12, 2271-2282. Luo et al. (2000). PNAS 97, 10637-10642. |
| Embryo development/Embryo viability | CAAT box binding complex LEC1/HAP3 HAP2, HAP5 | Lotan et al. (1998). Cell 93, 1195. US Patent #6,235,975 |
| Embryo development/Seed dormancy | DNA binding proteins ABI4 (AP2 domain) FUS3 (B3 domain) VP1 (B3 domain) | Finkelstein et al. (1998). Plant Cell 10, 1043-1054. Luerssen et al. (1998). Plant J. 15, 755-764. |
| Embryo development | Signal transduction ABI1, ABI2 [Serine/threonine protein phosphatase 2C (PP2C)] | Leung et al. (1994). Science 264, 1448-1452. Leung et al. (1997). Plant Cell 9, 759-771. |
| Endosperm development | Chromatin level control of gene activity Polycomb complex; FIE, MEA, FIS2 | Ohad et al. (1996). PNAS 93, 5319-5324. US Patent #6,229,064 Kiyosue et al. (1999). PNAS 96, 4186-4191. Grossniklaus et al. (1998). Science 280, 446-450. Chaudhury et al. (1997) PNAS 94, 4223-4228. |
| Integument development/Seed coat development | DNA binding AP2, ANT (AP2 domain) BEL1 (Homeodomain) | Jofuku et al. (1994). Plant Cell 6, 1211-1225. Klucher et al. Plant Cell 8, 137-153. Reiser et al. (1995). Cell 83, 735-742. |
| Anthocyanin production | Secondary transporter TT12 (MATE; multidrug and toxic compound extrusion) | Debeaujon et al. (2001). Plant Cell 13, 853-872. |
| Anthocyanin production | DNA binding protein TT8 (Basic helix-loop-helix domain) | Nesi et al. (2000). Plant Cell 12, 1863-1878. |
| Fruit development | Chromatin level control of gene activity Polycomb complex; FIE, MEA, FIS2 | Ohad et al. (1996). PNAS 93, 5319-5324. Kiyosue et al. (1999). PNAS 96, 4186-4191. Grossniklaus et al. (1998). Science 280, 446-450. Chaudhury et al. (1997) PNAS 94, 4223-4228. |
| Fruit size control | Signal transduction FW2.2 (c-Ras P21) | Frary et al. (2000). Science 289, 85-88. |
| Fruit development/Pod shattering | Transcriptional control SHP1, SHP2, FUL (MADS domain) DNA binding proteins | Liljegren et al. (2000). Nature 404, 766-770. Ferrandiz et al. (2000). Science 289, 436-438.. |
| Transcription and Posttranscription | Transcription SRF-domain AGL11 (CLONE_ID 32791) AP2-domain containing protein (CLONE_ID | Delseny, M. et al. (1977). Planta 135, 125-128. Lalonde, L. and Bewley, J. D. (1986). J. Exp. Bot. 37, 754-764. |

| FUNCTION/PROCESS | EXAMPLES OF BIOCHEMICAL/MOLECULAR ACTIVITIES | Reference AND ASSAY |
|---|---|---|
| | 332) Myb-DNA binding protein (CLONE_ID 94597) Transcription factors Signal transduction mechanisms Protein-kinases Phosphatases meiosis proteins Chromatin remodeling proteins Chaperones Chalcone synthase Putative Ser/Thr protein kinase (CLONE_ID 31383) ER6-like protein (implicated in ethylene signal transduction) (CLONE_ID 7474) Translation, ribosomal structure and biogenesis Ribosomal proTein S15A (CLONE_ID 17466) Translation initiation factor (CLONE_ID 103464) Posttranslational modification, protein turnover, chaperones DnaJ-domain containing protein (CLONE_ID 4150) Cyclophilin-like protein (CLONE_ID 35643) | Walling, L. et al. (1986). PNAS 83, 2123-2125. Okamuro, J. K. and Goldberg, R. B. (1989). In "Biochemistry of Plants, Vol 15." Academic Press, Inc. Wong, J. et al. (1995). Genes Dev. 9, 2696-2711. Dimitrov et al. (1994). J. Cell Biol. 126, 591-601. Landsberger, N. and Wolffe, A. P. (1997). EMBO J. 16, 4361-4373. Bogdanove, A. J. and Martin, G. G. (2000). PNAS 97, 8836-8840. Zhu, H. et al. Science Jul. 26, 2001: 10.1126/science.1062191 (Reports). |
| Cell division and Repair | Cell division and chromosome partitioning Protein of unknown function with tropomyosin-, myosin tail- and filament-domains (CLONE_ID 15546) Actin-1 (CLONE_ID 25785) DNA replication, recombination and repair Proliferating cell nuclear antigen-1 (axillary protein, DNA polymerase I delta) (CLONE_ID 28554) AAA-type ATPase, cdc48 (CLONE_ID 100292) Cell envelope biogenesis, outer membrane dTDP-D-glucose 4,6-dehydratase (CLONE_ID 28597) Putative cinnamoyl-CoA reductase (CLONE_ID 109228) | Rogan, P. G. and Simon, E. W. (1975). New Phytol. 74, 273-275. Morahashi, Y. and Bewley, J. D. (1980). Plant Physiol 66, 70-73. Morahashi, Y. et al. (1981). Plant Physiol. 68, 318-323. Morahashi, Y. (1986). Physiol. Plant. 66, 653-658. Zlatanova, J. et al. (1987). Plant Mol. Biol. 10, 139-144. Zlatanova, J. and Ivanov, P. (1988). Plant Sci. 58, 71-76. |

Other biological activities that are modulated by the reproductive genes and gene products are listed in the Reference tables. Assays for detecting such biological activities are described in the Protein Domain table, for example.

III.5.A.c. Use of Reproduction Genes, Gene Components and Products to Modulate Transcription Levels Reproduction genes are characteristically differentially transcribed in response to cell signals such as fluctuating hormone levels or concentrations, whether internal or external to an organism or cell. Many reproduction genes belong to networks or cascades of genes under the control of regulatory genes. Thus some reproduction genes are useful to modulate the expression of other genes. Examples of transcription profiles of reproduction genes are described in the Table below with associated biological activities. "Up-regulated" profiles are those where the mRNA transcript levels are higher in flowers, flower parts or siliques as compared to the plant as a whole. "Down-regulated" profiles represent higher transcript levels in the whole plant as compared to flowers, flower part or siliques alone.

| TRANSCRIPT LEVELS | TYPE OF GENES WITH ALTERED ACTIVITY | PHYSIOLOGICAL CONSEQUENCES OF ALTERING GENE EXPRESSION | EXAMPLES OF BIOCHEMICAL ACTIVITIES OF GENES WITH ALTERED EXPRESSION |
|---|---|---|---|
| Up Regulated Transcripts Flower Reproduction Genes | Genes that control flower differentiation, number and size Genes that promote petal, stamen and carpel formation Genes controlling flower-specific metabolism such as petal pigments Genes that promote ovule formation Genes that promote fertilization, seed, embryo and endosperm formation | Flowers form from flower meristem Floral organs mature Flavonoid pathways induced | Transcription Factors Signal transduction Membrane Structure Protein kinases Phosphatases Meiosis proteins Chromatin remodeling proteins Chaperones Chalcone synthase Amino acid transport and metabolism Storage protein synthesis Lipid metabolic enzymes Carbohydrate transport and metabolism Starch biosynthesis |
| AP2 Reproduction Genes | Genes activated by AP2 transcription factors Genes that induce petal and stamen formation | Many steps and pathways induced, developmental and metabolic No petals or stamens produced | Proteins associated with: Energy production and conversion Amino acid transport and metabolism Carbohydrate transport and metabolism Lipid metabolism Transcription and signal transduction Poor translational modification DNA replication Chromatin remodeling |
| Down-Regulated Transcripts Flower Reproduction Genes | Genes that repress flower development | Flowers form from flower meristem | Transcritipion factors Signal transduction pathways Kinases and phosphatases Chromatin remodeling proteins |
|  | Genes that induce stem, leaf and other organ differentiation Genes that negatively regulate flower specific metabolism Genes that negatively regulate ovule formation, meiosis, fertilization and seed development | Non-floral organs are repressed Flower-specific pathways are induced |  |
| AP2 Reproduction Genes | Genes activated by AP2 transcription factors | Many steps and pathways induced, developmental and metabolic | Proteins associated with: Energy production and conversion |
|  | Genes that induce petal and stamen formation | No petals or stamens produced | Amino acid transport and metabolism Carbohydrate transport and metabolism Lipid metabolism Transcription and signal transduction |

| TRANSCRIPT LEVELS | TYPE OF GENES WITH ALTERED ACTIVITY | PHYSIOLOGICAL CONSEQUENCES OF ALTERING GENE EXPRESSION | EXAMPLES OF BIOCHEMICAL ACTIVITIES OF GENES WITH ALTERED EXPRESSION |
|---|---|---|---|
| | | | Poor translational modification DNA replication Chromatin remodeling |

While polynucleotides and gene products modulating reproduction can act alone, combinations of these polynucleotides also affect growth and development. Useful combinations include different polynucleotides and/or gene products of the instant invention that have similar transcription profiles or similar biological activities, and members of the same or similar biochemical pathways. In addition, the combination of a polynucleotide and/or gene product(s) capable of modulating reproduction with a hormone responsive polynucleotide, particularly one affected by gibberellic acid and/or Auxin, is also useful because of the interactions that exist between hormone-regulated pathways, and development. Here, in addition to polynucleotides having similar transcription profiles and/or biological activities, useful combinations include polynucleotides that may have different transcription profiles but which participate in common or overlapping pathways.

Use of Promoters and Reproduction Genes

Promoter of reproduction genes are useful for transcription of desired polynucleotides, both plant and non-plant. For example, extra copies of carbohydrate transporter genes can be operably linked to a reproduction gene promoter and inserted into a plant to increase the "sink" strength of flowers or siliques. Similarly, reproduction gene promoters can be used to drive transcription of metabolic enzymes capable of altering the oil, starch, protein or fiber of a flower or silique. Alternatively, reproduction gene promoters can direct expression of non-plant genes that can, for instance confer insect resistance specifically to a flower.

III.A.7. Ovule Genes, Gene Components and Products

The ovule is the primary female sexual reproductive organ of flowering plants. It contains the egg cell and, after fertilization occurs, contains the developing seed. Consequently, the ovule is at times comprised of haploid, diploid and triploid tissue. As such, ovule development requires the orchestrated transcription of numerous polynucleotides, some of which are ubiquitous, others that are ovule-specific and still others that are expressed only in the haploid, diploid or triploid cells of the ovule.

Although the morphology of the ovule is well known, little is known of these polynucleotides and polynucleotide products. Mutants allow identification of genes that participate in ovule development. As an example, the pistillata (PI) mutant replaces stamens with carpels, thereby increasing the number of ovules present in the flower. Accordingly, comparison of transcription levels between the wild-type and PI mutants allows identification of ovule-specific developmental polynucleotides.

Changes in the concentration of ovule-specific polynucleotides during development results in the modulation of many polynucleotides and polynucleotide products. Examples of such ovule-specific responsive polynucleotides and polynucleotide products are shown in the Reference, Sequence, Protein Group, Protein Group Matrix, MA_diff, and MA_clust tables. These polynucleotides and/or products are responsible for effects on traits such as fruit production and seed yield.

While ovule-specific developmentally responsive polynucleotides and polynucleotide products can act alone, combinations of these polynucleotides also affect fruit and seed growth and development. Useful combinations include different ovule-specific developmentally responsive polynucleotides and/or polynucleotide products that have similar transcription profiles or similar biological activities, and members of the same or similar biochemical pathways. In addition, the combination of an ovule-specific developmentally responsive polynucleotide and/or polynucleotide product with an environmentally responsive polynucleotide is also useful because of the interactions that exist between development, hormone-regulated pathways, stress pathways and nutritional pathways. Here, in addition to polynucleotides having similar transcription profiles and/or biological activities, useful combinations include polynucleotides that may have different transcription profiles but which participate in a common pathway. The MA_diff Table(s) reports the transcript levels of the experiment (see EXPT ID: 108595). For transcripts that had higher levels in the samples than the control, a "+" is shown. A "−" is shown for when transcript levels were reduced in root tips as compared to the control. For more experimental detail see the Example section below.

Ovule genes are those sequences that showed differential expression as compared to controls, namely those sequences identified in the MA_diff tables with a "+" or "−" indication.

Ovule Genes Identified by Cluster Analyses of Differential Expression

Ovule Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Ovule genes is any group in the MA_clust that comprises a cDNA ID that also appears in Expt ID 108595 of the MA_diff table(s).

Ovule Genes Identified by Correlation to Genes that Cause Physiological Consequences Additionally, the differential expression data and the phenotypic observations can be merged to identify pathways or networks of Ovule genes. A group in the MA_clust is considered a Ovule pathway or network if the group comprises a cDNA ID that also appears in Knock-in or Knock-out tables that causes one or more of the phenotypes described in section above.

Ovule Genes Identified by Amino Acid Sequence Similarity

Ovule genes from other plant species typically encode polypeptides that share amino acid similarity to the sequences encoded by corn and *Arabidopsis* Ovule genes. Groups of Ovule genes are identified in the Protein Group table. In this table, any protein group that comprises a peptide ID that corresponds to a cDNA ID member of a Ovule pathway or network is a group of proteins that also exhibits Ovule functions/utilities.

Such ovule-specific developmentally responsive polynucleotides and polynucleotide products can function to either increase or dampen the above phenotypes or activities either in response to transcript changes during ovule development or in the absence of ovule-specific polynucleotide fluctuations. More specifically, ovule-specific developmentally responsive polynucleotides and polynucleotide products are useful to or modulate one or more of the phenotypes, including egg cell, maturation (for development of parthenogenic embryos), metabolism, polar nuclei, fusion (for development of parthenogenic endosperm), central cell, maturation, metabolism (for alteration of endosperm metabolism), synergids, maturation, programmed cell death, nucellus, maturation, integuments, maturation, funiculus, extension (for increased seed), cuticle, maturation, tensile properties (for increased seed size), ovule, modulation of ovule senescence, and shaping (for increased seed number).

To produce the desired phenotype(s) above, one or more of the ovule-specific developmentally responsive polynucleotides and polynucleotide products can be tested by screening for the desired trait. Specifically, the polynucleotide, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Weigel et al. (2000, Plant Physiol 122: 1003-14) and Winkler et al. (1998, Plant Physiol 118: 743-50).

Alternatively, the activities of one or more of the ovule-specific developmentally responsive polynucleotides and polynucleotide products can be modulated to change biochemical or metabolic activities and/or pathways such as those noted below. Such biological activities can be measured according to the citations included in the Table below:

| GENERAL CATEGORY | BIOCHEMICAL OR METABOLIC ACTIVITIES AND/OR PATHWAYS | ASSAY |
|---|---|---|
| Cell Growth and Differentiation | Programmed Cell Death | Pennell and Lamb (1997) Plant Cell 9, 1157-1168 |
| | DNA Methylation and Imprinting | Adams et al. (2000) Development 127: 2493-502 |
| Organ Growth and Development | Ovule Growth and Development Ethylene Response Megagametophyte Development Seed Growth and Development Fertilization Independent Seed Development | De Martinis and Mariani (1999) Plant Cell 11: 1061-72 Christensen et al. (1997) Sexual Plant Reproduc 10: 49-64 Scott et al. (1998) Development 125: 3329-41 Ohad et al. (1996) PNAS USA 93: 5319-24 Chaudhury et al. (1997) PNAS USA 94: 4223-28 |
| Signal Transduction | Ethylene Metabolism Protein Remodeling Sucrose Mobilization and Partitioning Pollen Tube Adhesion Jasmonic Acid Biosynthesis | DeMartinis and Mariani (1999) Plant Cell 11: 1061-1072 Winkler et al. (1998) Plant Physiol 118: 743-750 |
| Senescence and Cell Death | Apomixis | |
| Environmental Responses | Wound and Defense Response Gene Expression Stress Response | Epple and Bohlmann (1997) Plant Cell 9: 509-20 He et al. (1998) Plant J. 14: 55-63 |

Other biological activities that can be modulated by the ovule-specific developmentally responsive polynucleotides and polynucleotide products are listed in the Reference tables. Assays for detecting such biological activities are described in the Protein Domain table section.

Ovule-specific developmentally responsive polynucleotides are characteristically differentially transcribed in response to fluctuating developmental-specific polynucleotide levels or concentrations, whether internal or external to a cell. The MA_diff Table reports the changes in transcript levels of various ovule-specific developmentally responsive polynucleotides in ovules.

These data can be used to identify a number of types of ovule-specific developmentally responsive polynucleotides. Profiles of these different ovule-specific developmentally responsive polynucleotides are shown in the Table below with examples of associated biological activities.

| TRANSCRIPTS AFFECTED BY | TYPES OF GENES | PHYSIOLOGICAL CONSEQUENCES | EXAMPLES OF BIOCHEMICAL ACTIVITY |
|---|---|---|---|
| Ethylene Signals | Responders to Ethylene | Ethylene Perception Ethylene Uptake Modulation of Ethylene Response Transduction Pathways | Transcription Factors Transporters |

| TRANSCRIPTS AFFECTED BY | TYPES OF GENES | PHYSIOLOGICAL CONSEQUENCES | EXAMPLES OF BIOCHEMICAL ACTIVITY |
|---|---|---|---|
| Protein Remodeling | | Specific Gene Transcription Initiation Repression of Pathways to Optimize Abscissic acid Response Pathways | Inhibit Transport of Abscissic acid Degradation |
| Lower at 1 hours than 6 hours | High Abscissic acid Responders | | Abscissic acid Metabolic Pathways |
| | Repressor of Abscissic acid Deprivation Pathways | Negative Regulation of Abscissic acid Pathways | |

Use of Promoters of Ovule Genes

Promoters of Ovule genes are useful for transcription of any desired polynucleotide or plant or non-plant origin. Further, any desired sequence can be transcribed in a similar temporal, tissue, or environmentally specific patterns as the Ovule genes where the desired sequence is operably linked to a promoter of a Ovule gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.A.8. Seed and Fruit Development Genes, Gene Components and Products

The ovule is the primary female sexual reproductive organ of flowering plants. At maturity it contains the egg cell and one large central cell containing two polar nuclei encased by two integuments that, after fertilization, develops into the embryo, endosperm, and seed coat of the mature seed, respectively. As the ovule develops into the seed, the ovary matures into the fruit or silique. As such, seed and fruit development requires the orchestrated transcription of numerous polynucleotides, some of which are ubiquitous, others that are embryo-specific and still others that are expressed only in the endosperm, seed coat, or fruit. Such genes are termed fruit development responsive genes.

Changes in the concentration of fruit-development responsive polynucleotides during development results in the modulation of many polynucleotides and polynucleotide products. Examples of such fruit development responsive polynucleotides and polynucleotide products relative to leaves and floral stem are shown in the Reference, Sequence, Protein Group, Protein Group Matrix, MA_diff, MA_clust, Knock-in and Knock-out tables. The polynucleotides were discovered by isolating fruits at developmental stages from *Arabidopsis* wild-type ecotype "Wassilewskija", and measuring the mRNAs expressed in them relative to those in a leaf and floral stem sample. These polynucleotides and/or products are responsible for effects on traits such as seed size, seed yield, seed composition, seed dormancy, fruit ripening, fruit production, and pod shattering.

While fruit development responsive polynucleotides and polynucleotide products can act alone, combinations of these polynucleotides also affect fruit and seed growth and development. Useful combinations include different polynucleotides and/or polynucleotide products that have similar transcription profiles or similar biological activities, and members of the same or functionally similar biochemical pathways. In particular, modulation of transcription factors and/or signal transduction pathways are likely to be useful for manipulating whole pathways and hence phenotypes. In addition, the combination of ovule-developmentally responsive polynucleotides and/or polynucleotide products with environmentally responsive polynucleotides is also useful because of the interactions that exist between development, hormone-regulated pathways, stress and pathogen induced pathways and nutritional pathways. Here, useful combinations include polynucleotides that may have different transcription profiles, and participate in common or overlapping pathways but combine to produce a specific, phenotypic change.

Such fruit development responsive polynucleotides and polynucleotide products can function to either increase or dampen the above phenotypes or activities either in response to transcript changes in fruit development or in the absence of fruit development polynucleotide fluctuations.

The MA_diff Table(s) reports the transcript levels of the experiment (see EXPT ID: 108436, 108437, 108438). For transcripts that had higher levels in the samples than the control, a "+" is shown. A "−" is shown for when transcript levels were reduced in root tips as compared to the control. For more experimental detail see the Example section below.

Fruit genes are those sequences that showed differential expression as compared to controls, namely those sequences identified in the MA_diff tables with a "+" or "−" indication.

Fruit Genes Identified by Cluster Analyses of Differential Expression

Fruit Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Fruit genes is any group in the MA_clust that comprises a cDNA ID that also appears in Expt ID 108436, 108437, 108438 of the MA_diff table(s).

Fruit Genes Identified by Correlation to Genes that Cause Physiological Consequences Additionally, the differential expression data and the phenotypic observations can be merged to identify pathways or networks of Fruit genes. A group in the MA_clust is considered a Fruit pathway or network if the group comprises a cDNA ID that also appears in Knock-in or Knock-out tables that causes one or more of the phenotypes described in section above.

Fruit Genes Identified by Amino Acid Sequence Similarity

Fruit genes from other plant species typically encode polypeptides that share amino acid similarity to the sequences encoded by corn and *Arabidopsis* Fruit genes. Groups of Fruit genes are identified in the Protein Group table. In this table, any protein group that comprises a peptide ID that corresponds to a cDNA ID member of a Fruit pathway or network is a group of proteins that also exhibits Fruit functions/utilities.

Use of Fruit Development Responsive Genes to Modulate Phenotypes

Manipulation of the polynucleotides in the mature ovule, developing embryo, endosperm, seed coat and fruit enables many features of seed and fruit to be improved including the following:

Female fertility, megasporogenesis, embryo and endosperm development, ovule size, endosperm size, embryo size, seed size, seed yield, seed protein, seed oil, seed starch, seed cell number, cell size, seed coat development, organ size, dormancy and acquisition of desiccation tolerance, seed storage and longevity, seed germination, apomixis, production of seedless fruit and vegetables and hybrid seed production.

To improve any of the phenotype(s) above, activities of one or more of the fruit development responsive polynucleotides and polynucleotide products can be modulated and the plants can be tested by screening for the desired trait. Specifically, the polynucleotide, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed.

Use of Fruit Development Responsive Genes to Modulate Biochemical Activities

The activities of one or more of the fruit-expressed polynucleotides and polynucleotide products can be modulated to change biochemical or metabolic activities and/or pathways such as those noted below. Such biological changes can be achieved and measured according to citations such as the following:

1. Winkler et al. (1998). Plant Physiol. 118, 743-750
2. Weigel et al. (2000). Plant Physiol. 122, 1003-1014
3. Cosgrove (1997). Plant Cell 9, 1031-1041
4. Jacobs (1997). Plant Cell 9, 1021-1029
5. Reismeier et al. (1994). EMBO J. 13, 1-7
6. Carland et al. (1999). Plant Cell 11, 2123-2138
7. Cheng et al. (1996). Plant Cell 8, 971-983
8. Weber et al. (1995). Plant Cell 7, 1835-1846
9. Leyser and Furner (1992). Development 116, 397-403
10. Hayashi et al. (1998). Plant Cell 10, 183-196.
11. Pyke (1999). Plant Cell 11, 549-556
12. Lotan et al. (1998). Cell 93, 1195-1205
13. Lending and Larkins (1989). Plant Cell 1, 1011-1023
14. Hong et al. (1996). Development 122, 2051-2058.
15. Fernandez et al. (2000). Science 289, 436-438
16. D'Aoust et al. (1999). Plant Cell 11, 2407-2418
17. Bewley (1997). Plant Cell 9, 1055-1066
18. Heath et al. (1986). Planta 169, 304-312
19. Browse et al. (1986). Anal. Biochem. 152, 141-145
20. D'Aoust et al. (1999). Plant Cell 11, 2407-2418

Other biological activities that can be modulated by the fruit-specific developmentally responsive polynucleotides and polynucleotide products are listed in Reference Tables. Assays for detecting such biological activities are described in the table as well as in the Protein Domain tables.

| BIOLOGICAL FUNCTION | | UTILITY | CITATION | ASSAY | CITATION |
|---|---|---|---|---|---|
| Ovule Growth, Ovule Development and Seed Growth and Development | Ethylene and ethylene signal transduction pathway Examples: AP2 domain DNA binding proteins; EREBP, EBF Example: Leucine-rich receptor kinase; ETR-like Example: Raf kinase; CTR | Manipulate female fertility. Manipulate megasporogenesis. Manipulate female gametophyte development. Manipulate fertilization independent endosperm development. Manipulate fertilization independent embryo development. Manipulate fertilization independent seed development. Manipulate ovule size. Manipulate endosperm size. Manipulate embryo size. Manipulate seed size. | De Martinis and Mariani (1999). Plant Cell 11, 1061-1072. Silencing gene expression of the ethylene-forming enzyme results in a reversible inhibition of ovule development in transgenic tobacco plants. Christensen et al. (1997). Sexual Plant Reproduc. 10, 49-64. Megagametogenesis in *Arabidopsis* wild type and the Gf mutant. Christiansen and Drews, unpublished | Analyze ovule and seed development by light microscopy or by confocal microscopy. Test for fertilization independent endosperm development. Test for fertilization independent embryo development. Test for fertilization independent seed production. Analyze seed size. Analyze seed yield. Analyze seed composition. Analyze fruit size. | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in *Arabidopsis*. Ohad et al. (1996). PNAS USA 93, 5319-5324. A mutation that allows endosperm development without fertilization Chaudhury et al. (1997). PNAS USA 94, 4223-4228. Fertilization-independent |

-continued

| BIOLOGICAL FUNCTION | UTILITY | CITATION | ASSAY | CITATION |
|---|---|---|---|---|
| | Manipulate seed yield. Manipulate seed protein. Manipulate seed oil. Manipulate starch production. Manipulate cell number. Manipulate cell size. Produce seedless fruit and vegetables Manipulate fruit size. | | | seed development in Arabidopsis *thaliana* De Martinis and Mariani (1999). Plant Cell 11, 1061-1072. Silencing gene expression of the ethylene-forming enzyme results in a reversible inhibition of ovule development in transgenic tobacco plants. Christensen et al. (1997). Sexual Plant Reproduc. 10, 49-64. Megagametogenesis in *Arabidopsis* wild type and the Gf mutant. Scott et al. (1998). Development 125, 3329-3341. Parent-of-origin effects on seed development in *Arabidopsis thaliana* Heath et al. (1986). Planta 169, 304-312. Browse et al. (1986). Anal. Biochem. 152, 141-145. D'Aoust et al. (1999). Plant Cell 11, 2407-2418. |
| 2. Growth and developmental control genes — Upregulated genes Example: DNA binding proteins; tiny-like, AGL1, FBP2, AGL9, AP3, CPC-like myb. Example: Protein kinase; ASK1. Example: | Manipulate female fertility. Manipulate megasporo-genesis. Manipulate female gametophyte development. Manipulate fertilization independent endosperm development. Manipulate fertilization independent embryo development. | Wilson et al. (1996). Plant Cell 8, 659-671. A dissociation insertion causes a semidominant mutation that increases expression of TINY, an *Arabidopsis* gene related to APETALA2. Zhao et al (1999). Developmental Genetics 25, 209-223. The ASK1 gene | Analyze ovule and seed development by light microscopy or by confocal microscopy. Test for fertilization independent endosperm development. Test for fertilization independent embryo development. Test for fertilization independent | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in *Arabidopsis*. Ohad et al. (1996). PNAS |

-continued

| BIOLOGICAL FUNCTION | UTILITY | CITATION | ASSAY | CITATION |
|---|---|---|---|---|
| Auxin conjugating enzyme; indole-3-acetate beta-glucosyltransferase. Example: S/T protein kinase; APK1. Example: Leucine-rich receptor kinase; CLV1, ER, BRI, Cf-2-like. — Downregulated genes Example: Cyclin-dependent kinase; cdc2. | Manipulate fertilization independent seed development. Manipulate ovule size. Manipulate endosperm size. Manipulate embryo size. Manipulate organ size and number. Manipulate seed size. Manipulate seed yield. Manipulate seedling size through seed size. Manipulate seedling vigor through seed size. Manipulate seed protein. Manipulate seed oil. Manipulate starch production. Manipulate integument development. Manipulate seedcoat development. Manipulate cell size. Manipulate cell number. Manipulate homeotic gene expression. Manipulate organ size. Manipulate meristem size. Produce seedless fruit and vegetables Manipulate fruit size. Manipulate time of seed dispersal. Manipulate seed viability upon storage. Manipulate germination frequency. | regulates development and interacts with the UFO gene to control floral organ identity in *Arabidopsis*. Flanagan et al. (1996). Plant J. 10, 343-53. Specific expression of the AGL1 MADS-box gene suggests regulatory functions in *Arabidopsis* gynoecium and ovule development. Angenent et al. (1994). Plant J 1994. 5, 33-44. Co-suppression of the petunia homeotic gene fbp2 affects the identity of the generative meristem. AGL9 web page. Wada et al. (1997) Science 277, 1113-6. Epidermal cell differentiation in Arabidopsis determined by a Myb homolog CPC. Szerszen et al. (1994). Science 16, 1699-1701. iaglu, a gene from Zea mays involved in conjugation of growth hormone indole-3-acetic acid. Ito et al. (1997). Plant Cell Physiol. 38, 248-258. A serine/threonine protein kinase gene isolated by an in vivo binding procedure using the | seed production. Analyze seed size. Analyze seed yield. Analyze seed composition. Analyze fruit size. Analyze seedling size. Analyze seedling viability. Screen for changes in shatter time. Screen for changes in germination frequency. Screen for seed longevity and viability. | USA 93, 5319-5324. A mutation that allows endosperm development without fertilization Chaudhury et al. (1997). PNAS USA 94, 4223-4228. Fertilization-independent seed development in *Arabidopsis thaliana* De Martinis and Mariani (1999). Plant Cell 11, 1061-1072. Silencing gene expression of the ethylene-forming enzyme results in a reversible inhibition of ovule development in transgenic tobacco plants. Christensen et al. (1997). Sexual Plant Reproduc. 10, 49-64. Megagametogenesis in *Arabidopsis* wild type and the Gf mutant. Scott et al. (1998). Development 125, 3329-3341. Parent-of-origin effects on seed development in *Arabidopsis thaliana*. Heath et al. (1986). Planta 169, 304-312. Browse et al. (1986). Anal. Biochem. 152, 141-145. D'Aoust et al. (1999). Plant Cell 11, 2407-2418. |

| BIOLOGICAL FUNCTION | UTILITY | CITATION | ASSAY | CITATION |
|---|---|---|---|---|
| | | Arabidopsis floral homeotic gene product, AGAMOUS. Clark et al. (1997). Cell 89, 575-585. The CLAVATA1 gene encodes a putative receptor kinase that controls shoot and floral meristem size in Arabidopsis. Torii et al. (1996). Plant Cell 8, 735-746. The Arabidopsis ERECTA gene encodes a putative receptor protein kinase with extracellular leucine-rich repeats. Li and Chory (1997). Cell 90, 929-38. A putative leucine-rich repeat receptor kinase involved in brassinosteroid signal transduction. | | |
| 3. Cell senescence and cell death Example: Cystatin Example: WIPK | Manipulate female fertility. Manipulate seed set. Manipulate seed yield. Manipulate seed size. Manipulate fruit set. Promote apomixis. Produce Seedless fruit and vegetables. | Solomon et al. (1999). Plant Cell 11, 431-444. The involvement of cysteine proteases and protease inhibitor genes in the regulation of programmed cell death in plants. Zhang et al. (2000). Plant J. 23, 339-347. Multiple levels of tobacco WIPK activation during the induction of cell death by fungal elicitins. | Analyze ovule and seed development by light microscopy or by confocal microscopy. Analyze seed set. Analyze seed size. Analyze seed yield. Analyze fruit set. Screen for fertilization independent seed development. | Winkler et al. (1998). Plant Physiol. 118, 743-750. Systematic reverse genetics of transfer-DNA-tagged lines of Arabidopsis. Weigel et al. (2000). Plant Physiol 122, 1003-1014. Activation tagging in Arabidopsis. Ohad et al. (1996). PNAS USA 93, 5319-5324. A mutation that allows endosperm development without fertilization |
| 4. Protein remodeling | Manipulate female | Christensen et al. (1997). | Test for altered female | Winkler et al. (1998). Plant |

-continued

| BIOLOGICAL FUNCTION | UTILITY | CITATION | ASSAY | CITATION |
|---|---|---|---|---|
| Example: DNA-J protein/chaperones | fertility. Manipulate female gametophyte development. Promote apomixis. Manipulate endosperm development. Manipulate embryo development. Manipulate seed size. Manipulate seed yield. Manipulate seed protein. Manipulate seed oil. Manipulate starch. Produce seedless fruit and vegetables. | Sexual Plant Reproduc. 10, 49-64. Megagametogenesis in *Arabidopsis* wild type and the Gf mutant. Cory Christiansen and Gary Drews, unpublished | fertility, seed set, seed yield. Analyze ovule development by light microscopy or by confocal microscopy. Analyze seed size. Analyze seed yield. Analyze seed composition. | Physiol. 118, 743-750. Systematic reverse genetics of transfer-DNA-tagged lines of *Arabidopsis*. Weigel et al. (2000). Plant Physiol 122, 1003-1014. Activation tagging in *Arabidopsis*. Christensen et al. (1997). Sexual Plant Reproduc. 10, 49-64. Megagametogenesis in *Arabidopsis* wild type and the Gf mutant. Ohad et al. (1996). PNAS USA 93, 5319-5324. A mutation that allows endosperm development without fertilization Scott et al. (1998). Development 125, 3329-3341. Parent-of-origin effects on seed development in *Arabidopsis thaliana*. Heath et al. (1986). Planta 169, 304-312. Browse et al. (1986). Anal. Biochem. 152, 141-145. D'Aoust et al. (1999). Plant Cell 11, 2407-2418. |
| 5. Sucrose mobilization and partitioning Example: Invertase inhibitor Example: bZIP transcription factor (translation of bZIP protein is inhibited by sucrose levels greater than 25 mM) | Manipulate female fertility. Manipulate ovule development. Manipulate seed development. Manipulate endosperm development. Manipulate embryo development. Manipulate | Mapping of tomato genes associated with sugar metabolism. Tomato Genetics Co-op Report 48, 22-23 (1998) Ikeda et al. (1999). Plant Physiol 121, 813-820. Sucrose and Cytokinin Modulation of | Analyze ovule and seed development by light microscopy or by confocal microscopy. Determine female fertility. Analyze seed mass. Analyze seed yield. Analyze seed composition. | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in |

-continued

| BIOLOGICAL FUNCTION | UTILITY | CITATION | ASSAY | CITATION |
|---|---|---|---|---|
| Example: Lipoxygenase — Downregulated gene Example: SNF1-related protein kinase | seed size. Manipulate seed yield. Manipulate seed protein. Manipulate seed oil. Manipulate starch. Manipulate cell size. Manipulate cell number. Manipulate organ size. Manipulate meristem size. Manipulate seedling size through seed size. Manipulate seedling viability through seed size. Produce seedless fruit and vegetables. Translational control of gene expression in ovule and seed by sucrose. Manipulate assimilate partitioning in ovule and seed development. | WPK4, a Gene Encoding a SNF1-Related Protein Kinase from Wheat. Rook et al. (1998). Plant J. 15, 253-263. Sucrose-specific signaling represses translation of the *Arabidopsis* ATB2 bZIP transcription factor gene. Rook et al. (1998). Plant Mol Biol 37, 171-178. The light-regulated *Arabidopsis* bZIP transcription factor gene ATB2 encodes a protein with an unusually long leucine zipper domain. Bunker et al. (1995). Plant Cell 7, 1319-1331. Sink limitation induces the expression of multiple soybean vegetative lipoxygenase mRNAs while the endogenous jasmonic acid level remains low. Lowry et al. (1998). Plant Physiol. 116, 923-933. Specific soybean lipoxygenases localize to discrete subcellular compartments and their mRNAs are differentially regulated by source-sink status. | Analyze organ size. Analyze seedling size. Analyze seedling viability. | *Arabidopsis*. Christensen et al. (1997). Sexual Plant Reproduc. 10, 49-64. Megagametogenesis in *Arabidopsis* wild type and the Gf mutant. Ohad et al. (1996). PNAS USA 93, 5319-5324. A mutation that allows endosperm development without fertilization Scott et al. (1998). Development 125, 3329-3341. Parent-of-origin effects on seed development in *Arabidopsis thaliana*. 6. Heath et al. (1986). Planta 169, 304-312. 7. Browse et al. (1986). Anal. Biochem. 152, 141-145. 8. D'Aoust et al. (1999). Plant Cell 11, 2407-2418. |
| 6. Jasmonic acid biosynthesis and signal | Targeted death of cells belonging to the female gametophyte, | Sanders et al. (2000). Plant Cell 12, 1041-1062. The *Arabidopsis* | Test for altered female fertility. Analyze male fertility. | Winkler et al. (1998). Plant Physiol. 118, 743-750. Systematic |

| | BIOLOGICAL FUNCTION | UTILITY | CITATION | ASSAY | CITATION |
|---|---|---|---|---|---|
| | transduction pathway Example: Biosynthetic enzyme; FMN oxidoreductase 12-oxophyto-dienoate reductase, OPR1, OPR1-like. Example: Signal transduction pathway kinase WIPK. | ovule or integuments. Delay senescence of unfertilized female gametophyte, ovule or integuments. Manipulate female fertility Coordinate female with male reproduction. Manipulate male fertility. Enhanced defense response in ovules and seed | DELAYED DEHISCENCE1 gene encodes an enzyme in the jasmonic acid synthesis pathway. Vijayan et al. (1998). A role for jasmonate in pathogen defense of *Arabidopsis*. PNAS USA 95, 7209-7214. Seo et al. (1999). Plant Cell 11, 289-298. Jasmonate-based wound signal transduction requires activation of WIPK, a tobacco mitogen-activated protein kinase. | Screen for enhanced expression of pathogen defense response genes. | reverse genetics of transfer-DNA-tagged lines of *Arabidopsis* Weigel et al. (2000). Plant Physiol 122, 1003-1014. Activation tagging in *Arabidopsis*. |
| Environmental responses | 1. Wound and defense response gene expression Example: Leucine rich receptor S/T kinase; Xa21-like and TMK-like. Example: Cell wall-associated protein kinase WAK1. Example: Thionins. | Pathogen resistant ovules. Pathogen resistant seeds. Pathogen resistant fruit. | Song et al. (1995). Science 270, 1804-1806. A receptor kinase-like protein encoded by the rice disease resistance gene, Xa21. Seo et al. (1995). Science 270, 1988-1992. Tobacco MAP kinase: a possible mediator in wound signal transduction pathways. He et al. (1998). Plant J. 14, 55-63. Requirement for the induced expression of a cell wall associated receptor kinase for survival during the pathogen response. He et al. (1999). Plant Mol. Biol. 39, 1189-1196. A cluster of five cell wall-associated receptor kinase genes, Wak1-5, are expressed in specific | Resistance to *Xanthamonas* sp. Resistance to known *arabidopsis* pathogens in ovules, seed and fruit. | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in *Arabidopsis*. Epple and Bohlmann (1997). Plant Cell 9, 509-520. Overexpression of an endogenous thionin enhances resistance of *Arabidopsis* against *Fusarium oxysporum*. He et al. (1998). Plant J. 14, 55-63. Requirement for the induced expression of a cell wall associated receptor kinase for survival during the pathogen |

-continued

| BIOLOGICAL FUNCTION | UTILITY | CITATION | ASSAY | CITATION |
|---|---|---|---|---|
| | | organs of *Arabidopsis*. Epple and Bohlmann (1997). Plant Cell 9, 509-520. Overexpression of an endogenous thionin enhances resistance of *Arabidopsis* against *Fusarium oxysporum*. Ichimura et al. (1998). DNA Res. 5,341-5348. Molecular cloning and characterization of three cDNAs encoding putative mitogen-activated protein kinase kinases (MAPKKs) in *Arabidopsis thaliana*. | | response. |
| 2. Stress response to cold, drought, salinity, seed maturation, embryo development, ABA. Example: Dehydrins Example: NPK1-like protein kinase Example: DNA binding protein genes: CBF-like, DREB2A, RAP2.1. | Manipulate drought resistance. Manipulate desiccation tolerance in flowers, ovules and seeds. Manipulate cold tolerance in flowers, ovules, and seeds. Manipulate seed dormancy. Manipulate germination frequency. Manipulate seed storage and viability. | Close, T. J. (1996). Physiol. Plant 97, 795-803. Dehydrins: emergence of a biochemical role of a family of plant dehydration proteins. Kovtun et al. (2000). PNAS USA 97, 2940-2945. Functional analysis of oxidative stress-activated mitogen-activated protein kinase cascade in plants. | Test for enhanced sensitivity to drought, dessication, cold, salinity, in ovules, developing seed and seedlings. Test for enhanced tolerance to drought, dessication, cold, salinity, in ovules, developing seed and seed. Test for changes in seed viability upon storage. Test for changes in germination frequencies. | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in *Arabidopsis*. |
| 3. Response to starvation, wounding, and pathogen attack by tryptophan synthesis. Example: DNA binding protein; ATR1-like myb. Example: Auxin conjugating enzyme; indole-3- | Altered response to starvation. Altered response to wounding. Altered response to pathogen attack. | Bender and Fink (1998). A myb homologue, ATR1, activates tryptophan gene expression in *arabidopsis*. PNAS USA 95, 5655-5660. | Test for enhanced sensitivity to starvation, wounding, and pathogen attack. Test for enhanced tolerance to starvation, wounding, and pathogen attack. | Winkler et al. (1998). Plant Physiol. 118, 743-750. Systematic reverse genetics of transfer-DNA-tagged lines of *Arabidopsis*. Weigel et al. (2000). Plant Physiol 122, 1003-1014. Activation tagging in |

-continued

|  | BIOLOGICAL FUNCTION | UTILITY | CITATION | ASSAY | CITATION |
|---|---|---|---|---|---|
| Cell metabolism | acetate beta-glucosyltransferase. Stearoyl-acyl carrier protein desaturase Example: C18 fatty acid desaturation | Production of oils high in saturated fatty acids Manipulate membrance composition | Merlo et al. (1998). Plant Cell 10, 1603-1621. | Analyze seed size. Analyze seed yield. Analyze seed composition. Analyze seed oil by gas chromatography. | *Arabidopsis.* Winkler et al. (1998). Plant Physiol. 118, 743-750. Systematic reverse genetics of transfer-DNA-tagged lines of *Arabidopsis.* Weigel et al. (2000). Plant Physiol 122, 1003-1014. Activation tagging in *Arabidopsis.* Browse et al. (1986). Anal. Biochem. 152, 141-145. |
|  | 2. Manipulate nitrogen economy Example: Asparaginase | Manipulate asparagine degradation in ovules and seeds. Manipulate endosperm production. Manipulate embryo development. Manipulate ovule size. Manipulate seed size. | Mathews and Van Holde | Analyze seed size. Analyze seed yield. Analyze seed composition. | Winkler et al. (1998). Plant Physiol. 118, 743-750. Systematic reverse genetics of transfer-DNA-tagged lines of *Arabidopsis.* Weigel et al. (2000). Plant Physiol 122, 1003-1014. Activation tagging in *Arabidopsis.* Heath et al. (1986). Planta 169, 304-312. Browse et al. (1986). Anal. Biochem. 152, 141-145. D'Aoust et al. (1999). Plant Cell 11, 2407-2418. |

Fruit development responsive polynucleotides are characteristically differentially transcribed in response to fluctuating developmental-specific polynucleotide levels or other signals, whether internal or external to a cell. MA_diff reports the changes in transcript levels of various fruit development responsive polynucleotides in fruits.

These data can be used to identify a number of types of fruit development responsive polynucleotides. Profiles of some of these different fruit development responsive polynucleotides are shown in the table below with examples of the kinds of associated biological activities. Because development is a continuous process and many cell types are being examined together, the expression profiles of genes overlap between stages of development in the chart below.

| Transcript Levels | Developmental Process | Metabolic Pathways | Examples of Biochemical Activity |
|---|---|---|---|
| (0-5 mm) >> (5-10 mm) ≅ (>10 mm)<br>(0-5 mm) >> (5-10 mm) > (>10 mm)<br>(0-5 mm) > (5-10 mm) ≅ (>10 mm) | Ovule Elongation<br>Tissue Specialization<br>Vascular system<br>Meristem<br>Endosperm<br>Seed coat<br>Fruit | Hormone Production, Transport, Perception, Signalling, Response (e.g., Gibberellin, Ethylene, Auxin)<br>Cell wall Biosynthesis<br>Lipid Biosynthesis<br>Specific Gene Transcription Initiation<br>Sucrose Mobilization and Partitioning<br>Sucrose Signaling<br>Lipoxygenase Localization<br>Repressors of Metabolic Pathways<br>Protein Remodeling | Transcription Factors<br>Transporters<br>Kinases<br>Changes in cytoskeletal protein activity modulating cell structure<br>Stability factors for protein translation<br>Changes in cell wall/membrane structure<br>Chromatin structure and/or DNA topology<br>Biosynthetic enzymes |
| (5-10 mm) >> (0-5 mm) > (>10 mm)<br>(5-10 mm) > (0-5 mm) ≅ (>10 mm)<br>(5-10 mm) >> (0-5 mm) ≅ (>10 mm) | Tissue Specialization<br>Vascular System<br>Organelle Differentiation<br>Cotyledon Elongation (cell division)<br>Vacuome Development<br>Lipid Deposition | Cell Wall Biosynthesis<br>Specific Gene Transcription Initiation<br>Sucrose Mobilization and Partitioning<br>Sucrose Signaling<br>Repressors of Metabolic Pathways<br>Auxin Perception, Response and Signaling<br>Protein Remodeling<br>Lipid Biosynthesis and Storage | Transcription Factors<br>Transporters<br>Kinases<br>Chaperones<br>Changes in cytoskeletal protein activity modulating cell strucure<br>Stability of factors for protein translation<br>Changes in cell wall/membrane structure<br>Chromatin structure and/or DNA topology<br>Biosynthetic enzymes |
| (>10 mm) > (0-5 mm) ≅ (5-10 mm) | Cotyledon Elongation (expansion)<br>Lipid Deposition<br>Protein Deposition<br>Desiccation | Cell Elongation<br>Specific Gene Transcription Initiation<br>Sucrose Mobilization and Partitioning<br>Sucrose Signaling<br>Lipoxygenase Localization<br>Repressors of metabolic pathways<br>Hormone Perception, Response and Signaling (e.g. abscissic acid)<br>Protein Remodeling<br>Protein synthesis and Storage<br>Lipid Synthesis and Storage<br>Acquisition of Dessication Tolerance<br>Senescence | Transcription Factors<br>Transporters<br>Kinases<br>Chaperones for protein translation<br>Changes in cell wall/membrane structure<br>Chromatin structure and/or DNA topology<br>Biosynthetic enzymes<br>Metabolic enzymes |
| (0-5 mm) < (5-10 mm) ≅ (>10 mm)<br>(0-5 mm) << (5-10 mm) ≅ (>10 mm) | Ovule Elongation<br>Repressors of Ethylene production | Cell elongation<br>Negative regulation of ethylene pathways<br>Maintenance of Ethylene | Transcription Factors<br>Transporters<br>Kinases |

-continued

| Transcript Levels | Developmental Process | Metabolic Pathways | Examples of Biochemical Activity |
|---|---|---|---|
| (0-5 mm) << (5-10 mm) < (>10 mm)<br>(0-5 mm) << (>10 mm) < (5-10 mm) | Tissue specialization<br>Vascular System<br>Meristem<br>Cotyledon<br>Seed Coat | response<br>Changes in pathways and processes operation in cells | Chaperones<br>Stability of factors<br>Biosynthetic enzymes<br>Metabolic enzymes |
| (5-10 mm) < (0-5 mm) ≅ (>10 mm) | Organelle differentiation<br>Cotyledon elongation (division)<br>Vacuome development<br>Lipid development<br>Desiccation | Negative regulation of hormone pathways<br>Maintenance of hormone response<br>Changes in pathways and processes operation in cells<br>Dehydration and acquisition of desiccation tolerance<br>Senescence | Transcription Factors<br>Transporters<br>Kinases<br>Chaperones |
| (>10 mm) < (0-5 mm) ≅ (5-10 mm) | Cotyledon Elongation (expansion)<br>Lipid deposition<br>Protein deposition<br>Desiccation | Cell elongation<br>Negative regulation of hormone pathways<br>Maintenance of hormone response<br>Changes in pathways and processes operation in cells<br>Dehydration and acquisition of desiccation tolerance<br>Senescence | Transcription Factors<br>Transporters<br>Kinases<br>Chaperones<br>Metabolic enzymes<br>Biosynthetic enzymes |
| (0-5 mm) ≅ (5-10 mm) ≅ (>10 mm) | All stages | Ribosome/polysome production and maintenance<br>Housekeeping genes | Transcription Factors<br>Transporters<br>Kinases<br>Chaperones |

III.B. Development Genes, Gene Components and Products

III.B.1. Imbibition and Germination Responsive Genes, Gene Components and Products Seeds are a vital component of the world's diet. Cereal grains alone, which comprise ~90% of all cultivated seeds, contribute up to half of the global per capita energy intake. The primary organ system for seed production in flowering plants is the ovule. At maturity, the ovule consists of a haploid female gametophyte or embryo sac surrounded by several layers of maternal tissue including the nucleus and the integuments. The embryo sac typically contains seven cells including the egg cell, two synergids, a large central cell containing two polar nuclei, and three antipodal cells. That pollination results in the fertilization of both egg and central cell. The fertilized egg develops into the embryo. The fertilized central cell develops into the endosperm. And the integuments mature into the seed coat. As the ovule develops into the seed, the ovary matures into the fruit or silique. Late in development, the developing seed ends a period of extensive biosynthetic and cellular activity and begins to desiccate to complete its development and enter a dormant, metabolically quiescent state. Seed dormancy is generally an undesirable characteristic in agricultural crops, where rapid germination and growth are required. However, some degree of dormancy is advantageous, at least during seed development. This is particularly true for cereal crops because it prevents germination of grains while still on the ear of the parent plant (preharvest sprouting), a phenomenon that results in major losses to the agricultural industry. Extensive domestication and breeding of crop species have ostensibly reduced the level of dormancy mechanisms present in the seeds of their wild ancestors, although under some adverse environmental conditions, dormancy may reappear. By contrast, weed seeds frequently mature with inherent dormancy mechanisms that allow some seeds to persist in the soil for many years before completing germination.

Germination commences with imbibition, the uptake of water by the dry seed, and the activation of the quiescent embryo and endosperm. The result is a burst of intense metabolic activity. At the cellular level, the genome is transformed from an inactive state to one of intense transcriptional activity. Stored lipids, carbohydrates and proteins are catabolized fueling seedling growth and development. DNA and organelles are repaired, replicated and begin functioning. Cell expansion and cell division are triggered. The shoot and root apical meristem are activated and begin growth and organogenesis. Schematic 4 summarizes some of the metabolic and cellular processes that occur during imbibition. Germination is complete when a part of the embryo, the radicle, extends to penetrate the structures that surround it. In *Arabidopsis*, seed germination takes place within twenty-four (24) hours after imbibition. As such, germination requires the rapid and orchestrated transcription of numerous polynucleotides. Germination is followed by expansion of the hypocotyl and opening of the cotyledons. Meristem development continues to promote root growth and shoot growth, which is followed by early leaf formation.

Genes with activities relevant to imbibition-germination and early seedling growth are described in the two sections A and B below.

III.B.1.a. Identification of Imbibition and Germination Genes

Imbibition and germination includes those events that commence with the uptake of water by the quiescent dry seed and terminate with the expansion and elongation of the shoots and roots. The germination period exists from imbibition to when part of the embryo, usually the radicle, extends to penetrate the seed coat that surrounds it. Imbibition and germination genes identified herein are defined as genes, gene components and products capable of modulating one or more processes of imbibition and germination described above. They are useful to modulate many plant traits from early vigor to yield to stress tolerance. Examples of such germination genes and gene products are shown in the Reference and Sequence Tables. The functions of many of the genes were deduced from comparisons with known proteins and are also given in the REF Tables.

Imbibition and Germination Genes Identified by Phenotypic Observations

Imbibition and germination genes are active, potentially active or more active during growth and development of a dry seed into a seedling. These genes herein were discovered and characterized from a much larger set of genes in experiments designed to find genes that cause poor germination.

In these experiments, imbibition and germination genes were identified by either 1) ectopic expression of a cDNA in a plant or (2) mutagenesis of the plant genome. The seeds were then imbibed and cultivated under standardized conditions and any phenotypic differences in the modified plants compared with the parental "wild-type" seedlings were recorded. The genes causing the changes were deduced from the cDNA inserted or gene mutated. The phenotypic differences observed were poor germination and aberrant seedlings.

Imbibition and Germination Genes Identified by Differential Expression

Germination genes were also identified by measuring the relative levels of mRNA products of genes in different stages of germination of a seed versus the plant as a whole. Specifically, mRNA was isolated from whole imbibed seeds of *Arabidopsis* plants 1, 2, 3 or 4 days after imbibition and compared to mRNA isolated from dry seed-utilizing microarray procedures. The MA_diff Table reports the transcript levels of the experiment. For transcript levels that were higher in the imbibed seed than in dry seed a "+" is shown. A "−" is shown when the transcript levels in dry seed were greater than those in imbibed seed. For more experimental detail, see the examples below:

Germination associated genes can be identified by comparing expression profiles of imbibed gibberellin treated and untreated ga1 mutant seed. Germination associated genes can also be identified by comparing expression profiles in late maturation seed from wild-type and mutants that are defective for the establishment of dormancy and can germinate precociously (e.g. aba1, aba2, abi4 in *arabidopsis* and vp1, vp5 in maize) or are defective for the specification of cotyledon identity and dessication tolerance (e.g. lec1, lec2, and fus3).

The MA_diff Table(s) reports the transcript levels of the experiment (see EXPT ID: 108461, 108462, 108463, 108464, 108528, 108529, 108530, 108531, 108545, 108546, 108547, 108518, 108529, 108543, 108544). For transcripts that had higher levels in the samples than the control, a "+" is shown. A "−" is shown for when transcript levels were reduced in root tips as compared to the control. For more experimental detail see the Example section below.

Imbibed & Germinating Seeds genes are those sequences that showed differential expression as compared to controls, namely those sequences identified in the MA_diff tables with a "+" or "−" indication.

Imbibed & Germinating Seeds Genes Identified by Cluster Analyses of Differential Expression Imbibed & Germinating Seeds Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Imbibed & Germinating Seeds genes is any group in the MA_clust that comprises a cDNA ID that also appears in Expt ID 108461, 108462, 108463, 108464, 108528, 108529, 108530, 108531, 108545, 108546, 108547, 108518, 108529, 108543, 108544 of the MA_diff table(s).

Imbibed & Germinating Seeds Genes Identified by Correlation to Genes that Cause Physiological Consequences Additionally, the differential expression data and the phenotypic observations can be merged to identify pathways or networks of Imbibed & Germinating Seeds genes. A group in the MA_clust is considered a Imbibed & Germinating Seeds pathway or network if the group comprises a cDNA ID that also appears in Knock-in or Knock-out tables that causes one or more of the phenotypes described in section above.

Imbibed & Germinating Seeds Genes Identified by Amino Acid Sequence Similarity

Imbibed & Germinating Seeds genes from other plant species typically encode polypeptides that share amino acid similarity to the sequences encoded by corn and *Arabidopsis* Imbibed & Germinating Seeds genes. Groups of Imbibed & Germinating Seeds genes are identified in the Protein Group table. In this table, any protein group that comprises a peptide ID that corresponds to a cDNA ID member of a Imbibed & Germinating Seeds pathway or network is a group of proteins that also exhibits Imbibed & Germinating Seeds functions/utilities.

III.B.1.b. Use of Imbibition and Germination Genes, Gene Components and Products to Modulate Phenotypes Imbibition and germination genes and gene products can be divided into those that act during primary events, secondary events, and/or termination. The genes and gene products of the instant invention are useful to modulate any one or more of the phenotypes described below:

I. Primary Events

A. Dormancy

Imbibition and germination genes and gene products of the invention can act to modulate different types of dormancy including:

1. Primary dormancy—dormancy is established during seed development
2. Seed coat-imposed dormancy—dormancy is imposed by blocking water uptake, mechanical restraint of embryo, blocking the exit of inhibitors
3. Embryo dormancy—cotyledon mediated inhibition of embryonic axis growth
4. Secondary dormancy—dormancy is induced when dispersed, mature seeds are exposed to unfavorable conditions for germination (e.g. anoxia, unsuitable temperature or illumination).
5. Hormone-induced B. Dormancy-breaking signal perception and transduction Germination genes and gene products include those that are able to modulate the response to dormancy releasing signals such as fruit ripening and seed development; imbibition; temperature (low and high, range 0-23°); light, particularly for coat imposed dormancy (white light, intermittent illumination, orange and red region of the spectrum (longer than 700 or 730 nm), and phytochrome); coat softening; chemicals (respiratory inhibitors, sulfhydryl compounds, oxidants, nitrogenous compounds, growth regulators—ga, ba, ethylene, and various, ethanol, methylene blue, ethyl ether, fusicoccin); oxygen and carbon dioxide; and stress.

II. Secondary Events

During the secondary events of germination, dormancy-maintaining metabolism is repressed, dormancy-breaking metabolism is induced and structures surrounding the embryo weaken (where present). Germination genes and gene products are useful to modulate processes of the secondary events including water uptake, such as cell expansion and change in osmotic state (ion exchange); and respiration—(oxygen consumption). the genes and genes products of the invention can regulate the following pathways which resume during the first respiratory burst of germination including glycolysis, pentose phosphate, citric acid, and tricarboxylic acid cycle.

A. Mitochondrial Development

Tissues of the mature dry seed contain mitochondria, and although these organelles are poorly differentiated as a consequence of the drying, they contain sufficient Kreb's cycle enzymes and terminal oxidases to provide adequate amount of ATP to support metabolism for several hours after imbibition. During germination of embryos, there appears to be two distinct patterns of mitochondrial development. In starch-storing seeds, repair and activation of preexisting organelles predominate, whereas oil-storing seeds typically produce new mitochondria. Germination genes and gene products of the invention are useful to modulate the repair, activation and biogenesis pathways of mitochondria, including membrane formation and repair, DNA repair and synthesis, protein synthesis, and coordinated regulation of mitochondrial and nuclear genomes B. Metabolism In addition to respiration and organelle activity, enzyme activity, DNA repair, RNA synthesis and protein synthesis are fundamental cellular activities intimately involved in the completion of germination and the preparation for subsequent growth. Imbibition and germination genes and gene products of the invention can participate in or modulate these activities, including ABA response, GA response, ATP synthesis and adenylate energy charge during germination, and the synthesis and utilization of reducing power: pyridine nucleotides (NADH and NADPH)

III. Termination

The last stage of seed germination is characterized by the emergence of the radicle or root apex through the seed coat. Typically, the cell walls loosen and the radicle extends from the embryo during late germination. Germination genes and gene products are useful to modulate the mobilization of stored reserves, DNA synthesis and cell division that are typical of this stage of germination.

To regulate any of the phenotype(s) above, activities of one or more of the late germination genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Dolan et al. (1993, Development 119: 71-84), Dolan et al. (1997, Development 124: 1789-98), Crawford and Glass (1998, Trends Plant Science 3: 389-95), Wang et al. (1998, PNAS USA 95: 15134-39), Gaxiola et al. (1998, PNAS USA 95: 4046-50), Apse et al. (1999, Science 285: 1256-58), Fisher and Long (1992, Nature 357: 655-60), Schneider et al. (1998, Genes Devel 12: 2013-21) and Hirsch (1999, Curr Opin Plant Biol. 2: 320-326).

III.B.1.c. Use of Imbibition and Germination Genes, Gene Components and Product to Modulate Biochemical Activities The roles of the biochemical changes associated with imbibition and germination can be appreciated from a summary of the processes occurring.

Physiology

Water plays an important role throughout the plant life cycle. The most dramatic example of this is in seed germination. Although germination is triggered by water, the germination response is also positively regulated by the plant growth regulators the gibberellins and negatively affected by the growth regulator abscisic acid. Genes that are activated by water and genes that are activated by gibberellins can be identified through expression profiling experiments using *arabidopsis* mutants defective for gibberellin biosynthesis or perception (ga1, gai), abscisic acid biosynthesis or perception (aba1, abi3, and abi4) in the presence or absence of exogenous gibberellins. These genes can be used to promote seedling growth and development and other phases of plant development.

Transcriptional Control of Gene Activity

At the end of seed development, dessication and dormancy have imposed a global state of repression on gene activity throughout the seed. Reactivation of the genome requires water and gibberellins. One function of the genes that are activated early by imbibition is the rapid and dramatic reversal of gene repression. For example, expression-profiling experiments revealed that several thousand genes are hyperactivated in *arabidopsis* upon imbibition. These include genes involved in metabolic pathways, genes that promote cell growth and division, and transcriptional control genes. Thus one class of genes expressed early in imbibition includes those that promote high levels of gene expression. Other early genes are responsible for regulating specific metabolic, cell, and developmental processes. The strategy for distinguishing these functions was outlined in the Introduction.

Mobilization of Storage Reserves

In contrast to the synthesis and accumulation of reserves during seed development an important function of genes expressed during imbibition and germination is the control of the mobilization and catabolism of seed storage reserves in the endosperm (in grasses and cereals) and the embryo. The mobilization of seed storage reserves is triggered by imbibition and may occur over several days. There are three classes of high molecular weight seed storage reserves: carbohydrates, triacylglycerols, and storage proteins. Upon imbibition seed storage reserves are converted into forms that can be transported and metabolized. Genes encoding enzymes for storage reserve catabolism are expressed shortly after imbibition. Starch for example is converted to sucrose. Triacylglycerols are converted into acetyl-CoA. Storage proteins are converted into amino acids or deaminated to provide carbon skeletons for oxidation.

Carbohydrate Catabolism

Starch is the most common storage carbohydrate in seeds. The primary components of starch are amylose and amylopectin.

Mobilization

There are two pathways for starch catabolism—hydrolytic and phosphorolytic. The product of these pathways is the monosaccharide glucose. Examples of the enzymes responsible for hydrolytic catabolism of starch are: amylase, glucosidase, amylase, dextrinase, isoamylase. The enzyme responsible for phosphorolytic activity is starch phosphorylase.

Transport

The mobilization of starch involves the synthesis of sucrose from glucose, which can then be transported to sites for growth in the root and shoot. In some seeds, maltose may be a major form of transported carbohydrate. The production of sucrose-6-P from glucose involves the following enzymes: UDP-glucose pyrophosphorylase, sucrose-6-P synthetase, and sucrose phosphatase.

Sucrose Catabolism

In target tissues sucrose is hydrolyzed by fructofuransidase (invertase) and/or sucrose synthetase. The synthesis of glucose from glucose-1-P involves sucrose synthetase.

Cell Biology

The lumen of the endoplasmic reticulum (ER) is target for other hydrolase activities including mannosidase, glucosaminidase, acid phosphatase, phosphodiesterase, and phospholipase D.

Triacylglycerol (TAG) Catabolism

Triacylglycerols are the major storage lipids of seeds. The products of TAG catabolism in imbibed and germinating seed are glycerol and free fatty acids. Most of the glycerol is converted to sucrose for export. Free fatty acids are catabolized through oxidation through the glyoxylate cycle and gluconeogenesis.

Mobilization

Hydrolysis of triacylglycerols is by lipases yielding glycerol and free fatty acids. Free fatty acids are oxidized to acetyl-CoA and propionyl-CoA via oxidation requiring ATP and coenzyme A. Catabolism of unsaturated fatty acids also requires cis, trans-isomerases, epimerases, and hydratases. Acetyl-CoA is oxidized through the citric acid cycle to $CO_2$ and $H_2O$. More importantly, acetyl-CoA can be utilized via the glyoxylate cycle and gluconeogenesis for glucose synthesis. Free fatty acids are also broken down via oxidation. Glycerol is converted via phosphorylation and oxidation to DHAP and G3P, which are used to synthesize glucose or oxidized via the citric acid cycle. Examples of other induced enzymes include isocitrate lyase and malate synthetase Transport Most of the glycerol, acetyl-CoA, and propionyl-CoA are converted to sucrose for transport. This requires the enzymes glycerol kinase and glycerol phosphate oxidoreductase.

Cell Biology

Glyoxysome biogenesis is required to support fatty acid catabolism and gluconeogenesis. Upon exposure to light there is a loss of glyoxysomes due to their conversion to peroxisomes.

Storage Protein Catabolism

Mobilization

The hydrolysis of storage proteins to amino acids is performed by a diverse group of proteinases and peptidases. The peptidases include endopeptidases, aminopeptidases, and carboxypeptidases. They include the A and B class proteinases. The liberated amino acids are available for protein synthesis, for deamination and reutilization of ammonia via glutamine and asparagine synthesis, and to provide carbon skeletons for respiration. Several enzymes including, deaminase, asparagine synthetase, glutamine synthetase and glutamate dehydrogenase are important players in the mobilization and utilization of stored nitrogen in imbibed seed.

Transport

The major transported form of amino acid in germinated seeds is asparagine. In some species glutamine and/or homoserine are the major form of transported amino acid. Aspartate, glutamate, alanine, glycine, and serine can be converted to sucrose and transported as sucrose. Other amino acids are transported unchanged.

Cell Biology

Proteinases are sequestered in lumen of endoplasmic reticulum (ER) which then fuses with protein bodies.

While catabolism is high in the storage tissues of imbibed seed the products of catabolism are transported to sites of growth including the shoot and root apices fueling respiration, biosynthesis, cell division and differentiation.

Development

Imbibition triggers several key processes for seedling development. One is the activation of the shoot and root apical meristems. The shoot apical meristem is responsible for two primary growth activities. One is the production of the protoderm, procambium and ground meristem. The protoderm gives rise to the epidermal system of the plant, the procambium to the primary vascular tissues, and the ground meristem to the ground tissues including the cortex and pith. The second is the production of leaf primordia, which arise on the flanks of the apex. Thus, activation of the shoot apical meristem results in shoot growth and organogenesis.

The root apical meristem, by contrast is responsible for vegetative root development. The first primary growth activity of the root apical meristem is the production of the protoderm, procambium and ground meristem. The second primary growth activity is the production of the cells that give rise to the root cap.

Genes that govern shoot apical meristem activation and development can be identified in *arabidopsis* by gene profiling experiments comparing gene expression in wild-type imbibed seed and partial loss-of-function stm (shootmeristemless) mutants (see SAM). Genes governing root meristem activity can be identified by gene profiling experiments comparing gene expression in wild-type imbibed seed and rml (rootmeristemless) mutants.

Genes identified in this way are useful to promote or retard meristem growth, modify and strengthen shoot and root development, promote leaf development as described below.

Changes in the concentration of imbibition-germination activated polynucleotides result in the modulation of many other polynucleotides and polynucleotide products. Examples of such activated responsive polynucleotides and polynucleotide products relative to leaves and floral stem and to fruits at different development stages are shown in the Reference and Sequence Tables. These polynucleotides and/or products are responsible fore effects on traits such as seedling growth, seedling viability, and seedling vigor. The polynucleotides were discovered by isolating seeds from *Arabidopsis* wild-type ecotype "Wassilewskija" imbibed for 24 hours, and measuring the mRNAs expressed in them relative to those in a leaf and floral stem sample and to those in fruits at different developmental stages.

While imbibition-germination activated polynucleotides and polynucleotide products can act alone, combinations of these polynucleotides also affect germination. Useful combinations include different polynucleotides and/or polynucleotide products that have similar transcription profiles or similar biological activities, and members of the same or functionally similar biochemical pathways. In addition, the combination of imbibition germination activated polynucleotides and/or polynucleotide products with environmentally responsive polynucleotides is also useful because of the interactions that exist between development, hormone-regulated pathways, stress and pathogen induced pathways and nutritional pathways. Here, useful combinations include polynucleotides that may have different transcription profiles, and participate in common or overlapping pathways but combine to produce a specific, phenotypic change.

Such imbibition and germination activated polynucleotides and polynucleotide products can function to either increase or dampen the above phenotypes or activities either in response to transcript changes in fruit development or in the absence of fruit-specific polynucleotide fluctuations.

| PROCESS | BIOCHEMICAL OR METABOLIC ACTIVITIES AND/OR PATHWAYS ALTERED | CITATIONS INCLUDING ASSAYS |
|---|---|---|
| Growth, Differentiation and Development | Farnesylation Mediated Seed Dormancy | Pei et al (1998) Science 282: 287-290; Cutler et al. (1996) Science 273: 1239 |
| Metabolic activity | Nitrogen metabolism | Goupil et al (1998) J Exptl Botany 49: 1855-62 |
| Metabolic activity | —H+ export and membrane hyperpolarization | Cerana et al. (1983) |
| Metabolic activity | Chloroplast functioning | Benkova et al (1999) Plant Physil 121: 245-252 |
| Growth, Differentiation and development | Regulation of Morphogenesis | Riou-Khamlichi et al. (1999) Science 283: 1541-44 |
| Metabolic activity | Cell Death | Lohman et al. (1994) Physiol Plant 92: 322-328 |
| Growth and development | Promotion of cell division Shoot formation in absence of exogenous cytokinin | Kakimoto (1996) Science 274: 982-985 |
| Metabolic activity | Membrane repair | Heath et al. (1986) Planta 169: 304-12 Browse et al. (1986) Anal Biochem 152: 141-5 D'Aoust et al (1999) Plant Cell 11: 2407-18 |
| Metabolism | Organic molecule export | Moody et al. (1988) Phytochemistry 27: 2857-61 |
| Metabolic activity | Nutrient Uptake | Uozumio et al. (2000) Plant Physiol 122: 1249-59 |
| Metabolic activity | Ion export | Uozumi et al. (2000) Plant Physiol 122: 1249-59 Frachisse et al. (2000) Plant J 21: 361-71 |
| Growth, Differentiation and development | Division and/or elongation | Zhang and Forde (1998) Science 279: 407-409. Coruzzi et al. U.S. Pat. No. 5,955,651 |
| Metabolic activity | Regulation of Molecular chaperones | Wisniewski et al. (1999) Physiolgia Plantarum 105: 600-608 |
| Metabolic activity | Reactivation of Aggregation and Protein Folding | Lee and Vierling (2000) Plant Physiol. 122: 189-197 |
| Metabolic activity | Maintenance of Native Conformation (cytosolic proteins) | Queitsch et al. (2000) The Plant Cell 12: 479-92 |
| Metabolic activity | Regulation of Translational Efficiency | Wells et al. (1998) Genes and Development 12: 3236-51 |
| Metabolic activity | DNA Repair | Bewley (1997) Plant Cell 9: 1055-66 |
| Metabolic activity | Protein Synthesis using stored or newly synthesized mRNAs | Heath et al. (1986) Planta 169: 304-12 |
| Metabolic activity | Mitochondrial repair and synthesis | MacKenzie and McIntosh (1999) Plant Cell 11: 571-86 |
| Metabolic activity | Commencement of respiration | Debeaujon et al. (2000) Plant Physiol 122: 403-4132 |
| | Water Uptake | Debeaujon et al. (2000) Plant Physiol 122: 403-4132 |

Other biological activities that are modulated by the imbibition-activated polynucleotides and polynucleotide products are listed in the Reference Tables. Assays for detecting such biological activities are described in the Table below as well as in the Domain section of the Reference Table.

III.B.1.d. Use of Imbibition and Germination Genes to Modulate the Transcription Levels of Other Genes The expression of many genes is "upregulated" or "downregulated" during imbibition and germination because some imbibition and germination genes are integrated into complex networks that regulate transcription of many other genes. Some imbibition and germination genes are therefore useful for regulating other genes and hence complex phenotypes.

Imbibition-activated polynucleotides may also be differentially transcribed in response to fluctuating developmental-specific polynucleotide levels or concentrations, whether internal or external to a cell, at different times during the plant life cycle to promote associated biological activities. These activities are, by necessity, a small subset of the genes involved in the development process. Furthermore, because development is a continuous process with few clear demarcations between stages, the associated metabolic and biochemical pathways overlap. Some of the changes in gene transcription are summarized in the Table below:

| DEVELOPMENTAL PROCESS REGULATED BY IMBIBITION-GERMINATION GENES | PHYSIOLOGICAL/METABOLIC CONSEQUENCES OF MODIFYING GENE PRODUCT LEVELS | EXAMPLES OF BIOCHEMICAL REGULATORY ACTIVITIES ASSOCIATED WITH IMBIBITION AND GERMINATION |
|---|---|---|
| Tissue Specialization Cotyledon Expansion Endosperm (???) Activation of the Shoot Apical Meristem Activation of the Root Apical Meristem Radicle Growth Vascular System Development | Lipid Catabolism Lipoxygenase Localization Starch Catabolism Seed Protein Catabolism Growth Regulator Production, Transport, Perception, Signaling, Response (e.g., Gibberellins, Ethylene, Auxin) Global Gene Activation Transcription Initiation Sucrose Synthesis and Partitioning Sucrose catabolism Sucrose Signaling Cell Wall Biosynthesis Activators of Metabolic Pathways Protein Remodeling | Transcription Factors Transporters Kinases Changes in cytoskeletal protein activity modulating cell structure Stability of factors for protein translation Changes in cell wall/membrane structure Chromatin structure and/or DNA topology Biosynthetic enzymes Metabolic enzymes |
| Organelle Differentiation and Development | Cell Wall Biosynthesis Membrane Repair and Synthesis Specific Gene Transcription Initiation Sucrose Mobilization and Partitioning Sucrose Signaling Activators of Metabolic Pathways Auxin Perception, Response and Signaling Protein Remodeling Lipid Mobilization, Metabolism and Biosynthesis Protein Transport, Metabolism, and Biosynthesis | Transcription Factors Transporters Kinases Chaperones Changes in cytoskeletal protein activity modulating cell structure Stability of factors for protein translation Changes in cell wall/membrane structure Chromatin structure and/or DNA topology Biosynthetic enzymes Metabolic enzymes |
| DNA Repair | Cell Division Cell Cycle Control DNA Replication Specific Gene Transcription Initiation Protein Remodeling Protein Synthesis Repressors of Senescence | Transcription Factors Transporters Kinases Chaperones for protein translation Changes in cell wall/membrane structure Chromatin structure and/or DNA topology Biosynthetic enzymes |
| Cellular Metabolism | Lipid Catabolism oxidation Glyoxylate cycle Citric acid cycle Gluconeogenesis Sucrose Synthesis and Partitioning Starch Catabolism Seed Protein Catabolism | Transcription Factors Transporters Kinases Chaperones Translation Initiation Factors Biosynthetic Enzymes Metabolic Enzymes |

| DEVELOPMENTAL PROCESS REGULATED BY IMBIBITION-GERMINATION GENES | PHYSIOLOGICAL/METABOLIC CONSEQUENCES OF MODIFYING GENE PRODUCT LEVELS | EXAMPLES OF BIOCHEMICAL REGULATORY ACTIVITIES ASSOCIATED WITH IMBIBITION AND GERMINATION |
|---|---|---|
| | Asparagine Synthesis and Transport Sucrose catabolism Sucrose Signaling Ribosome/polysome production and maintenance Housekeeping genes Respiration Photosynthesis | |

Changes in the processes of germination are the result of modulation of the activities of one or more of these many germination genes and gene products. These genes and/or products are responsible for effects on traits such as fast germination, plant vigor and seed yield, especially when plants are growing in the presence of biotic or abiotic stresses or when they are growing in barren conditions or soils depleted of certain minerals.

Germination genes and gene products can act alone or in combination as described in the introduction. Of particular interest are combination of these genes and gene products with those that modulate stress tolerance and/or metabolism. Stress tolerance and metabolism genes and gene products are described in more detail in the sections below.

Use of Promoters of Imbibition and Germination Genes

These promoters can be used to control expression of any polynucleotide, plant or non-plant, in a plant host. Selected promoters when operably linked to a coding sequence can direct synthesis of the protein in specific cell types or to loss of a protein product, for example when the coding sequence is in the antisense configuration. They are thus useful in controlling changes in imbibition and germination phenotypes or enabling novel proteins to be made in germinating seeds.

III.B.2. Early Seedling-Phase Specific Responsive Genes, Gene Components and Products One of the more active stages of the plant life cycle is a few days after germination is complete, also referred to as the early seedling phase. During this period the plant begins development and growth of the first leaves, roots, and other organs not found in the embryo. Generally this stage begins when germination ends. The first sign that germination has been completed is usually that there is an increase in length and fresh weight of the radicle.

III.B.2.a. Identification of Early Seedling Phase Genes, Gene Components and Products These genes defined and identified herein are capable of modulating one or more processes of development and growth of many plant organs as described below. These genes and gene products can regulate a number of plant traits to modulate yield. Examples of such early seedling phase genes and gene products are shown in the Reference and Sequence, Knock-in, Knock-out and MA-diff Tables. The functions of the protein of some of these genes are also given in these Tables.

Early Seedling Genes Identified by Phenotypic Observations

Some early seedling genes were discovered and characterized from a much larger set of genes by experiments designed to find genes that cause phenotypic changes in germinating seeds as the transitioned into seedlings.

In these experiments, leaf genes were identified by either (1) ectopic expression of a cDNA in a plant or (2) mutagenesis of the plant genome. The plants were then cultivated and one or more of the following leaf phenotypes, which varied from the parental "wild-type", were observed:
 Abnormal growth
 Abnormal cotyledons or root growth
 Reduced growth
 Abnormal first leaf
 Abnormal hypocotyl
 Abnormal pigmentation The genes identified by these phenotypes are given in the Knock-in and Knock-out Tables.

Early Seedling Phase Genes Identified by Differential Expression

Such genes are active or potentially active to a greater extent in developing and rapidly growing cells, tissues and organs, as exemplified by development and growth of a seedling 3 or 4 days after planting a seed. These genes herein were also discovered and characterized from a much larger set of genes in experiments designed to find genes. Early seedling phase genes were identified by measuring the relative levels of mRNA products in a seedling 3 or 4 days after planting a seed versus a sterilized seed. Specifically, mRNA was isolated from aerial portion of a seedling 3 or 4 days after planting a seed and compared to mRNA isolated from a sterilized seed utilizing microarray procedures. The MA_diff Table(s) reports the transcript levels of the experiment (see EXPT ID: Sqn (relating to SMD 7133, SMD 7137)). For transcripts that had higher levels in the samples than the control, a "+" is shown. A "−" is shown for when transcript levels were reduced in root tips as compared to the control. For more experimental detail see the Example section below.

Early Seedling Phase genes are those sequences that showed differential expression as compared to controls, namely those sequences identified in the MA_diff tables with a "+" or "−" indication.

Early Seedling Phase Genes Identified by Cluster Analyses of Differential Expression Early Seedling Phase Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Early Seedling Phase genes is any group in the MA_clust that comprises a cDNA ID that also appears in Expt ID Sqn (relating to SMD 7133, SMD 7137) of the MA_diff table(s).

Early Seedling Phase Genes Identified by Correlation to Genes that Cause Physiological Consequences Additionally, the differential expression data and the phenotypic observations can be merged to identify pathways or networks of Early Seedling Phase genes. A group in the MA_clust is considered a Early Seedling Phase pathway or network if the group comprises a cDNA ID that also appears in Knock-in or Knock-out tables that causes one or more of the phenotypes described in section above.

Early Seedling Phase Genes Identified by Amino Acid Sequence Similarity

Early Seedling Phase genes from other plant species typically encode polypeptides that share amino acid similarity to the sequences encoded by corn and *Arabidopsis* Early Seedling Phase genes. Groups of Early Seedling Phase genes are identified in the Protein Group table. In this table, any protein group that comprises a peptide ID that corresponds to a cDNA ID member of a Early Seedling Phase pathway or network is a group of proteins that also exhibits Early Seedling Phase functions/utilities.

Of particular interest are early seedling phase genes that are differentially expressed 3 or 4 days after planting a seed but not differentially expressed germinating seeds and/or mature leaves.

Examples of phenotypes, biochemical activities, and transcription profiles that can be modulated by these genes and gene products are described above and below.

III.B.2.b. Use of Early Seedling Genes, Gene Components and Products to Modulate Phenotypes Rapid, efficient establishment of a seedling is very important in commercial agriculture and horticulture. It is also vital that resources are approximately partitioned between shoot and root to facilitate adaptive growth. Phototropism and geotropism need to be established. All these require post-germination process to be sustained to ensure that vigorous seedlings are produced. Early seedling phase genes, gene components and products are useful to manipulate these and other processes.

I. Development

The early seedling phase genes, gene components and products of the instant invention are useful to modulate one or more processes of the stages of leaf morphogenesis including: stage 1—organogenesis that gives rise to the leaf primordium; stage 2—delimiting basic morphological domains; and stage 3—a coordinated processes of cell division, expansion, and differentiation. Early seedling phase genes include those genes that terminate as well as initiate leaf development. Modulating any or all of the processes leads to beneficial effects at specific locations.

Gene Sequences Affecting Types of Leaves—Applicants provide with these genes, gene components and gene products the means to modulate one or more of the types of leaves, and stem, including cotyledons and major leaves.

Gene sequences affecting cell properties—These genes, gene components and gene products are useful to modulate changes in cell size, cell division, rate and direction, cell elongation, cell differentiation, xylem and phloem cell numbers, cell wall composition, and all cell types.

Gene Sequences Affecting Leaf Architecture—Modifying leaf architecture is useful to modulate change in overall leaf architecture including veination, such as improvements in photosynthetic efficiency, stress tolerance efficiency of solute and nutrient movement to and from the leaf which are accomplished by increases or decreases in vein placement and number of cells in the vein and shape, such as elongated versus rounded and symmetry (around either abaxial-adaxial (dorsiventral) axis or apical-basal (proximodistal) axis, margin-blade-midrib (lateral) axis).

Genes Sequences Influencing Leaf Responses—Shoot apical meristem cells differentiate to become leaf primordia that eventually develop into leaves. The genes, gene components and gene products of this invention are useful to modulate any one or all of these growth and development processes, by affecting timing and rate or planes of cell divisions for example, in response to the internal plant stimuli and/or programs such as embryogenesis, germination, hormones (like Auxin), phototropism, coordination of leaf growth and development with that of other organs (like roots and stems), and stress-related program.

II. Interaction with the Environment

Successful seedling establishment demands successful interaction with the environment in the soil. Early vegetation genes orchestrate and respond to interactions with the environment. Thus early seedling phase genes are useful for improving interactions between a plant and the environment including pigment accumulation, oxygen gain/loss control, carbon dioxide gain/loss control, water gain/loss control, nutrient transport, light harvesting, chloroplast biogenesis, circadian rhythm control, light/dark adaptation, defense systems against biotic and abiotic stresses, metabolite accumulation, and secondary metabolite production III. Organizing Tissues for Photosynthesis and Metabolism Following germination and utilization of seed reserves, plant tissues prepare for photosynthesis and seedling metabolism. Leaf meristems, and root meristems participate in these changes before cell differentiation. Many of the uses for plants depend on the success of leaves as the powerhouses for plant growth, their ability to withstand stresses and their chemical composition. Leaves are organs with many different cell types and structures. Most genes of a plant are active in leaves and therefore leaves have very diverse of pathways and physiological processes. Examples of such pathways and processes that are modulated by early seedling phase genes, gene components and products include photosynthesis, sugar metabolism, starch synthesis, starch degradation, nitrate and ammonia metabolism, amino acid biosynthesis, transport, protein biosynthesis, DNA replication, repair, lipid biosynthesis and breakdown, protein biosynthesis, storage and breakdown, nucleotide transport and metabolism, cell envelope biogenesis, membrane formation, mitochondrial and chloroplast biogenesis, transcription and rna metabolism, vitamin biosynthesis, steroid and terpenoid biosynthesis, devise secondary metabolite synthesis, co-enzyme metabolism, flavonoid biosynthesis and degradation, synthesis of waxes, glyoxylate metabolism, and hormone perception and response pathways.

Use of Plants that are Modified as Described Above

Altering leaf genes or gene products in a plant modifies one or more the following plant traits, to make the plants more useful for specific purposes in agriculture, horticulture and for the production of valuable molecules. The useful plants have at least one of the following characteristics: More seedling vigor; a higher yield of early leaves and their molecular constituents due to different number, size, weight, harvest index, composition including and amounts and types of carbohydrates, proteins, oils, waxes, etc., photosynthetic efficiency, e.g. reduced photorespiration, absorption of water and nutrients to enhance yields, including under stresses such as high light, herbicides, and heat, pathways to accumulate new valuable molecules; more optimal leaf shape and architecture in early seedling—enhancing photosynthesis and enhancing appeal in ornamental species including size, number, or pigment; a better overall plant architecture—enhancing photosynthesis and enhancing appeal in ornamental species; reduced negative effects of high planting density, by altering leaf placement to be more vertical instead of parallel to the ground; for instance better stress tolerance, including drought resistance, by decreasing water loss, and pathogen resistance; better overall yield and vigor—Plant yield of biomass and of constituent molecules and plant vigor are modulated to create benefits by genetically changing the growth rate of seedling, coleoptile elongation, and young leaves.

To change any of the phenotype(s) above, activities of one or more of the early seedling phase genes or gene products are modulated in an organism and the consequence evaluated by screening for the desired trait. Specifically, the gene, mRNA levels, or protein levels are altered in a plant utilizing the procedures described herein and the phenotypes can be assayed. As an example, a plant can be transformed according to Bechtold and Pelletier (*Methods. Mol. Biol.* 82:259-266 (1998)) with leaf gene constructs and/or screened for variants as in Winkler et al., *Plant Physiol.* 118: 743-50 (1998) and visually inspected for the desired phenotype and metabolically and/or functionally assayed for altered levels of relevant molecules.

III.B.2.c. Use of Early Seedling Phase Genes, Gene Components and Products to Modulate Biochemical Activities Seedlings are complex and their structure, function and properties result from the integration of many processes and biochemical activities. Some of these are known from the published literature and some can be deduced from the genes and their products described in this application. Early seedling phase genes, and gene components are used singly or in combination to modify these processes and biochemical activities and hence modify the phenotypic and trait characteristics described above. Examples of the processes and metabolic activities are given in the Table below. The resulting changes are measured according to the citations included in the Table.

| PROCESS | BIOCHEMICAL OR METABOLIC ACTIVITIES AND/OR PATHWAYS | CITATIONS INCLUDING ASSAYS |
| --- | --- | --- |
| Metabolism - anabolic and catabolic | G. Farnesylation<br>H. Cell Wall Biosynthesis<br>I. Nitrogen Metabolism<br>J. Secondary Metabolite Biosynthesis and Degradation | Pei et al., *Science* 282: 287-290 (1998); Cutler et al., *Science* 273: 1239 (1996)<br>Goupil et al., *J Exptl. Botany* 49: 1855-62 (1998)<br>Walch-Liu et al., *J Exppt. Botany* 51, 227-237 (2000) |
| Water Conservation And Resistance To Drought And Other Related Stresses Transport Anion and Cation Fluxes | A. Production of polyols<br>B. Regulation of salt concentration<br>C. ABA response(s)<br>  (i) Ca2+ Accumulation<br> (a) K+ Fluxes<br> (b) Na+ Fluxes<br> 1. Receptor - ligand binding<br> 2. Anion and Cation fluxes | Allen et al., *Plant Cell* 11: 1785-1798 (1999)<br>Li et al., *Science* 287: 300-303 (2000)<br>Burnett et al., *J Exptl. Botany* 51: 197-205 (2000)<br>Raschke, In: *Stomatal Function*, Zeiger et al. Eds., 253-279 (1987)<br>Lacombe et al., *Plant Cell* 12: 837-51 (2000);<br>Wang et al., *Plant Physiol.* 118: 1421-1429 (1998);<br>Shi et al., *Plant Cell* 11: 2393-2406 (1999)<br>Gaymard et al., *Cell* 94: 647-655 (1998)<br>Jonak et al., *Proc. Natl. Acad. Sci.* 93: 11274-79 (1996);<br>Sheen, *Proc. Natl. Acad. Sci.* 95: 975-80 (1998);<br>Allen et al., *Plant Cell* 11: 1785-98 (1999) |
| Carbon Fixation | 3. Calvin Cycle<br>5. Photorespiration<br>6. Oxygen evolution<br>7. RuBisCO<br> 4. Chlorophyll metabolism<br>  (ii) Chloroplast Biogenesis and Metabolism | Wingler et al., *Philo Trans R Soe Lond B Biol Sci* 355, 1517-1529 (2000);<br>Palecanda et al., *Plant Mol Biol* 46, 89-97 (2001);<br>Baker et al., *J Exp Bot* 52, 615-621 (2001)<br>Chen et al., *Acta Biochim Pol* 41, 447-457 (1999)<br>Imlau et al., *PlantCell* II, 309-322 (1999) |

-continued

| PROCESS | BIOCHEMICAL OR METABOLIC ACTIVITIES AND/OR PATHWAYS | CITATIONS INCLUDING ASSAYS |
|---|---|---|
| | 5. Fatty Acid and Lipid Biosynthesis (iii) Glyoxylate metabolism (iv) Sugar Transport (v) Starch Biosynthesis and Degradation | |
| Hormone Perception and Growth | (vi) Hormone Receptors and Downstream Pathways for (a) ethylene (b) jasmonic acid (c) brassinosteroid (d) gibberellin (e) Auxin (f) cytokinin Activation Of Specific Kinases And Phosphatases | Tieman et al., *Plant J* 26, 47-58 (2001) Hilpert et al., *Plant J* 26, 435-446 (2001) Wenzel et al., *Plant Phys* 124, 813-822 (2000) Dengler and Kang, *Curr Opin Plant Biol* 4, 50-56 (2001) Tantikanjana et al., *Genes Dev* 15, 1577-1580 (2001) |

See Imbibition, Shoot Apical Meristem, Root and Leaf sections for more details

Other biological activities that are modulated by the leaf genes and gene products are listed in the Reference tables. Assays for detecting such biological activities are described in the Protein Domain table, for example.

III.B.2.d. Use of Early Seedling Phase Genes, Gene Components and Products to Modulate Transcription Levels The expression of many genes is "up regulated" or down regulated" in plants because some genes and their products are integrated into complex networks that regulate transcription of many other genes. Some early seedling phase genes, gene components and products are therefore useful for modifying the transcription of other genes and hence complex phenotypes, as described above. Profiles of leaf gene activities are described in the Table below with associated biological activities. "Up-regulated" profiles are those where the mRNA transcript levels are higher in young seedlings as compared to the sterilized seeds. "Down-regulated" profiles represent higher transcript levels in the plantlet as compared to sterilized seed only.

III.B.3. Size and Stature Genes, Gene Components and Products

Great agronomic value can result from modulating the size of a plant as a whole or of any of its organs. For example, the green revolution came about as a result of creating dwarf wheat plants, which produced a higher seed yield than taller plants because they could withstand higher levels and inputs of fertilizer and water. Size and stature genes elucidated here are capable of modifying the growth of either an organism as a whole or of localized organs or cells. Manipulation of such genes, gene components and products can enhance many traits of economic interest from increased seed and fruit size to increased lodging resistance. Many kinds of genes control the height attained by a plant and the size of the organs. For genes additional to the ones in this section other sections of the Application should be consulted.

III.B.3.a. Identification of Size and Stature Genes, Gene Components and Products Size and stature genes identified herein are defined as genes, gene components and products capable of modulating one or more processes in growth and development, to produce changes in size of one or more organs. Examples of such stature genes and gene products are shown in the Reference, Sequence, Protein Group, Protein Group Matrix, Knock-in, Knock-out, MA-diff and MA-clust. The biochemical functions of the protein products of many of these genes determined from comparisons with known proteins are also given in the Reference tables.

Size and Stature Genes, Gene Components and Products Identified by Phenotypic Observations Mutant plants exhibiting increased or decreased stature in comparison to parental wild-type plants were used to identify size and stature genes. In these experiments, size and stature genes were identified by either (1) the ectopic expression of a cDNA in a plant or (2) mutagenesis of the plant genome. The plants were then cultivated and stature genes were identified from plants that were smaller than the parental "wild-type". The phenotypes and gene mutations associated with them are given in Tables Examples of phenotypes, biochemical activities, or transcript profiles that are modulated using these genes are described above and below.

Use of Size and Stature Genes, Gene Components and Products to Modulate Phenotypes Typically, these genes can cause or regulate cell division, rate and time; and also cell size and shape. Many produce their effects via meristems. These genes can be divided into three classes. One class of genes acts during cytokinesis and/or karyokinesis, such as mitosis and/or meiosis. A second class is involved in cell growth; examples include genes regulating metabolism and nutrient uptake pathways. Another class includes genes that control pathways that regulate or constrain cell division and growth. Examples of these pathways include those specifying hormone biosynthesis, hormone sensing and pathways activated by hormones.

Size and stature genes and gene components are useful to selectively alter the size of organs and stems and so make plants specifically improved for agriculture, horticulture and other industries. There are a huge number of utilities. For example, reductions in height of specific ornamentals, crops and tree species can be beneficial, while increasing height of others may be beneficial.

Increasing the length of the floral stems of cut flowers in some species would be useful, while increasing leaf size in others would be economically attractive. Enhancing the size of specific plant parts, such as seeds, to enhance yields by stimulating hormone (Brassinolide) synthesis specifically in these cells would be beneficial. Another application would be to stimulate early flowering by altering levels of gibberellic acid in specific cells. Changes in organ size and biomass also results in changes in the mass of constituent molecules. This makes the utilities of size and stature genes useful for the production of valuable molecules in parts of plants, for extraction by the chemical and pharmaceutical industries.

Examples of phenotypes that can be modulated by the genes and gene components include cell size, cell shape, cell division, rate and direction, cell elongation, cell differentiation, stomata number, and trichome number. The genes of the invention are useful to regulate the development and growth of roots (primary, lateral, root hairs, root cap, apical meristem, epidermis, cortex, and stele); stem (pholem, xylem, nodes, internodes, and shoot apical meristem); leaves (cauline, rosette, and petioles); flowers (receptacle, sepals, petals, and tepals, including color, shape, size, number, and petal drop, androecium, stamen, anther, pollen, sterility, size, shape, weight, color, filament, gynoecium, carpel, ovary, style, stigma, ovule, size, shape, and number, pedicel and peduncle, flowering time, and fertilization); seeds (placenta, embryo, cotyledon, endosperm, suspensor, and seed coat (testa)); and fruits (pericarp—thickness, texture, exocarp, mesocarp, and endocarp. Traits can be modulated with the genes and gene products of this invention to affect the traits of a plant as a whole include architecture (such as branching, ornamental architecture, shade avoidance, planting density effects, and wind resistance) and vigor (such as increased biomass and drought tolerance).

To regulate any of the phenotype(s) above, activities of one or more of the sizing genes or gene products are modulated in an organism and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (*Methods. Mol. Biol.* 82:259-266 (1998)) and/or screened for variants as in Winkler et al., (*Plant Physiol.* 118: 743-50 1998) and visually inspected for the desired phenotype or metabolically and/or functionally assayed.

III.B.3.b. Use of Size and Stature Genes, Gene Components and Products to Modulate Biochemical Activities Many metabolic and developmental processes can be modulated by size and stature genes and gene components to achieve the phenotypic characteristics exemplified above. Some of these are listed below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth and Development | Gibberellic Acid Biosynthesis Gibberellic Acid Receptor and Downstream Pathways | Swain SM, Tseng Ts, Olszewski NE. Altered expression of spindly affects gibberellin response and plant development. Plant Physiol 2001 July; 126(3): 1174-85 Hooley, R. Gibberellins: perception, transduction, and responses. Plant Mol. Biol. 1994 26: 1529-1555. Hooley, R. Gibberellins: perception, transduction, and responses. Plant Mol. Biol. 1994 26: 1529-1555. Perata, P, Matsukura, C, Vernieri, P, Yamaguchi, J, Sugar repression of a gibberellin-dependent signaling pathway in barley embryos. Plant Cell 1997 9: 2197-2208. |
| | Brassinolide Biosynthesis Brassinolide Receptors, Degradation of Brassinolide Pathways affected by Brassinolide | Noguchi T, Fujioka S, Choe S, Takatsuto S, Tax FE, Yoshida S, Feldmann KA. Biosynthetic pathways of brassinolide in *Arabidopsis*. Plant Physiol 2000 September; 124(1): 201-9 Wang ZY, Seto H, Fujioka S, Yoshida S, Chory J. BRI1 is a critical component of a plasma-membrane receptor for plant steroids. Nature 2001 Mar 15; 410(6826): 380-3 Neff MM, Nguyen SM, Malancharuvil EJ, Fujioka S, Noguchi T, Seto H, Tsubuki M, |

| PROCESS | BIOCHEMICAL OR METABOLIC ACTIVITIES AND/OR PATHWAYS | CITATIONS INCLUDING ASSAYS |
|---|---|---|
| | Cytokinin biosynthesis<br>Cytokinin receptor<br>Degradation of Cytokinin<br>Pathways affected by Cytokinin | Honda T, Takatsuto S, Yoshida S, Chory J. BAS1: A gene regulating brassinosteroid levels and light responsiveness in *Arabidopsis*. Proc Natl Acad Sci USA 1999 Dec 21; 96(26): 15316-23<br>Kang JG, Yun J, Kim DH, Chung KS, Fujioka S, Kim JI, Dae HW, Yoshida S, Takatsuto S, Song PS, Park CM. Light and brassinosteroid signals are integrated via a dark-induced small G protein in etiolated seedling growth. Cell 2001 Jun 1; 105(5): 625-36<br>Mok DW, Mok MC. Cytokinin metabolism and action. Annu Rev Plant Physiol Plant Mol Biol 2001; 52: 89-118<br>Schmulling T. CREam of cytokinin signalling: receptor identified. Trends Plant Sci 2001 July; 6(7): 281-4<br>Mok DW, Mok MC. Cytokinin metabolism and action. Annu Rev Plant Physiol Plant Mol Biol 2001; 52: 89-118<br>Seyedi M, Selstam E, Timko MP, Sundqvist C. The cytokinin 2-isopentenyladenine causes partial reversion to skotomorphogenesis and induces formation of prolamellar bodies and protochlorophyllide657 in the lip1 mutant of pea. Physiol Plant 2001 June; 112(2): 261-272 |
| | Auxin Biosynthesis<br>Auxin Receptor<br>Auxin Degradation<br>Pathways affected by Auxins<br>Auxin transport | Zhao Y, Christensen SK, Fankhauser C, Cashman JR, Cohen JD, Weigel D, Chory J. A role for flavin monooxygenase-like enzymes in Auxin biosynthesis. Science 2001 Jan 12; 291(5502): 306-9<br>Abel S, Ballas N, Wong LM, Theologis A. DNA elements responsive to Auxin. Bioessays 1996 August; 18(8): 647-54<br>del Pozo JC, Estelle M. Function of the ubiquitin-proteosome pathway in Auxin response. Trends Plant Sci 1999 March; 4(3): 107-112.<br>Rahman A, Amakawa T, Goto N, Tsurumi S. Auxin is a positive regulator for ethylene-mediated response in the growth of *Arabidopsis* roots. Plant Cell Physiol 2001 March; 42(3): 301-7<br>Zhao Y, Christensen SK, Fankhauser C, Cashman JR, Cohen JD, Weigel D, Chory J. A role for flavin monooxygenase-like enzymes in Auxin biosynthesis. Science 2001 Jan 12; 291(5502): 306-9<br>Abel S, Ballas N, Wong LM, Theologis A. DNA elements responsive to Auxin. Bioessays 1996 August; 18(8): 647-54<br>del Pozo JC, Estelle M. |

| PROCESS | BIOCHEMICAL OR METABOLIC ACTIVITIES AND/OR PATHWAYS | CITATIONS INCLUDING ASSAYS |
|---|---|---|
| | | Function of the ubiquitin-proteosome pathway in Auxin response. Trends Plant Sci 1999 March; 4(3): 107-112. Rahman A, Amakawa T, Goto N, Tsurumi S. Auxin is a positive regulator for ethylene-mediated response in the growth of *Arabidopsis* roots. Plant Cell Physiol 2001 March; 42(3): 301-7 Gil P, Dewey E, Friml J, Zhao Y, Snowden KC, Putterill J, Palme K, Estelle M, Chory J. BIG: a calossin-like protein required for polar Auxin transport in *Arabidopsis*. Genes Dev. 2001 Aug 1; 15(15): 1985-97 Estelle M., Polar Auxin transport. New support for an old model. Plant Cell 1998 November; 10(11): 1775-8 |
| | Cell wall growth | Cosgrove DJ., Loosening of plant cell walls by expansins. Nature 2000 Sep 21; 407(6802): 321-6 |

Other biological activities that are modulated by the stature genes and gene products are listed in the Reference tables. Assays for detecting such biological activities are described in the Protein Domain table, for example.

Changes in the size, vigor, or yield of a plant are the result of modulation of the activities of one or more of these many size and stature genes and gene products. While size and stature polynucleotides and gene products can act alone, combinations of these polynucleotides and also with others that also affect growth and development are especially useful.

Use of Promoters of "Size and Stature" Genes

Promoters of "size and stature" genes are useful for controlling the transcription of any desired polynucleotides, both plant and non-plant. They can be discovered from the "size and stature" genes in the Reference Tables, and their patterns of activity from the MA Tables. When operably linked to any polynucleotide encoding a protein, and inserted into a plant, the protein will be synthesized in those cells in which the promoter is active. Many "size and stature" genes will function in meristems, so the promoters will be useful for expressing proteins in meristems. The promoters can be used to cause loss of, as well as synthesis of, specific proteins via antisense and sense suppression approaches.

III.B.4. Shoot-Apical Meristem Genes, Gene Components and Products

New organs, stems, leaves, branches and inflorescences develop from the stem apical meristem (SAM). The growth structure and architecture of the plant therefore depends on the behavior of SAMs. Shoot apical meristems (SAMs) are comprised of a number of morphologically undifferentiated, dividing cells located at the tips of shoots. SAM genes elucidated here are capable of modifying the activity of SAMs and thereby many traits of economic interest from ornamental leaf shape to organ number to responses to plant density.

III.B.4.a. Identification of Sam Genes, Gene Components and Products

SAM genes identified herein are defined as genes, gene components and products capable of modulating one or more processes or functions of SAMs as described below. Regulation of SAM genes and gene products are useful to control many plant traits including architecture, yield and vigor. Examples of such SAM genes and gene products are shown in the Reference, Sequence, Protein Group, Protein Group Matrix, phenotype and MA-diff Tables. The functions of many of the protein products of these genes are also given in the Reference tables.

Sam Genes, Gene Components and Products Identified by Phenotypic Observations

SAM genes were discovered and characterized from a much larger set of genes by experiments designed to find genes that cause phenotypic changes in leaf morphology, such as cotyledon or leaf fusion. In these experiments, SAM genes were identified by either (1) ectopic expression of a cDNA in a plant or (2) mutagenesis of the plant genome. The plants were then cultivated and one or more of the following phenotypes, which varied from the parental "wild-type", was observed:

I. Cotyledon
    Fused
II. Leaves
    Fused
    Leaf placement on stems
III. Branching
    Number
IV. Flowers
    Petals fused
    Altered bolting
    Early bolting
    Late bolting
    Strong bolting
    Weak bolting
    Abnormal branching For more experimental detail see the Example section below. The genes identified by these results of the phenotypes that are shown in Knock-in and Knock-out Tables.

Sam Genes, Gene Components and Products Identified by Differential Expression

SAM genes were also identified in experiments designed to find genes whose mRNA products are associated specifically or preferentially with SAMs. The concentration of mRNA products in the *arabidopsis* plant with the SHOOTMER-ISTEMLESS (STM) gene knocked-out was measured relative to the concentration in the parental, non-mutant plant. The *Arabidopsis* STM gene is required for embryonic SAM formation. The STM gene encodes a Knotted1 (Kn1) type of homeodomain protein. Homeodomain proteins regulate transcription of many genes in many species and have been shown to play a role in the regulation of translation as well. Seedlings homozygous for recessive loss-of-function alleles germinate with roots, a hypocotyl, and cotyledons, but no SAM is formed. The MA_diff Table(s) reports the transcript levels of the experiment (see EXPT ID: 108478, 108479, 108480, 108481, 108598, 108535, 108536, 108435). For transcripts that had higher levels in the samples than the control, a "+" is shown. A "−" is shown for when transcript levels were reduced in root tips as compared to the control. For more experimental detail see the Example section below.

Meristem genes are those sequences that showed differential expression as compared to controls, namely those sequences identified in the MA_diff tables with a "+" or "−" indication.

Meristem Genes Identified by Cluster Analyses of Differential Expression

Meristem Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Meristem genes is any group in the MA_clust that comprises a cDNA ID that also appears in Expt ID 108478, 108479, 108480, 108481, 108598, 108535, 108536, 108435 of the MA_diff table(s).

Meristem Genes Identified by Correlation to Genes that Cause Physiological Consequences Additionally, the differential expression data and the phenotypic observations can be merged to identify pathways or networks of Meristem genes. A group in the MA_clust is considered a Meristem pathway or network if the group comprises a cDNA ID that also appears in Knock-in or Knock-out tables that causes one or more of the phenotypes described in section above.

Meristem Genes Identified by Amino Acid Sequence Similarity

Meristem genes from other plant species typically encode polypeptides that share amino acid similarity to the sequences encoded by corn and *Arabidopsis* Meristem genes. Groups of Meristem genes are identified in the Protein Group table. In this table, any protein group that comprises a peptide ID that corresponds to a cDNA ID member of a Meristem pathway or network is a group of proteins that also exhibits Meristem functions/utilities.

Examples of phenotypes, biochemical activities, and transcription profiles that can be modulated by SAM genes and gene products are described above and below.

III.B.4.b. Use of Sam Genes, Gene Components and Products to Modulate Phenotypes With the SAM genes and gene products of the invention, Applicants provide the means to modulate one or more of the following types of SAMs:
1. Embryonic meristem
2. Vegetative lateral SAMs
3. Inflorescence lateral SAMs
4. Floral meristems
5. Adventitious SAM The SAM genes of the instant invention are useful for modulating one or more processes of SAM structure and/or function including (I) cell size and division; (II) cell differentiation and organ primordia.

I. Cell Size and Division

A. Cell Properties

SAM genes and gene products can be used to modulate changes in cell size, cell division, rate and direction, and cell division symmetry.

A key attribute of the SAM is its capacity for self-renewal. The self-renewing initial cell population resides in the central zone of the SAM. A small number of slowly dividing initial cells (typically 2 to 4 per layer) act as a self-replenishing population, whereas some of their descendants, pushed out onto the flanks of the SAM, differentiate into leaves. Other descendants, displaced below the SAM, differentiate into stem. The immediate descendants of the initial cells divide further, amplifying the cell population before being incorporated into leaf or stem primordia.

The genes and gene components of this invention are useful for modulating any one or all of these cell division processes generally, as in timing and rate, for example. In addition, the polynucleotides and polypeptides of the invention can control the response of these processes to the internal plant programs associated with embryogenesis, hormone responses like cytokinin (inhibitory for root development, see section on cytokinin-responsive genes), coordination of growth and development with that of other plant organs (such as leaves, flowers, seeds, and fruits.

SAM genes can also be used to control the response of these processes to changes in the environment, including heat, cold, drought, high light and nutrition.

B. Sam Cell Patterns and Organization

Although SAMs appear as small regions of morphological undifferentiated dividing cells, a group of morphologically undifferentiated dividing cells does not necessarily constitute a SAM. Rather, evidence indicates that SAMs are highly organized or patterned regions of the plant in which many important events in early organogenesis occur. Thus, the term "SAM" is used to denote a highly organized structure and site of pattern formation. The invention also permits engineering of specific as well as overall features of SAM architecture including zones (central, peripheral, and rib), layers (l1, l2, and l3) and symmetry.

II Cell Differentiation and Organ Primordia

The apical meristem in many species first undergoes a vegetative phase whereby cells set aside from the apex become leaf primordia with an axillary vegetative meristem. Upon floral induction, the apical meristem is converted to an inflorescence meristem. The inflorescence meristem arises in the axils of modified leaves and is indeterminate, producing whorls or rings of floral organ primordia. In species which produce terminal flowers, the apical meristem is determinate and eventually adopts a third identity, that of a floral meristem. Examples of the plant properties that the genes and gene products of the invention can be used to modulate include indeterminacy (inhibiting or increasing differentiation and enhancing plant growth and yield), symmetry (symmetry of organs developed, and symmetry of arrangement of organs, such as leaves, petals, flowers, etc.), leaf fate and timing internode length modulation, such as longer internodes to increase shade avoidance and shorter internodes to favor leaf development), and floral fate and timing of flowering.

Uses of Plants Modified as Described Above Using Sam Genes, Gene Components and Products Because SAMs determine the architecture of the plant, modified plants will be useful in many agricultural, horticultural, forestry and other industrial sectors. Plants with a different shape, numbers of flowers and seed and fruits will have altered yields of plant parts. For example, plants with more branches can produce more flowers, seed or fruits. Trees without lateral branches will produce long lengths of clean timber. Plants with greater yields of specific plant parts will be useful sources of constituent chemicals. Such plants will have, for example, more prolific leaf development, better optimized stem and shoot development, adventitious shoots, more flowers, seeds, and fruits, enhanced vigor (including growth rate of whole plant, including height, flowering time, etc., seedling, coleoptile elongation, young leaves, flowers, seeds, and fruit. higher yields based on biomass (fresh and dry weight during any time in plant life, including maturation and senescence), number of flowers, seed yield (number, size, weight, harvest index, content and composition, e.g. amino acid, jasmonate, oil, protein and starch) and fruit yield (number, size, weight, harvest index, content and composition, e.g. amino acid, jasmonate, oil, protein and starch).

To regulate any of the phenotype(s) above, activities of one or more of the SAM genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Dolan et al. (1993, Development 119: 71-84), Dolan et al. (1997, Development 124: 1789-98), Crawford and Glass (1998, Trends Plant Science 3: 389-95), Wang et al. (1998, PNAS USA 95: 15134-39), Gaxiola et al. (1998, PNAS USA 95: 4046-50), Apse et al. (1999, Science 285: 1256-58), Fisher and Long (1992, Nature 357: 655-60), Schneider et al. (1998, Genes Devel 12: 2013-21) and Hirsch (1999, Curr Opin Plant Biol. 2: 320-326).

III.B.4.c. Use of Sam Genes and Gene Components to Modulate Biochemical Activities SAM genes and gene components are useful for modulating biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Growth, Differentiation And Development | Leaf shape and inflorescence and flower morphology systems | Chuck, G. et al., 1996 Plant Cell 8: 1227-1289. |
| | Activities of SAM transcriptional regulatory proteins. | Schneeberger et al., 1998 Development 125: 2857-2865. |
| | Meristem size and organ number determinants | Kayes, J. M. and Clark, S. E. 1998 Development 125: 3843-3851. |
| | Regulated by Receptor Kinases Receptor kinase location and activity. | Jeong, S. et al., 1999 Plant Cell 11: 1925-1934. |
| | Meristem proliferation activities | Tantikanjana, T. Genes and Development. Jun. 15, 2001. 15(12): 1577-1588. |
| Internode elongation | Hormone signaling pathways | Yamamuro, C. et al., 2000 Plant Cell. 12: 1591-1605. |
| Hormone Perception | Levels of growth hormones including gibberellic acid, Auxin and cytokinin. | Kusaba, S. et al; 1998 Plant Physiology 116(2): 471-476. |
| | Gibberellic acid biosynthesis GA biosynthetic enzyme GA-20 oxidase is a required step in GA biosynthesis. GA-20 oxidase is Regulated by some SAM gene products. | Modulation of GA perception and function can be assayed as described in Sakamoto, T. et al. 2001 Genes and Development 15: 581-590. |
| | Over expression of SAM genes can lead to reduced internode elongation, reduced cell elongation and reduced cell expansion. | Sakamoto, T. et al. 2001. Genes and Development 15: 581-590. |
| | Cytokinin Receptor activity | Inoue, T. et al., Nature 409: 1060-1063. |
| | SAM gene products can affect the activity of Auxin dependent postranscriptional gene protein expression. | Sieberer, T. et al., 2000 Current Biology 10: 1595-1598. del Pozo, J. C.; Estelle, M. PNAS (USA) 1999. 96(26): 15342-15347. |
| | SAM gene products can affect Auxin Perception/metabolism in the meristem to produce useful changes in plant architecture. | Tantikanjana, T. Genes and Development. Jun. 15, 2001. 15(12): 1577-1588. |

-continued

| PROCESS | BIOCHEMICAL OR METABOLIC ACTIVITIES AND/OR PATHWAYS | CITATIONS INCLUDING ASSAYS |
|---|---|---|
| Leaf senescence | SAM gene products can increase and decrease leaf senescence rate. This can be done by modulating cytokinin hormone levels. | Ori, N. et al; Plant Cell. June, 1999. 11(6): 1073-1080. |
|  | Cytokinin effect on cell division and expansion. | Beemster, Gerrit T. S.; Baskin, Tobias I. 2000 Plant Physiology 124: 1718-1727. |
| Adventitious shoot formation | Alter growth hormone status. | Kusaba, S. et al; 1998 Plant Physiology 116(2): 471-476 |
|  | Ectopic expression of SAM genes in leaf or other non SAM organs or tissue can produce shoots | Chuck, G. 1996 Plant Cell 8: 1227-1289. |
|  | Pathways comprising isopentenyl transferase (ipt) |  |

Other biological activities that can be modulated by the SAM genes and gene products are listed in the Reference tables. Assays for detecting such biological activities are described in the Protein Domain table.

III.B.4.d. Use of Sam Genes, Gene Components and Products to Modulate Transcription Levels of Other Genes The expression of many genes is "upregulated" or "downregulated" in the SAM mutants because some of the SAM genes are integrated into complex networks that regulate the transcription of many other genes. Some SAM genes and gene components are therefore useful for modifying the transcription of other genes and hence complex phenotypes as described above. Profiles of genes altered by SAM mutations and genes are described in the Table below with associated biological activities. "Up-regulated" profiles are for genes whose mRNA levels are higher in the stm plants as compared to parental wild-type plants; and vice-versa for "down-regulated" profiles.

| TRANSCRIPT LEVELS | TYPE OF GENES WHOSE TRANSCRIPTS ARE CHANGED | PHYSIOLOGICAL CONSEQUENCES OF MODIFYING SAM GENE PRODUCT LEVELS | EXAMPLES OF BIOCHEMICAL ACTIVITIES WHOSE TRANSCRIPTS ARE CHANGED |
|---|---|---|---|
| Up Regulated Transcripts | Genes repressed by SAMs directly or indirectly | Altered Auxin/cytokinin hormone ratio and perception. Increased/decreased cell expansion - promoting effects of brassinosteroids and gibberellic acids, due to altered levels of biosynthetic pathway enzymes and or the amount of functional hormone receptor. Increased or decreased rate of cell division. Altered planes of cell division Increased or decreased rate and extent of cell expansion. Increased or decreased rigidity of cell ways. | Transporters Metabolic Enzymes Cell Membrane Structure Kinases, Phosphatases, G-Proteins Transcription Activators/Repressors Transcription coactivators/corepressors Chromatin Structure And/Or Localized DNA Topology Proteins Cell Wall Proteins Translational activators/repressors Cell wall proteins involved in cell rigidity e.g. extensin, glycine rich proteins. Cell cycle regulatory proteins such as cyclins and cyclin dependent protein kinases (CDKs). |
| Down-Regulated Transcripts | Genes involved in SAM cells and genes whose expression is induced by SAMs | Altered pattern of organs immerging from the meristem Increased or decreased the number of cells partitioned into a lateral organ. Altered apical dominance due to suppression of lateral bud growth. | Auxin transporter proteins Auxin receptor proteins Cytokinin receptor proteins Gibberellic acid receptor proteins Brassinolide receptor proteins Hormone biosynthesis proteins |

| TRANSCRIPT LEVELS | TYPE OF GENES WHOSE TRANSCRIPTS ARE CHANGED | PHYSIOLOGICAL CONSEQUENCES OF MODIFYING SAM GENE PRODUCT LEVELS | EXAMPLES OF BIOCHEMICAL ACTIVITIES WHOSE TRANSCRIPTS ARE CHANGED |
|---|---|---|---|
| | | Altered apical dominance due to releasing of axillary meristems from repression. Increased/or decreased production of adventitious meristems. Increased potential to form somatic embryos. Altered cell signaling pathways Altered hormone levels | Hormone degradation proteins Hormone conjugation proteins Ubiquitin conjugating enzymes. Receptor kinase signal transduction |

SAM genes and gene products can be modulated alone or in combination as described in the introduction. Of particular interest are combination of these genes and gene products with those that modulate hormone responsive pathways. Hormone responsive genes and gene products are described in more detail in the sections below.

Use of Sam Gene Promoters to Modify SAMs

Promoters of SAM genes, as described in the Reference tables, for example, can be used to modulate transcription of coding sequences in SAM cells to influence growth, differentiation or patterning of development or any of the phenotypes or biological activities above. For example, any desired sequence can be transcribed in similar temporal, tissue, or environmentally specific patterns as a SAM gene when the desired sequence is operably linked to the promoter of the SAM gene.

A specific instance is linking of a SAM gene promoter normally active in floral meristem primordia, to a phytotoxic protein coding sequence to inhibit apical meristem switching into an inflorescence and/or floral meristem, thereby preventing flowering.

SAM gene promoters can also be used to induce transcription of antisense RNA copies of a gene or an RNA variant to achieve reduced synthesis of a specific protein in specific SAM cells. This provides an alternative way to the example above, to prevent flowering.

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES OF GENE PRODUCTS WITH MODIFIED LEVELS |
|---|---|---|---|
| Up regulated Transcripts | Genes involved in leaf, stem and root cell differentiation, cell division, cell expansion Genes involved in positive regulation of root, stem and leaf genes Repressors of root and other organ cell types e.g. flowers | Leaf cells proliferate and differentiate; Leaf structures form and expand | Transcription factors, signal transduction proteins, kinase and phosphatases Chromatin remodeling Hormone biosynthesis enzymes Receptors |
| | Genes involved in photosynthesis | Photosynthesis and plastid differentiation Calvin cycle activated Chloroplast biogenesis and plastid differentiation activated | Light harvesting coupled to ATP production Chlorophyll biosynthesis Ribulose Bisphosphate carboxylase Chloroplast membranes synthesis Chloroplast ribosome biogenesis |

-continued

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES OF GENE PRODUCTS WITH MODIFIED LEVELS |
|---|---|---|---|
| | Other genes involved in metabolism | Starch biosynthesis Lipid biosynthesis Nitrogen metabolism - NO3 reduced and amino acids made Secondary metabolites produced | Starch synthase Nitrate reductase Terpenoid biosynthesis Transcription factors Transporters Kinases Phosphatases and signal transduction protein Chromatin structure modulators |
| Down regulated genes | Genes involved in negative regulation of root, stem and leaf genes Genes involved in other organs e.g. flowers | Leaf genes activated and leaf functions induced Other organs not induced Leaf, stem and root metabolic pathways induced | Transcription factors Signal transduction proteins - kinases and phosphatases Metabolic enzymes Chromatin remodeling proteins |

While early seedling phase polynucleotides and gene products are used singly, combinations of these polynucleotides are often better to optimize new growth and development patterns. Useful combinations include different leaf polynucleotides and/or gene products with a hormone responsive polynucleotide. These combinations are useful because of the interactions that exist between hormone-regulated pathways, nutritional pathways and development.

Use of Early Seedling Phase Gene Promoters

Promoters of early seedling phase genes are useful for transcription of desired polynucleotides, both plant and non-plant. If the gene is expressed only in the post-germination seedling, or in certain kinds of leaf cells, the promoter is used to drive the synthesis of proteins specifically in those cells. For example, extra copies of carbohydrate transporter cDNAs operably linked to a early seedling phase gene promoter and inserted into a plant increase the "sink" strength of leaves. Similarly, early seedling phase promoters are used to drive transcription of metabolic enzymes that alter the oil, starch, protein, or fiber contents of the seedling. Alternatively, the promoters direct expression of non-plant genes that can, for instance, confer resistance to specific pathogen. Additionally the promoters are used to synthesize an antisense mRNA copy of a gene to inactivate the normal gene expression into protein. The promoters are used to drive synthesis of sense RNAs to inactivate protein production via RNA interference.

III.B.5. Vegetative-Phase Specific Responsive Genes, Gene Components and Products Often growth and yield are limited by the ability of a plant to tolerate stress conditions, including water loss. To combat such conditions, plant cells deploy a battery of responses that are controlled by a phase shift, from so called juvenile to adult. These changes at distinct times involve, for example, cotyledons and leaves, guard cells in stomata, and biochemical activities involved with sugar and nitrogen metabolism. These responses depend on the functioning of an internal clock, that becomes entrained to plant development, and a series of downstream signaling events leading to transcription-independent and transcription-dependent stress responses. These responses involve changes in gene expression.

Manipulation of the activation of one or more genes controlling the phase changes is useful to modulate the biological processes and/or phenotypes listed below. Phase responsive genes and gene products can act alone or in combination. Useful combinations include phase responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants.

Phase responsive genes and gene products can function to either increase or dampen the above phenotypes or activities. Characterization of phase responsive genes was carried out using microarray technology. Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing about 10,000 non-redundant ESTs, selected from about 37,000 randomly sequenced ESTs generated from mRNA of different tissues and developmental stages.

The sequences of the ESTs showing at least two-fold increases or decreases in a mutant of *Arabidopsis thaliana*, squint, that appears not to undergo phase changes and appears adult-like throughout its growth cycle, compared with wild type were identified, compared to the Ceres full length cDNA and genomic sequence databanks, and equivalent Ceres clones identified. The MA_diff tables reports the results of this analysis, indicating those Ceres clones which are up or down regulated over controls, thereby indicating the Ceres clones which represent phase responsive genes. The MA_diff Table(s) reports the transcript levels of the experiment (see EXPT ID: Sqn (relating to SMD 7133, SMD 7137)). For transcripts that had higher levels in the samples than the control, a "+" is shown. A "−" is shown for when transcript levels were reduced in root tips as compared to the control. For more experimental detail see the Example section below.

Phase responsive genes are those sequences that showed differential expression as compared to controls, namely those sequences identified in the MA_diff tables with a "+" or "−" indication.

Phase Responsive Genes Identified by Cluster Analyses of Differential Expression Phase Responsive Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of phase responsive genes is any group in the MA_clust that comprises a cDNA ID that also appears in Expt ID Sqn (relating to SMD 7133, SMD 7137) of the MA_diff table(s).

Phase Responsive Genes Identified by Correlation to Genes that Cause Physiological Consequences Additionally, the differential expression data and the phenotypic observations can be merged to identify pathways or networks of phase responsive genes. A group in the MA_clust is considered a phase responsive pathway or network if the group comprises a cDNA ID that also appears in Knock-in or Knock-out tables that causes one or more of the phenotypes described in section above.

Phase Responsive Genes Identified by Amino Acid Sequence Similarity

Phase responsive genes from other plant species typically encode polypeptides that share amino acid similarity to the sequences encoded by corn and *Arabidopsis* phase responsive genes. Groups of phase responsive genes are identified in the Protein Grouping table. In this table, any protein group that comprises a peptide ID that corresponds to a cDNA ID member of a phase responsive pathway or network is a group of proteins that also exhibits Phase responsive functions/utilities.

Further, promoters of phase responsive genes, as described in Reference tables, for example, are useful to modulate transcription that is induced by phase or any of the following phenotypes or biological activities below. Further, any desired sequence can be transcribed in similar temporal, tissue, or environmentally specific patterns as the phase responsive genes when the desired sequence is operably linked to a promoter of a phase responsive gene.

III.B.5.a. Use of Phase Responsive Genes to Modulate Phenotypes Phase responsive genes and gene products are useful to or modulate one or more phenotype including timing phenotypes, dormancy, germination, cotyledon opening, first leaves, juvenile to adult transition, bolting, flowering, pollination, fertilization, seed development, seed set, fruit drop, senescence, epinasty, biomass, fresh and dry weight during any time in plant life, such as maturation, number of flowers, seeds, branches, and/or leaves, seed yield, including number, size, weight, and/or harvest index, fruit yield, including number, size, weight, and/or harvest index, plant development, time to fruit maturity, cell wall strengthening and reinforcement, stress tolerance, drought tolerance, flooding tolerance, and UV tolerance.

To regulate any of the phenotype(s) above, activities of one or more of the phase responsive genes or gene products can be modulated and the plants can be tested by screening for the desired trait. Specifically, the gene, mRNA levels, or protein levels can be altered in a plant utilizing the procedures described herein and the phenotypes can be screened for variants as in Anderson et al. (1997) *Plant Cell* 9: 1727-1743; Heintzen et al. (1997) *Proc. Natl. Acad. Sci. USA* 94: 8515-20; Schaffer et al. (1998) *Cell* 93:1219-1229; Somers et al. (1998) *Development* 125: 485-494; Somers et al. (1998) *Science* 282: 1488-1490; Wang and Tobin (1998) *Cell* 93: 1207-1217; Zhong et al. (1998) *Plant Cell* 10: 2005-2017; Sugano et al. (1998) *Proc. Natl. Acad. Sci. USA* 95: 11020-11025; Dowson-Day and Millar (1999) *Plant J* 17: 63-71; Green and Tobin (1999) *Proc. Natl. Acad. Sci. USA* 96: 4176-419; Staiger and Apel (1999) *Mol. Gen. Genet.* 261: 811-819; Strayer and Kay (1999) *Curr. Opin. Plant Biol.* 2:114-120; Strayer et. al. (2000) *Science* 289:768-771; Kreps et al. (2000) *J Biol Rhythms* (2000) 15:208-217; Nelson et al. (2000) *Cell* 101:331-340; Somers et al. (2000) *Cell* 101:319-329.

III.B.5.b. Use of Phase Responsive Genes to Modulate Biochemical Activities

The activities of one or more of the phase responsive genes can be modulated to change biochemical or metabolic activities and/or pathways such as those noted below. Such biological activities are documented and can be measured according to the citations above and included in the table below:

| Process | Biochemical Or Metabolic Activities And/Or Pathways | Citations including assays |
|---|---|---|
| Germination And Seedling Development | Cold, Light And Water Modulated Signal Transduction Pathways, Receptors, Kinases, PAS Domain Proteins | Bognar et al. (1999) *Proc. Natl. Acad. Sci. USA* 96: 14652-14657; Sugano et al (1999) *Proc. Natl. Acad. Sci. USA* 96: 12362-12366; Dowson-Day and Millar (1999) *Plant J* 17: 63-71; Somers et al. (2000) Cell 101: 319-329; Zhong et al. (1998) *Plant Cell* 10: 2005-2017 |

| Process | Biochemical Or Metabolic Activities And/Or Pathways | Citations including assays |
|---|---|---|
| Growth Transitions And Flowering | Cold And Light Modulated Signal Transduction Pathways, Receptors, Kinases, PAS Domain Protiens | Nelson et al. (2000) Cell 101: 331-340; Fowler et al. (1999) EMBO J. 18: 4679-4688 |
| Tuber Formation | Cold And Light Modulated Signal Transduction Pathways | Yanovsky et al. (2000) Plant J. 23: 223-232 |
| METABOLISM | | |
| Lipid Metabolism | Membrane Lipid Synthesis Including Omega-3 Fatty Acid Desaturase, Lipases, Lipid Transfer Proteins | Bradley and Reddy (1997) J. Bacteriol. 179: 4407-4410; Martin, M et al. 1999 Europe J. Biochem 262: 283-290 |
| Sugar Metabolism | Glycosylhydrolases, Glycosyltransferases, Amylases, Sucrose Synthase, CAB, Rubisco, Light Signal Transduction | Liu et al. (1996) Plant Physiol. 112: 43-51; Millar and Kay (1996) Proc Natl Acad Sci USA 93: 15491-15496; Wang et al. (1997) Plant Cell 9: 491-507; Shinohara et al (1999) J. Biol. Chem. 273: 446-452 |
| Nitrogen Metabolism | Aminotransferases, Arginase, Proteases And Vegetative Storage Proteins, Aromatic Amino Acid Synthesis | Bradley and Reddy (1997) J. Bacteriol. 179: 4407-4410 |
| Photorespiration | Mitochondrial, Chloroplast And Peroxisomal Photorespiratory Enzymes, Serine Hydroxymethyl Transferases, Catalase | Zhong and McClung (1996) Mol. Gen. Genet. 251: 196-203; McClung (1997) Free. Radic. Biol. Med. 23: 489-496; McClung et al. (2000) Plant Physiol. 123: 381-392 |
| Responses To Environmental Stress | Expression Of Genes Involved In Responses To Drought, Salt, UV | McClung (1997) Free Radic Biol Med 23: 489-496; Shi et al. (2000) Proc. Natl. Acad. Sci. USA 97: 6896-6901 |

Other biological activities that can be modulated by the phase responsive genes and their products are listed in the Reference tables. Assays for detecting such biological activities are described in the Protein Domain table.

Phase responsive genes are characteristically differentially transcribed in response to maturity of the cell, organ or tissue which depends on a timing mechanism, which is internal to an organism or cell. The Intensity Table reports the changes in transcript levels of various phase responsive genes in a plant.

The data from this experiment reveal a number of types of phase responsive genes and gene products. Profiles of some classes of phase responsive genes are shown in the table below with examples of which associated biological activities are modulated when the activities of one or more such genes vary in plants.

| Transcript Levels | Type Of Genes | Physiological Consequences | Examples Of Biochemical Activity |
|---|---|---|---|
| Up Regulated Transcripts | Responders To mutation that confers adult like phase Genes induced in adult-like phase | Adult phase adoption Metabolisms Affected By phase change Synthesis Of Secondary Metabolites And/Or Proteins Modulation Of Phase Response Transduction Pathways Specific Gene Transcription Initiation | Metabolic Enzymes Change In Cell Membrane Structure And Potential Kinases And Phosphatases Transcription Activators Change In Chromatin Structure And/Or Localized DNA Topology |
| Down-Regulated Transcripts | Responders To mutation that confers adult phase Genes repressed in adult-like phase Genes With Discontinued Expression Or | Negative Regulation of adult phase pathways Changes In Pathways And Processes Operating In Cells | Transcription Factors Change In Protein Structure By Phosphorylation (Kinases) Or Dephosphoryaltion (Phosphatases) Change In Chromatin |

| Transcript Levels | Type Of Genes | Physiological Consequences | Examples Of Biochemical Activity |
|---|---|---|---|
| | Unstable mRNA in adult-like phase | Changes In Metabolic pathways other than phase specific pathways | Structure And/Or DNA Topology Stability Factors For Protein Synthesis And Degradation Metabolic Enzymes |

Use of Promoters of Phase Responsive Genes

Promoters of phase responsive genes are useful for transcription of any desired polynucleotide or plant or non-plant origin. Further, any desired sequence can be transcribed in a similar temporal, tissue, or environmentally specific patterns as the phase responsive genes where the desired sequence is operably linked to a promoter of a phase responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.C. Hormone Responsive Genes, Gene Components and Products

III.C.1. Abscissic Acid Responsive Genes, Gene Components and Products

Plant hormones are naturally occurring substances, effective in very small amounts, which act as signals to stimulate or inhibit growth or regulate developmental processes in plants. Abscisic acid (ABA) is a ubiquitous hormone in vascular plants that has been detected in every major organ or living tissue from the root to the apical bud. The major physiological responses affected by ABA are dormancy, stress stomatal closure, water uptake, abscission and senescence. In contrast to Auxins, cytokinins and gibberellins, which are principally growth promoters, ABA primarily acts as an inhibitor of growth and metabolic processes.

Changes in ABA concentration internally or in the surrounding environment in contact with a plant results in modulation of many genes and gene products. Examples of such ABA responsive genes and gene products are shown in the Reference, Sequence, Protein Group, Protein Group Matrix tables, MA_diff, and MA_clust tables. These genes and/or products are responsible for effects on traits such as plant vigor and seed yield. They were discovered and characterized from a much larger set of genes by experiments designed to find genes whose mRNA products changed in concentration in response to application of ABA to plants.

While ABA responsive polynucleotides and gene products can act alone, combinations of these polynucleotides also affect growth and development. Useful combinations include different ABA responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of an ABA responsive polynucleotide and/or gene product with another environmentally responsive polynucleotide is also useful because of the interactions that exist between hormone-regulated pathways, stress and defense induced pathways, nutritional pathways and development. Here, in addition to polynucleotides having similar transcription profiles and/or biological activities, useful combinations include polynucleotides that may have different transcription profiles but which participate in common or overlapping pathways.

Such ABA responsive genes and gene products can function to either increase or dampen the above phenotypes or activities either in response to changes in ABA concentration or in the absence of ABA fluctuations. The MA_diff Table(s) reports the transcript levels of the experiment (see EXPT ID: 108560, 108561, 108513, 108597). For transcripts that had higher levels in the samples than the control, a "+" is shown. A "−" is shown for when transcript levels were reduced in root tips as compared to the control. For more experimental detail see the Example section below.

ABA genes are those sequences that showed differential expression as compared to controls, namely those sequences identified in the MA_diff tables with a "+" or "−" indication.

ABA Genes Identified by Cluster Analyses of Differential Expression

ABA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of ABA genes is any group in the MA_clust that comprises a cDNA ID that also appears in Expt ID 108560, 108561, 108513, 108597 of the MA_diff table(s).

ABA Genes Identified by Correlation to Genes that Cause Physiological Consequences Additionally, the differential expression data and the phenotypic observations can be merged to identify pathways or networks of ABA genes. A group in the MA_clust is considered a ABA pathway or network if the group comprises a cDNA ID that also appears in Knock-in or Knock-out tables that causes one or more of the phenotypes described in section above.

ABA Genes Identified by Amino Acid Sequence Similarity

ABA genes from other plant species typically encode polypeptides that share amino acid similarity to the sequences encoded by corn and *Arabidopsis* ABA genes. Groups of ABA genes are identified in the Protein Group table. In this table, any protein group that comprises a peptide ID that corresponds to a cDNA ID member of a ABA pathway or network is a group of proteins that also exhibits ABA functions/utilities.

Further, promoters of ABA responsive genes, as described in the Reference tables, for example, are useful to modulate transcription that is induced by ABA or any of the following phenotypes or biological activities below.

III.C.1.a. Use of Abscissic Acid Responsive Genes to Modulate Phenotypes

ABA responsive genes and gene products are useful to or modulate one or more of the following phenotypes including development such as cell growth (promotion of leaf cell elongation), fruit development (fruit drop and inhibition of parthenocarpy and ovary growth), seed development (maturation of zygotic and somatic embryos, embryo development, seed development and maturation, acquisition of desiccation tolerance, dormancy including control rate and timing of germination, prolongation of seed storage and viability, and inhibition of hydrolytic enzyme synthesis); growth of roots such as inhibition of root elongation under low water potential), stems, buds (such as promotion of dormancy and lateral/axillary bud formation), leaves, and inhibition of aba-induced growth and elongation; biomass (such as fresh and dry weight during any time in plant life, such as maturation), number, size, and weight of flowers and seeds); senescence (including abscission, leaf fall, and flower longevity); differentiation (including plastid/chloroplast differentiation and regulation of sterility); and stress responses (such as mediation of response to desiccation, drought, salt and cold).

To regulate any of the phenotype(s) above, activities of one or more of the ABA responsive genes or gene products can be modulated in an organism and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Koorneef and Karssen (1994, Seed dormancy and germination, In: *Arabidopsis*, Cold Spring Harbor Lab. Press, pp 314-334), Cramer et al (1998, J. Exptl. Botany 49:191-198), and White and Rivin (2000, Plant Physiol 122: 1089-97). Phillips et al. (1997) EMBO J 16: 4489-96; Nambara et al (1995) Development 121: 629-636; Hays et al (1999) Plant Physiol. 119: 1065-72; Filonova et al (2000) J Exptl Botany 51: 249-64; White et al (2000) Plant Physiol. 122: 1081-88; and Visser et al. (1998) Plant Mol Biol 37: 131-40; Rohde et al. (2000) Plant Cell 12:35-52; and Cramer et al. (1998) J. experimental Botany. 49: 191-198.

III.C.1.b. Use of Abscissic Acid Responsive Genes to Modulate Biochemical Activities The activities of one or more of the ABA responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Growth, Differentiation And Development | Farnesylation | Pei Et Al (1998) Science 282: 287-290; Cutler Et Al. (1996) Science 273: 1239 |
| | Nitrogen Metabolism | Goupil Et Al (1998) J Exptl Botany 49: 1855-62 |
| Water Conservation And Resistance To Drought And Other Related Stresses | Stomatal Development And Physiology | Allen Et Al. (1999) Plant Cell 11: 1785-1798 Li Et Al. 2000 Science 287: 300-303 Burnett Et Al 2000. J. Exptl Botany 51: 197-205 Raschke (1987) In: Stomatal Function Zeiger Et Al. Eds., 253-279 |
| | Stress Response Pathways | Bush And Pages (1998) Plant Mol. Biol. 37: 425-35 |
| | Inhibition Of Ethylene Production Under Low Water Potential | Spollen Et Al (2000) Plant Physiol. 122: 967-976 |
| | Proline And Other Osmolite Synthesis And Degradation | Hare Et Al. (1998) Plant, Cell And Environment 21: 535-553; Hare Et Al. (1999) J. Exptl. Botany 50: 413-434 |
| | Plasmalemma And Tonoplast Ion Channel Changes | Macrobbie (1998) Philos Trans R Soc Lond B Biol Sci 353: 1475-88; Li Et Al (2000) Science 287: 300-303; Barkla Et Al. (1999) Plant Physiol. 120: 811-819 |
| | Ca2+ Accumulation | Lacombe Et Al. (2000) Plant Cell 12: 837-51; Wang Et Al. (1998) Plant Physiol 118: 1421-1429; Shi Et Al. (1999) Plant Cell 11: 2393-2406 |
| | K+ Efflux | Gaymard Et Al. (1998) Cell 94: 647-655 |
| | Activation Of Kinases And Phosphatases | Jonak Et Al. (1996) Proc. Natl. Acad. Sci 93: 11274-79; Sheen (1998) Proc. Natl. Acad. Sci. 95: 975-80; Allen Et Al. (1999) Plant Cell 11: 1785-98 |

Other biological activities that can be modulated by the ABA responsive genes and gene products are listed in the Reference tables. Assays for detecting such biological activities are described in the Protein Domain table.

ABA responsive genes are characteristically differentially transcribed in response to fluctuating ABA levels or concentrations, whether internal or external to an organism or cell. The MA_diff reports the changes in transcript levels of various ABA responsive genes in entire seedlings at 1 and 6 hours after a plant was sprayed with a Hoagland's solution enriched with ABA as compared to seedlings sprayed with Hoagland's solution only.

The data from this time course can be used to identify a number of types of ABA responsive genes and gene products, including "early responders," and "delayed ABA responders", "early responder repressors" and "delayed repressors". Profiles of these different ABA responsive genes are shown in the Table below together with examples of the kinds of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up Regulated Transcripts (Level At 1 Hr ≅ 6 Hr) or (Level At 1 Hr > 6 Hr) | Early Responders To ABA | ABA Perception ABA Uptake Modulation Of ABA Response Transduction Pathways Specific Gene Transcription Initiation | Transcription Factors Transporters Change In Cell Membrane Structure Kinases And Phosphatases Transcription Activators Change In Chromatin Structure And/Or Localized DNA Topology |
| Up Regulated Transcripts (Level At 1 Hr < 6 Hr) | Delayed Responders | Maintenance Of Response To ABA Maintenance Of Seed Dormancy, Stress Stomatal Closure, Water Uptake Control, Abscission And Senescence Control Pathways | Transcription Factors Specific Factors (Initiation And Elongation) For Protein Synthesis Maintenance Of Mrna Stability Maintenance Of Protein Stability Maintenance Of Protein-Protein Interaction |
| Down-Regulated Transcripts (Level At 1 Hr ≅ 6 Hr) or (Level At 6 Hr > 1 Hr) | Early Responder Repressors Of ABA State Of Metabolism Genes With Discontinued Expression Or UnsTable mRNA In Presence Of ABA | Negative Regulation Of ABA Pathways Released Changes In Pathways And Processes Operating In Cells | Transcription Factors Change In Protein Structure By Phosphorylation (Kinases) Or Dephosphoryaltion (Phosphatases) Change In Chromatin Structure And/Or DNA Topology |
| Down-Regulated Transcripts (Level At 1 Hr > 6 Hr) | Delayed Repressors Of ABA State Of Metabolism Genes With Discontinued Expression Or UnsTable mRNA In Presence Of ABA | Negative Regulation Of ABA Pathways Released Maintenance Of Pathways Released From Repression Changes In Pathways And Processes Operating In Cells | Transcription Factors Kinases And Phosphatases Stability Of Factors For Protein Synthesis And Degradation |

Use of Promoters of ABA Responsive Genes

Promoters of ABA responsive genes are useful for transcription of any desired polynucleotide or plant or non-plant origin. Further, any desired sequence can be transcribed in a similar temporal, tissue, or environmentally specific patterns as the ABA responsive genes where the desired sequence is operably linked to a promoter of a ABA responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.C.2. Auxin Responsive Genes, Gene Components and Products

Plant hormones are naturally occurring substances, effective in very small amounts that stimulate or inhibit growth or regulate developmental processes in plants. One of the plant hormones is indole-3-acetic acid (IAA), often referred to as Auxin.

Changes in Auxin concentration in the surrounding environment in contact with a plant or in a plant results in modulation of the activities of many genes and hence levels of gene products. Examples of such Auxin responsive genes and their products are shown in the Reference and Sequence Tables. These genes and/or products are responsible for effects on traits such as plant vigor and seed yield. The genes were discovered and characterized from a much larger set by experiments designed to find genes whose mRNA products changed in response to application of Auxin to plants.

Manipulation of one or more Auxin responsive gene activities are useful to modulate the biological activities and/or phenotypes listed below. Auxin response genes and gene products can act alone or in combination. Useful combinations include Auxin response genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of the levels of such proteins is especially useful for altering phenotypes and biochemical activities of plants. The MA_diff Table(s) reports the transcript levels of the experiment (see EXPT ID: 108564, 108565, 108516, 108554, 108466, 107886, 107891, SMD 3743, and NAA (relating to SMD 3749, SMD 6338, SMD 6339)). For transcripts that had higher levels in the samples than the control, a "+" is shown. A "−" is shown for when transcript levels were reduced in root tips as compared to the control. For more experimental detail see the Example section below.

NAA genes are those sequences that showed differential expression as compared to controls, namely those sequences identified in the MA_diff tables with a "+" or "−" indication.

NAA Genes Identified by Cluster Analyses of Differential Expression

NAA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of NAA genes is any group in the MA_clust that comprises a cDNA ID that also appears in Expt ID 108564, 108565, 108516, 108554, 108466, 107886, 107891, SMD 3743, and NAA (relating to SMD 3749, SMD 6338, SMD 6339) of the MA_diff table(s).

NAA Genes Identified by Correlation to Genes that Cause Physiological Consequences Additionally, the differential expression data and the phenotypic observations can be merged to identify pathways or networks of NAA genes. A group in the MA_clust is considered a NAA pathway or network if the group comprises a cDNA ID that also appears in Knock-in or Knock-out tables that causes one or more of the phenotypes described in section above.

NAA Genes Identified by Amino Acid Sequence Similarity

NAA genes from other plant species typically encode polypeptides that share amino acid similarity to the sequences encoded by corn and *Arabidopsis* NAA genes. Groups of NAA genes are identified in the Protein Group table. In this table, any protein group that comprises a peptide ID that corresponds to a cDNA ID member of a NAA pathway or network is a group of proteins that also exhibits NAA functions/utilities.

Such Auxin responsive genes and gene products can function to either increase or dampen the above phenotypes or activities either in response to changes in Auxin concentration or in the absence of Auxin fluctuations. Further, promoters of Auxin responsive genes, as described in the Reference tables, for example, are useful to modulate transcription that is induced by Auxin or any of the following phenotypes or biological activities below.

III.C.2.a. Use of Auxin Responsive Genes, Gene Components and Products to Modulate Phenotypes Auxin responsive genes and gene products are useful to or modulate one or more phenotypes including growth, apical dominance, vascular growth, roots, inhibition of primary root elongation, increased lateral root formation, stems, lateral buds, lateral branching, reduction of branching, for high density growth per acre, for increased wood production, lateral organ initiation and/or positioning in apical meristem, organ formation, for example, fruit number in tomatoes, leaves, height/stature, e.g., taller crops or increase wood production, regeneration and differentiation of cultured cells or plantlets, biomass, fresh and dry weight during any time in plant life, such as maturation; number of flowers; number of seeds; number of branches; number of leaves; starch content, seed yield, including number, size, weight, harvest index, starch content, fruit yield, number, size, weight, harvest index, starch content, development, orienting cell growth, establishment and maintenance of plant axis, apical dominance, cell plate placement, polarised growth, initiation and/or development, of embryos morphogenic progression, e.g., from early radial to late axialized torpedo stages, differentiation of cells into morphologically different cell layers, cotyledon separation, fruit development, abscission, leading to modulation of fruit drop, parthenocarpy, seedless crops resulting from lack of seed set, vascularization, e.g. hypocotyl and cotyledon tissues, genetic control of vascular patterning and influences its maturation; specification of the sites where vascular differentiation will occur; determination of the direction and extent of vascular tissue formation, maintenance of the continuity of vascular development with plant growth, tropic responses, gravitropic responses, e.g. affecting roots and shoots, and modulation of phototropic sensitivity, e.g. increase growth under a reduced light spectrum.

Further, any desired sequence can be transcribed in similar temporal, tissue, or environmentally specific patterns as the Auxin responsive genes when the desired sequence is operably linked to a promoter of an Auxin responsive gene.

To modulate any of the phenotype(s) above, activities of one or more of the Auxin response genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance with Bechtold and Pelletier (1998). Methods Mol. Biol. 82: 259-266; Clough and Bent (1998). 16: 735-743; Krysan et al. (1999). Plant Cell 11:2283-2290.

III.C.2.b. Use of Auxin Responsive Genes, Gene Components and Products to Biochemical Activities:

The activities of one or more of the Auxin responsive genes can be modulated to change biochemical or metabolic activities and/or pathways such as those noted below. Such biological activities are documented and can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Cell Growth and Differentiation | Protein Ubiquitination | Gray et al. (1999) Genes and Develop, 13: 1678-1691 Bechtold and Pelletier (1998). Methods. Mol. Biol. 82: 259-266 |

-continued

| PROCESS | BIOCHEMICAL OR METABOLIC ACTIVITIES AND/OR PATHWAYS | CITATIONS INCLUDING ASSAYS |
|---|---|---|
| | Cell Wall loosening and Expansion | Catala et al. (2000). Plant Physiol. 122: 527-534.<br>Cosgrove, D. (1993). New Phytol. 124: 1-23. |
| Auxin/Cytokinin Ratio | Changing Auxin and/or cytokinin synthesis and/or turnover | Chen et al. (1988). Plant Physiol. 86: 822-825<br>Tam et al. (2000). Plant Physiol. 123: 589-595<br>Bartel and Fink. (1995). Science 268: 1745-1748.<br>Prinsen et al. (1995). Quantifying phytohormones in transformed plants. In: Methods in Molecular Biology. 44: 245-262. |
| Auxin Transport | Channeling of polar Auxin Transport | Reed et al. (1998). Plant Physiol. 118: 1369-1378.<br>Estelle, M. (1998). Plant Cell 10: 1775-1778 |
| | Auxin Efflux Between Cells | Reed et al. (1998). Plant Physiol. 118: 1369-1378.<br>Marchant et al. (1999). EMBO J. 18: 2066-2073. |
| | Auxin Influx In and Out of a Cell | Reed et al. (1998). Plant Physiol. 118: 1369-1378.<br>Marchant et al. (1999). EMBO J. 18: 2066-2073. |
| | Electogenic Proton Symport of Auxin | Young et al. (1999). Biochim Biophys Acta. 1415(2): 306-22 |
| Signal Transduction | K+ Accumulation | Philippar et al. (1999). Proc. Natl. Acad. Sci. 96: 12186-12191 |
| | Permeability of Cell Membranes | Marchant et al. (1999). EMBO J. 18: 2066-2073. |
| | Guanine-Nucleotide Exchange | Steinmann et al. (1999). Science 286: 316-318.<br>Peyroche et al. (1996). Nature 384: 479-481. |
| | Protein Phosphorylation | Christensen et al. (2000). Cell 100: 469-478.<br>Hirt (2000). Proc. Natl. Acad Sci. 97: 2405-2407. |
| | Interaction with Ethylene mode of action | Madlung et al. (1999). Plant Physiol. 120: 897-906.<br>Xu et al. (1998). Plant Physiol. 118: 867-874. |
| Protein Turnover | Localization of Polypeptides with the basal End of Cells | Grebe et al. (2000). Plant Cell. 12: 343-356 |

Other biological activities that can be modulated to by the Auxin responsive genes and their products are listed in the Reference Tables. Assays for detecting such biological activities are described in the Domain section of the Reference Tables.

Auxin responsive genes are characteristically differentially transcribed in response to fluctuating Auxin levels or concentrations, whether internal or external to an organism or cell. The MA_diff(s) report(s) the changes in transcript levels of various Auxin responsive genes in the aerial parts of a seedling at 1 and 6 hours after the seedling was sprayed with a solution enriched with Auxin as compared to aerial parts of a seedling sprayed with water.

The data from this time course can be used to identify a number of types of Auxin responsive genes and gene products, including "early responders," and "delayed responders." Profiles of these different classes of Auxin responsive genes are shown in the Table below together with examples of the kinds of associated biological activities.

| TRANSCRIPT LEVEL | TYPE OF GENES | PHYSIOLOGICAL CONSEQUENCES | EXAMPLES OF BIOCHEMICAL ACTIVITY OF GENE PRODUCTS |
|---|---|---|---|
| Upregulated transcripts (level at 1 hr ≅6 hours) (level at 1 hr > 6 | Early responders to Auxin | Auxin perception Auxin Uptake/transport Modulation of Auxin response | Transcription factors Transporters; channeling of polar Auxin transport Kinases and phosphatases; protein |

-continued

| TRANSCRIPT LEVEL | TYPE OF GENES | PHYSIOLOGICAL CONSEQUENCES | EXAMPLES OF BIOCHEMICAL ACTIVITY OF GENE PRODUCTS |
|---|---|---|---|
| hours) | | transduction pathways<br>Initiating transcription of specific gene(s)<br>Modification of cell walls<br>Modification of cell structures<br>Modification of metabolism | ubiqutination; guanine nucelotide exchange; changing Auxin and/or cytokininin synthesis and/or turnover; interaction with ethylene mode of action<br>Auxin metabolic pathways<br>Change in chromatin structure and/or DNA topology<br>Transcriptional activators<br>Change in activity of protein-protein interactions<br>Cell wall and cell growth promoting pathways<br>Change in activity of cytoskeletal proteins modulating cell structure<br>Metabolic enzymes<br>Coordination and control of central carbon and Auxin metabolism |
| Upregulated transcripts (level at 1 hr < 6 hr) | "Delayed" Responders | Completion and/or Maintenance of Auxin response<br>Initiating transcription of specific gene(s)<br>Modification of cell walls<br>Modification of cell structures<br>Modification of metabolism | Transcription factors<br>Changes in membrane protein, membrane channel and/or transporter protein activity<br>Change in chromatin structure and/or DNA topology<br>Transcriptional activators<br>Change in activity of protein-protein interactions<br>Cell wall proteins<br>Change(s) in activity of cytoskeletal proteins modulating cell structure<br>Coordination and control of central carbon and Auxin metabolism metabolic enzymes |
| Downregulated transcripts (level at 1 hour ≅ 6 hours) (level at 1 hour > 6 hours) | Early repressor responders to Auxin<br>Genes for pathways diminished in presence of Auxin | Repression of Auxin induced proteins released<br>Reorientation of metabolism in certain cells | Transcription factors<br>Changes in activity of cytoskeletal proteins modulating cell structure<br>Changes in chromatin structure and/or DNA topology<br>Changes in protein structure and/or function by phosphorylation (kinases) and/or dephosphorylation (phosphatases)<br>Stability of factors for protein translation<br>Changes in cell membrane structure<br>Changes in chromatin and/or localized DNA topology<br>Changes in protein-protein interaction<br>Metabolic enzymes |
| Down-regulated transcripts (level at 1 hour < | "Delayed" repressor responders to | Maintenance of Auxin stimulated state(s) in certain | Transcription factors<br>Change in activity of cytoskeletal proteins |

| TRANSCRIPT LEVEL | TYPE OF GENES | PHYSIOLOGICAL CONSEQUENCES | EXAMPLES OF BIOCHEMICAL ACTIVITY OF GENE PRODUCTS |
| --- | --- | --- | --- |
| 6 hours) | Auxin Genes for pathways diminished in presence of Auxin | cells Reorientation of metabolism in certain cells | modulating cell structure Changes in chromatin structure and/or DNA topology Changes in protein structure and/or function by phosphorylation (kinases) and/or dephosphorylation (phosphatases) Stability of factors for protein translation Changes in cell membrane structure Changes in chromatin and/or localized DNA topology Changes in protein-protein interaction Metabolic enzymes |

Use of Promoters of NAA Responsive Genes

Promoters of NAA responsive genes are useful for transcription of any desired polynucleotide or plant or non-plant origin. Further, any desired sequence can be transcribed in a similar temporal, tissue, or environmentally specific patterns as the NAA responsive genes where the desired sequence is operably linked to a promoter of a NAA responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.C.3. Brassinosteroid Responsive Genes, Gene Components and Products:

Plant hormones are naturally occurring substances, effective in very small amounts, which act as signals to stimulate or inhibit growth or regulate developmental processes in plants. Brassinosteroids (BRs) are the most recently discovered, and least studied, class of plant hormones. The major physiological response affected by BRs is the longitudinal growth of young tissue via cell elongation and possibly cell division. Consequently, disruptions in BR metabolism, perception and activity frequently result in a dwarf phenotype. In addition, because BRs are derived from the sterol metabolic pathway, any perturbations to the sterol pathway can affect the BR pathway. In the same way, perturbations in the BR pathway can have effects on the later part of the sterol pathway and thus the sterol composition of membranes.

Changes in BR concentration in the surrounding environment or in contact with a plant result in modulation of many genes and gene products. Examples of such BR responsive genes and gene products are shown in the Reference and Sequence Tables. These genes and/or products are responsible for effects on traits such as plant biomass and seed yield. These genes were discovered and characterized from a much larger set of genes by experiments designed to find genes whose mRNA abundance changed in response to application of BRs to plants.

While BR responsive polynucleotides and gene products can act alone, combinations of these polynucleotides also affect growth and development. Useful combinations include different BR responsive polynucleotides and/or gene products that have similar transcription profiles or similar biological activities, and members of the same or functionally related biochemical pathways. Whole pathways or segments of pathways are controlled by transcription factors and proteins controlling the activity of signal transduction pathways. Therefore, manipulation of such protein levels is especially useful for altering phenotypes and biochemical activities of plants. In addition, the combination of a BR responsive polynucleotide and/or gene product with another environmentally responsive polynucleotide is useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in common or overlapping pathways. The MA_diff Table(s) reports the transcript levels of the experiment (see EXPT ID: 108580, 108581, 108557, 108478, 108479, 108480, 108481). For transcripts that had higher levels in the samples than the control, a "+" is shown. A "−" is shown for when transcript levels were reduced in root tips as compared to the control. For more experimental detail see the Example section below.

BR genes are those sequences that showed differential expression as compared to controls, namely those sequences identified in the MA_diff tables with a "+" or "−" indication.

BR Genes Identified by Cluster Analyses of Differential Expression

BR Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of BR genes is any group in the MA_clust that comprises a cDNA ID that also appears in Expt ID 108580, 108581, 108557, 108478, 108479, 108480, 108481 of the MA_diff table(s).

BR Genes Identified by Correlation to Genes that Cause Physiological Consequences Additionally, the differential expression data and the phenotypic observations can be merged to identify pathways or networks of BR genes. A group in the MA_clust is considered a BR pathway or network if the group comprises a cDNA ID that also appears in Knock-in or Knock-out tables that causes one or more of the phenotypes described in section above.

BR Genes Identified by Amino Acid Sequence Similarity

BR genes from other plant species typically encode polypeptides that share amino acid similarity to the sequences encoded by corn and *Arabidopsis* BR genes. Groups of BR genes are identified in the Protein Group table. In this table, any protein group that comprises a peptide ID that corresponds to a cDNA ID member of a BR pathway or network is a group of proteins that also exhibits BR functions/utilities.

Such BR responsive genes and gene products can function to either increase or dampen the above phenotypes or activities either in response to changes in BR concentration or in the absence of BR fluctuations. Further, promoters of BR responsive genes, as described in the Reference tables, for example, are useful to modulate transcription that is induced by BR or any of the following phenotypes or biological activities below.

III.C.3.a. Use of Brassinosteroid Responsive Genes to Modulate Phenotypes

Brassinosteroid responsive genes and gene products are useful to modulate one or more phenotypes including growth (promotes cell elongation, elongation accelerated at low temperatures for increased plant growth in marginal lands, acts in concert with other hormones to promote cell division); roots (inhibitory to root growth, and expression in roots would inhibit bud breaking due to higher auxin:cytokinin ratio in epicotyl); stems (inhibits radial growth while causing stem elongation, in low concentrations, promotes radial expansion, and increases biomass); height; seeds; promotes cell expansion in embryo and thus enhances germination; leaves; increase biomass; flowers, increase reproduction; biomass; fresh and dry weight during any time in plant life, such as maturation; number of flowers; number of seeds; number of branches; number of leaves; starch content; seed yield (including number, size, weight, harvest index, starch content; fruit yield, number, size, weight, harvest index, and starch content); development; morphogenesis; control of organ size and shape; development of new ornamentals; control of leaf size and shape; promotes leaf unrolling and enlargement; for development of new leafy ornamentals; seed development; inhibition of de-etiolation; dormancy; accelerated germination at low temperatures; root; gravitropism; senescence; promoted in light grown plants; inhibiting synthesis or perception could extend life span of desired tissues/organs; differentiation; vascularization; promotes xylem differentiation; increases xylem fiber length; resistance responses; increases resistance to pathogens; and tropic responses.

Gravitropic Responses Affecting Roots

Further, any desired sequence can be transcribed in similar temporal, tissue, or environmentally specific patterns as the BR responsive genes when the desired sequence is operably linked to a promoter of a BR responsive gene.

To improve any of the desired phenotype(s) above, activities of one or more of the BR response genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266, and/or screened for variants as in Winkler et al. (1998) Plant Physiol 118: 743-50, visually inspected for the desired phenotype and metabolically and/or functionally assayed according to Choe et al. (1999, Plant Cell 11:207-21 and Plant Physiol 119: 897-907), Yamamoto et al. (1997, Plant Cell Physiol 38:980-3), Asami and Yshida (1999, Trends in Plant Sciences, 4:348-353) and Azpiroz et al. (1998, Plant Cell 10:219-230)

III.C.3.b. Use of Brassinosteroid Responsive Genes to Modulate Biochemical Activities The activities of one or more of the BR responsive genes can be modulated to change biochemical or metabolic activities and/or pathways such as those noted below. Such biological activities are documented and can be measured according to the citations included in the Table below.

| PROCESS | BIOCHEMICAL OR METABOLIC ACTIVITIES AND/OR PATHWAYS | CITATIONS INCLUDING ASSAYS |
|---|---|---|
| BR Transport | BR Efflux Between Cells | B. Schulz and K. Feldmann, unpub. results |
|  | BR Influx In And Out Of A Cell | B. Schulz and K. Feldmann, unpub. results |
| Signal Transduction | Permeability Of Cell Membranes Protein Phosphorylation |  |
| Metabolism | Major Growth Coordinating Pathways |  |

Other biological activities that can be modulated by the BR responsive genes and gene products are listed in the Reference Tables. Assays for detecting such biological activities are described in the Domain section of the Reference Tables.

BR responsive genes are differentially transcribed in response to fluctuating BR levels or concentrations, whether internal or external to an organism or cell. The MA_diff table(s) report(s) the changes in transcript levels of various BR responsive genes in the aerial parts of a seedling at 1 and 6 hours after a plant was sprayed with a solution enriched with BR as compared to seedlings sprayed with water. The data from this time course can be used to identify a number of types of BR responsive genes and gene products, including "early responders," "delayed responders." Profiles of these different categories of BR responsive genes are shown in the Table below together with examples of the kinds of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up Regulated Transcripts | Early Responders To | BR Perception | Transcription Factors |

| TRANSCRIPT LEVELS | TYPE OF GENES | PHYSIOLOGICAL CONSEQUENCES | EXAMPLES OF BIOCHEMICAL ACTIVITY |
|---|---|---|---|
| (Level At 1 Hr ≈ 6 Hr) (Level At 1 Hr > 6 Hr) | BR | BR Transport | Receptors Transporters Change In Cell Membrane Structure |
| | | BR Biosynthesis Feedback | Feedback Regulated Biosynthetic Genes Kinases And Phosphatases |
| | | Modulation Of BR Response Transduction Pathways | $2^{nd}$ Messengers, Eg., Calmodulin |
| | | Specific Gene Transcription Initiation | Transcription Activators Change In Chromatin Structure And/Or Localized DNA Topology |
| Up Regulated Transcripts (Level At 1 Hr < 6 Hr) | Delayed Responders | Maintenance Of Response To Br | Transcription Factors BR Biosynthetic Genes Specific Factors (Initiation And Elongation) For Protein Synthesis Maintenance Of Mrna Stability Maintenance Of Protein Stability Maintenance Of Protein-Protein Interaction |
| | | Cell And Organ Elongation Gravitropism | Cell Wall Elongation |
| Down-Regulated Transcripts (Level At 1 Hr ≈ 6 Hr) (Level At 6 Hr > 1 Hr) | Early Responder Repressors Of BR State Of Metabolism Genes With Discontinued Expression Or UnsTable Mrna In Presence Of BR | Negative Regulation Of BR Pathways Released Changes In Pathways And Processes Operating In Cells | Transcription Factors Change In Protein Structure By Phosphorylation (Kinases) Or Dephosphoryaltion (Phosphatases) Change In Chromatin Structure And/Or DNA Topology |
| Down-Regulated Transcripts (Level At 1 Hr > 6 Hr) | Delayed Repressors Of BR State Of Metabolism Genes With Discontinued Expression Or UnsTable Mrna In Presence Of BR | Negative Regulation Of BR Pathways Released Maintenance Of Pathways Released From Repression Changes In Pathways And Processes Operating In Cells | Transcription Factors Kinases And Phosphatases Stability Of Factors For Protein Synthesis And Degradation |

Use of Promoters of Br Responsive Genes

Promoters of BR responsive genes are useful for transcription of any desired polynucleotide or plant or non-plant origin. Further, any desired sequence can be transcribed in a similar temporal, tissue, or environmentally specific patterns as the BR responsive genes where the desired sequence is operably linked to a promoter of a BR responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.C.4. Cytokinin Responsive Genes, Gene Components and Products

Plant hormones are naturally occurring substances, effective in very small amounts, which act as signals to stimulate or inhibit growth or regulate developmental processes in plants. Cytokinins (BA) are a group of hormones that are best known for their stimulatory effect on cell division, although they also participate in many other processes and pathways. All naturally occurring BAs are aminopurine derivatives, while nearly all synthetic compounds with BA activity are 6-substituted aminopurine derivatives. One of the most common synthetic BAs used in agriculture is benzylaminopurine (BAP).

Changes in BA concentration in the surrounding environment or in contact with a plant results in modulation of many genes and gene products. Examples of such BA responsive genes and gene products are shown in the Reference, Sequence, Protein Group, Protein Group Matrix tables, MA_diff and MA_clust. These genes and/or products are responsible for effects on traits such as plant vigor and seed yield. They were discovered and characterized from a much larger set by experiments designed to find genes whose mRNA products changed in response to application of BA to plants.

While cytokinin responsive polynucleotides and gene products can act alone, combinations of these polynucleotides also affect growth and development. Useful combinations include different BA responsive polynucleotides and/or gene products that have similar transcription profiles or similar biological activities, and members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of a BA responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in common or overlapping pathways. The MA_diff Table(s) reports the transcript levels of the experiment (see EXPT ID: 108566, 108567, 108517). For transcripts that had higher levels in the samples than the control, a "+" is shown. A "−" is shown for when transcript levels were reduced in root tips as compared to the control. For more experimental detail see the Example section below.

BA genes are those sequences that showed differential expression as compared to controls, namely those sequences identified in the MA_diff tables with a "+" or "−" indication.

BA Genes Identified by Cluster Analyses of Differential Expression

BA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of BA genes is any group in the MA_clust that comprises a cDNA ID that also appears in Expt ID 108566, 108567, 108517 of the MA_diff table(s).

BA Genes Identified by Correlation to Genes that Cause Physiological Consequences Additionally, the differential expression data and the phenotypic observations can be merged to identify pathways or networks of BA genes. A group in the MA_clust is considered a BA pathway or network if the group comprises a cDNA ID that also appears in Knock-in or Knock-out tables that causes one or more of the phenotypes described in section above.

BA Genes Identified by Amino Acid Sequence Similarity

BA genes from other plant species typically encode polypeptides that share amino acid similarity to the sequences encoded by corn and *Arabidopsis* BA genes. Groups of BA genes are identified in the Protein Group table. In this table, any protein group that comprises a peptide ID that corresponds to a cDNA ID member of a BA pathway or network is a group of proteins that also exhibits BA functions/utilities.

Such BA responsive genes and gene products can function to either increase or dampen the above phenotypes or activities either in response to changes in BA concentration or in the absence of BA fluctuations.

Further, promoters of BA responsive genes, as described in the Reference tables, for example, are useful to modulate transcription that is induced by BA or any of the following phenotypes or biological activities below.

III.C.4.a. Use of Ba-Responsive Genes to Modulate Phenotypes

BA responsive genes and gene products are useful to or modulate one or more phenotypes including growth, roots (such as inhibition of elongation of root); stems (such as inhibition of elongation of hypocotyl); lateral buds (such as promotion of outgrowth for rapid production of multiple shoots as a source for grafting); leaves such as development (including cell growth, such as expansion of cotyledon and promotes cell enlargement for increased yield from leaf crops, chloroplast development such as delayed degradation of chloroplasts for increased photosynthesis and crop yield, cell division and senescence such as delays for delayed conversion from photosynthesis to salvage programs in leaves and for increased crop yield); differentiation such as regulation of morphogenesis for manipulating callus growth and shoot/root formation in culture; maintenance of shoot meristem such as for increased usable wood production, and reduced tiller number for denser crop planting regimes; nutrient metabolism for effects on seed size and effects on rate of seed set for increased seed yield; induction of ethylene biosynthesis for control of fruit ripening; and parthenocarpy for control of sexual reproduction and production of seedless fruits.

To regulate any of the phenotype(s) above, activities of one or more of the BA responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or molecularly or metabolically or functionally assayed according to Lohman et al (1994, Physil. Plant 92:322-328), Woolhouse (1983, In Agricultural Research-Strategies of Plant reproduction, Meudt, ed., 201-236), Medford et al. (1989, Plant Cell 1: 403-13), Vogel et al. (1998, Genetics 149:417-27), Ehnes and Roitsch (1997, Plant J 1: 539-48), Rotino et al. (1997, Nat. Biotchnol. 15: 1398-1401).

III.C.4.b. Use of Ba-Responsive Genes to Modulate Biochemical Activities

The activities of one or more of the BA responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/ OR PATHWAYS | CITATIONS INCLUDING ASSAYS |
|---|---|---|
| Chloroplast Functioning | Photosynthesis | Benkova et al (1999) Plant Physil 121: 245-252 |
| Induction And Maintenance Of Cell Division | Cell Cycle Phase Transition | Riou-Khamlichi et al. (1999) Science 283: 1541-44 |
| Senescence | Cell Death/Apoptosis | Lohman et al. (1994) Physiol Plant 92: 322-328 |
| Signal Transduction | Sensing Endogenous Stimuli To Trigger Growth And Shoot Formation | Kakimoto (1996) Science 274: 982-985 |

Other biological activities that can be modulated by the BA responsive genes and gene products are listed in the Reference tables. Assays for detecting such biological activities are described in the Domain section above.

BA responsive genes are characteristically differentially transcribed in response to fluctuating BA levels or concentrations, whether internal or external to an organism or cell. The MA_diff table reports the changes in transcript levels of various BA responsive genes in the aerial parts of a seedling at 1 and 6 hours after a plant was sprayed with a Hoagland's solution enriched with BA as compared to seedlings sprayed with Hoagland's solution only.

The data from this time course can be used to identify a number of types of BA responsive genes and gene products, including "early responders," and "delayed responders." Profiles of these different BA responsive genes are shown in the Table below together with examples of the kinds of associated biological activities.

| GENE EXPRESSION LEVELS | FUNCTIONAL CATEGORY OF GENES | TYPE OF BIOLOGICAL ACTIVITY | EXAMPLES OF BIOCHEMICAL ACTIVITY |
|---|---|---|---|
| Up Regulated Transcripts (Level At 1 h ≅ 6 h) Or (Higher At 1 h Than 6 h) | Early Responders To BA | BA Perception BA Uptake Modulation Of BA Response Transduction Pathways | Transcription Factors Transporters Kinase, Receptor-Like Protein Kinase |
| | | Specific Gene Transcription Initiation | Ovule-Specific Homeotic Protein, Secretory Pathway |
| | | Initiate And Coordinate Cell Division | Cell Division Control Protein, Cyclins, Cyclin-Dependent Protein Kinase (Cdpk), Cell Cycle Phosphatases, Mitosis-Specific Chromosome Segregation Protein, Mitotic Phosphoprotein, Dna Replication Proteins, Helicase Telomerase, Centromere Protein, tRNA Synthase |
| | | Regulation Of Pathways To Senescence | Senescence-Associated Protein, Bifunctional Nuclease, Aba Pathway Genes, Ethylene Pathway Genes, Proteases, Nucleases, Pcd Genes |
| | | Modulation Of Chloroplast Gene Expression And Photosysthesis | Calvin Cycle, Chlorophyll A/B Binding Protein (Cab), Transketolase, Lipoxygenase, Chloroplast Rna Processing Protein, Chloroplast Envelope Membrane Protein. |
| | | Modulation Of Photorespiration And Primary Nitrogen Assimilation In Leaves Expression | Glutamate Synthase, Gogat, Asparagine Synthase, Catalase, Peroxidase |
| | | Stress Response | Heat Shock Proteins, Gst |
| | | Wax Biosynthesis | Fatty Acid Elongase-Like Protein, Very-Long-Chain Fatty Acid Condensing Enzyme, Coa Synthase |

| GENE EXPRESSION LEVELS | FUNCTIONAL CATEGORY OF GENES | TYPE OF BIOLOGICAL ACTIVITY | EXAMPLES OF BIOCHEMICAL ACTIVITY |
|---|---|---|---|
| | | Nutrient Metabolism Embryogenesis | Vicilin Storage Protein Homeobox Domain Proteins |
| | | Glycolysis, Gluconeogenesis | Mutase, Phosphoglycerate Mutase |
| | | Ripening | Pectate Lyase, Ethylene Pathway Genes |
| Upregulated Transcripts (Higher At 6 h Than 1 h) | BA Late Responders | BA Responsive Pathways | Transfactors, Kinases, Phosphatases, LRR's, Dna Remodelling Proteins, Cu-Binding Proteins |
| | | Cell Wall Extension | Expansins, Extensins, Proline Rich Proteins |
| | | Organogenesis | AP2 Domain Containing Proteins |
| | | Modulate Activation Of Disease Defense Genes | Transfactors Interacting With Resistant Genes |
| | | Modulate Responses To External Stimuli | Glycin-Rich Proteins, Wall-Associated Receptor Kinase (Wak) |
| | | Osmotic Stress Tolerance | Proline Oxidase |
| Down-Regulated Transcripts (Low At Both 1 h and 6 h) | Repressors Of BA Pathway | Regulation Of Senescence-Related Gene Expression | Transfactors (Such As Zinc-Finger Type), Kinases, Phosphatases, G-Proteins, LRR Proteins, DNA Remodeling Protein Carbonyl Reductases |
| | | Regulation Of Genes Involved In Maintenance Of Apical Dominance. | Atpases Oxygenase Octaprenyltransferase Auxin Pathway Genes Auxin Binding Proteins |

Further, any desired sequence can be transcribed in similar temporal, tissue, or environmentally specific patterns as the BA responsive genes when the desired sequence is operably linked to a promoter of a BA responsive gene.

III.C.5. Gibberellic Acid Responsive Genes, Gene Components and Products

Plant hormones are naturally occurring substances, effective in very small amounts, which act as signals to stimulate or inhibit growth or regulate developmental processes in plants. Gibberellic acid (GA) is a hormone in vascular plants that is synthesized in proplastids (giving rise to chloroplasts or leucoplasts) and vascular tissues. The major physiological responses affected by GA are seed germination, stem elongation, flower induction, anther development and seed and pericarp growth. GA is similar to Auxins, cytokinins and gibberellins, in that they are principally growth promoters.

Changes in GA concentration in the surrounding environment or in contact with a plant result in modulation of many genes and gene products. Examples of such GA responsive genes and gene products are shown in the Reference and Sequence Tables. These genes and/or products are responsible for effects on traits such as plant vigor and biomass and seed yield. They were discovered and characterized from a much larger set of genes by experiments designed to find genes whose mRNA products changed in concentration in response to application of nitrogen to plants.

While GA responsive polynucleotides and gene products can act alone, combinations of these polynucleotides also affect growth and development. Useful combinations include different GA responsive polynucleotides and/or gene products that have similar transcription profiles or similar biological activities, and members of the same or similar biochemical pathways. Whole pathways and/or segments of pathways are controlled by transcription factors and proteins that affect the activity of signal transduction pathways. Therefore, manipulation of such protein levels is especially useful for altering phenotypes and biochemical activities of plants. In addition, the combination of a GA responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in common overlapping pathways. The MA_diff Table(s) reports the transcript levels of the experiment (see EXPT ID: 108562, 108563, 108519, 108520, 108521, 108484, 108485, 108486). For transcripts that had higher levels in the samples than the control, a "+" is shown. A "−" is shown for when transcript levels were reduced in root tips as compared to the control. For more experimental detail see the Example section below.

GA genes are those sequences that showed differential expression as compared to controls, namely those sequences identified in the MA_diff tables with a "+" or "−" indication.

GA Genes Identified by Cluster Analyses of Differential Expression

GA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of GA genes is any group in the MA_clust that comprises a cDNA ID that also appears in Expt ID 108562, 108563, 108519, 108520, 108521, 108484, 108485, 108486 of the MA_diff table(s).

GA Genes Identified by Correlation to Genes that Cause Physiological Consequences Additionally, the differential expression data and the phenotypic observations can be merged to identify pathways or networks of GA genes. A group in the MA_clust is considered a GA pathway or network if the group comprises a cDNA ID that also appears in Knock-in or Knock-out tables that causes one or more of the phenotypes described in section above.

GA Genes Identified by Amino Acid Sequence Similarity

GA genes from other plant species typically encode polypeptides that share amino acid similarity to the sequences encoded by corn and *Arabidopsis* GA genes. Groups of GA genes are identified in the Protein Group table. In this table, any protein group that comprises a peptide ID that corresponds to a cDNA ID member of a GA pathway or network is a group of proteins that also exhibits GA functions/utilities.

Such GA responsive genes and gene products can function to either increase or dampen the above phenotypes or activities either in response to changes in GA concentration or in the absence of GA fluctuations. Further, promoters of GA responsive genes, as described in the Reference tables, for example, are useful to modulate transcription that is induced by GA or any of the following phenotypes or biological activities below.

III.C.5.a. Use of GA Responsive Genes to Modulate Phenotypes:

GA responsive genes and gene products are useful to or modulate one or more phenotypes including growth, promotes root growth, promotes cell division, promotes stem elongation, secondary (woody) growth, promotes growth in leaves, biomass, increase in stem and leaf mass, increase in xylem fiber length and biomass production, development, cell growth, fruit development, seed development, dormancy, breaks dormancy in seeds and buds, promotes trichome formation, decrease senescence, regulation of fertility, stress responses, and flowering time.

Further, any desired sequence can be transcribed in similar temporal, tissue, or environmentally specific patterns as the GA responsive genes when the desired sequence is operably linked to a promoter of a GA responsive gene.

To regulate any of the phenotype(s) above, activities of one or more of the GA response genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Hedden and Proebsting (1999, Plant Physiol. 119:365-370), Hedden and Phillips (1999, Current Opinion in Plant Biotech. 11:130-137), Perazza et al (1998, Plant Physiol. 117:375-383), Kende and Zeevart (1997, Plant Cell 9:1197-1210) and van der Knaap et al. (2000, Plant Physiol. 122:695-704).

III.C.5.b. Use of GA-Responsive Genes to Modulate Biochemical Activities:

The activities of one or more of the GA responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Cell Growth and Differentiation | Biosynthesis of Gas Cell wall loosening and cell expansion GA deactivation Major growth promoting metabolic pathways | Hedden and Proebsting (1999, Plant Physiol. 119: 365-370) Cosgrove (1993, New Phytol. 124: 1-23) Hedden and Proebsting (1999, Plant Physiol. 119: 365-370) |
| Perception and Signal Transduction | Receptors | Koornneef and van der Veen (1980, TAG 58: 257-263) |
| | Synthesis of transcriptional regulators Calcium and Calmodulin | Bethke and Jones (1998, Curr. Opin. Plant Biol. 1: 440-446) |

Other biological activities that can be modulated by the GA responsive genes and gene products are listed in the Reference Tables. Assays for detecting such biological activities are described in the Protein Domain table.

GA responsive genes are characteristically differentially transcribed in response to fluctuating GA levels or concentrations, whether internal or external to an organism or cell. The MA_diff table(s) report(s) the changes in transcript levels of various GA responsive genes in entire seedlings at 1 and 6 hours after a plant was sprayed with a Hoagland's solution enriched with GA as compared to seedlings sprayed with Hoagland's solution only.

The data from this time course can be used to identify a number of types of GA responsive genes and gene products, including "early responders," and "delayed responders." Profiles of some GA responsive genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
| --- | --- | --- | --- |
| Up regulated transcripts | Early responders to GA | GA perception GA transport | Transcription factors Transporters |

-continued

| TRANSCRIPT LEVELS | TYPE OF GENES | PHYSIOLOGICAL CONSEQUENCES | EXAMPLES OF BIOCHEMICAL ACTIVITY |
|---|---|---|---|
| (level at 1 hr ≈ 6 hr) (level at 1 hr > 6 hr) | Genes induced by GA | Modulation of GA response transduction pathways Specific gene transcription initiation Growth stimulating pathway induction | Change in cell membrane structure Kinases and phosphatases Transcription activators Change in chromatin structure and/or localized DNA topology Cell wall proteins Metabolic Enzymes |
| Up regulated transcripts (level at 1 hr < 6 hr) | Maintenance of GA response "Delayed" responders | Maintenance of response to GA Induction of GA metabolic pathways | Transcription factors Specific factors (initiation and elongation) for protein synthesis Maintenance of mRNA stability Metabolic enzymes |
| Down-regulated transcripts (level at 1 hr ≈ 6 hr) (level at 6 hr > 1 hr) | Early repressor responders to GA Genes repressed by GA Genes whose activities are diminished or mRNAs are unsTable in the presence of GA | Negative regulation of GA pathways released Reduced activity of repressed pathways | Transcription factors Calmodulin Change in protein structure by phosphorylation (kinases) or dephosphoryaltion (phosphatases) Change in chromatin structure and/or DNA topology |
| Down-regulated transcripts (level at 1 hr > 6 hr) | Delayed responders Genes repressed by GA Genes whose activities are diminished or mRNAs are unsTable in the presence of GA | Maintenance or GA repressed pathways | Transcription factors Kinases and phosphatases Stability factors for protein translation Metabolic enzymes |

Use of Promoters of Ga Responsive Genes

Promoters of GA responsive genes are useful for transcription of any desired polynucleotide or plant or non-plant origin. Further, any desired sequence can be transcribed in a similar temporal, tissue, or environmentally specific patterns as the GA responsive genes where the desired sequence is operably linked to a promoter of a GA responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D. Metabolism Affecting Genes, Gene Components and Products

III.D.1. Nitrogen Responsive Genes, Gene Components and Products

Nitrogen is often the rate-limiting element in plant growth, and all field crops have a fundamental dependence on exogenous nitrogen sources. Nitrogenous fertilizer which is usually supplied as ammonium nitrate, potassium nitrate, or urea, typically accounts for 40% of the costs associated with crops, such as corn and wheat in intensive agriculture. Increased efficiency of nitrogen use by plants should enable the production of higher yields with existing fertilizer inputs and/or enable existing yields of crops to be obtained with lower fertilizer input, or better yields on soils of poorer quality. Also, higher amounts of proteins in the crops could also be produced more cost-effectively.

Changes in nitrogen concentration in the surrounding environment or in contact with a plant results in modulation of the activities of many genes and hence levels of gene products. Examples of such "nitrogen responsive" genes and gene products with these properties are shown in the Reference, Sequence, Protein Group, Protein Group Matrix tables, MA_diff, MA_clust, Knock-in and Knock-out tables. These genes and/or products are responsible for effects on traits such as plant vigor and seed yield. They were discovered and characterized from a much larger set by experiments designed to find genes whose mRNA products changed in response to changing levels of available nitrogen to plants.

Manipulation of one or more "nitrogen responsive" gene activities is useful to modulate the biological activities and/or phenotypes listed below. "Nitrogen responsive" genes and gene products can act alone or in combination. Useful combinations include nitrogen responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of the levels of such proteins is especially useful for altering phenotypes and biochemical activities of plants. The MA_diff Table(s) reports the transcript levels of the experiment (see EXPT ID: 108592, 108593, 108588, 108589, 108590, 108591, 108532, 108548, 108549, 108550, 108551, 108454, 108455, 108487, 108488, 108489, and Nitrogen (relating to SMD 3787, SMD 3789)). For transcripts that had higher levels in the samples than the control, a "+" is shown. A "−" is shown for when transcript levels were reduced in root tips as compared to the control. For more experimental detail see the Example section below.

Nitrogen genes are those sequences that showed differential expression as compared to controls, namely those sequences identified in the MA_diff tables with a "+" or "−" indication.

Nitrogen Genes Identified by Cluster Analyses of Differential Expression

Nitrogen Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Nitrogen genes is any group in the MA_clust that comprises a cDNA ID that also appears in Expt ID 108592, 108593, 108588, 108589, 108590, 108591, 108532, 108548, 108549, 108550, 108551, 108454, 108455, 108487, 108488, 108489, and Nitrogen (relating to SMD 3787, SMD 3789) of the MA_diff table(s).

Nitrogen Genes Identified by Correlation to Genes that Cause Physiological Consequences Additionally, the differential expression data and the phenotypic observations can be merged to identify pathways or networks of Nitrogen genes. A group in the MA_clust is considered a Nitrogen pathway or network if the group comprises a cDNA ID that also appears in Knock-in or Knock-out tables that causes one or more of the phenotypes described in section above.

Nitrogen Genes Identified by Amino Acid Sequence Similarity

Nitrogen genes from other plant species typically encode polypeptides that share amino acid similarity to the sequences encoded by corn and *Arabidopsis* Nitrogen genes. Groups of Nitrogen genes are identified in the Protein Group table. In this table, any protein group that comprises a peptide ID that corresponds to a cDNA ID member of a Nitrogen pathway or network is a group of proteins that also exhibits Nitrogen functions/utilities.

Such "nitrogen responsive" genes and gene products can function either to either increase or dampen the phenotypes and activities below, either in response to changes in nitrogen concentration or in the absence of nitrogen fluctuations.

Further, promoters of nitrogen responsive genes, as described in the Reference tables, for example, are useful to modulate transcription that is induced by nitrogen or any of the following phenotypes or biological activities below.

III.D.5.a. Use of Nitrogen-Responsive Genes to Modulate Phenotypes

"Nitrogen responsive" genes and gene products can be used to alter or modulate one or more phenotypes including plant development, initiation of the reproduction cycle from a vegetative state (such as flower development time and time to fruit maturity); root development and initiation (such as root branching, lateral root, initiation and/or development, nodule formation and nitrogen assimilation from any nitrogen-fixing symbions), growth rate, whole plant (including height, flowering time, etc.), organs (such as flowers, fruits, stems, leaves, roots, and lateral roots), biomass (such as fresh and dry weight during any time in plant life, such as maturation); number, size, and weight of flowers; seeds; branches, and leaves); total plant nitrogen content, amino acid/protein content of whole plant or parts, seed yield (such as number, size, weight, harvest index and content and composition, e.g., amino acid, nitrogen, oil, protein, and carbohydrate) and fruit yield (such as number, size, weight, harvest index, content and composition, e.g., amino acid, nitrogen, oil, protein, carbohydrate, and water.

To regulate any of the phenotype(s) above, activities of one or more of the nitrogen responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance to Zhang (1999) Proc. Natl. Acad. Sci. 96(11): 6529-34; or Zhang and Forde (1998) Science 279(5349):407-9; Scheible, W., Lauerer, M., Schultze, E.-D., Caboche, M., and Sitt, M. (1997). Plant J. 11, 671-691; Chevalier C, Bourgeois E, Just D, Raymond P. Plant J. 1996 January; 9(1):1-11.

III.D.5.b. Use of Nitrogen-Responsive Genes to Modulate Biochemical Activities

The activities of one or more of the nitrogen responsive genes can be modulated to change biochemical or metabolic activities and/or pathways such as those noted below. Such biological activities are documented and can be measured according to the citations included in the Table below:

| Process | Biochemical Or Metabolic Activities And/Or Pathways | Citations including assays |
|---|---|---|
| Nitrate And Ammonium Uptake and Assimilation | $NO_3^-$ Influx And Efflux | Lejay et al. (1999) Plant J. 18(5): 509-519 |
| | Nitrate Channels | Liu et al. (1999) Plant Cell 11: 865-874; and Wang et al.(1998) Proc. Natl. Acad. Sci. USA 95: 15134-15139 |
| | Changes In Membrane-Potential | Meharg et al. (1995) J. Membr. Biol. 145: 49-66; and Wang et al. (1998), supra |
| Amino Acid Synthesis | Glutamine Synthesis And Then Biosynthesis Of Other Amino Acids | Coruzzi et al. U.S. Pat. No. 5,955,651; and Oliveira et al. (1999) Plant. Phys. 121: 301-309 |
| | Asparagine Synthesis And Then Biosynthesis Of Other Amino Acids | LAM ET AL. (1998) PLANT J. 16(3): 345-353 |

| Process | Biochemical Or Metabolic Activities And/Or Pathways | Citations including assays |
|---|---|---|
| Coordination Of Carbon And Nitrogen Metabolism | Light-Regulation Of Major Central Carbon And Nitrogen Metabolic Pathways To Coordinate Growth | Lam et al. (1998), supra; Lejay et al. (1999), supra; and Oliveira et al. (1999), supra |
| | Carbohydrate And Nitrogen Control Of Carbohydrate And Organic Nitrogen Accumulation Pathways | Lam et al. (1998) supra; Lejay et al. (1999) supra; and Oliveira et al. (1999) supra |
| Nitrogen Loading And Unloading | Nitrogen Transport From Source To Sinks | Walker et al. (1999) 210(1): 9-18 Elsheikh et al. (1997) 51(2): 137-44. |
| Nitrogen Storage | Accumulation Of Amino Acids And/Or Storage Proteins In Vacuoles | Johnson et al. (1990) Plant Cell 2(6): 525-32. Herman and Larkins (1999) Plant Cell. 11(4): 601-14. |
| Ammonium Detoxification | Plastid Ammonium Storage/Glutamine Synthesis | Crawford (1995) Plant Cell 7(7): 859-68. Zhang and Forde (1998) Science 279: 407-409. |
| Cell Growth | DIVISION AND/OR ELONGATION | Zhang and Forde (1998) Science 279: 407-409. Coruzzi et al. U.S. Pat. No. 5,955,651 |

Other biological activities that can be modulated by the nitrogen responsive genes and their products are listed in the Reference tables. Assays for detecting such biological activities are described in the Domain section above.

Nitrogen responsive genes are characteristically differentially transcribed in response to fluctuating nitrogen levels or concentrations, whether internal or external to an organism or cell. The MA_diff table reports the changes in transcript levels of various nitrogen responsive genes in the aerial parts of a seedling at 2, 6, 9 and 12 hours after a plant was sprayed with a solution enriched with ammonium nitrate as compared to seedlings sprayed with water. The MA_diff reports the changes in transcript levels of various nitrogen responsive genes in roots at 12 and 24 hours that were cut from seedlings transferred from a high to low potassium nitrate environment compared to control seedlings transferred to a high potassium nitrate environment.

The data from this time course reveal a number of types of nitrogen responsive genes and gene products, including "early responders," and "delayed nitrogen responders". Profiles of the individual categories of nitrogen responsive genes are shown in the Tables below together with examples of the kinds of associated biological activities that are modulated when the activities of one or more such genes vary in plants.

Low to High Ammonium Nitrate Experiment

| Gene Expression Levels | Functional Category Of Gene | Physiological Consequences | Examples Of Gene Products |
|---|---|---|---|
| Upregulated Transcripts (Level At 2 h ≅ 6, 9 Or 12 h) Or (Level At 2 h > 6, 9 Or 12 h) | Early Responders To Nitrogen | Perception Of Nitrogen Induced Nitrogen Uptake Into Cells Induction Of Nitrogen Response Transduction Pathways Initiation Of Specific Gene Transcription | Transcription Factors Transporters Inhibitors Of Nitrogen Fixation Components Of Pathways Released From Repression Transaminases Amino Acid Biosynthetic Enzymes |
| Upregulated Transcripts (Level At 2 h < 6, 9, Or 12 h | Delayed Nitrogen Responders | Maintenance Of High Nitrogen Metabolism And Growth | Nitrogen Metabolic Pathway Enzymes Transaminases Amino Acid Biosynthetic Enzymes Factors Induced In Coordination And Control Of Central Carbon And Nitrogen Metabolism Cell Wall And Cell Growth-Promoting Pathway Enzymes Storage Proteins |
| Down Regulated Transcripts (Level At 2 h ≅ 6, 9 Or 12 h) Or | Early Responder Repressors Of Nitrogen | Negative Regulation Of Nitrogen Utilization Pathways Released | Transcription Factors Kinases And Phosphatases Cytoskeletal Proteins Modulating Cell Structure |

| Gene Expression Levels | Functional Category Of Gene | Physiological Consequences | Examples Of Gene Products |
|---|---|---|---|
| (Level At 6, 9 Or 12 h > 2 h) | Utilization Pathways Genes With Discontinued Expression Or UnsTable Mrna Following Nitrogen Uptake | Pathways Of C And N Metabolism Required At Lower Levels Decline In Presence Of High Nitrogen | Chromatin Structure Regulatory Proteins Metabolic Enzymes Transporters Proteins And Rna Turnover Systems |
| Level At 2 Hours > 6, 9 Or 12 Hours | Delayed Response Repressors Of Nitrogen Utilization Pathways Genes With Discontinued Expression Or UnsTable Mrna Following Nitrogen Uptake | Negative Regulation Of Nitrogen Utilization Pathways Released Pathways Of C And N Metabolism Required At Lower Levels Decline In Presence Of High Nitrogen | Transcription Factors Kinases And Phosphatases Cytoskeletal Proteins Modulating Cell Structure Chromatin Structure Regulatory Proteins Metabolic Enzymes Transporters Protein And Rna Turnover Systems |

25

High to Low Potassium Nitrate Experiments

| Gene Expression Levels | Functional Category Of Gene | Type Of Biological Activity | Examples Of Biochemical Activities Of Gene Products |
|---|---|---|---|
| Upregulated Transcripts (Level At 12 h~ 24 h) (Level At 12 h > 24 h) | Early Responders To Low Nitrate | Perception Of Low Nitrate Nitrogen Uptake Into Cells Low Nitrogen Signal Transduction Response Pathways Initiation Of Specific Gene Transcription Initiation Of Nitrogen Fixation | Transcription Factors - Controlling Transcription Transporters - Facilitating Transport Cell Wall/Membrane Structure Determining Proteins Kinases And Phosphatases- Regulating Signal Transduction Pathways Cytoskeletal Proteins-Modulating Cell Structure Chromatin Structure And/Or Dna Topology Proteins Protein-Protein Interaction Participants Metabolic Enzymes- Nitrogen Turnover Enzymes And Pathway Components |
| Upregulated Transcripts (Level 12 h < 24 h) | Delayed Low Nitrate Responders | Maintenance Of Low Nitrogen Response Pathways (See the Table Above) | Transcription Factors - Controlling Transcription Transporters - Facilitating Transport Cell Wall/Membrane Structure Determining Proteins Kinases And Phosphatases- Regulating Signal Transduction Pathways Cytoskeletal Proteins-Modulating Cell Structure Chromatin Structure And/Or Dna Topology Proteins Protein-Protein Interaction Participants |

| Gene Expression Levels | Functional Category Of Gene | Type Of Biological Activity | Examples Of Biochemical Activities Of Gene Products |
|---|---|---|---|
| Down-Regulated Transcripts (Level At 12 h~24 h) (Level At 12 h > 24 h) | Early Repressor Responders To Low Nitrate Genes Whose Expression Is Discontinued Or Mrna Is UnsTable In Presence Of Low Nitrate | Negative Regulation Of Low Nitrogen-Mediated Pathways And/Or Responses Released Pathways In C And N Metabolism Required At Lower Levels Decline In The Presence Of Low Nitrate | Metabolic Enzymes-Nitrogen Turnover Enzymes And Pathway Components Transcription Factors Cell Wall/Membrane Structure Determining Proteins Factors For Promoting Protein Translation Kinases And Phosphatases Cytoskeletal Proteins-Modulating Cell Structure Protein And Rna Turnover Systems |
| Down-Regulated Transcripts (Level At 12 h < 24 h) | Delayed Repressor Responders To Low Nitrate Genes Whose Expression Is Discontinued Or mRNA Is UnsTable In Presence Of Low Nitrate | Negative Regulation Of Low Nitrogen-Mediated Pathways And/Or Responses Released Pathways In C And N Metabolism Required At Lower Levels Decline In The Presence Of Low Nitrate | Transcription Factors Cell Wall/Membrane Structure Determining Proteins Factors For Promoting Protein Translation Kinases And Phosphatases Cytoskeletal Proteins-Modulating Cell Structure Protein And Rna Turnover Systems Chromatin Structure And/Or Dna Topology Proteins |

Further, any desired sequence can be transcribed in similar temporal, tissue, or environmentally specific patterns as the nitrogen responsive genes when the desired sequence is operably linked to a promoter of a nitrogen responsive gene.

III.D.2. Circadian Rhythm (Clock) Responsive Genes, Gene Components and Products Often growth and yield are limited by the ability of a plant to tolerate stress conditions, including water loss. To combat such conditions, plant cells deploy a battery of responses that are controlled by an internal circadian clock, including the timed movement of cotyledons and leaves, timed movements in guard cells in stomata, and timed biochemical activities involved with sugar and nitrogen metabolism. These responses depend on the functioning of an internal circadian clock, that becomes entrained to the ambient light/dark cycle, and a series of downstream signaling events leading to transcription independent and transcription dependent stress responses.

A functioning circadian clock can anticipate dark/light transitions and prepare the physiology and biochemistry of a plant accordingly. For example, expression of a chlorophyll a/b binding protein (CAB) is elevated before daybreak, so that photosynthesis can operate maximally as soon as there is light to drive it. Similar considerations apply to light/dark transitions and to many areas of plant physiology such as sugar metabolism, nitrogen metabolism, water uptake and water loss, flowering and flower opening, epinasty, germination, perception of season, and senescence.

Manipulation of one or more clock gene activities is useful to modulate the biological processes and/or phenotypes listed below. Clock responsive genes and gene products can act alone or in combination. Useful combinations include clock responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. The MA_diff Table (s) reports the transcript levels of the experiment (see EXPT ID: Circadian (relating to SMD 2344, SMD 2359, SMD 2361, SMD 2362, SMD 2363, SMD 2364, SMD 2365, SMD 2366, SMD 2367, SMD 2368, SMD 3242)). For transcripts that had higher levels in the samples than the control, a "+" is shown. A "−" is shown for when transcript levels were reduced in root tips as compared to the control. For more experimental detail see the Example section below.

Circadian genes are those sequences that showed differential expression as compared to controls, namely those sequences identified in the MA_diff tables with a "+" or "−" indication.

Circadian Genes Identified by Cluster Analyses of Differential Expression

Circadian Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Circadian genes is any group in the MA_clust that comprises a cDNA ID that also appears in Expt ID Circadian (relating to SMD 2344, SMD 2359, SMD 2361, SMD 2362, SMD 2363, SMD 2364, SMD 2365, SMD 2366, SMD 2367, SMD 2368, SMD 3242) of the MA_diff table(s).

Circadian Genes Identified by Correlation to Genes that Cause Physiological Consequences Additionally, the differential expression data and the phenotypic observations can be merged to identify pathways or networks of Circadian genes. A group in the MA_clust is considered a Circadian pathway or network if the group comprises a cDNA ID that also appears in Knock-in or Knock-out tables that causes one or more of the phenotypes described in section above.

Circadian Genes Identified by Amino Acid Sequence Similarity

Circadian genes from other plant species typically encode polypeptides that share amino acid similarity to the sequences encoded by corn and *Arabidopsis* Circadian genes. Groups of Circadian genes are identified in the Protein Group table. In this table, any protein group that comprises a peptide ID that corresponds to a cDNA ID member of a Circadian pathway or network is a group of proteins that also exhibits Circadian functions/utilities.

Such clock responsive genes and gene products can function to either increase or dampen the above phenotypes or activities either in response to changes in daylength or in response to changes in light quality. Further, promoters of cirdadian (clock) responsive genes, as described in the Reference tables, for example, are useful to modulate transcription that is induced by circadian or any of the following phenotypes or biological activities below. Further, any desired sequence can be transcribed in similar temporal, tissue, or environmentally specific patterns as the circadian (clock) responsive genes when the desired sequence is operably linked to a promoter of a circadian (clock) responsive gene.

The expression of many genes is modulated by the clock. Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing some 10,000 non-redundant ESTs, selected from about 37,000 randomly sequenced ESTs generated from mRNA of different tissues and developmental stages.

The sequences of the ESTs showing at least two-fold increases or decreases in response to the circadian rhythm clock at various times through the 24 hour cycle relative to the controls were identified, compared to the Ceres full length cDNA and genomic sequence databanks, and equivalent Ceres clones identified. The MA_diff table reports the results of this analysis, indicating those Ceres clones which are up or down regulated over controls, thereby indicating the Ceres clones which represent clock responsive genes.

III.D.2.a. Use of Circadian Rhythm (Clock) Responsive Genes to Modulate Phenotypes Clock responsive genes and gene products are useful to or modulate one or more phenotypes including timing phenotypes, dormancy, germination, cotyledon opening, first leaves, juvenile to adult transition, bolting, flowering, pollination, fertilization, seed development, seed set, fruit drop, senescence, epinasty, biomass, fresh and dry weight during any time in plant life, such as maturation, number of flowers, seeds, branches, and/or leaves, seed yield, including number, size, weight, and/or harvest index, fruit yield, including number, size, weight, and/or harvest index, plant development, time to fruit maturity, cell wall strengthening and reinforcement, stress tolerance, drought tolerance, flooding tolerance, and uv tolerance To regulate any of the phenotype(s) above, activities of one or more of the clock responsive genes or gene products can be modulated and the plants can be tested by screening for the desired trait. Specifically, the gene, mRNA levels, or protein levels can be altered in a plant utilizing the procedures described herein and the phenotypes can be screened for variants as in Anderson et al. (1997) Plant Cell 9: 1727-1743; Heintzen et al. (1997) Proc. Natl. Acad. Sci. USA 94: 8515-20; Schaffer et al. (1998) Cell 93:1219-1229; Somers et al. (1998) Development 125: 485-494; Somers et al. (1998) Science 282: 1488-1490; Wang and Tobin (1998) Cell 93: 1207-1217; Zhong et al. (1998) Plant Cell 10: 2005-2017; Sugano et al. (1998) Proc. Natl. Acad. Sci. USA 95: 11020-11025; Dowson-Day and Millar (1999) Plant J 17: 63-71; Green and Tobin (1999) Proc. Natl. Acad. Sci. USA 96: 4176-419; Staiger and Apel (1999) Mol. Gen. Genet. 261: 811-819; Strayer and Kay (1999) Curr. Opin. Plant Biol. 2:114-120; Strayer et. al. (2000) Science 289:768-771; Kreps et al. (2000) J Biol Rhythms (2000) 15:208-217; Nelson et al. (2000) Cell 101:331-340; Somers et al. (2000) Cell 101:319-329.

III.D.2.b. Use of Active Clock Responsive Genes to Modulate Biochemical Activities The activities of one or more of the clock responsive genes can be modulated to change biochemical or metabolic activities and/or pathways such as those noted below. Such biological activities are documented and can be measured according to the citations above and included in the Table below:

| PROCESS | BIOCHEMICAL OR METABOLIC ACTIVITIES AND/OR PATHWAYS | CITATIONS INCLUDING ASSAYS |
|---|---|---|
| Germination and seedling development | Cold, light and water modulated signal transduction pathways, receptors, kinases, PAS domain | Bognar et al. (1999) Proc. Natl. Acad. Sci. USA 96: 14652-14657; Sugano et al (1999) Proc. Natl. Acad. Sci. USA 96: 12362-12366; Dowson-Day and Millar (1999) Plant J 17: 63-71; Somers et al. (2000) Cell 101: 319-329; Zhong et al. (1998) Plant Cell 10: 2005-2017 |

| | BIOCHEMICAL OR METABOLIC ACTIVITIES AND/OR PATHWAYS | CITATIONS INCLUDING ASSAYS |
|---|---|---|
| Growth transitions and flowering | Cold and light modulated signal transduction pathways, receptors, kinases, PAS domain | Nelson et al. (2000) Cell 101: 331-340; Fowler et al. (1999) EMBO J. 18: 4679-4688 |
| Tuber formation | Cold and light modulated signal transduction pathways | Yanovsky et al. (2000) Plant J. 23: 223-232 |
| METABOLISM | | |
| Lipid metabolism | Membrane lipid synthesis including omega-3 fatty acid desaturase, lipases, lipid transfer proteins | Bradley and Reddy (1997) J. Bacteriol. 179: 4407-4410; Martin, M et al. 1999 Europe J. Biochem 262: 283-290 |
| Sugar metabolism | Glycosylhydrolases, glycosyltransferases, amylases, sucrose synthase, CAB, Rubisco, light signal transduction | Liu et al. (1996) Plant Physiol. 112: 43-51; Millar and Kay (1996) Proc Natl Acad Sci USA 93: 15491-15496; Wang et al. (1997) Plant Cell 9: 491-507; Shinohara et al (1999) J. Biol. Chem. 273: 446-452 |
| Nitrogen metabolism | Aminotransferases, arginase, proteases and vegetative storage proteins, aromatic amino acid synthesis | Bradley and Reddy (1997) J. Bacteriol. 179: 4407-4410 |
| Photorespiration | Mitochondrial, chloroplast and peroxisomal photorespiratory enzymes, serine hydroxymethyl transferases, catalase | Zhong and McClung (1996) Mol. Gen. Genet. 251: 196-203; McClung (1997) Free. Radic. Biol. Med. 23: 489-496; McClung et al. (2000) Plant Physiol. 123: 381-392 |
| Responses to Environmental Stress | Expression of genes involved in responses to drought, salt, UV | McClung (1997) Free Radic Biol Med 23: 489-496; Shi et al. (2000) Proc. Natl. Acad. Sci. USA 97: 6896-6901 |

Other biological activities that can be modulated by the clock responsive genes and their products are listed in the Reference tables. Assays for detecting such biological activities are described in the Protein Domain table.

Clock responsive genes are characteristically differentially transcribed in response to fluctuations in an entrained oscillator, which is internal to an organism and cell. The MA_diff table(s) report(s) the changes in transcript levels of various clock responsive genes in a plant.

Profiles of clock responsive genes are shown in the table below with examples of which associated biological activities are modulated when the activities of one or more such genes vary in plants.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to circadian rhythm Genes induced by rythm | Circadian rhythm perception Metabolisms affected by Circadian rhythm Synthesis of secondary metabolites and/or proteins Modulation of clock response transduction pathways Specific gene transcription initiation | Metabolic enzymes Change in cell membrane structure and potential Kinases and phosphatases Transcription activators Change in chromatin structure and/or localized DNA topology Enzymes in lipid, sugar and nitrogen metabolism Enzymes in photorespiration and photosynthesis |
| Down-regulated transcripts | Responders to circadian rhythm. Repressors of circadian "state" of metabolism | Negative regulation of circadian pathways released Changes in | Transcription factors Change in protein structure by phosphorylation |

| TRANSCRIPT LEVELS | TYPE OF GENES | PHYSIOLOGICAL CONSEQUENCES | EXAMPLES OF BIOCHEMICAL ACTIVITY |
|---|---|---|---|
| | Genes repressed by rhythm Genes with discontinued expression or unsTable mRNA in presence of zinc | pathways and processes operating in cells Changes in metabolism other than circadian pathways | (kinases) or dephosphoryaltion (phosphatases) Change in chromatin structure and/or DNA topology Stability of factors for protein synthesis and degradation Metabolic enzymes in light, sugar, lipid and nitrogen metabolism |

Use of Promoters of Clock Responsive Genes

Promoters of Clock responsive genes are useful for transcription of any desired polynucleotide or plant or non-plant origin. Further, any desired sequence can be transcribed in a similar temporal, tissue, or environmentally specific patterns as the Clock responsive genes where the desired sequence is operably linked to a promoter of a Clock responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D.3. Blue Light (Phototropism) Responsive Genes, Gene Components and Products Phototropism is the orientation or growth of a cell, an organism or part of an organism in relation to a source of light. Plants can sense red (R), far-red (FR) and blue light in their environment and respond differently to particular ratios of these. For example, a low R:FR ratio enhances cell elongation and favors flowering over leaf production, but blue light regulated cryptochromes also appear to be involved in determining hypocotyl growth and flowering time.

Phototropism of *Arabidopsis thaliana* seedlings in response to a blue light source is initiated by nonphototropic hypocotyl 1 (NPH1), a blue light-activated serine-threonine protein kinase, but the downstream signaling events are not entirely known. Blue light treatment leads to changes in gene expression. These genes have been identified by comparing the levels of mRNAs of individual genes in dark-grown seedlings, compared with in dark grown seedlings treated with 1 hour of blue light. Auxin also affects blue light phototropism. The effect of Auxin on gene expression stimulated by blue light has been explored by studying mRNA levels in a mutant of *Arabidopsis thaliana* nph4-2, grown in the dark and, treated with blue light for 1 hour compared with wild type seedlings treated similarly. This mutant is disrupted for Auxin-related growth and Auxin-induced gene transcription. Gene expression was studied using microarray technology.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing some 10,000 non-redundant ESTs, selected from about 37,000 randomly sequenced ESTs generated from mRNA of different tissues and developmental stages.

The sequences of the ESTs showing at least two-fold increases or decreases over the controls were identified, compared to the Ceres full-length cDNA and genomic sequence databanks, and the equivalent Ceres clones identified. The MA_diff table(s)report(s) the results of this analysis, indicating those Ceres clones which are up or down regulated over controls, thereby indicating the Ceres clones which represent blue light responsive genes and of those which are blue light responsive in the absence of nph4 gene activity. The MA_diff Table(s) reports the transcript levels of the experiment (see EXPT ID: Phototropism (relating to SMD 4188, SMD 6617, SMD 6619)). For transcripts that had higher levels in the samples than the control, a "+" is shown. A "−" is shown for when transcript levels were reduced in root tips as compared to the control. For more experimental detail see the Example section below.

Blue Light genes are those sequences that showed differential expression as compared to controls, namely those sequences identified in the MA_diff tables with a "+" or "−" indication.

Blue Light Genes Identified by Cluster Analyses of Differential Expression

Blue Light Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Blue Light genes is any group in the MA_clust that comprises a cDNA ID that also appears in Expt ID Phototropism (relating to SMD 4188, SMD 6617, SMD 6619) of the MA_diff table(s).

Blue Light Genes Identified by Correlation to Genes that Cause Physiological Consequences Additionally, the differential expression data and the phenotypic observations can be merged to identify pathways or networks of Blue Light genes. A group in the MA_clust is considered a Blue Light pathway or network if the group comprises a cDNA ID that also appears in Knock-in or Knock-out tables that causes one or more of the phenotypes described in section above.

Blue Light Genes Identified by Amino Acid Sequence Similarity

Blue Light genes from other plant species typically encode polypeptides that share amino acid similarity to the sequences encoded by corn and *Arabidopsis* Blue Light genes. Groups of Blue Light genes are identified in the Protein Group table. In this table, any protein group that comprises a peptide ID that corresponds to a cDNA ID member of a Blue Light pathway or network is a group of proteins that also exhibits Blue Light functions/utilities.

III.D.3.a. Use of Blue Light Responsive Genes, Gene Components and Products to Modulate Phenotypes Changes in blue light in a plant's surrounding environment result in modulation of many genes and gene products. Examples of such blue light response genes and gene products are shown in the REFERENCE and SEQUENCE Tables. These genes and/or products are responsible for effects on traits such as plant vigor and seed yield.

While blue light responsive polynucleotides and gene products can act alone, combinations of these polynucleotides also affect growth and development. Useful combinations include different blue light responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of a blue light responsive polynucleotides and/or gene product with other environmentally responsive polynucleotide is also useful because of the interactions that exist between hormone-regulated pathways, stress and pathogen induced pathways, nutritional pathways and development. Here, in addition to polynucleotides having similar transcription profiles and/or biological activities, useful combinations include polynucleotides that may have different transcription profiles but which participate in common or overlapping pathways.

III.D.3.b. Use of Blue Light Responsive Genes, Gene Components and Products to Modulate Phenotypes Blue light responsive genes and gene products can function to either increase or dampen the above phenotypes or activities either in response to changes in blue light response concentration or in the absence of blue light responsive fluctuations. Further, promoters of blue light responsive genes, as described in the Reference tables, for example, are useful to modulate transcription that is induced by blue light or any of the following phenotypes or biological activities below. Further, any desired sequence can be transcribed in similar temporal, tissue, or environmentally specific patterns as the blue light responsive genes when the desired sequence is operably linked to a promoter of a blue light responsive gene.

Blue light responsive genes and gene products can be used to alter or modulate one or more phenotypes including growth, roots (elongation or gravitropism) and stems (such as elongation), development of cell (such as growth or elongation), flower (including flowering time), seedling (including elongation), plant yield, and seed and fruit yield.

To regulate any of the phenotype(s) above, activities of one or more of the blue light responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Liscum and Briggs (1995, Plant Cell 7: 473-85), Vitha et al. (2000, Plant Physiol 122: 453-61), Stowe-Evance et al. (1998, Plant Physiol 118: 1265-75), Baum et al. (1999, PNAS USA 96: 13554-9), Huala et al. (1997) Science 278: 2120-2123), Kanegae et al. (2000, Plant Cell Physiol 41: 415-23), Khanna et al. (1999, Plant Mol Biol 39: 231-42), Sakai et al. (2000, Plant Cell 12: 225-36), Parks et al (1996, Plant Physiol 110: 155-62) and Janoudi et al. (1997, Plant Physiol 113: 975-79).

III.D.3.c. Use of Blue Light Responsive Genes, Gene Components and Products to Modulate Biochemical Activities The activities of one or more of the blue light responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Cell Growth and Development | Cell Elongation Seedling Stem | Liscum and Briggs (1995) Plant Cell 7: 473-85 |
| | Root | Vitha et al. (2000) Plant Physiol 122: 453-61 |
| Signalling | UV light Perception | Liscum and Briggs (1996) Plant Physiol 112: 291-96 |
| | Far-red/Red light Perception | Parks et al. (1996) Plant Physiol 110: 155-62 |
| | Phosphorylation of cellular and nuclear-localized proteins | Liscum and Briggs (1996) Plant Physiol 112: 291-96 |
| | Activation and Synthesis of Transcription Factors | Sakae et al. (2000) Plant Cell 12: 225-36 |
| | Ca+2 levels | Baum et al. (1999) PNAS USA 96: 13554-9 Pu and Robinson (1998) J Cell Sci 111: 3197-3207 |
| | Auxin Concentration | Estelle (1998) Plant Cell 10: 1775-8 Reed et al. (1998) Plant Physiol 118: 1369-78 |
| | Inter-photoreceptors | Janoudi et al. (1997) Plant Physiol 113: 975-79 |

Other biological activities that can be modulated by blue light response genes and their products are listed in the REF Tables. Assays for detecting such biological activities are described in the Domain section of the REF Table.

The specific genes modulated by blue light, in wild type seedlings and in the mutant deficient in transmitting Auxin effects are given in the Reference and Sequence Tables. The kinds of genes discovered and some of their associated effects are given in the Table below.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to no blue light in wild type or to blue light in mutant lacking Auxin effects | Blue light perception Metabolism affected by blue light Synthesis of secondary metabolites and/or proteins Modulation of blue light transduction pathways Specific gene transcription initiation | Transporters Metabolic enzymes Change in cell membrane structure and potential Kinases and phosphatases Transcription activators Change in chromatin structure and/or localized DNA topology |
| Down-regulated transcripts | Responders to no blue light in wild type or to blue light in mutants lacking Auxin effects Genes with discontinued expression or unsTable mRNA during response | Blue light perception Metabolism affected by blue light Synthesis of secondary metabolites and/or proteins Modulation of blue light transduction pathways Specific gene transcription initiation Changes in pathways and processes operating in cells Changes in metabolic pathways other than phototropic blue light responsive pathways | Transcription factors Change in protein structure by phosphorylation (kinases) or dephosphorylation (phosphatases) Change in chromatin structure and/or DNA topology Stability factors for protein synthesis and degradation Metabolic enzymes |

Use of Promoters of Blue Light Responsive Genes

Promoters of Blue Light responsive genes are useful for transcription of any desired polynucleotide or plant or non-plant origin. Further, any desired sequence can be transcribed in a similar temporal, tissue, or environmentally specific patterns as the Blue Light responsive genes where the desired sequence is operably linked to a promoter of a Blue Light responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D.4 Responsive Genes, Gene Components and Products

There has been a recent and significant increase in the level of atmospheric carbon dioxide. This rise in level is projected to continue over the next 50 years. The effects of the increased level of carbon dioxide on vegetation are just now being examined, generally in large scale, whole plant (often trees) experiments. Some researchers have initiated physiological experiments in attempts to define the biochemical pathways that are either affected by and/or are activated to allow the plant to avert damage from the elevated carbon dioxide levels. A genomics approach to this issue, using a model plant system, allows identification of those pathways affected by and/ or as having a role in averting damage due to the elevated carbon dioxide levels and affecting growth. Higher agronomic yields can be obtained for some crops grown in elevated $CO_2$.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The U.S. *Arabidopsis* Functional Genomics Consortium (AFGC) has recently made public the results from such microarray experiments conducted with AFGC chips containing about 10,000 non-redundant ESTs, selected from about 37,000 randomly sequenced ESTs generated from mRNA of different tissues and developmental stages.

The sequences of the ESTs showing at least two-fold increases or decreases in plants grown in higher $CO_2$ levels compared with plants grown at more normal $CO_2$ levels, were compared to the Ceres full length cDNA and genomic sequence databanks, and equivalent Ceres clones were identified. The MA_diff table reports the results of this analysis, indicating those Ceres clones which are up or down regulated over controls, thereby indicating the Ceres clones cDNA sequences that change in response to $CO_2$.

Examples of $CO_2$ responsive genes and gene products are shown in the Reference, Sequence, Protein Group, Protein Group Matrix tables, MA_diff and MA_clust tables. While $CO_2$ responsive polynucleotides and gene products can act alone, combinations of these polynucleotides also affect growth and development. Useful combinations include different $CO_2$ responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants.

Manipulation of one or more $CO_2$ responsive gene activities is useful to modulate the biological processes and/or phenotypes listed below. $CO_2$ responsive genes and gene products can act alone or in combination. Useful combinations include genes and/or gene products with similar transcription profiles, similar biological activities, or members of the same or functionally related biochemical pathways. Here, in addition to polynucleotides having similar transcription profiles and/or biological activities, useful combinations include polynucleotides that may have different transcription profiles but which participate in common or overlapping pathways.

$CO_2$ responsive genes and gene products can function to either increase or dampen the above phenotypes or activities. Further, promoters of $CO_2$ responsive genes, as described in the Reference tables, for example, are useful to modulate transcription that is induced by $CO_2$ or any of the following phenotypes or biological activities below. Further, any desired sequence can be transcribed in similar temporal, tissue, or environmentally specific patterns as the $CO_2$ responsive genes when the desired sequence is operably linked to a promoter of a $CO_2$ responsive gene. The MA_diff Table(s) reports the transcript levels of the experiment (see EXPT ID: CO2 (relating to SMD7561, SMD 7562, SMD 7261, SMD 7263, SMD 3710, SMD 4649, SMD 4650)). For transcripts that had higher levels in the samples than the control, a "+" is shown. A "–" is shown for when transcript levels were reduced in root tips as compared to the control. For more experimental detail see the Example section below.

CO2 genes are those sequences that showed differential expression as compared to controls, namely those sequences identified in the MA_diff tables with a "+" or "–" indication.

CO2 Genes Identified by Cluster Analyses of Differential Expression

CO2 Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of CO2 genes is any group in the MA_clust that comprises a cDNA ID that also appears in Expt ID CO2 (relating to SMD7561, SMD 7562, SMD 7261, SMD 7263, SMD 3710, SMD 4649, SMD 4650) of the MA_diff table(s).

CO2 Genes Identified by Correlation to Genes that Cause Physiological Consequences Additionally, the differential expression data and the phenotypic observations can be merged to identify pathways or networks of CO2 genes. A group in the MA_clust is considered a CO2 pathway or network if the group comprises a cDNA ID that also appears in Knock-in or Knock-out tables that causes one or more of the phenotypes described in section above.

CO2 Genes Identified by Amino Acid Sequence Similarity

CO2 genes from other plant species typically encode polypeptides that share amino acid similarity to the sequences encoded by corn and *Arabidopsis* CO2 genes. Groups of CO2 genes are identified in the Protein Group table. In this table, any protein group that comprises a peptide ID that corresponds to a cDNA ID member of a CO2 pathway or network is a group of proteins that also exhibits CO2 functions/utilities.

III.D.4.a. Use of CO2 Responsive Genes to Modulate Phenotypes $CO_2$ responsive genes and gene products are useful to or modulate one or more phenotypes including catabolism, energy generation, atp, etc., metabolism, carbohydrate synthesis, growth rate, whole plant, including height, flowering time, etc., organs, flowers, fruits, stems, leaves, roots, lateral roots, biomass, fresh and dry weight during any time in plant life, such as maturation; number, size, and weight of flowers; seeds; branches; leaves; total plant nitrogen content, amino acid/protein content of whole plant or parts, seed yield (such as number, size, weight, harvest index, and content and composition, e.g., amino acid, nitrogen, oil, protein, and carbohydrate); fruit yield; number, size, weight, harvest index; content and composition, e.g., amino acid, nitrogen, oil, protein, carbohydrate, water; and photosynthesis (such as carbon dioxide fixation).

To improve any of the phenotype(s) above, activities of one or more of the $CO_2$ responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Saito et al. (1994, Plant Physiol. 106: 887-95), Takahashi et al (1997, Proc. Natl. Acad. Sci. USA 94: 11102-07) and Koprivova et al. (2000, Plant Physiol. 122: 737-46).

III.D.2. Use of $CO_2$ Responsive Genes to Modulate Biochemical Activities

The activities of one or more of the $CO_2$ responsive genes can be modulated to change biochemical or metabolic activities and/or pathways such as those noted below. Such biological activities can be measured according to the citations included in the Table below:

| GENERAL CATEGORY | BIOCHEMICAL OR METABOLIC ACTIVITIES AND/OR PATHWAYS | CITATIONS INCLUDING ASSAYS |
| --- | --- | --- |
| Cell Division | Cell Cycle Control Genes | Masle (2000) Plant Physiol. 122: 1399-1415 |
| Starch Biosynthesis | Starch Biosynthesis Enzymes And Pathways | Ludewig et al., (1998) FEBS Lett. 429: 147-151 |
| Photosynthesis | Photosynthetic Enzymes, e.g., Rubisco | Cheng et al., (1998) Plant Physiol 166: 715-723 |

-continued

| GENERAL CATEGORY | BIOCHEMICAL OR METABOLIC ACTIVITIES AND/OR PATHWAYS | CITATIONS INCLUDING ASSAYS |
|---|---|---|
| Respiration | Energy Metabolism Pathways | Musgrave et al., (1986) Proc. Natl. Acad. Sci. USA 83: 8157-8161 |
| $CO_2$ Uptake | Guard Cell Stomata Control Systems | Allen et al., Plant Cell (1999) 11(9): 1785-1798 |

Reference tables. Assays for detecting such biological activities are described in the Protein Domain table.

$CO_2$ responsive genes are characteristically differentially transcribed in response to fluctuating $CO_2$ levels or concentrations, whether internal or external to an organism or cell. The MA_diff tables report the changes in transcript levels of various $CO_2$ responsive genes that are differentially expressed in response to high $CO_2$ levels.

Profiles of these different $CO_2$ responsive genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up Regulated Transcripts | Responders To Higher Levels Of $CO_2$ Genes Induced By $CO_2$ | Changes In Generation Of ATP Changes In Catabolism And Anabolism Enzymes and Pathways Activation Of Krebs Cycle Specific Gene Transcription Initiation Changes In Carbohydrate Synthesis Changes In Chloroplast Structure Changes In Photosynthesis Changes In Respiration | Transporters Catabolic And Anabolic Enzymes Change In Cell Membrane Structure And Potential Kinases And Phosphatases Transcription Activators And Repressors Change In Chromatin Structure And/Or Localized DNA Topology Redox Control |
| Down-Regulated Transcripts | Responders To Higher Levels Of $CO_2$ Genes Repressed By $CO_2$ | Changes In Pathways And Processes Operating In Cells Changes In Catabolism and Anabolism Changes in Chloroplast Structure | Transcription Factors Change In Protein Structure By Phosphorylation (Kinases) Or Dephosphorylation (Phosphatases) Change In Chromatin Structure And/Or DNA Topology Stability Of Factors For Protein Synthesis And Degradation Metabolic Enzymes |

-continued

| GENERAL CATEGORY | BIOCHEMICAL OR METABOLIC ACTIVITIES AND/OR PATHWAYS | CITATIONS INCLUDING ASSAYS |
|---|---|---|
| Coordination Of Carbon And Nitrogen Metabolism | Light-Regulation Of Major Central Carbon And Nitrogen Metabolic Pathways To Coordinate Growth Carbohydrate And Nitrogen Control Of Carbohydrate And Organic Nitrogen Accumulation Pathways | Ichida et al., Plant Cell (1997) 9(10): 1843-1857 Hedrich et al., EMBO J (1993) 12(3): 897-901 Lam et al. (1998) Plant J. 16(3): 345-353 Lejay et al. (1999) Plant J. 18(5): 509-519; and Oliveira et al. (1999) Plant. Phys. 121: 301-309 Lam et al. (1998) supra; Lejay et al. (1999) supra; and Oliveira et al. (1999) supra |

Other biological activities that can be modulated by the $CO_2$ responsive genes and gene products are listed in the Use of Promoters of CO2 Responsive Genes Promoters of CO2 responsive genes are useful for transcription of any desired polynucleotide or plant or non-plant origin. Further, any desired sequence can be transcribed in a similar temporal, tissue, or environmentally specific patterns as the CO2 responsive genes where the desired sequence is operably linked to a promoter of a CO2 responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D.5. Mitochondria Electron Transport (Respiration) Genes, Gene Components and Products One means to alter flux through metabolic pathways is to alter the levels of proteins in the pathways. Plant mitochondria contain many proteins involved in various metabolic processes, including the TCA cycle, respiration, and photorespiration and particularly the electron transport chain (mtETC). Most mtETC complexes consist of nuclearly-encoded mitochondrial proteins (NEMPs) and mitochondrially-encoded mitochondrial proteins (MEMPs). NEMPs are produced in coordination with MEMPs of the same complex and pathway and with other proteins in multi-organelle pathways. Enzymes involved in photorespiration, for example, are located in chloroplasts, mitochondria, and peroxisomes and many of the proteins are nuclearly-encoded. Manipulation of the coordination of protein levels within and between organelles can have critical and global consequences to the growth and yield of a plant. Genes which are manipulated by interfering with the mtETC have been characterized using microarray technology.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing about 10,000 non-redundant ESTs, selected from about 37,000 randomly sequenced ESTs generated from mRNA of different tissues and developmental stages.

The sequences of the ESTs showing at least two-fold increases or decreases in the presence of the ETC inhibitor, 10 mM antimycin A compared with the control lacking antimycin A. were identified, compared to the Ceres full length cDNA and genomic sequence databanks, and equivalent Ceres clones identified. The MA_diff table reports the results of this analysis, indicating those Ceres clones which are up or down regulated over controls, thereby indicating the Ceres clones that represent respiration responsive genes.

Examples of genes and gene products that are responsive to antimycin A block of respiration are shown in the Reference, Sequence, Protein Group, Protein Group Matrix, MA_diff and MA_clust tables. While respiration responsive polynucleotides and gene products can act alone, combinations of these polynucleotides also affect growth and development. Useful combinations include different respiration responsive polynucleotides and/or gene products that have similar transcription profiles or similar biological activities, and members of the same or similar biochemical pathways. Here, in addition to polynucleotides having similar transcription profiles and/or biological activities, useful combinations include polynucleotides that may have different transcription profiles but which participate in common or overlapping pathways. Whole pathways or segments of pathways are controlled by transcription factor proteins and proteins controlling the activity of signal transduction pathways. Therefore, manipulation of such protein levels is especially useful for altering phenotypes and biochemical activities of plants. Manipulation of one or more respiration responsive gene activities are useful to modulate the biological processes and/or phenotypes listed below.

Such respiration responsive genes and gene products can function to either increase or dampen the phenotypes or activities below. Further, promoters of respiration responsive genes, as described in the Reference tables, for example, are useful to modulate transcription that is induced by respiration or any of the following phenotypes or biological activities below. Further, any desired sequence can be transcribed in similar temporal, tissue, or environmentally specific patterns as the respiration responsive genes when the desired sequence is operably linked to a promoter of a respiration responsive gene. The MA_diff Table(s) reports the transcript levels of the experiment (see EXPT ID: Mitchondria-Electron Transport (relating to SMD 8061, SMD 8063)). For transcripts that had higher levels in the samples than the control, a "+" is shown. A "−" is shown for when transcript levels were reduced in root tips as compared to the control. For more experimental detail see the Example section below.

Mitchondria-Electron Transport genes are those sequences that showed differential expression as compared to controls, namely those sequences identified in the MA_diff tables with a "+" or "−" indication.

Mitchondria-Electron Transport Genes Identified by Cluster Analyses of Differential Expression Mitchondria-Electron Transport Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Mitchondria-Electron Transport genes is any group in the MA_clust that comprises a cDNA ID that also appears in Expt ID Mitchondria-Electron Transport (relating to SMD 8061, SMD 8063) of the MA_diff table(s).

Mitchondria-Electron Transport Genes Identified by Correlation to Genes that Cause Physiological Consequences Additionally, the differential expression data and the phenotypic observations can be merged to identify pathways or networks of Mitchondria-Electron Transport genes. A group in the MA_clust is considered a Mitchondria-Electron Transport pathway or network if the group comprises a cDNA ID that also appears in Knock-in or Knock-out tables that causes one or more of the phenotypes described in section above.

Mitchondria-Electron Transport Genes Identified by Amino Acid Sequence Similarity Mitchondria-Electron Transport genes from other plant species typically encode polypeptides that share amino acid similarity to the sequences encoded by corn and *Arabidopsis* Mitchondria-Electron Transport genes. Groups of Mitchondria-Electron Transport genes are identified in the Protein Group table. In this table, any protein group that comprises a peptide ID that corresponds to a cDNA ID member of a Mitchondria-Electron Transport pathway or network is a group of proteins that also exhibits Mitchondria-Electron Transport functions/utilities.

III.D.5.a. Use of Respiration Responsive Genes to Modulate Phenotypes

Respiration responsive genes and gene products are useful to or modulate one or more phenotypes including catabolism; energy generation, ATP, etc.; growth rate; whole plant, including height, flowering time, etc.; organs; flowers; fruits; stems; leaves; roots, lateral roots; biomass; fresh and dry weight during any time in plant life, such as maturation; number, size, and weight of flowers; seeds; branches; leaves; total plant nitrogen content; amino acid/protein content of whole plant or parts; seed yield (such as number, size weight, harvest index, and content and composition, e.g., amino acid, nitrogen, oil, protein, and carbohydrate); fruit yield; number, size, weight, harvest index; content and composition, e.g., amino acid, nitrogen, oil, protein, carbohydrate, water; and photosynthesis (such as carbon dioxide fixation).

To improve any of the phenotype(s) above, activities of one or more of the respiration responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Saito et al. (1994, Plant Physiol. 106: 887-95), Takahashi et al (1997, Proc. Natl. Acad. Sci. USA 94: 11102-07) and Koprivova et al. (2000, Plant Physiol. 122: 737-46).

III.D.5.b. Use of Respiration-Responsive Genes to Modulate Biochemical Activities The activities of one or more of the respiration responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Respiration and energy-related processes | Mitochondrial Electron Transport Chain | Passam et al. (1973) Biochem Biophys. Acta 325: 54-61 |
| | Alternative oxidase pathway | Saisho et al. (1997) Plant Mol. Biol. 35: 585-600 Vanlerberghe and McIntosh (1994) Plant Physiol. 105: 867-874 |
| | ATP generation pathways ATP utilization pathways | Mahler and Cordes (1966) In Biological Chemistry, Harper and Row |
| | Chloroplast energy related pathways | Foyer et al. (1989) Arch. Biochem. Biophys. 268: 687-697 Mills et al. (1978) Biochem. Biophys. Acta 504: 298-309 |
| | Peroxisome energy related pathways | Olsen (1998) Plant mol. Biol. 38: 163-89 |
| | Cytoplasmic energy related pathways | Roberts et al. (1995) Febs Letters 373: 307-309 |
| | Catabolism and Anabolism | Mahler and Cordes (1966) In Biological Chemistry, Harper and Row |
| | Aerobic versus anaerobic pathways | Mahler and Cordes (1966) In Biological Chemistry, Harper and Row |
| Coordination of Carbon and Nitrogen Metabolism | Light-regulation of major central carbon and nitrogen | Lam et al. (1998) Plant J. 16(3): 345-353 |
| | Metabolic pathways to coordinate growth | Lejay et al. (1999) Plant J. 18(5): 509-519; and Oliveira et al. (1999) Plant. Phys. 121: 301-309 |
| | Carbohydrate and nitrogen control of carbohydrate and organic nitrogen accumulation pathways | Lam et al. (1998) Plant J. 16(3): 345-353 Lejay et al. (1999) Plant J. 18(5): 509-519; and Oliveira et al. (1999) Plant. Phys. 121: 301-309 |

Other biological activities that can be modulated by the respiration genes and gene products are listed in the REF Tables. Assays for detecting such biological activities are described in the Protein Domain table.

Respiration responsive genes are differentially expressed in response to inhibition of mitochondrial electron transport by antimycin A. The MA_diff table reports the changes in transcript levels of various respiration responsive genes that are differentially expressed in response to this treatment.

Profiles of these different respiration genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to inhibition of mitochondrial electron transport respiration Genes induced by inhibition of mitochondrial electron transport | Changes in generation of ATP Alternate oxidase induction Changes in catabolic and anabolic enzymes and pathways Specific gene transcription initiation Changes in electron transport proteins | Transporters Catabolic and anabolic enzymes Changes in cell and organelle membrane structures and potentials Kinases and phosphatases Transcription activators Change in chromatin structure and/or localized DNA topology Redox control |
| Down-regulated transcripts | Responders to inhibition of mitochondrial electron transport Genes repressed by inhibition of mitochondrial electron transport | Changes in ATP generating pathways Changes in pathways and processes operating in cells Induction of aerobic pathways Changes in catabolism and anabolism | Transcription factors Change in protein structure by phosphorylation (kinases) or dephosphoryaltion (phosphatases) Transporters Catabolic and anabolic enzymes Changes in cell and organelle membrane structures and potentials Change in chromatin structure and/or localized DNA topology changes Stability factors for protein synthesis and degradation Metabolic enzymes |
| | | Changes in redox activities | Changes in redox enzymes |

Use of Promoters of Respiration Genes

Promoters of Respiration genes are useful for transcription of any desired polynucleotide or plant or non-plant origin. Further, any desired sequence can be transcribed in a similar temporal, tissue, or environmentally specific patterns as the Respiration genes where the desired sequence is operably linked to a promoter of a Respiration gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D.6. Protein Degradation Genes, Gene Components and Products

One of the components of molecular mechanisms that operate to support plant development is the "removal" of a gene product from a particular developmental circuit once the substrate protein is not functionally relevant anymore in temporal and/or spatial contexts. The "removal" mechanisms can be accomplished either by protein inactivation (e.g., phosphorylation or protein-protein interaction) or protein degradation most notably via ubiquitination-proteasome pathway. The ubiquitination-proteasome pathway is responsible for the degradation of a plethora of proteins involved in cell cycle, cell division, transcription, and signal transduction, all of which are required for normal cellular functions. Ubiquitination occurs through the activity of ubiquitin-activating enzymes (E1), ubiquitin-conjugating enzymes (E2), and ubiquitin-protein ligases (E3), which act sequentially to catalyze the attachment of ubiquitin (or other modifying molecules that are related to ubiquitin) to substrate proteins (Hochstrasser 2000, Science 289: 563). Ubiquitinated proteins are then routed to proteasomes for degradation processing [2000, Biochemistry and Molecular Biology of Plants, Buchanan, Gruissem, and Russel (eds), Amer. Soc. of Plant Physiologists, Rockville, Md.]. The degradation mechanism can be selective and specific to the concerned target protein (Joazeiro and Hunter 2001, Science 289: 2061; Sakamoto et al., 2001, PNAS Online 141230798). This selectivity and specificity may be one of the ways that the activity of gene products is modulated.

III.D.6.a. Identification of Protein Degradation Genes, Gene Components and Products "Protein degradation" genes identified herein are defined as genes, gene components and products associated with or dependant on the ubiquitination—proteasome protein degradation process. Examples of such "protein degradation" genes and gene products are shown in the Reference and Sequence Tables. The biochemical functions of the protein products of many of these genes are also given in the Reference, Sequence, Protein Group, Protein Group Matrix tables, MA_diff and MA_clust tables. Selected genes, gene components and gene products of the invention can be used to modulate many plant traits from architecture to yield to stress tolerance.

"Protein Degradation" Genes, Gene Components and Products Identified by Phenotypic Observations "Protein degradation" genes herein were discovered and characterized from a much larger set of genes in experiments designed to find the genes associated with the increased number of lateral branches (and secondary inflorescences) that are formed per cauline node. In these experiments, "protein degradation" genes were identified using a mutant with these characteristics. The gene causing the changes was identified from the mutant gene carrying an inserted tag. The mutant plant was named 13B12-1 and the mutant was in the E2 conjugating enzyme gene of the ubiquitination process. Compared to "wild-type" parental plants, the mutant plants exhibited multiple lateral stems per node and multi-pistillated flowers. For more experimental detail, see Example section below.

Protein Degradation Genes, Gene Components and Products Identified by Differential Expression "Protein degradation" genes were also identified by measuring the relative levels of mRNA products in the mutant plant 13B12-1 lacking the E2 conjugating enzyme versus a "wild-type" parental plant. Specifically, mRNAs were isolated from 13B12-1 and compared with mRNAs isolated from wild-type plants utilizing microarray procedures. The MA_diff Table(s) reports the transcript levels of the experiment (see EXPT ID: 108451). For transcripts that had higher levels in the samples than the control, a "+" is shown. A "−" is shown for when transcript levels were reduced in root tips as compared to the control. For more experimental detail see the Example section below.

Protein Degradation genes are those sequences that showed differential expression as compared to controls, namely those sequences identified in the MA_diff tables with a "+" or "−" indication.

Protein Degradation Genes Identified by Cluster Analyses of Differential Expression Protein Degradation Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Protein Degradation genes is any group in the MA_clust that comprises a cDNA ID that also appears in Expt ID 108451 of the MA_diff table(s).

Protein Degradation Genes Identified by Correlation to Genes that Cause Physiological Consequences Additionally, the differential expression data and the phenotypic observations can be merged to identify pathways or networks of Protein Degradation genes. A group in the MA_clust is considered a Protein Degradation pathway or network if the group comprises a cDNA ID that also appears in Knock-in or Knock-out tables that causes one or more of the phenotypes described in section above.

Protein Degradation Genes Identified by Amino Acid Sequence Similarity

Protein Degradation genes from other plant species typically encode polypeptides that share amino acid similarity to the sequences encoded by corn and *Arabidopsis* Protein Degradation genes. Groups of Protein Degradation genes are identified in the Protein Group table. In this table, any protein group that comprises a peptide ID that corresponds to a cDNA ID member of a Protein Degradation pathway or network is a group of proteins that also exhibits Protein Degradation functions/utilities.

These differentially expressed genes include genes associated with the degradation process and the genes whose expression is disturbed by the aberrant ubiquitination.

Examples of phenotypes, biochemical activities, and transcription profiles that can be modulated using these genes, gene components and gene products are described above and below.

III.D.6.b. Use of "Protein Degradation" Genes, Gene Components and Products to Modulate Phenotypes The "protein degradation" genes, their components and products of the instant invention are useful for modulating one or more processes required for post-translational modification (e.g., ubiquitination) and degradation or inactivation of substrate proteins and also the pathways and processes that are associated with protein inactivation that are important for either or all of the following: (i) cell proliferation; (ii) cell differentiation; and (iii) cell death. The "protein degradation" genes, gene components and gene products are useful to alter or modulate one or more phenotypes including cell proliferation and cell size.

The intracellular levels of many proteins are regulated by ubiquitin-proteasome proteolysis. Without proper regulation of protein levels, normal cell differentiation can be altered. Examples of cell differentiation and development can be modulated by the genes and gene products of this invention include root size (such as length of primary roots or length of lateral roots) and function; branching and stem formation (such as multiple pistils, multiple lateral stems or secondary inflorescence per cauline node, and internode length) and cell differentiation and/or development in response to hormones (such as Auxin).

Programmed cell death can result from specific and targeted degradation of critical substrate proteins (e.g., transcription factors, enzymes, and proteins involved in signal transduction). Thus, alteration of "protein degradation" genes, their gene products, and the corresponding substrate proteins that they are acting upon are useful to modulate the vigor and yield of the plant overall as well as distinct cells, organs, or tissues. Traits that can be modulated by these genes and gene products include sterility or reproduction and seedling lethality.

Uses of Plants that are Modified as Described Above

Genes that control fundamental steps in regulatory pathways, such as protein inactivation, that in turn influence cascades and networks of other genes and processes are extremely useful. They and their component parts can be used selectively to manipulate development in specific cells, tissues and organs, including meristems when genes are designed to inactivate the normal genes only in specific cells, tissues and organs or to promote protein production where it is not normally produced. They can also be used to promote/control cell death.

Other "protein degradation" genes described here are components of the pathways determining organ identity and phenotypes. These and their component parts are also useful for modifying the characteristics of specific cells, tissues and organs when regulated appropriately. Thus "protein degradation" genes have wide utility for achieving the following: better plant survival by decreased lodging; better responses to high plant density; better stress tolerance; better animal (including human) nutrition values; improved dietary mineral nutrition; more vigor, growth rate and yield in terms of biomass; root/tuber yield (in terms of number, size, weight, or harvest index); content and composition, e.g. amino acid, jasmonate, oil, protein and starch; number of flowers; seed yield (e.g. number, size, weight, harvest index, content and composition, e.g. amino acid, jasmonate, oil, protein and starch); and fruit yield (e.g. number, size, weight, harvest index, post harvest quality, content and composition, e.g. amino acid, jasmonate, oil, protein and starch).

To regulate any of the phenotype(s) above, activities of one or more of the "protein degradation" genes or gene products can be modulated and tested by screening for the desired trait. Specifically, the gene, mRNA levels, or protein levels can be altered in a plant utilizing the procedures described herein and the phenotypes can be assayed. In addition, a synthetic molecule containing specific domains from "protein degradation" genes or gene product and/or in combination with other domains from gene products that are not necessarily related to protein degradation pathway can be constructed to target the degradation or inactivation of specific substrate proteins. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Dolan et al. (1993, Development 119: 71-84), Dolan et al. (1997, Development 124: 1789-98), Crawford and Glass (1998, Trends Plant Science 3: 389-95), Wang et al. (1998, PNAS USA 95: 15134-39), Gaxiola et al. (1998, PNAS USA 95: 4046-50), Apse et al. (1999, Science 285: 1256-58), Fisher and Long (1992, Nature 357: 655-60), Schneider et al. (1998, Genes Devel 12: 2013-21) and Hirsch (1999, Curr Opin Plant Biol. 2: 320-326).

Use of Protein Degradation Genes, Gene Components and Products to Modulate Biochemical Activities One or more of the "protein degradation" genes and their components can be used to modulate biochemical or metabolic activities, processes and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation and Development | Auxin response | Schwechheimer et al, Science 292: 1379 (2001); Leyser et al, Nature 8: 161 (1993); Lasswell et al, Plant Cell 12: 2395 (2000) |
| | Photomorphogenesis via leaf cells and meristems | Schwechheimer et al, Science 292: 1379 (2001) |
| | Apical dominance via shoot meristems | Schwechheimer et al, Science 292: 1379 (2001) |
| | Lateral root development via root meristem | Xie et al, Genes Dev 14: 3024 (2000) |
| | Hypocotyl, shoot elongation by hormone controlled process | Nagpal et al, Plant Physiol 123: 563 (2000) |
| Gene Expression and related cellular processes | mRNA stability | Johnson et al, PNAS 97: 13991 (2000); |
| | Gene activation | Pham and Sauer, 289: 2357 (2000) |
| | Cell division and cell cycle control in meristems | King et al, Cell 81: 279 (1995); Ciechanover et al, Cell 37: 57 (1984); Finley et al, Cell 37: 43 (1984); Robzyk et al, Science 287: 501 (2000) |
| | Chromatin remodeling | Roest et al, Cell 86: 799 (1996) |
| | Post-translational modification and organelle targeting of proteins | Biederer et al, Science 278: 1806 (1997) |

Other biological activities that can be modulated by the "protein degradation" gene, gene components and products are listed in the Reference tables. Assays for detecting such biological activities are described in the Protein Domain table.

III.D.6.d. Use of Protein Degradation Genes, Gene Components and Products to Modulate Transcription Levels of Other Genes The expression of many genes is "up regulated" or "down regulated" in the 13B12-1 mutant because some protein degradation genes and their products are integrated into complex networks that regulate transcription of many other genes. Some protein degradation genes are therefore useful for modifying the transcription of other genes and hence complex phenotypes, as described above. Profiles of "protein degradation" genes are described in the Table below with associated biological activities. "Up-regulated" profiles are those where the gene produces mRNA levels that are higher in the 13B12-1 as compared to wild-type plant; and vice-versa for "down-regulated" profiles.

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES WHOSE TRANSCRIPTS ARE CHANGED |
|---|---|---|---|
| Up Regulated Transcripts | Genes induced as a consequence of mutant ubiquitination degradation system Genes repressed by "protein degradation" system directly or indirectly Genes repressed or mRNAs degraded as a consequence of mutant ubiquitination degradation process | Shoot formation Lateral stem, lateral and main inflorescence development Internode elongation Node determination and development Root formation Lateral root development Proper response to Auxin and other growth regulators Seed dormancy and seed development Resistance to drought and other forms of stress Secondary metabolite biosynthesis | Transcription Activators and Repressors Chromatin Structure and/or Localized DNA Topology determining proteins Methylated DNA binding proteins Kinases, Phosphatases Signal transduction pathway proteins Transporters Metabolic Enzymes Cell cycle checkpoint proteins Cell Membrane Structure And Proteins Cell Wall Proteins Proteins involved in secondary metabolism Seed storage metabolism |
| Down Regulated Transcripts | Genes activated by "protein degradation" systems directly or indirectly | | |

"Protein degradation" genes and gene products can be modulated alone or in combination as described in the introduction. Of particular interest are combination of these genes and gene products with those that modulate hormone responses and/or metabolism. Hormone responsive and metabolism genes and gene products are described in more detail in the sections above. Such modification can lead to major changes in plant architecture and yield.

Use of Promoters and "Protein Degradation Genes, Gene Components and Products"

Promoters of "protein degradation" genes, as described in the Reference tables, for example, can be used to modulate transcription of any polynucleotide, plant or non plant to achieve synthesis of a protein in association with production of the ubiquitination—proteasome pathway or the various cellular systems associated with it. Additionally such promoters can be used to synthesize antisense RNA copies of any gene to reduce the amount of protein product produced, or to synthesize RNA copies that reduce protein formation by RNA interference. Such modifications can make phenotypic changes and produce altered plants as described above.

III.D.7. Carotenogenesis Responsive Genes, Gene Components and Products

Carotenoids serve important biochemical functions in both plants and animals. In plants, carotenoids function as accessory light harvesting pigments for photosynthesis and to protect chloroplasts and photosystem II from heat and oxidative damage by dissipating energy and scavenging oxygen radicals produced by high light intensities and other oxidative stresses. Decreases in yield frequently occur as a result of light stress and oxidative stress in the normal growth ranges of crop species. In addition light stress limits the geographic range of many crop species. Modest increases in oxidative stress tolerance would greatly improve the performance and growth range of many crop species. The development of genotypes with increased tolerance to light and oxidative stress would provide a more reliable means to minimize crop losses and diminish the use of energy-costly practices to modify the soil environment.

In animals carotenoids such as beta-carotene are essential provitamins required for proper visual development and function. In addition, their antioxidative properties are also thought to provide valuable protection from diseases such as cancer. Modest increases in carotenoid levels in crop species could produce a dramatic effect on plant nutritional quality. The development of genotypes with increased carotenoid content would provide a more reliable and effective nutritional source of Vitamin A and other carotenoid derived antioxidants than through the use of costly nutritional supplements.

Genetic changes produced through DNA mutation in a plant can result in the modulation of many genes and gene products. Examples of such mutation altered genes and gene products are shown in the Reference and Sequence Tables. These genes and/or products are responsible for effects on traits such as plant vigor, nutritional content and seed yield.

While carotenoid synthesis and/or oxidative stress responsive polynucleotides and gene products can act alone, combinations of these polynucleotides also affect growth and development. Useful combinations include different carotenoid biosynthetic polynucleotides and/or gene products that have similar transcription profiles or similar biological activities, and members of the same or similar biochemical pathways. In addition, the combination of an carotenoid synthesis or oxidative stress protective polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in a common pathway.

Such carotenoid synthesis/oxidative stress tolerance genes and gene products can function to either increase or dampen the above phenotypes or activities either in response to changes in light intensity or in the absence of osmotic fluctuations. They were discovered and characterized from a much larger set of genes by experiments designed to find genes whose mRNA products participate in carotenogenesis. These experiments made use of an *Arabidopsis* mutant (Or) having an accumulation of up to 500 times more beta-carotene than wild-type in non-photosynthetic tissues.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The USArabidopsis Functional Genomics Consortium (AFGC) has recently made public the results from such microarray experiments conducted with AFGC chips containing some 10,000 non-redundant ESTs, selected from about 37,000 randomly sequenced ESTs generated from mRNA of different tissues and developmental stages.

The sequences of the ESTs showing at least two-fold increases or decreases in the mutant plant compared with wild type seedlings were identified, compared to the Ceres full length cDNA and genomic sequence databanks, and equivalent Ceres clones identified. MA_diff Table reports the results of this analysis, indicating those Ceres clones which are up or down regulated over controls, thereby indicating the Ceres clones which represent Carotenoid synthesis/oxidative stress tolerance responsive genes. The MA_diff Table(s) reports the transcript levels of the experiment (see EXPT ID: Cauliflower (relating to SMD 5329, SMD 5330)). For transcripts that had higher levels in the samples than the control, a "+" is shown. A "−" is shown for when transcript levels were reduced in root tips as compared to the control. For more experimental detail see the Example section below.

Carotenogenesis genes are those sequences that showed differential expression as compared to controls, namely those sequences identified in the MA_diff tables with a "+" or "−" indication.

Carotenogenesis Genes Identified by Cluster Analyses of Differential Expression

Carotenogenesis Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Carotenogenesis genes is any group in the MA_clust that comprises a cDNA ID that also appears in Expt ID Cauliflower (relating to SMD 5329, SMD 5330) of the MA_diff table(s).

Carotenogenesis Genes Identified by Correlation to Genes that Cause Physiological Consequences Additionally, the differential expression data and the phenotypic observations can be merged to identify pathways or networks of Carotenogenesis genes. A group in the MA_clust is considered a Carotenogenesis pathway or network if the group comprises a cDNA ID that also appears in Knock-in or Knock-out tables that causes one or more of the phenotypes described in section above.

Carotenogenesis Genes Identified by Amino Acid Sequence Similarity

Carotenogenesis genes from other plant species typically encode polypeptides that share amino acid similarity to the sequences encoded by corn and *Arabidopsis* Carotenogenesis genes. Groups of Carotenogenesis genes are identified in the Protein Group table. In this table, any protein group that comprises a peptide ID that corresponds to a cDNA ID member of a Carotenogenesis pathway or network is a group of proteins that also exhibits Carotenogenesis functions/utilities.

III.D.7.a. Use of Carotenoid Synthesis/Oxidative Stress Tolerance Responsive Genes, Gene Components and Products to Modulate Phenotypes Carotenoid synthesis/oxidative stress tolerance genes and gene products are useful to or modulate one or more phenotypes including growth rate; whole plant, including height, flowering time, etc.); seedling; organ (such as stem, leaves, roots, flowers, fruits, or seed yield, size, or weight); seed development; embryo; germination; cell differentiation; chloroplasts; plant nutrition; uptake and assimilation of organic compounds; uptake and assimilation of inorganic compounds; animal (including human) nutrition; improved dietary mineral nutrition; stress responses; drought; cold; and osmotic.

To improve any of the phenotype(s) above, activities of one or more of the Carotenoid synthesis/oxidative stress tolerance genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Friedrich, (1999, JAMA 282: 1508), Kumar et al. (1999, Phytochemistry 51: 847-51), La Rocca et al. (2000, Physiologia Plantarum 109: 51-7) and Bartley (1994, In: Ann Rev Plant Physiol Plant Molec Biol, Jones and Somerville, eds, Annual Reviews Inc, Palo Alto, Calif.).

III.D.7.b. Use of Carotenoid Synthesis/Oxidative Stress Tolerance Responsive Genes, Gene Components and Products to Modulate Biochemical Activities The activities of one or more of the carotenoid synthesis/oxidative stress tolerance genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation and Development | Chloroplast biosynthesis | Kumar et al. (1999) Phytochemistry 51: 847-51<br>Fraser et al. (1994) Plant Physiol 105: 405-13 |
| Metabolism | Carotenoid biosynthesis | Kumar et al. (1999) Phytochemistry 51: 847-51 |
| | Herbicide resistance | La Rocca et al. (2000) Physiolgia Plantarum 109: 51-57 |
| | Regulate abscisic acid levels | Tan et al. (1997) PNAS USA 94: 12235-40 |
| | Drought, cold and osmotic tolerance | Tan et al. (1997) PNAS USA 94: 12235-40 |

Other biological activities that can be modulated by the Carotenoid synthesis, oxidative stress tolerance genes and gene products are listed in the Reference Tables. Assays for detecting such biological activities are described in the Protein Domain table.

Profiles of these different carotenoid synthesis/oxidative stress tolerance responsive genes are shown in the Table below together with examples of the kinds of associated biological activities.

| TRANSCRIPT LEVELS | TYPE OF GENES | PHYSIOLOGICAL CONSEQUENCES | EXAMPLES OF BIOCHEMICAL ACTIVITY |
| --- | --- | --- | --- |
| Up regulated transcripts | Genes induced during carotenoid synthesis/ oxidative stress tolerance activity | Gene Repression/Induction activity<br>Cell cycle progression<br>Chromatin condensation<br>Synthesis of metabolites and/or proteins<br>Modulation of transduction pathways<br>Specific gene transcription initiation | Transporters<br>Metabolic enzymes<br>Kinases and phosphatases<br>Transcription activators<br>Change in chromatin structure and/or localized DNA topology |
| Down-regulated transcripts | Genes repressed during carotenoid synthesis/oxidative stress tolerance activity<br>Genes with discontinued expression or unsTable mRNA in conditions of reduced carotenoid synthesis/oxidative stress tolerance | Gene repression/induction activity<br>Changes in pathways and processes operating in cells<br>Changes in metabolism other than carotenoid synthesis/oxidative stress tolerance | Transcription factors<br>Change in protein structure by phosphorylation (kinases) or dephosphorylation (phosphatases)<br>Change in chromatin structure and/or DNA topology<br>Stability of factors for protein synthesis and degradation<br>Metabolic enzymes |

Use of Promoters of Carotenogenesis Responsive Genes

Promoters of Carotenogenesis responsive genes are useful for transcription of any desired polynucleotide or plant or non-plant origin. Further, any desired sequence can be transcribed in a similar temporal, tissue, or environmentally specific patterns as the Carotenogenesis responsive genes where the desired sequence is operably linked to a promoter of a Carotenogenesis responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.D.8. Viability Genes, Gene Components and Products

Plants contain many proteins and pathways that when blocked or induced lead to cell, organ or whole plant death. Gene variants that influence these pathways can have profound effects on plant survival, vigor and performance. The critical pathways include those concerned with metabolism and development or protection against stresses, diseases and pests. They also include those involved in apoptosis and necrosis. The applicants have elucidated many such genes and pathways by discovering genes that when inactivated lead to cell or plant death.

Herbicides are, by definition, chemicals that cause death of tissues, organs and whole plants. The genes and pathways that are activated or inactivated by herbicides include those that cause cell death as well as those that function to provide protection. The applicants have elucidated these genes.

The genes defined in this section have many uses including manipulating which cells, tissues and organs are selectively killed, which are protected, making plants resistant to herbicides, discovering new herbicides and making plants resistant to various stresses.

III.D.8.a. Identification of Viability Genes, Gene Components and Products

Viability genes identified here are defined as genes, gene components and products capable of inhibiting cell, tissue, organ or whole plant death or protecting cells, organs and plants against death and toxic chemicals or stresses. Examples of such viability genes and gene products are shown in the Reference, Sequence, Protein Group, Protein Group Matrix tables, MA_diff, MA_clust, Knock-in and Knock-out tables. The biochemical functions of the protein products of many of these genes determined from comparisons with known proteins are also given in the Reference tables.

Viability Genes, Gene Components and Products Identified by Phenotypic Observations These genes were discovered and characterized from a much larger set of genes by experiments designed to find genes that cause serious disturbances in progeny survival, seed germination, development, embryo and/or seedling growth. In these experiments, viability genes were identified by either (1) ectopic expression of a cDNA in a plant or (2) mutagenesis of a plant genome. The plants were then cultivated and one or more of the following phenotypes, which varied from the parental wild-type was observed:

A. Gametophytic loss of progeny seedlings (detected from a parent on the basis of a linked herbicide resistance gene showing abnormal segregation ratios, as revealed by treating with herbicide)

B. Embryo death, resulting in some cases to loss of seed
C. Pigment variation in cotyledons and leaves, including absence of chlorophyll, which leads to seedling death.
  1. Abinos
  2. Yellow/greens
D. Cotyledons produced but no or few leaves and followed by seedling death.
E. Very small plantlets The genes identified in these experiments are shown in Tables X.

Viability Genes, Gene Components and Products Identified by Differential Expression Viability genes were also identified from a much larger set of genes by experiments designed to find genes whose mRNA products changed in concentration in response to applications of different herbicides to plants. Viability genes are characteristically differentially transcribed in response to fluctuating herbicide levels or concentrations, whether internal or external to an organism or cell. The MA_diff Table reports the changes in transcript levels of various viability genes in entire seedlings at 0, 4, 8, 12, 24, and 48 hours after a plant was sprayed with a Hoagland's nutrient solution enriched with either 2,4 D (Trimec), GLEAN®, Grassgetter, ROUNDUP®, or Finale herbicides as compared to seedlings sprayed with Hoagland's solution only.

The MA_diff Table(s) reports the transcript levels of the experiment (see EXPT ID: 108467, 107871, 107876, 108468, 107881, 108465, 107896, 108466, 107886, 107891, 108501). For transcripts that had higher levels in the samples than the control, a "+" is shown. A "−" is shown for when transcript levels were reduced in root tips as compared to the control. For more experimental detail see the Example section below.

Viability genes are those sequences that showed differential expression as compared to controls, namely those sequences identified in the MA_diff tables with a "+" or "−" indication.

Viability Genes Identified by Cluster Analyses of Differential Expression

Viability Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Viability genes is any group in the MA_clust that comprises a cDNA ID that also appears in Expt ID 108467, 107871, 107876, 108468, 107881, 108465, 107896, 108466, 107886, 107891, 108501 of the MA_diff table(s).

Viability Genes Identified by Correlation to Genes that Cause Physiological Consequences Additionally, the differential expression data and the phenotypic observations can be merged to identify pathways or networks of Viability genes. A group in the MA_clust is considered a Viability pathway or network if the group comprises a cDNA ID that also appears in Knock-in or Knock-out tables that causes one or more of the phenotypes described in section above.

Viability Genes Identified by Amino Acid Sequence Similarity

Viability genes from other plant species typically encode polypeptides that share amino acid similarity to the sequences encoded by corn and *Arabidopsis* Viability genes. Groups of Viability genes are identified in the Protein Group table. In this table, any protein group that comprises a peptide ID that corresponds to a cDNA ID member of a Viability pathway or network is a group of proteins that also exhibits Viability functions/utilities.

It is assumed that those gene activity changes in response to the toxic herbicides are either responsible, directly or indirectly, for cell death or reflect activation of defense pathways. These genes are therefore useful for controlling plant viability.

Examples of phenotypes, biochemical activities, or transcript profiles that can be modulated using selected viability gene components are described above and below.

III.D.8.b. Use of Viability Genes, Gene Components and Products to Modulate Phenotypes Deficiencies in viability genes can cause cell death at various rates and under various conditions. Viability genes can be divided into two classes; (1) those that lead to cell death under permissive growth conditions and (2) those that cause cell demise under restrictive conditions. Examples of the first class are viability genes which encode toxins or which participate in the programmed cell death pathway(s). Disruption of metabolic pathways, such as amino acid synthesis, may not cause death when the cell is supplemented with appropriate amino acids, but can cause death under more restrictive conditions.

Some deficiencies in viability genes identified cause the organism as a whole to die, while other genes cause death only of a specific subset of cells or organs. For example, genes identified from embryo viability phenotypes can cause an entire organism to die. In contrast, genes characterized from gametophytic lethals may inhibit cell growth only in a select set of cells. In addition, some viability genes may not cause an immediate demise. A seedling lethal phenotype is one such example, where a seed germinates and produces cotyledons but the plant dies before producing any true leaves. Yellow-green pigment mutants provide yet another set of examples. In some cases, the plant produces a number of yellow-green leaves but dies before producing any seed, due in part, to the necessity to produce chlorophyll in functioning chloroplasts to fix $CO_2$.

Viability genes, in which mutational deficiencies lead to death, carry no duplicates in the haploid plant genome. They thus may be especially likely to promote viability and vigor when expressed more optimally in a plant, in specific tissues or throughout the plant.

Proteins which lead to death when inactivated, and other proteins in the pathways in which they act, are potential targets for herbicides. In this kind of application, chemicals specifically capable of interacting with such proteins are discovered. Typically, this could be done by designing a gene involving the relevant viability gene, that also facilitates a rapid easily measured assay for the functioning of the protein product, and treating plants containing the new genes with the potential herbicides. Those chemicals specifically interfering with the protein activity can then easily be selected for further development.

Genes whose products interact directly with a herbicide can also be modified such that the herbicide no longer inactivates the protein. Such genes are useful for making herbicide resistant plants, valuable in agriculture.

Many of the genes activated or inactivated by the herbicides define genes involved in the pathways that protect the plant against damage and stresses. These genes and gene components, especially those regulating such pathways, are especially useful for enhancing the ability of plants to withstand specific stresses, including herbicides. [See the sections on Stress responsive genes, gene components and products.]

Genes that cause cellular death can be used to design new genes that cause death of specific cells and tissues and hence new valuable products. For example, activation of genes causing death in cells specifying seeds can be used to produce fruits lacking seeds. They can also be used to prevent cell death by pathogens and pests.

The genes and gene components of the instant invention are useful to modulate one or more processes that affect viability and vigor at the (1) cellular level; (2) organelle level; (3) organ level; or (4) overall organism level.

Phenotypes that are modulated by these genese and gene components include (1) at the cellular level: cell size, cell differentiation, cell division, cell longevity, cell position, and cytotoxins; (2) at the organelle level: chloroplasts and/or mitochondria; (3) at the organ level: flower number or size; seed size, number or composition (amino Acid, carbohydrates, lipid, and secondary metabolites); fruit size, number, or composition (amino Acid, carbohydrates, lipid, and secondary metabolites); fruit drop, fruit ripening; leaf (size, composition, amino acid, carbohydrates, lipid, and secondary metabolites, photoefficiency, abscission, or senescence); stem; or root; and (4) at the overall organism level: vigor (e.g. increased biomass), stress tolerance (e.g. cold, drought, heat, herbicide, oxidative, and salt); and pathogen resistance To regulate any of the phenotype(s) above, activities of one or more of the viability genes or gene products can be modulated in an organism and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (*Methods. Mol. Biol.* 82:259-266 (1998)) and/or screened for variants as in Winkler et al., *Plant Physiol.* 118: 743-50 and visually inspected for the desired phenotype or metabolically and/or functionally assayed.

III.D.8.c. Use of Viability Genes, Gene Components and Products to Modulate Biochemical Activities The viability genes, their components and/or products can be used to modulate processes, biochemical or metabolic activities and/or pathways such as those noted below. Such biological activities can be measured according to the citations included in the table below:

| PROCESS | BIOCHEMICAL OR METABOLIC ACTIVITIES AND/OR PATHWAYS | CITATIONS INCLUDING ASSAYS |
| --- | --- | --- |
| Amino Acid Synthesis | Aceto-lactate synthase | Hershey et al. (1999) Plant Mol. Biol. 40, 795-806 |
| Cell Wall Synthesis | Cellulose synthase | Peng et al. (2001) Plant Physiol. 126, 981-982 Kawagoe and Delmer (1997) Genet Eng. 19, 63-87 |

-continued

| PROCESS | BIOCHEMICAL OR METABOLIC ACTIVITIES AND/OR PATHWAYS | CITATIONS INCLUDING ASSAYS |
|---|---|---|
| Nucleotide Synthesis | Coenzyme A biosynthesis | Kupke et al. (2001) J. Biol. Chem. 276, 19190-19196 |
| Lipid Synthesis | Oleosin biosynthesis | Singh et al. (2000) Biochem. Soc. Trans. 28, 925-927<br>Zou et al. (1996). Plant Mol. Biol. 31, 429-433 |
| Hormone Signaling Pathways | Brassinolide and light signal transduction | Kang et al. (2001) Cell 105, 625-636 |
| Hormone Biosynthesis | Cytokinin biosynthesis | Takei et al, (2001) J. Biol. Chem. 276, 26405-26410 |
| Secondary Metabolites | Carotenoid biosynthesis | Estevez et al. (2001) J. Biol. Chem. 276, 22901-22909<br>Carol and Kuntz (2001) Trendy Plant Sci. 6, 31-36<br>Pogson and Rissler (2001) Phil. Trans. Roy. Soc. Lord. B 355, 1395-1400 |
| Clearing of Toxic Substances | Ubiquitination | |
| Growth, Differentiation And Development | Farnesylation<br>Nitrogen Metabolism | Pei et al (1998) Science 282: 287-290; Cutler et al. (1996) Science 273: 1239<br>Goupil et al (1998) J Exptl Botany 49: 1855-62 |
| Water Conservation And Resistance To Drought And Other Related Stresses | Stomatal Development And Physiology<br>Stress Response Pathways<br>Inhibition Of Ethylene Production Under Low Water Potential<br>Proline And Other Osmolite Synthesis And Degradation | Allen et al. (1999) Plant Cell 11: 1785-1798<br>Li et al. 2000 Science 287: 300-303<br>Burnett Et Al 2000. J. Exptl Botany 51: 197-205<br>Raschke (1987) In: Stomatal Function Zeiger et al. Eds., 253-279<br>Bush And Pages (1998) Plant Mol. Biol. 37: 425-35<br>Spollen Et Al (2000) Plant Physiol. 122: 967-976<br>Hare et al. (1998) Plant, Cell And Environment 21: 535-553; Hare et al. (1999) J. Exptl. Botany 50: 413-434 |
| Programmed cell death | Proteases<br>DNA endonucleases<br>Mitochondriae uncoupling proteins<br><br><br><br><br><br><br><br>Plasmalemma and Tonoplast Ion Channel Changes<br>Ca2+ Accumulation<br>K+ Efflux<br>Activation Of Kinases And Phosphatases | Kamens et al. (1995) J. Biol. Chem. 270, 15250-15256<br>Wang et al. (2001) Anticancer Res. 21, 1789-1794<br>Drake et al. (1996) Plant Mol. Biol 304, 755-767<br>Mittler and Lam (1995) Plant Cell 7, 1951-1962<br>Mittler and Lam (1995) Plant Physiol. 108, 489-493<br>Thelen and Northcote (1989) Planta 179, 181-195<br>Hanak and Jezek (2001) FEBS Lett. 495, 137-141<br>Macrobbie (1998) Philos Trans R Soc Lond B Biol Sci 353: 1475-88; Li et al (2000) Science 287: 300-303; Barkla et al. (1999) Plant Physiol. 120: 811-819<br>Lacombe et al. (2000) Plant Cell 12: 837-51; Wang et al. (1998) Plant Physiol 118: 1421-1429; Shi et al. (1999) Plant Cell 11: 2393-2406<br>Gaymard et al. (1998) Cell 94: 647-655<br>Jonak et al. (1996) Proc. Natl. Acad. Sci 93: 11274-79; |

| PROCESS | BIOCHEMICAL OR METABOLIC ACTIVITIES AND/OR PATHWAYS | CITATIONS INCLUDING ASSAYS |
|---|---|---|
| | | Sheen (1998) Proc. Natl. Acad. Sci. 95: 975-80; Allen et al. (1999) Plant Cell 11: 1785-98 |

Other biological activities that can be modulated by the viability genes, their components and products are listed in the Reference tables. Assays for detecting such biological activities are described in the Protein Domain table.

III.D.8.d. Use of Viability Genes, Gene Components and Products to Modulate Transcript Levels of Other Genes The expression of many genes is "up regulated" or "down regulated" following herbicide treatment and also in the leaf mutants, because some "viability" genes and their products are integrated into complex networks that regulate transcription of many other genes. Some "viability genes" are therefore useful for modifying the transcription of other genes and hence complex phenotypes, as described above. The data from differential expression experiments can be used to identify a number of types of transcript profiles of "viability genes", including "early responders," and "delayed responders", "early responder repressors" and "delayed repressors". Profiles of these different types responsive genes are shown in the Table below together with examples of the kinds of associated biological activities. "Up-regulated" profiles are those where the mRNA transcript levels are higher in the herbicide treated plants as compared to the untreated plants. "Down-regulated" profiles represent higher transcript levels in the untreated plant as compared to the herbicide treated plants.

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES WHOSE TRANSCRIPTS ARE CHANGED |
|---|---|---|---|
| Up Regulated Transcripts (Level At 4 Hr ≅ 0 Hr) or (Level At 4 Hr > 0 Hr) | Early Responders To: Gluphosinate Chlorsulfuron Glyphosate and/or 2, 4-D | Suppression of cell, tissue, organ or plant death following: Herbicide treatment or under stress Activation of cell, tissue, organ or plant death following: Herbicide treatment or under stress | Transcription Factors Transporters Change In Cell Membrane Structure Kinases And Phosphatases Germins, Germin-like proteins, Calcium-binding proteins and $H_2O_2$ generating and $H_2O_2$ neutralizing proteins. Transcription Activators Change In Chromatin Structure And/Or Localized DNA Topology Annexins, cell wall structural proteins |
| Up Regulated Transcripts (Level At 4 Hr < 12 Hr) | Delayed Responders to Gluphosinate, Chlorsulfuron, Glyphosate and/or 2, 4-D | Suppression of cell, tissue, organ or plant death following: Herbicide treatment or under stress Activation of cell, tissue, organ or plant death following: Herbicide treatment or under stress | Transcription Factors Specific Factors (Initiation And Elongation) For Protein Synthesis Lipid transfer proteins Myrosinase-binding proteins Sugar interconverting enzymes Maintenance Of mRNA Stability Maintenance Of Protein Stability Maintenance Of Protein-Protein Interaction Protein translocation factors RNA-binding proteins |

| TRANSCRIPT LEVELS | TYPE OF GENES WHOSE TRANSCRIPTS ARE CHANGED | PHYSIOLOGICAL CONSEQUENCES OF MODIFYING GENE PRODUCT LEVELS | EXAMPLES OF BIOCHEMICAL ACTIVITIES WHOSE TRANSCRIPTS ARE CHANGED |
|---|---|---|---|
| | | | Centromere and cytoskeleton proteins<br>Lipases<br>Zn/Cu transporters<br>Cell wall structural proteins |
| Down-Regulated Transcripts (Level At 0 Hr ≅ 4 Hr) or (Level At 0 Hr > 4 Hr) | Early Responder Repressors Of Stress Response State Of Metabolism Genes With Discontinued Expression Or UnsTable mRNA In Presence Of Herbicide or Abiotic Stress | Suppression of cell, tissue, organ or plant death following: Herbicide treatment or under stress Activation of cell, tissue, organ or plant death following: Herbicide treatment or under stress Zn/Cu transporters Cell wall structural proteins | Transcription Factors<br>Change In Protein Structure By Phosphorylation (Kinases) Or Dephosphoryaltion (Phosphatases)<br>Change In Chromatin Structure And/Or DNA Topology<br>$H_2O_2$ neutralizing proteins<br>Neutralizing proteins including SOD and GST |
| Down-Regulated Transcripts (Level At 4 Hr > 12 Hr) | Delayed Responder Repressors Of ABA Function State Of Metabolism Genes With Discontinued Expression Or Unstable mRNA In Presence Of herbicide or Abiotic Stress | Suppression of cell, tissue, organ or plant death following: Herbicide treatment or under stress Activation of cell, tissue, organ or plant death following: Herbicide treatment or under stress | Transcription Factors<br>Kinases And Phosphatases<br>Stability Of Factors For Protein Synthesis And Degradation<br>Amino Acid biosynthesis proteins including aspargive synthase<br>Ca-binding proteins<br>Lipid biosynthesis proteins<br>Lipases<br>Zn/Cu transporters<br>Cell wall structural proteins |

While viability modulating polynucleotides and gene products can act alone, combinations of these polynucleotides also affect growth and development.

Use of Promoters of Viability Genes, Gene Components and Products

Promoters of viability genes can include those that are induced by (1) destructive chemicals, e.g. herbicides, (2) stress, or (3) death. These promoters can be linked operably to achieve expression of any polynucleotide from any organism. Specific promoters from viability genes can be selected to ensure transcription in the desired tissue or organ. Proteins expressed under the control of such promoters can include those that can induce or accelerate death or those that can protect plant cells organ death. For example, stress tolerance can be increased by using promoters of viability genes to drive transcription of cold tolerance proteins, for example. Alternatively, promoters induced by apoptosis can be utilized to drive transcription of antisense constructs that inhibit cell death.

III.D.9. Histone Deacetylase (Axel) Responsive Genes, Gene Components and Products The deacetylation of histones is known to play an important role in regulating gene expression at the chromatin level in eukaryotic cells. Histone deacetylation is catalyzed by proteins known as histone deacetylases (HDAcs). HDAcs are found in multisubunit complexes that are recruited to specific sites on nuclear DNA thereby affecting chromatin architecture and target gene transcription. Mutations in plant HDAc genes cause alterations in vegetative and reproductive growth that result from changes in the expression and activities of HDAc target genes or genes whose expression is governed by HDAc target genes. For example, transcription factor proteins control whole pathways or segments of pathways and proteins also control the activity of signal transduction pathways. Therefore, manipulation of these types of protein levels is especially useful for altering phenotypes and biochemical activities.

Manipulation of one or more HDAc gene activities is useful to modulate the biological activities and/or phenotypes listed below. HDAc genes and gene products can act alone or in combination. Useful combinations include HDAc genes and/or gene products with similar biological activities, or members of the same, co-regulated or functionally related biochemical pathways. Such HDAc genes and gene products can function to either increase or dampen these phenotypes or activities.

Examples of genes whose expression is affected by alterations in HDAc activity are shown in the Reference and Sequence Tables. These genes and/or gene products are responsible for effects on traits such as inflorescence branching and seed production. They were discovered and characterized from a much larger set of genes by experiments designed to find genes whose mRNA products are affected by a decrease in HDAc gene activity. These experiments made use of an *Arabidopsis* mutant having severely reduced mRNA levels for the histone deactylase gene AtHDAC1.

Microarray technology allows monitoring of gene expression levels for thousands of genes in a single experiment. This is achieved by simultaneously hybridizing two differentially labeled fluorescent cDNA pools to glass slides that contain spots of DNA (Schena et al. (1995) Science 270: 467-70). The *Arabidopsis* Functional Genomics Consortium (AFGC) has recently made public the results from such microarray experiments conducted with AFGC chips containing 10,000 non-redundant ESTs, selected from 37,000 randomly sequenced ESTs generated from mRNA of different tissues and developmental stages.

The sequences of the ESTs showing at least two-fold increases or decreases over the controls were identified, compared to the Ceres full-length cDNA and genomic sequence databanks, and identical Ceres clones identified. MA_diff table reports the results of this analysis, indicating those Ceres clones which are up or down regulated over controls, thereby indicating the Ceres clones which are HDAc genes. The MA_diff Table(s) reports the transcript levels of the experiment (see EXPT ID: Axel (relating to SMD 6654, SMD 6655)). For transcripts that had higher levels in the samples than the control, a "+" is shown. A "−" is shown for when transcript levels were reduced in root tips as compared to the control. For more experimental detail see the Example section below.

Histone Deacetylase genes are those sequences that showed differential expression as compared to controls, namely those sequences identified in the MA_diff tables with a "+" or "−" indication.

Histone Deacetylase Genes Identified by Cluster Analyses of Differential Expression Histone Deacetylase Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Histone Deacetylase genes is any group in the MA_clust that comprises a cDNA ID that also appears in Expt ID Axel (relating to SMD 6654, SMD 6655) of the MA_diff table(s).

Histone Deacetylase Genes Identified by Correlation to Genes that Cause Physiological Consequences Additionally, the differential expression data and the phenotypic observations can be merged to identify pathways or networks of Histone Deacetylase genes. A group in the MA_clust is considered a Histone Deacetylase pathway or network if the group comprises a cDNA ID that also appears in Knock-in or Knock-out tables that causes one or more of the phenotypes described in section above.

Histone Deacetylase Genes Identified by Amino Acid Sequence Similarity

Histone Deacetylase genes from other plant species typically encode polypeptides that share amino acid similarity to the sequences encoded by corn and *Arabidopsis* Histone Deacetylase genes. Groups of Histone Deacetylase genes are identified in the Protein Group table. In this table, any protein group that comprises a peptide ID that corresponds to a cDNA ID member of a Histone Deacetylase pathway or network is a group of proteins that also exhibits Histone Deacetylase functions/utilities.

III.D.9.a. Use of Hdac Genes, Gene Components and Products to Modulate Phenotypes HDAc genes and gene products are useful to or modulate one or more phenotypes including growth rate; whole plant, including height, flowering time, etc.; seedling; organ; seed development; embryo; germination, and cell differentiation.

To improve any of the phenotype(s) above, activities of one or more of the HDAc genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Wu et al. (2000, Plant J 22: 19-27), Hu et al. (2000, J Biol Chem 275: 15254-64), Johnson and Turner (1999, Semin Cell Dev Biol 10: 179-88), Koyama et al. (2000, Blood 96: 1490-5), Wu et al. (2000, Plant J 22: 19-27), Li (1999, Nature Genetics 23: 5-6), Adams et al. (2000, Development 127: 2493-2502) and Lechner et al. (2000, Biochemistry 39: 1683-92).

III.D.9.b. Use of Hdac Development Genes, Gene Components and Products to Modulate Biochemical Activities The activities of one or more of the HDAc genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation And Development | Cell Differentiation | Koyama et al. (2000) Blood 96: 1490-5 |
| | Cell Cycle Progression | Hu et al. (2000) J Biol Chem 275: 15254-64 |
| Metabolism | Chromatin Structure | Hu et al. (2000) J Biol Chem 275: 15254-64 |

| PROCESS | BIOCHEMICAL OR METABOLIC ACTIVITIES AND/OR PATHWAYS | CITATIONS INCLUDING ASSAYS |
| --- | --- | --- |
| Reproduction And Seed Development | Gene Transcription And Chromatin Assembly Seed Development Seed Germination<br><br>Independent Embryo Fertilization Fertilization Independent Seed Development Megagametogenesis | Johnson and Turner (1999) Semin Cell Dev Biol 10: 179-88 Wu et al. (2000) Plant J 22: 19-27 Lechner et al. (2000) Biochemistry 39: 1683-92 Ohad et al. (1996) PNAS USA 93: 5319-24 Chaudhury et al. (1997) PNAS USA 94: 4222-28 Christensen et al. (1997) Sex Plant Reproduc 10: 49-64 |

Other biological activities that can be modulated by the HDAc genes and gene products are listed in the REFERENCE Table. Assays for detecting such biological activities are described in the Protein Domain table.

Profiles of these different HDAc genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
| --- | --- | --- | --- |
| Up Regulated Transcripts | Responders To HDAc Activity | Gene Repression Activity Cell Cycle Progression Chromatin Condensation Synthesis Of Metabolites And/Or Proteins Modulation Of Transduction Pathways Specific Gene Transcription Initiation | Transporters Metabolic enzymes Kinases and phosphatases Transcription activators Change in chromatin structure and/or localized DNA topology |
| Down-Regulated Transcripts | Responder To Hdac Inhibitors Genes With Discontinued Expression Or UnsTable Mrna In Presence Of Hdac | Negative Regulation Of Acetylation Pathways Changes In Pathways And Processes Operating In Cells Changes In Metabolism | Transcription factors Change in protein structure by phosphorylation (kinases) or dephosphorylation (phosphatases) Change in chromatin structure and/or DNA topology Stability of factors for protein synthesis and degradation Metabolic enzymes |

Use of Promoters of Histone Deacetylase Responsive Genes

Promoters of Histone Deacetylase responsive genes are useful for transcription of any desired polynucleotide or plant or non-plant origin. Further, any desired sequence can be transcribed in a similar temporal, tissue, or environmentally specific patterns as the Histone Deacetylase responsive genes where the desired sequence is operably linked to a promoter of a Histone Deacetylase responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E. Stress Responsive Genes, Gene Components and Products

III.E.1. Cold Responsive Genes, Gene Components and Products

The ability to endure low temperatures and freezing is a major determinant of the geographical distribution and productivity of agricultural crops. Even in areas considered suitable for the cultivation of a given species or cultivar, can give rise to yield decreases and crop failures as a result of aberrant, freezing temperatures. Even modest increases (1-2° C.) in the freezing tolerance of certain crop species would have a dramatic impact on agricultural productivity in some areas. The development of genotypes with increased freezing tolerance would provide a more reliable means to minimize crop losses and diminish the use of energy-costly practices to modify the microclimate.

Sudden cold temperatures result in modulation of many genes and gene products, including promoters. Examples of such cold responsive genes and gene products are shown in the Reference, Sequence, Protein Group, Protein Group Matrix tables, MA_diff and MA_clust tables These genes and/or products are responsible for effects on traits such as plant vigor and seed yield. They were discovered and characterized from a much larger set by experiments designed to find genes whose mRNA products changed in response to cold treatment.

Manipulation of one or more cold responsive gene activities is useful to modulate the biological activities and/or phenotypes listed below. Cold responsive genes and gene products can act alone or in combination. Useful combinations include cold responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of the levels of such proteins is especially useful for altering phenotypes and biochemical activities of plants. The MA_diff Table(s) reports the transcript levels of the experiment (see EXPT ID: 108578, 108579, 108533, 108534). For transcripts that had higher levels in the samples than the control, a "+" is shown. A "−" is shown for when transcript levels were reduced in root tips as compared to the control. For more experimental detail see the Example section below.

Cold genes are those sequences that showed differential expression as compared to controls, namely those sequences identified in the MA_diff tables with a "+" or "−" indication.

Cold Genes Identified by Cluster Analyses of Differential Expression

Cold Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Cold genes is any group in the MA_clust that comprises a cDNA ID that also appears in Expt ID 108578, 108579, 108533, 108534 of the MA_diff table(s).

Cold Genes Identified by Correlation to Genes that Cause Physiological Consequences Additionally, the differential expression data and the phenotypic observations can be merged to identify pathways or networks of Cold genes. A group in the MA_clust is considered a Cold pathway or network if the group comprises a cDNA ID that also appears in Knock-in or Knock-out tables that causes one or more of the phenotypes described in section above.

Cold Genes Identified by Amino Acid Sequence Similarity

Cold genes from other plant species typically encode polypeptides that share amino acid similarity to the sequences encoded by corn and *Arabidopsis* Cold genes. Groups of Cold genes are identified in the Protein Group table. In this table, any protein group that comprises a peptide ID that corresponds to a cDNA ID member of a Cold pathway or network is a group of proteins that also exhibits Cold functions/utilities.

Such cold responsive genes and their products can function to either increase or dampen the phenotypes and activities below either in response to cold treatment or in the absence of cold temperature fluctuations.

Further, promoters of cold responsive genes, as described in the Reference tables, for example, are useful to modulate transcription that is induced by ABA or any of the following phenotypes or biological activities below.

III.E.1.a. Use of Cold-Responsive Genes to Modulate Phenotypes

Cold responsive genes and gene products are useful to or modulate one or more phenotypes including cold tolerance, below 7° C., for example, cells, organelles, proteins, dehydration resistance, growth rate, whole plant, including height, bolting time, etc., organs, biomass, fresh and dry weight during any time in plant life, such as maturation, number, size, and/or weight of flowers, seeds, branches, or leaves; seed yield in terms of number, size, weight, harvest index, or water content, fruit yield in terms of number, size, weight, harvest index, water content.

To regulate any of the phenotype(s) above, activities of one or more of the cold responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance to Steponokus et al. (1993) Biochimica et Biophysica Acta 1145: 93-104; Quinn (1988) Symp Soc. Exp. Biol. 42: 237-258; Bectold and Pelletier (1998) Methods Mol. Biol. 82: 259-266; Kasuga et al.(1999) Nature Biotechnology 17: 287-291; Guy et al. (1998) Cryobiology 36: 301-314; or Liu et al. (1998) Plant Cell 10: 1391-1406.

III.E.1.b. Use of Cold-Responsive Genes to Modulate Biochemical Activities

The activities of one or more of the cold responsive genes can be modulated to change biochemical or metabolic activities and/or pathways such as those noted below. Such biological activities are documented and can be measured according to the citations above and those included in the Table below:

| PROCESS | BIOCHEMICAL OR METABOLIC ACTIVITIES AND/OR PATHWAYS | CITATIONS INCLUDING ASSAYS |
| --- | --- | --- |
| Cold Tolerance | Viability Of Plant Protoplasts At Low Temperatures. | Steponkus (1998) PNAS USA 95: 14570-14575 |
| | Viability Of Yeast At Low Temperatures. | Schirmer et al. (1994) Plant Cell 6: 1899-1909 |
| | Complementation Of Yeast Tsp Mutant | Zentella et al. (1999) Plant Physiology, 119: 1473-1482 |
| | Viability Of *E. Coli* At Low Temperatures. | Yeh et. al. (1997) PNAS 94: 10967-10972 |
| | Induction Of Cold Shock Response Genes | Pearce (1999) Plant Growth Regulation 29: 47-76. |
| Lipid Composition | Altered Composition Of Membrane Fatty Acids | Sayanova et al. (1999) Journal of Experimental Botany 50: 1647-1652 Sayanova (1997) PNAS USA 94: 4211-4216 |
| | ALTERATION OF LIPOXYGENASE ENZYME ACCUMULATION AND ACTIVITY | Porta et al. (1999) Plant and Cell Physiology 40: 850-858. |
| Protein Composition | PROTEIN DENATURATION | Wisniewski et al.(1999) Physiologia Plantarum 105: 600-608 |
| | Protein Hydrophilicity | Steponkus (1998) PNAS USA 95: 14570-14575 |
| Modulation of Transcription Induced by Low Temperatures | Induced Transcription Factors And Other Dna Binding Proteins Transcription Of Specific Genes | Current Protocols in Molecular Biology/edited by Frederick M. Ausubel.. [et al.]. New York: Published by Greene Pub. Associates and Wiley-Interscience: J. Wiley, c1987. Steponkus (1998) PNAS USA 95: 14570-14575 Kadyrzhanova et al., Plant Mol Biol (1998) 36(6): 885-895; and Pearce et al., Plant Physiol (1998) 117(3): 787-795 |
| Signal Transduction | Plasma Membrane Proteins | Goodwin et al., Plant Mol Biol (1996) 31(4) 777-781; and Koike et al., Plant Cell Physiol (1997) 38(6): 707-716 |
| Oxygen Scavengers | Glutathione | Kocsy et al., Planta (2000) 210(2): 295-301 |
| | Accumulation Active $O_2$ and $H_2O_2$ Scavengers | Tao et al., Cryobiology (1998) 37(1): 38-45 |
| Dehydration | Dehydrin | Ismail et al., Plant Physiol (1999) 120(1): 237-244 |
| | Transcription of mRNA | Kaye et al., Plant Physiol (1998) 116(4): 1367-1377 |
| Metabolism | Soluble Sugars and/or Proline | Wanner et al., (1999) Plant Physiol 120(2): 391-400 |
| RNA/DNA Chaperone | Stabilization of RNA/DNA through RNA binding and modulation of RNA translation through RNA binding and or unwinding. | Jiang, Weining et al., (1997) Journal of Biological Chemistry, 272: 196-202. Fukunaga et al., (1999) Journal of Plant Research, 112: 263-272. |
| Protein Chaperone | Stabilize protein structure and facilitate protein folding | Forreiter and Nover (1998) *Journal of Biosciences* 23: 287-302 |

Other biological activities that can be modulated by the cold responsive genes and their products are listed in the Reference tables. Assays for detecting such biological activities are described in the Protein Domain table.

Cold responsive genes are characteristically differentially expressed in response to fluctuating cold temperature levels, whether internal or external to an organism or cell. The MA_diff table reports the changes in transcript levels of various cold responsive genes in the aerial parts of seedlings at 1 and 6 hours at 4° C. in the dark as compared to aerial parts of seedlings covered with aluminium foil, and grown at 20° C. in the growth chamber.

The data from this time course can be used to identify a number of types of cold responsive genes and gene products, including "early responders" and "delayed responders". Profiles of these different cold responsive genes are shown in the Table below together with examples of the kinds of associated biological activities.

| GENE EXPRESSION LEVELS | FUNCTIONAL CATEGORY OF GENE | TYPE OF BIOLOGICAL ACTIVITY | EXAMPLES OF BIOCHEMICAL ACTIVITIES OF GENE PRODUCTS |
|---|---|---|---|
| Upregulated Genes (Level At 1 h ≅ 6 h) or (Level At 1 h > 6 h) | Early Responders To Cold | Perception Of Cold Induction Of Cold Response Signal Transduction Pathways Initiating Specific Gene Transcription Osmotic Adjustment Alteration Of Lipid Composition. Ice Nucleation Inhibition Mitigation Of Dehydration By Sequestering Water | Transcription Factors Kinases And Phosphatases Amino Acid Sugar And Metabolite Transporters Carbohydrate Catabolic And Anabolic Enzymes. Lipid Biosynthesis Enzymes Lipid Modification Enzymes, Example Desaturases Ice Crystal Binding Proteins Hydrophilic Proteins |
| | Stress Response | Repression Of General Biochemical Pathways To Optimize Cold Response Pathways. Stabilization Of Protein/Enzyme Activity At Low Temperature Protection Against Oxidative Stress Anaerobic Metabolism | Transcription Factors Kinases And Phosphatases Protein Stability Factors mRNA Stability Factors mRNA Translation Factors Protein Turnover Factors Oxygen Radical Scavengers, Example-Peroxidases Energy Generation Enzymes EtOH Detoxification |
| Upregulated Genes (Level At 1 h < 6 h) | Delayed Responders To Cold Stress Cold Acclimation Genes | Respiration, Photosynthesis And Protein Synthesis Carbohydrate And Amino Acid Solute Accumulation Increased Fatty Acid Desaturation To Increase Lipid Membrane Stability Increased Accumulation Or Activity Of Oxidative Stress Protection Proteins Stabilization Of Protein/Enzyme Activity At Low Temperature Protection Against Oxidative Stress | Transcription Factors Kinases And Phosphatases Protein Stability Factors mRNA Stability Factors mRNA Translation Factors Protein Turnover Factors Oxygen Radical Scavengers, Peroxidase Metabolic Enzymes |

-continued

| GENE EXPRESSION LEVELS | FUNCTIONAL CATEGORY OF GENE | TYPE OF BIOLOGICAL ACTIVITY | EXAMPLES OF BIOCHEMICAL ACTIVITIES OF GENE PRODUCTS |
|---|---|---|---|
| | Stress Response Genes | Extracellular Matrix Modification Stabilization Of Protein/Enzyme Activity At Low Temperature Protection Against Oxidative Stress Anaerobic Metabolism | Transcription Factors Kinases And Phosphatases Protein Stability Factors mRNA Stability Factors mRNA Translation Factors Protein Turnover Factors Oxygen Radical Scavengers, Example- Peroxidase Energy Generation Enzymes, Etoh Detoxification |
| Downregulated (Level At 1 h ≅ 6 h) (Level At 6 h > 1 h) | Early Responder Repressors Of Cold Stress Metabolism | Negative Regulation Of Cold Signal Transduction Pathways Released | Transcription Factors Kinases And Phosphatases Protein Stability Factors mRNA Stability Factors mRNA Translation Factors Protein Turnover Factors |
| | Genes With Discontinued Expression Or UnsTable mRNA In Cold | Negative Regulation Of Cold Induced Transcription Reduced Reduction In Gene Expression In Pathways Not Required Under Cold Conditions Induced mRNA Turnover | Cold Repressed Metabolic Pathway Proteins Factors Coordinating And Controlling Central C and N Metabolism Storage Proteins |
| Down-Regulated Transcripts (Level At 1 h > 6 h) | Delayed Responder Repressors Of Cold Stress Metabolism Genes With Discontinued Expression Or UnsTable mRNA In Cold | Maintenance Of Cold Induced State Of Metabolism Reduction In Gene Expression For Pathways Not Required Under Cold Conditions Induced mRNA Turnover | Transcription Factors Kinases And Phosphatases Protein Stability Factors mRNA Stability Factors mRNA Translation Factors Protein Turnover Factors Cold Repressed Metabolic Pathway Proteins Factors Coordinating And Controlling Central C and N Metabolism Storage Proteins |

Further, any desired sequence can be transcribed in similar temporal, tissue, or environmentally specific patterns as the cold responsive genes when the desired sequence is operably linked to a promoter of a cold responsive gene.

III.E.2. Heat Responsive Genes, Gene Components and Products

The ability to endure high temperatures is a major determinant of the geographical distribution and productivity of agricultural crops. Decreases in yield and crop failure frequently occur as a result of aberrant, hot conditions even in areas considered suitable for the cultivation of a given species or cultivar. Only modest increases in the heat tolerance of crop species would have a dramatic impact on agricultural productivity. The development of genotypes with increased heat tolerance would provide a more reliable means to minimize crop losses and diminish the use of energy-costly practices to modify the microclimate.

Changes in temperature in the surrounding environment or in a plant microclimate results in modulation of many genes and gene products. Examples of such heat stress responsive genes and gene products are shown in the Reference, Sequence, Protein Group, Protein Group Matrix, MA_diff and MA_clust tables. These genes and/or products are responsible for effects on traits such as plant vigor and seed yield. They were discovered and characterized from a much larger set by experiments designed to find genes whose mRNA products changed in response to high temperatures.

While heat stress responsive polynucleotides and gene products can act alone, combinations of these polynucleotides also affect growth and development. Useful combinations include different heat stress responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of a heat stress responsive polynucleotide and/or gene product with other environmentally responsive polynucleotide is also useful because of the interactions that exist between stress pathways, pathogen stimulated pathways, hormone-regulated pathways, nutritional pathways and development. Here, in addition to polynucleotides having similar transcription profiles and/or biological activities, useful combinations include polynucleotides that may have different transcription profiles, but which participate in common or overlapping pathways. The MA_diff Table(s) reports the transcript levels of the experiment (see EXPT ID: 108576, 108577, 108522, 108523). For transcripts that had higher levels in the samples than the control, a "+" is shown. A "−" is shown for when transcript levels were reduced in root tips as compared to the control. For more experimental detail see the Example section below.

Heat genes are those sequences that showed differential expression as compared to controls, namely those sequences identified in the MA_diff tables with a "+" or "−" indication.

Heat Genes Identified by Cluster Analyses of Differential Expression

Heat Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Heat genes is any group in the MA_clust that comprises a cDNA ID that also appears in Expt ID 108576, 108577, 108522, 108523 of the MA_diff table(s).

Heat Genes Identified by Correlation to Genes that Cause Physiological Consequences Additionally, the differential expression data and the phenotypic observations can be merged to identify pathways or networks of Heat genes. A group in the MA_clust is considered a Heat pathway or network if the group comprises a cDNA ID that also appears in Knock-in or Knock-out tables that causes one or more of the phenotypes described in section above.

Heat Genes Identified by Amino Acid Sequence Similarity

Heat genes from other plant species typically encode polypeptides that share amino acid similarity to the sequences encoded by corn and *Arabidopsis* Heat genes. Groups of Heat genes are identified in the Protein Group table. In this table, any protein group that comprises a peptide ID that corresponds to a cDNA ID member of a Heat pathway or network is a group of proteins that also exhibits Heat functions/utilities.

Such heat stress responsive genes and gene products can function either to increase or dampen the above phenotypes or activities either in response to changes in temperature or in the absence of temperature fluctuations.

Further, promoters of heat responsive genes, as described in the Reference tables, for example, are useful to modulate transcription that is induced by heat or any of the following phenotypes or biological activities below.

III.E.2.a. Use of Heat Stress Responsive Genes to Modulate Phenotypes

Heat stress responsive genes and gene products can be used to alter or modulate one or more phenotypes including heat tolerance (above 20° C., 23° C., 27° C., 30° C., 33° C., 37° C., 40° C. or 42° C.), heat tolerance of of cells, of organelles, of proteins, of cells or organelles dehydration resistance, growth rate, whole plant, including height, bolting time, etc., organs, biomass, fresh and dry weight during any time in plant life, such as maturation, number, size, and weight of flowers, seeds, branches, or leaves; seed yield in number, size, weight, harvest index; fruit yield in terms of number, size, weight, or harvest index, stress responses such as mediation of response to desiccation, drought, salt, disease, wounding, cold and other stresses, and reproduction To regulate any of the phenotype(s) above, activity of one or more of the heat stress responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Queitsch et al. (2000, The Plant Cell 12: 479-92).

III.E.2.b. Use of Heat Stress Responsive Genes to Modulate Biochemical Activities The activities of one or more of the heat stress responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATION INCLUDING ASSAY |
|---|---|---|
| Cell Growth and Differentiation | Regulation And Molecular Chaperones Maintenance Of Native | Wisniewski et al. (1999) Physiolgia Plantarum 105: 600-608 |
| | Conformation (Cytosolic Proteins) Reactivation Of Aggregation And Protein Folding Autoregulation Of Heat | Queitsch et al. (2000) The Plant Cell 12: 479-92 Lee and Vierling (2000) Plant Physiol. 122: 189-197 |

-continued

| PROCESS | BIOCHEMICAL OR METABOLIC ACTIVITIES AND/OR PATHWAYS | CITATION INCLUDING ASSAY |
|---|---|---|
| | Shock Response Regulation Of Translational Efficiency Regulation Of Kinase Activity Regulation Of Calcium Mediated Signal Transduction | Schwechheimer (1998) Plant Mol Biol 36: 195-204 Shi et al. (1998) Genes and Development 12: 654-66 Wells et al. (1998) Genes and Development 12: 3236-51 Lis et al. (2000) Genes and Development 14: 792-803 Malho, R.(1999) Plant Biology 1: 487-494. Sheen, Jen.(1996) Science 274: 1900-1902. Farmer, P. et al., (1999.) Biochimica et Biophysica Acta 1434: 6-17. |
| Gene regulation | Transcriptional Regulation Of Heat Induced Proteins Through DNA Binding Proteins. Transcriptional Regulation Of Heat Induced Proteins Through Protein-Protein Interactions Between DNA Binding Proteins And Coactivators. Transcriptional Regulation Of Heat Induced Proteins Through Protein Phosphorylation And Dephosphorylation Transcriptional Regulation Of Thermal Stress Induced Genes By Protein-Protein Interactions. Translational Regulation Of Thermal Stress Induced Messenger Rnas. Transcriptional Regulation Of Heat Induced Genes Through Chromatin Remodeling. | Current Protocols in Molecular Biology/edited by Frederick M. Ausubel.. [et al.]. New York: Published by Greene Pub. Associates and Wiley-Interscience: J. Wiley, c1987. Steponkus (1998) PNAS USA 95: 14570-14575 Gubler et al. (1999) Plant Journal 17: 1-9 Glenn et al. (1999) Journal of Biological Chemistry, 274: 36159-36167 Zhou et al., (1997) EMBO Journal16: 3207-3218. Sessa et al., (2000) EMBO Journal 19: 2257-2269. Burnett et al., (2000) Journal of Experimental Botany. 51: 197-205. Osterlund et al., (2000) Nature 405: 462-466. Gross and Watson (1998) Canadian Journal of Microbiology, 44: 341-350 Luo, R. X., Dean, D. C. (1999) Journal of the National Cancer Institute 91: 1288-1294. Chromatin protocols (1999) edited by Peter B. Becker. Totowa, N. J.: Humana Press. |
| Cell Structure | Thermal Stress Protection By Plasma Membrane Anchored Or Secreted And/Or Cell Wall Associated Proteins. | Goodwin et al. (1996) Plant Mol Biol 31(4) 777-781; and Koike et al. (1997) Plant Cell Physiol 38(6): 707-716 |

-continued

| PROCESS | BIOCHEMICAL OR METABOLIC ACTIVITIES AND/OR PATHWAYS | CITATION INCLUDING ASSAY |
|---|---|---|
| Signal Transduction | Regulation Of Thermal Stress Pathways And Protein Activity By Protein Kinase And Protein Phosphatase Mediated Phosphorylation And Dephosphorylation Respectively. | Jonak (1996) Proceedings of the National Academy of Sciences of the United States of America, 93: 11274-11279. Monroy. et al., (1998) Analytical Biochemistry 265: 183-185. |
| Photosynthesis | Regulation Of Photoprotection And Repair Of Photosystem II | Schroda et al. (1999) The Plant Cell 11: 1165-178 Oh and Lee (1996) J Plant Biol. 39: 301-07 |
| Stress Response | Regulation Of Cytosol Peroxide Levels Regulation Of Heat Shock Factor Binding Regulation Of Protein Stability During Thermal Stress Nucleocytoplasmic Export Of Heat Shock Protein Mrnas Regulation/Reconfiguration Of Cell Architecture Regulation Of Pathways For Reactivation Of "Damaged" And/Or Denatured Proteins Regulation Of Protein Degradation During Thermal Stress. Regulation Of Osmotic Potential During Thermal Stress. Regulation Of Universal Stress Protein Homologue Activity By Phosphorylation And Dephosphorylation. Regulation Of Dehydrin, LEA-Like And Other Heat STable Protein Accumulation | Dat et al. (1998) Plant Physiol 116: 1351-1357 Kurek et al. (1999) Plant Physiol 119: 693-703 Storozhenko et al. (1998) Plant Physiol 118: 1005-14 Soto et al. (1999) Plant Physiol 120: 521-28 Yeh et al. (1997) PNAS 94: 10967-10972 Winkler et al. (1998) Plant Physiol 118: 743-50 Saavedra et al. (1997) Genes and Development 11: 2845-2856 Parsell and Lindquist (1993). Ann. Rev. Genet. 27: 437-496. Parsell and Lindquist (1993). Ann. Rev. Genet. 27: 437-496. Georgopoulos and Welch (1993). Ann Rev. Cell Biol. 9: 601-634. Vierstra, Richard D. (1996) Plant Molecular Biology, 32: 275-302. Vierstra, Richard D.; Callis, Judy. (1999) Plant Molecular Biology, 41: 435-442. Liu, J. et al., (1998)Plant Science 134: 11-20. Freestone, P. 1997et al., Journal of Molecular Biology, v. 274: 318-324. Robertson, A. J. (1994) Plant Physiology 105: 181-190. |

Other biological activities that can be modulated by the heat stress responsive genes and gene products are listed in the Reference tables. Assays for detecting such biological activities are described in the Protein Domain table.

Heat stress responsive genes are characteristically differentially transcribed in response to fluctuating temperatures, whether internal or external to an organism or cell. The MA_diff table reports the changes in transcript levels of various heat stress responsive genes in aerial tissues at 1 and 6 hours after plants were placed at 42° C. as compared to aerial tissues kept at 20° C. growth chamber temperature.

The data from this time course can be used to identify a number of types of heat stress responsive genes and gene products, including "early responders to heat stress," "delayed responders to heat stress," "early responder repressors," and "delayed repressor responders." Profiles of these different heat stress responsive genes are shown in the Table below together with examples of the kinds of associated biological activities.

| GENE EXPRESSION LEVELS | FUNCTIONAL CATEGORY OF GENE | PHYSIOLOGICAL CONSEQUENCES | EXAMPLES OF BIOCHEMICAL ACTIVITIES/GENE PRODUCTS |
|---|---|---|---|
| Up Regulated Transcripts | Early Responders To Heat Stress | Heat Stress Perception Modulation Of Heat | Transcription Factors |

-continued

| GENE EXPRESSION LEVELS | FUNCTIONAL CATEGORY OF GENE | PHYSIOLOGICAL CONSEQUENCES | EXAMPLES OF BIOCHEMICAL ACTIVITIES/GENE PRODUCTS |
|---|---|---|---|
| (Level At 1 h ≅ 6 h) Or (Level At 1 h > 6 h) | | Stress Response Transduction Pathways Specific Gene Transcription Initiation Conditional Shift In Preferential Translation Of Transcripts Changes In Cell Architecture To Optimize Cell Adaptation To Heat Stress | Transporters Changes In Cell Membrane Structure Kinases And Phosphatases Transcription Activators Changes In Chromatin Structure And/Or Localized Dna Topology Modification Of Pre-Existing Translation Factors By Phosphorylation (Kinases) Or Dephosphorylation (Phosphatases) Synthesis Of New Translation Factors Stability Of Mediators Of Protein-Protein Interaction Heat Shock Proteins Changes In Organelle Structures, Membranes And Energy-Related Activities Proteins To Catalyse Metabolic Turnover |
| Up Regulated Transcripts (Level At 1 h < 6 h) | "Delayed" Responders Maintenance Of Heat Stress Response | Maintenance Of Response To Heat Stress Maintenance Of Protein Stability And Conformation | Transcription Factors Specific Factors (Initiation And Elongation) For Protein Synthesis Maintenance Of Mrna Stability Heat Shock Proteins Changes In Organelle Structures, Membranes And Energy-Related Activities Proteins To Catalyse Metabolic Turnover. Stability Of Mediators Of Protein-Protein Interaction |
| Down-Regulated Transcripts (Level At 1 h ≅ 6 h) Or (Level At 6 h > 1 h) | Early Responder Repressors Of "Normal" State Of Metabolism Genes With Discontinued Expression Or UnsTable mRNA In Presence Of Heat Stress | Negative Regulation Of Heat Stress Response Released Changes In Biochemical And Signal Transduction Pathways And Processes Operating In Cells Reorientation Of Metabolism | Transcription Factors And Activators Change In Protein Structure By Phosphorylation (Kinases) Or Dephosphoryaltion (Phosphatases) Change In Chromatin Structure And/Or Dna Topology |
| Down-Regulated Transcripts (Level At 1 hr > 6 hr) | Delayed Repressors Of "Normal" State Of Metabolism Genes With | Maintenance Of Heat Stress Response Maintenance Of Pathways Released From Repression | Transcription Factors And Activators Kinases And Phosphatases |

| GENE EXPRESSION LEVELS | FUNCTIONAL CATEGORY OF GENE | PHYSIOLOGICAL CONSEQUENCES | EXAMPLES OF BIOCHEMICAL ACTIVITIES/GENE PRODUCTS |
|---|---|---|---|
| | Discontinued Expression Or UnsTable mRNA In Presence Of Heat Stress | Changes In Pathways And Processes Operating In Cells Reorientation Of Metabolism | Stability Of Factors For Protein Translation |

Further, any desired sequence can be transcribed in similar temporal, tissue, or environmentally specific patterns as the heat responsive genes when the desired sequence is operably linked to a promoter of a heat responsive gene.

III.E.3. Drought Responsive Genes, Gene Components and Products

The ability to endure drought conditions is a major determinant of the geographical distribution and productivity of agricultural crops. Decreases in yield and crop failure frequently occur as a result of aberrant, drought conditions even in areas considered suitable for the cultivation of a given species or cultivar. Only modest increases in the drought tolerance of crop species would have a dramatic impact on agricultural productivity. The development of genotypes with increased drought tolerance would provide a more reliable means to minimize crop losses and diminish the use of energy-costly practices to modify the microclimate.

Drought conditions in the surrounding environment or within a plant, results in modulation of many genes and gene products. Examples of such drought responsive genes and gene products are shown in the Reference and Sequence Tables. These genes and/or products are responsible for effects on traits such as plant vigor and seed yield. They were discovered and characterized from a much larger set by experiments designed to find genes whose mRNA products changed in response to availability of water.

While drought responsive polynucleotides and gene products can act alone, combinations of these polynucleotides also affect growth and development. Useful combinations include different drought responsive polynucleotides and/or gene products that have similar transcription profiles or similar biological activities, and members of the same or similar biochemical pathways. Whole pathways, or segments of pathways are controlled by transcription factor proteins and proteins controlling the activity of signal transduction pathways. Therefore, manipulation of the levels of such proteins is especially useful for altering phenotypes and biochemical activities of plants. In addition, the combination of a drought responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in a common pathway. The MA_diff Table(s) reports the transcript levels of the experiment (see EXPT ID: 108572, 108573, 108502, 108503, 108504, 108556, 108482, 108483, 108473, 108474, 108477). For transcripts that had higher levels in the samples than the control, a "+" is shown. A "−" is shown for when transcript levels were reduced in root tips as compared to the control. For more experimental detail see the Example section below.

Drought genes are those sequences that showed differential expression as compared to controls, namely those sequences identified in the MA_diff tables with a "+" or "−" indication.

Drought Genes Identified by Cluster Analyses of Differential Expression

Drought Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Drought genes is any group in the MA_clust that comprises a cDNA ID that also appears in Expt ID 108572, 108573, 108502, 108503, 108504, 108556, 108482, 108483, 108473, 108474, 108477 of the MA_diff table(s).

Drought Genes Identified by Correlation to Genes that Cause Physiological Consequences Additionally, the differential expression data and the phenotypic observations can be merged to identify pathways or networks of Drought genes. A group in the MA_clust is considered a Drought pathway or network if the group comprises a cDNA ID that also appears in Knock-in or Knock-out tables that causes one or more of the phenotypes described in section above.

Drought Genes Identified by Amino Acid Sequence Similarity

Drought genes from other plant species typically encode polypeptides that share amino acid similarity to the sequences encoded by corn and *Arabidopsis* Drought genes. Groups of Drought genes are identified in the Protein Group table. In this table, any protein group that comprises a peptide ID that corresponds to a cDNA ID member of a Drought pathway or network is a group of proteins that also exhibits Drought functions/utilities.

Such drought responsive genes and gene products can function to either increase or dampen the above phenotypes or activities either in response to drought conditions or in the absence of drought conditions. Further, promoters of drought responsive genes, as described in the Reference tables, for example, are useful to modulate transcription that is induced by drought or any of the following phenotypes or biological activities below.

More specifically, drought responsive genes and gene products are useful to or modulate one or more phenotypes including growth, roots, stems, buds, leaves, development, cell growth, leaves, fruit development, seed development, senescence, stress responses, and mediates response to desiccation, drought, salt and cold.

Further, any desired sequence can be transcribed in similar temporal, tissue, or environmentally specific patterns as the drought responsive genes when the desired sequence is operably linked to a promoter of a drought responsive gene.

To produce the desired phenotype(s) above, one or more of the drought response genes or gene products can be tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259- 266) and/or screened for variants as in Winkler et al. (1998) Plant Physiol 118: 743-50 and visually inspected for the desired phenotype or metabolically and/or functionally assayed according to Ruzin (1999, In: Plant Microtechnique and Microscopy, Oxford University Press, London) and Khanna-Chopra et al. (1999, BBRC 255:324-7).

Alternatively, the activities of one or more of the drought responsive genes can be modulated to change biochemical or metabolic activities and/or pathways such as those noted below. Such biological activities can be measured according to the citations included in the Table below:

| GENERAL CATEGORY | BIOCHEMICAL OR METABOLIC ACTIVITIES AND/OR PATHWAYS | ASSAY |
| --- | --- | --- |
| Cell Growth and Differentiation | Preservation of Leaf Sub-Cellular Structures Including Photosynthetic Apparatus | Jagtap et al. (1998) J Exptl Botany 49: 1715-1721 |
| | Preservation of Cell Membrane Structures | Munne-Bosch and Alegre (2000) Planta 210: 925-31 |
| | Regulation of Stomatal development and Physiology | Menke et al. (2000) Plant Physiol. 122: 677-686. |
| | Regulation of Factors Involved in the Drought-adapted change in cell ultrastructure | Harrak et al. (1999) Plant Physiol. 121: 557-564. |
| Physiology | Modulation of Transpiration | Allen et al. (1999) Plant Cell 11: 1785-98 |
| | | Li et al. (2000) Science 287: 300-303 |
| | | Burnett et al. (2000) J Exptl Bot 51: 197-205 |
| | | Raschke (1987) In: Stomatal function, Zeiger et al., Eds, 253-79 |
| | Modulation of Photosynthesis | Sung and Krieg (1979) Plant Physiol 64: 852-56 |
| | Regulation of Epicuticular Wax Biosynthesis | Rhee et al. (1998) Plant Physiol 116: 901-11 |
| | Regulation of Carotenoid Biosynthesis | Alegre (2000) Planta 210: 925-31 |
| | | Loggini et al (2000) Plant Physiol 119: 1091 |
| Stress Response | Modulation of Leaf Rolling to minimize water loss | Taiz and Zeiger (1991) In: Plant Physiology, Benjamin/Cummings Publishing Co., Redwood City, pp 346-70 |
| | Modulation of Osmolite Synthesis | Hare et al. (1998) Plant, Cell and Environment 21: 535-553 |
| | | Huan et al. (2000) Plant Physiol 122: 747-756 |
| | Regulation of gene transcriptional activity specific to the establishment of drought tolerance | Hare et al. (1999) J. Exptl. Botany 333: 413-434. |
| | Regulation of protein degradation and reactivation during drought stress condition | Lee and Vierling (2000) Plant Physiol. 122: 189-197 |
| | Modulation/reconfiguration of translation machineries ("recycling" mechanisms) adapTable to drought condition | Lis et al. (2000) Genes and Development 14: 792-803 |
| Signal Transduction | Regulation of Ion Sequestration | Bush and Jones (1987) Cell Calcium 8: 455-72 |
| | Regulation of Nuclear Targeted Protein Transport | Ferringno and Silver (1999) Methods in Cell Biology 58: 107-22 |
| | Regulation of Cytoplasmic Ca+2 | Shi et al. (1999) Plant Cell 11: 2393-2406 |
| | Regulation of Kinase Synthesis and Activity | Li et al. (2000) Science 287-300-03 |
| | Modulation of Molecular Chaperone Activity | Mayhew et al (1996) Nature 379: 420-26 |
| | | Kimura et al. (1995) Science 268: 1362-1365. |

Other biological activities that can be modulated by the drought responsive genes and gene products are listed in the Reference Tables. Assays for detecting such biological activities are described in the Protein Domain table.

Drought responsive genes are characteristically differentially transcribed in response to drought conditions, whether internal or external to an organism or cell. The MA_diff table(s) report(s) the changes in transcript levels of various drought responsive genes at 1 and 6 hours after aerial tissues were isolated and left uncovered at room temperature on 3 MM paper, as compared to isolated aerial tissues placed on 3 MM paper wetted with Hoagland's solution. The data from this time course can be used to identify a number of types of drought responsive genes and gene products, including "early responders," and "delayed responders." Profiles of these different drought responsive genes are shown in the Table below together with examples of the kinds of associated biological activities.

| GENE EXPRESSION LEVELS | FUNCTIONAL CATEGORY OF GENE | PHYSIOLOGICAL CONSEQUENCES | EXAMPLES OF BIOCHEMICAL ACTIVITIES OF GENE PRODUCTS |
|---|---|---|---|
| Up regulated transcripts (level at 1 hr ≈ 6 hr) (level at 1 hr > 6 hr) | Early responders to drought | Drought perception leading to the establishment of tolerance to drought | Transcription factors Transporters |
| | | Modulation of drought response transduction pathways Specific gene transcription initiation | Change in cell membrane structure Kinases and phosphatases Transcription activators Change in chromatin structure and/or localized DNA topology |
| | | Conditional shift in preferential translation of transcripts | Modification of pre-existing translation factors by phosphorylation (kinases) or dephosphorylation (phosphatases) Synthesis of new translation factors |
| | | Changes in cell architecture to optimize cell adaptation to heat stress | Stability of mediators of protein-protein interaction |
| | | Changes in cell division cycle | Synthesis and/or stability of factors regulating cell division |
| Up regulated transcripts (level at 1 hr < 6 hr) | Maintenance of drought response "Delayed" responders | Maintenance of response to drought and maintenance of drought-tolerance mechanisms | Transcription factors Specific factors (initiation and elongation) for protein synthesis RNA-binding proteins effective for mRNA stability Change in chromatin structure and/or DNA topology |
| | | Maintenance of mechanisms effective for ions sequestration, osmolite biosynthesis, nuclear protein transport, regulation of cytoplasmic Ca+2, and regulation of proteins effective for maintaining protein stability and conformation | Stability of mediators of protein-protein interaction Stability of factors to effectively utilize pre-existing translation machinery ("recycling" mechanisms) under drought condition |
| | | Maintenance of cellular structures | Stability of mediators of protein-protein interaction |
| Down-regulated transcripts (level at 1 hr ≈ 6 hr) (level at 6 hr > 1 hr) | Early responder repressors of "normal" state of metabolism Genes with discontinued expression or unsTable mRNA in presence of water stress | Negative regulation of drought response inducible pathways released Changes in biochemical and signal transduction pathways and processes operating in cells | Transcription factors and activators Change in protein structure by phosphorylation (kinases) or dephosphoryaltion (phosphatases) Change in chromatin structure and/or DNA topology |
| Down-regulated transcripts | Delayed repressors of "normal" state of | Maintenance of drought response | Transcription factors and activators |

| GENE EXPRESSION LEVELS | FUNCTIONAL CATEGORY OF GENE | PHYSIOLOGICAL CONSEQUENCES | EXAMPLES OF BIOCHEMICAL ACTIVITIES OF GENE PRODUCTS |
|---|---|---|---|
| (level at 1 hr > 6 hr) | metabolism Genes with discontinued expression or unsTable mRNA in presence of water stress | Maintenance of pathways released from repression Changes in pathways and processes operating in cells | Kinases and phosphatases Stability of factors for protein translation |

Use of Promoters of Drought Responsive Genes

Promoters of Drought responsive genes are useful for transcription of any desired polynucleotide or plant or non-plant origin. Further, any desired sequence can be transcribed in a similar temporal, tissue, or environmentally specific patterns as the Drought responsive genes where the desired sequence is operably linked to a promoter of a Drought responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.4. Wounding Responsive Genes, Gene Components and Products

Plants are continuously subjected to various forms of wounding from physical attacks including the damage created by pathogens and pests, wind, and contact with other objects. Therefore, survival and agricultural yields depend on constraining the damage created by the wounding process and inducing defense mechanisms against future damage.

Plants have evolved complex systems to minimize and/or repair local damage and to minimize subsequent attacks by pathogens or pests or their effects. These involve stimulation of cell division and cell elongation to repair tissues, induction of programmed cell death to isolate the damage caused mechanically and by invading pests and pathogens, and induction of long-range signaling systems to induce protecting molecules, in case of future attack. The genetic and biochemical systems associated with responses to wounding are connected with those associated with other stresses such as pathogen attack and drought.

Wounding results in the modulation of activities of specific genes and, in consequence, of the levels of key proteins and metabolites. These genes, called here wounding responsive genes, are important for minimizing the damage induced by wounding from pests, pathogens and other objects. Examples of such wounding responsive genes, gene components and products are shown in the Reference, Sequence, Protein Group, Protein Group Matrix, MA_diff, and MA_clust tables. They can be active in all parts of a plant and so where, when and to what extent they are active is crucial for agricultural performance and for the quality, visual and otherwise, of harvested products. They were discovered and characterized from a much larger set of genes by experiments designed to find genes whose products changed in response to wounding.

Manipulation of one or more wounding responsive gene activities is useful to modulate the biological activities and/or phenotypes listed below. Wounding responsive genes and gene products can act alone or in combination with genes induced in other ways. Useful combinations include wounding responsive genes and/or gene products with similar transcription profiles, similar biological activities, or members of functionally related biochemical pathways. Whole pathways or segments of pathways are controlled by transcription factor proteins and proteins controlling the activity of signal transduction pathways. Therefore, manipulation of the levels of such proteins is especially useful for altering phenotypes and biochemical activities of plants. The MA_diff Table(s) reports the transcript levels of the experiment (see EXPT ID: 108574, 108575, 108524, 108525, and Wounding (relating to SMD 3714, SMD 3715)). For transcripts that had higher levels in the samples than the control, a "+" is shown. A "−" is shown for when transcript levels were reduced in root tips as compared to the control. For more experimental detail see the Example section below.

Wounding genes are those sequences that showed differential expression as compared to controls, namely those sequences identified in the MA_diff tables with a "+" or "−" indication.

Wounding Genes Identified by Cluster Analyses of Differential Expression

Wounding Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Wounding genes is any group in the MA_clust that comprises a cDNA ID that also appears in Expt ID 108574, 108575, 108524, 108525, and Wounding (relating to SMD 3714, SMD 3715) of the MA_diff table(s).

Wounding Genes Identified by Correlation to Genes that Cause Physiological Consequences Additionally, the differential expression data and the phenotypic observations can be merged to identify pathways or networks of Wounding genes. A group in the MA_clust is considered a Wounding pathway or network if the group comprises a cDNA ID that also appears in Knock-in or Knock-out tables that causes one or more of the phenotypes described in section above.

Wounding Genes Identified by Amino Acid Sequence Similarity

Wounding genes from other plant species typically encode polypeptides that share amino acid similarity to the sequences encoded by corn and *Arabidopsis* Wounding genes. Groups of Wounding genes are identified in the Protein Group table. In this table, any protein group that comprises a peptide ID that corresponds to a cDNA ID member of a Wounding pathway or network is a group of proteins that also exhibits Wounding functions/utilities.

Such wounding responsive genes and gene products can function either to increase or dampen the phenotypes and activities below, either in response to wounding or in the absence of wounding.

Further, promoters of wounding responsive genes, as described in the Reference tables, for example, are useful to modulate transcription that is induced by wounding or any of the following phenotypes or biological activities below.

III.E.4.a. Use of Wounding-Responsive Genes to Modulate Phenotypes

Wounding responsive genes and gene products can be used to alter or modulate one or more phenotypes including growth rate; whole plant height, width, or flowering time; organs (such as coleoptile elongation, young leaves, roots, lateral roots, tuber formation, flowers, fruit, and seeds); biomass; fresh and dry weight during any time in plant life, such as at maturation; number of flowers; number of seeds seed yield, number, size, weight, harvest index (such as content and composition, e.g., amino acid, nitrogen, oil, protein, and carbohydrate); fruit yield, number, size, weight, harvest index, post harvest quality, content and composition (e.g., amino acid, carotenoid, jasmonate, protein, and starch); seed and fruit development; germination of dormant and non-dormant seeds; seed viability, seed reserve mobilization, fruit ripening, initiation of the reproductive cycle from a vegetative state, flower development time, insect attraction for fertilization, time to fruit maturity, senescence; fruits, fruit drop; leaves; stress and disease responses; drought; heat and cold; wounding by any source, including wind, objects, pests and pathogens; uv and high light damage (insect, fungus, virus, worm, nematode damage).

To regulate any of the phenotype(s) above, activities of one or more of the wounding responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance with Johnson et. al. (1998) Plant Physiol 116:643-649, Reymond et. al. (2000) Plant Cell 12 707-720, or Keith et. al. (1991) Proc. Nat. Acad. Sci. USA 888821 8825.

III.E.4.b. Use of Wounding-Responsive Genes to Modulate Biochemical Activities

The activities of one or more of the wounding responsive genes can be modulated to change biochemical or metabolic activities and/or pathways such as those noted below. Such biological activities are documented and can be measured according to the citations included in the Table below:

| PROCESS | BIOLOGICAL OR METABOLIC ACTIVITIES AND/OR PATHWAYS | CITATIONS INCLUDING ASSAYS |
| --- | --- | --- |
| Plant Tissue Proliferation | Cell Damage Repair; Cell Division | Flanders (1990) J. Cell Biol. 110: 1111-1122 |
| Wound Induced Pathways Providing Defense Against Pests And Pathogens | Synthesis Of Jasmonic And Salicylic Acids And The Pathways Induced By These Signaling Molecules. Induction Of Jasmonic Acid Independent Defense Pathways. Induction Of Lipoxygenase, Thionins And Nodulins | Reymond, P and Farmer E. E. Current Opinion in Plant Biology 1998 1: 404-411 Creelman, RA and Mullet, J. E. (1997) Ann Rev. Plant Physiol Mol Biol 48: 355-387 Leon et al. 1998 Mol Gen Genet 254: 412-419 Titarentko et al. 1997 Plant Physiol 115: 817-826 |
| | Cell Wall Degradation, Ethylene Formation, Systemic Signaling And Induction Of Defense Related Genes | Rojo, E. et al. 1998. Plant J 13: 153-165 Ryan, CA and Pearce, G. 1998. Ann Rev. Cell Dev. Biol 14: 1-17 |
| | Specific Rnase Induction | Reymond, P. et al. 2000. Plant Cell 12: 707-720 Glazebrook, J. 1999. Current Opinion in Plant Biol. 2: 280-286 O'Donnel P. J., et al. 1996 Science 274: 1914-1917 Rojo et al. 1999. Plant J. 20: 135-142 Merkouropoulus G. et al. 1999 Planta 208: 212-219 Kariu et al. 1998. Bioscience Biotechnology and Biochemistry 62: 1144-1151 Mcoann et al. 1997 PNAS 94: 5473-5477 |
| Other Stress Induced Pathways | Abscisic Acid Formation And Its Signaling Pathway Cold Responsive Genes and Pathways Drought Induced Dehydrins And Pathways | Carrera, E and Prat, S. 1998. Plant J 15: 767-771 Chao et. al. 1999. Plant Physiol 120: 979-992 |
| Modified Lipid Motabolism | Membrane Lipid Synthesis Including Omega-3 Fatty Acid Desaturase Lipases Lipid Transfer Proteins | Martin, M et al. 1999 Europe J. Biochem 262: 283-290 |

| PROCESS | BIOLOGICAL OR METABOLIC ACTIVITIES AND/OR PATHWAYS | CITATIONS INCLUDING ASSAYS |
|---|---|---|
| Modified Sugar And Energy Metabolism | Induction Of Glycohydrolases And Glycotransferases, Amylases | |
| Modified Protein And Nitrogen Metabolism | Induction Of Aminotransferases, Arginase, Proteases And Vegetative Storage Proteins, Aromatic Amino Acid Synthesis | |
| Secondary Metabolite Induction | Aromatic Amino Acid Synthesis And Secondary Metabolites | Keith, B et al. 1991 PNAS 88: 8821-8825 |

Other biological activities that can be modulated by wound responsive genes and their products are listed in the Reference tables. Assays for detecting such biological activities are described in the Protein Domain table.

The MA_diff table reports the changes in transcript levels of various wound responsive genes in the aerial parts of a plant, 1 and 6 hours after the plants were wounded with forceps. The comparison was made with aerial tissues from unwounded plants.

The data from this time course reveal a number of types of wound responsive genes and gene products, including "early responders," and "delayed responders." Profiles of the individual wounding responsive genes are shown in the Table below together with examples of the kinds of associated biological activities that are modulated when the activities of one or more such genes vary in plants.

| TRANSCRIPT LEVELS | TYPES OF GENES | PHYSIOLOGICAL CONSEQUENCES | EXAMPLES OF BIOCHEMICAL ACTIVITY |
|---|---|---|---|
| Up Regulated Transcripts (Level At 1 h ≈ 6 h) Or (Level At 1 h > 6 h) | Early Responders To Wounding | Induction Of Key Signaling Pathways Within And Between Cells | Transcription Factors Kinases And Phosphatases |
| | | Modulation Of Wounding And Stress Induced Signal Transduction Pathways Specific Gene Transcription Initiation Induction Of Repair Processes Or Cell Death | Jasmonic Acid, Salicylic Acid And Nitric Oxide Pathway Proteins. Glycohydrolases Dehydrins Rnases Metabolic Enzymes Nodulins Cell Division And Cell Wall Proteins |
| | | Reorientation Of Metabolism, Including Management Of Active Oxygen | Cold Response Proteins Lipoxygenase Jacalin Proteins To Detoxify Active Oxygen Species |
| | | Movement Of Wound Induced Signals Through Plant | Systemin |
| | | Synthesis Of Phytoalexins And Secondary Metabolites | Biosynthetic Enzymes |
| Up Related Transcripts (Level At 1 h < 6 h) | Delayed Responders | Maintenance Of Defence Pathways | Transcription Factors Kinases And Phosphatases |
| | Genes Involved In Wounding Response At Distant Sites From Wound. | Maintenance Of Reorientated Metabolism | Jasmonic Acid, Salicylic Acid And Nitric Oxide Pathway Proteins |
| | Genes Involved In Maintenance Of Wounding Response | Maintenance Of Wound Response Programmed Cell Death In Selected Cells Reorientation Of Metabolism | Glycohydrolases Dehydrins Rnases Metabolic Enzymes Nodulins Cold Response Proteins Lipoxygenase Jacalin |

-continued

| TRANSCRIPT LEVELS | TYPES OF GENES | PHYSIOLOGICAL CONSEQUENCES | EXAMPLES OF BIOCHEMICAL ACTIVITY |
|---|---|---|---|
| | | | Proteins To Detoxify Active Oxygen Species Cell Division And Cell Wall Proteins |
| | | Movement Of Wound Induced Signals Through Plant | Systemin |
| | | Synthesis Of Phytoalexins And Secondary Metabolites | Biosynthetic Enzymes |
| Down-Regulated Transcripts (Level At 1 h ≈ 6 h) Or (Level At 6 Hr > 1 h) | Early Responder Repressors Of Wounding Response State | Negative Regulation Of Wounding Response Pathways Released | Transcription Factors Change In Protein Structure By Phosphory-Laton (Kinases) Or Dephos-Phorylation (Phosphatases) Change In Chromatin Structure And Or Dna Topology |
| | Genes With Discontinued Expression Or UnsTable mRNA Following Wounding | Changes In Pathways And Processes Operating In Cells | Local Changes In Regulatory Proteins, Metabolic Enzymes, Transporters Etc. |
| Down-Regulated Transcripts (Level At 1 hr > 6 h) | Delayed Repressors Of Wounding Response State | Negative Regulation Of Wounding Response Pathways Released | Transcription Factors, Phosphatases, Kinases Changes In Protein Complex Structures Chromatin Restructuring Proteins |
| | Genes With Discontinued Expression Or UnsTable mRNA Following Wounding | Change In Pathways And Process Operating In Cells Programmed Cell Death | Local Changes In Regulatory Proteins, Metabolic Enzymes, Transporters Etc. Most Proteins In Selected Cells Undergoing Death |

Further, any desired sequence can be transcribed in similar temporal, tissue, or environmentally specific patterns as the wounding responsive genes when the desired sequence is operably linked to a promoter of a wounding responsive gene.

III.E.5. Methyl Jasmonate (Jasmonate) Responsive Genes, Gene Components and Products Jasmonic acid and its derivatives, collectively referred to as jasmonates, are naturally occurring derivatives of plant lipids. These substances are synthesized from linolenic acid in a lipoxygenase-dependent biosynthetic pathway. Jasmonates are signalling molecules which have been shown to be growth regulators as well as regulators of defense and stress responses. As such, jasmonates represent a separate class of plant hormones.

Changes in external or internal jasmonate concentration result in modulation of the activities of many genes and gene products. Examples of such "jasmonate responsive" genes and gene products are shown in the Reference and Sequence Tables. These genes and/or products are responsible for effects on traits such as plant vigor and seed yield, especially when plants are growing in the presence of biotic or abiotic stresses. They were discovered and characterized from a much larger set of genes by experiments designed to find genes whose mRNA products changed in concentration in response to application of methyl jasmonate to plants.

Manipulation of one or more jasmonate responsive gene activities is useful to modulate the biological activities and/or phenotypes tested below. Jasmonate response genes and gene products can act alone or in combination. Useful combinations include jasmonate responsive genes and/or gene products with similar transcription profiles, similar biological activities, or members of the same co-regulated or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities Such jasmonate responsive genes and gene products can function to either increase or dampen the phenotypes or activities below either in response to changes in jasmonate concentration or in the absence of jasmonate fluctuations. The MA_diff Table(s) reports the transcript levels of the experiment (see EXPT ID: 108568, 108569, 108555). For transcripts that had higher levels in the samples than the control, a "+" is shown. A "−" is shown for when transcript levels were reduced in root tips as compared to the control. For more experimental detail see the Example section below.

MeJA genes are those sequences that showed differential expression as compared to controls, namely those sequences identified in the MA_diff tables with a "+" or "−" indication.

MeJA Genes Identified by Cluster Analyses of Differential Expression

MeJA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of MeJA genes is any group in the MA_clust that comprises a cDNA ID that also appears in Expt ID 108568, 108569, 108555 of the MA_diff table(s).

MeJA Genes Identified by Correlation to Genes that Cause Physiological Consequences Additionally, the differential expression data and the phenotypic observations can be merged to identify pathways or networks of MeJA genes. A group in the MA_clust is considered a MeJA pathway or network if the group comprises a cDNA ID that also appears in Knock-in or Knock-out tables that causes one or more of the phenotypes described in section above.

MeJA Genes Identified by Amino Acid Sequence Similarity

MeJA genes from other plant species typically encode polypeptides that share amino acid similarity to the sequences encoded by corn and *Arabidopsis* MeJA genes. Groups of MeJA genes are identified in the Protein Group table. In this table, any protein group that comprises a peptide ID that corresponds to a cDNA ID member of a MeJA pathway or network is a group of proteins that also exhibits MeJA functions/utilities.

Further, promoters of jasmonate responsive genes, as described in the Reference tables, for example, are useful to modulate transcription that is induced by jasmonate or any of the following phenotypes or biological activities below.

III.E.5.a. Use of Jasmonate Responsive Genes to Modulate Phenotypes:

Jasmonate responsive genes and their gene products can be used to alter or modulate one or more phenotypes including growth rate, whole plant (including height, flowering time, etc.), seedling, organ, coleoptile elongation, young leaves, roots, lateral roots, tuber formation, flowers, fruit, seeds, biomass; fresh and dry weight during any time in plant life, including maturation and senescence; number of flowers, number of seeds (including secondary metabolite accumulation, alkaloids, anthocyanins; paclitaxel and related taxanes, rosmarinic; seed yield (such as number, size, weight, harvest index, content and composition, e.g., amino acid, jasmonate, oil, protein, and starch); fruit yield (such as number, size, weight, harvest index, post harvest quality, content and composition e.g., amino acid, carotenoid, jasmonate, protein, starch); seed and fruit development; germination of dormant and non-dormant seeds; seed viability; seed reserve mobilization; fruit ripening (such as initiation of the reproductive cycle from a vegetative state); flower development time; insect attraction for fertilization; time to fruit maturity; senescence; fruits, fruit drop; leaves; stress and disease responses; drought; wounding; UV damage; and insect, fungus, virus, or worm damage.

Further, any desired sequence can be transcribed in similar temporal, tissue, or environmentally specific patterns as the jasmonate responsive genes when the desired sequence is operably linked to a promoter of a jasmonate responsive gene.

To improve any of the phenotype(s) above, activities of one or more of the jasmonate responsive genes or gene products can be modulated and the plants can be tested by screening for the desired trait. Specifically, the gene, mRNA levels, or protein levels can be altered in a plant utilizing the procedures described herein and the phenotypes can be assayed, for example, in accordance to citations described below.

III.E.5.b. Use of Jasmonate-Responsive Genes to Modulate Biochemical Activities:

The activities of one or more of the jasmonate responsive genes can be modulated to change biochemical or metabolic activities and/or pathways such as those noted below. Such biological activities are documented and can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Turnover of proteins | Induction of various proteases, ubiquitin and proteosome components and turnover of RNA polymerases and translation initiation factors Reduction in many ribosomal proteins | This study. Standard biochemical assays. |
| Activation of nitrogen metabolism | Induction of glutamine synthetase, many aminotransferases, vegetative storage proteins | Crawford (1995) Plant Cell 7, 859-868 This study. Standard biochemical assays. |
| Lipid turnover | Induction of various lipases, desaturases, and reduction of lipid transfer protein mRNAs | This study. Standard biochemical assays. |
| Sugar metabolism | Induction of sugar transporters, UDP glucosyltransferases, other transferases | This study. Standard biochemical assays. |

| PROCESS | BIOCHEMICAL OR METABOLIC ACTIVITIES AND/OR PATHWAYS | CITATIONS INCLUDING ASSAYS |
|---|---|---|
| Glycolysis and central carbon metabolism | Induction of glycolytic related enzymes. Example, glucose 6-phosphate dehydrogenase, glyceraldehyde-3-phosphate dehydrogenase, phosphoglycerate kinase, phosphoglucomutase ATP synthase | This study. Standard biochemical assays. |
| Chlorosis | Degradation of Chlorophyll | Tsuchiya et al. (1999) Proc. Natl. Acad. Sci. USA 96: 15362-15367 |
| | Inhibition of Photosynthesis Related Proteins | Reinbothe et al. (1993) J. Biol. Chem. 268, 10606-10611 |
| Carbon Assimilation and turnover | Induction of chlorophyll ab binding protein precursor | Reinbothe et al. (1993) J. Biol. Chem. 268, 10606-10611 |
| Jasmonate metabolism | Induction of lipid biosynthesis, myrosinase and jacalin | This study. Standard biochemical assays. |
| Jasmonate mediated signal transduction | Receptor binding | Cho and Pai (2000) Mol Cells 10, 317-324 |
| | Protein kinases | Lee et al. (1998) Mol. Gen. Genet. 259, 516-522 Seo et al. (1999) Plant Cell 11, 289-298 Yoon et al. (1999) Plant Mol. Biol. 39, 991-1001 |
| | Ubiquitination of Repressor Proteins | Xie et al. (1998) Science 280, 1091-1094 |
| | Calcium Flux regulators | Bergey and Ryan (1999) Plant Mol. Biol. 40, 815-823 |
| | Transcription Activators. Example-induction of various zinc finger, myb and AP-2 related factors | Xiang et al. (1996) Plant Mol. Biol. 32, 415-426 Menke et al. (1999) EMBO J. 18, 4455-4463 |
| Response to Cell Membrane Damage | Lipid Peroxidation | Dubery et al. (2000) Mol. Cell Biol. Res. Commun. 3, 105-110 |
| Cell Elongation | Inhibition of incorporation of Glucose into Cell Wall Saccharides | Burnett et al. (1993) Plant Physiol. 103, 41-48 |
| Cell Organization and Division | Reductions in tropomyosin related proteins and certain cyclins Induction of actins and tubulins | Ishikawa et al. (1994) Plant Mol. Biol. 26, 403-414 |
| Cell Wall Turnover and modulation | Induction of cell wall proteins, glycine-rich proteins, annexins, pectate lyase and pectin esterases Reductions in various dehydrins and expansins | Creelman et al. (1992) Proc. Natl. Acad. Sci. USA 89, 4938-4941 Garcia-Muniz et al. (1998) Plant Mol. Biol. 38, 623-632 Norman et al (1999) Mol. Plant Microbe Interact. 12, 640-644 |
| Stress, Disease, and Pathogen Resistance | Induction of antifungal proteins, wounding responsive proteins, dehydrins, heat shock type proteins and elicitor response proteins | Hildmann et al. (1992) Plant Cell 4, 1157-1170 Reinbothe et al. (1994) Proc. Natl. Acad. Sci. USA 91, 7012-7016 Moons et al. (1997) Plant Cell 9, 2243-2259 Richard et al. (2000) Plant Mol. Biol. 43, 1-10 Van Wees et al. (2000) Proc. Natl. Acad. Sci. USA 97, 8711-8716 |
| | Phytoalexin Biosynthesis | Creelman et al. (1992) Proc. Natl. Acad. Sci. USA 89, 4938-4941 Choi et al. (1994) Proc. Natl. Acad. Sci. USA 91, 2329-2333 |

-continued

| PROCESS | BIOCHEMICAL OR METABOLIC ACTIVITIES AND/OR PATHWAYS | CITATIONS INCLUDING ASSAYS |
|---|---|---|
| | Biosynthesis of phenolics | Doares et al., (1995) Proc. Natl. Acad. Sci. USA 92, 4095-5098 |
| | Production of Protease Inhibitors | Botella et al. (1996) Plant Physiol 112, 1201-1210 |
| | Defense Gene Transcription in Response to UV | Mason et al. (1993) Plant Cell 5, 241-251 Schaller et al. (2000) Planta 210, 979-984 |
| Secondary Metabolite biosynthesis | Fruit Cartenoid Composition | Czapski and Saniewski (1992) J. Plant Physol. 139, 265-268 |
| | Palitaxel and Related Taxanes | Yukimune et al. (1996) Nature Biotech. 14, 1129-1132 |
| | Alkaloids | Aerts et al. (1994) Plant J. 4, 635-643 Geerlings et al. (2000) J. Biol. Chem. 275, 3051-3056 |
| | Anthocyanins | Franceschi et al. (1991) Proc. Natl. Acad. Sci. USA 83, 6745-6749 |
| | Rosmarinic | Mizukami et al., (1993) Plant Cell Reprod. 12, 706-709 |
| | Activation of Ethylene-forming Enzyme and Production of Ethylene | Czapski and Saniewski (1992) J. Plant Physiol. 139, 265-268 |

Other biological activities that can be modulated by the jasmonate responsive genes and their products are listed in the Reference Tables. Assays for detecting such biological activities are described in the Domain section of the Reference Tables.

Jasmonate responsive genes are characteristically differentially transcribed in response to fluctuating jasmonate levels or concentrations, whether internal or external to an organism or cell. The MA_diff table(s) report(s) the changes in transcript levels of various jasmonate responsive genes in the aerial parts of a seedling at 1 and 6 hours after being sprayed with SILWET L-77® solution enriched with methyl jasmonate as compared to seedlings sprayed with SILWET L-77® alone.

The data from this time course reveal a number of types of jasmonate responsive genes and gene products, including "early responders" and "delayed responders". Profiles of the individual kinds of jasmonate responsive genes are shown in the Table below, together with examples of the kinds of associated biological activities that are modulated when the activities of such genes vary.

| GENE EXPRESSION LEVELS | FUNCTIONAL CATEGORY OF GENE | TYPE OF BIOLOGICAL ACTIVITY | EXAMPLES OF BIOCHEMICAL ACTIVITY |
|---|---|---|---|
| Upregulated genes (Level at 1 hour ≅ 6 hours). (Level at 1 hour > 6 hours) | Early Responders to Jasmonate | Binding and Perception of Jasmonate Transduction of Jasmonate signal tranduction response pathways Initiation of Specific Gene Transcription to reorientate metabolism | Transcription Factors Transporters Kinases, Phosphatases, Leucine-rich Repeat Proteins (LRRs), GTP-binding proteins (G-proteins), calcium-binding proteins and calcium responsive proteins Proteases, lipases, glutamine synthetase (GS), arginase, aminotransferases, glycosyltransferases, sugar transporters, cell wall proteins, methyl transferases, glycolytic enzymes. |
| Upregulated genes (Level at 1 hour < 6 hours) | Delayed Jasmonate Responders | Maintenance of Metabolism under high Jasmonate Jasmonate signal Tranduction Response Pathways Gene Transcription to | Enzymes of methyl jasmonate-induced pathways, including dehydrin, phytoalexin, phenolic, carotenoid, alkaloid and anthocyanin |

-continued

| GENE EXPRESSION LEVELS | FUNCTIONAL CATEGORY OF GENE | TYPE OF BIOLOGICAL ACTIVITY | EXAMPLES OF BIOCHEMICAL ACTIVITY |
|---|---|---|---|
| | | Reorientate Metabolism Gene Transcription to Maintain Reorientated Metabolism Reorient Cell Division and Cell Development | biosynthesis. Transcription factors, Transporters, Kinases and phosphatases Proteases, Lipases, Glutaminae Synthetase, Arginase, Aminotransferases, Lipid Peroxidases, Glycosyltransferases, Sugar transporters, Cell Wall Proteins, Glycolytic Enzymes, Chlorophyll Binding Proteins Transcription factors, kinases, phosphatases, LRRs, G-proteins Actins, Tubulins, Myosins Cyclins, Cyclin-dependent Kinases (CDPKs) Glycosyl Transferases, Glycosyl hydrolases, Expansins, Extensins, O-Methyl Transferases Arabinogalactan-proteins (AGPs), Enzymes of Lipid Biosynthesis, Cutinase |
| Down regulated transcripts (level at 1 hour = 6 hours) (level at 6 hours > 1 hour) | Early responders of Jasmonate Genes with discontinued expression or unsTable mRNA following Jasmonate uptake | Relese of Suppression of Jasmonate Induced Pathways Reorientation of metabolism | Transcription Factors, Kinases, Phosphatases, LRRs, G-Proteins, Chromatin Restructuring proteins, Ribosomal proteins, Translation Factors, Histones, RNA polymerases, Pectin esterase, Lipid transfer proteins |
| Down regulated transcripts (level at 1 hour > 6 hours) | Genes with Discontinued expression or UnsTable mRNA Following Jasmonate uptake | Negative Regulation of Jasmonate Induced Pathways Released. Reorientation of metabolism | Transcription factors Kinases, Phosphatases Chromatin Restructuring Proteins, LRRs, G-proteins Ribosomal proteins, Translation Factors, Histones RNA Polymerases, Cyclins Pectin esterase, Lipid Transfer Proteins |

Use of Promoters of Jasmonate Responsive Genes

Promoters of Jasmonate responsive genes are useful for transcription of any desired polynucleotide or plant or non-plant origin. Further, any desired sequence can be transcribed in a similar temporal, tissue, or environmentally specific patterns as the Jasmonate responsive genes where the desired sequence is operably linked to a promoter of a Jasmonate responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.6. Reactive Oxygen Responsive Genes, Gene Components and H2O2 Products

Often growth and yield are limited by the ability of a plant to tolerate stress conditions, including pathogen attack, wounding, extreme temperatures, and various other factors. To combat such conditions, plant cells deploy a battery of inducible defense responses, including triggering an oxidative burst. The burst of reactive oxygen intermediates occurs in time, place and strength to suggest it plays a key role in either pathogen elimination and/or subsequent signaling of downstream defense functions. For example, $H_2O_2$ can play a key role in the pathogen resistance response, including initiating the hypersensitive response (HR). HR is correlated with the onset of systemic acquired resistance (SAR) to secondary infection in distal tissues and organs.

Changes in reactive oxygen, such as $H_2O_2$ or $O_2^-$, in the surrounding environment or in contact with a plant results in modulation of the activities of many genes and hence levels of gene products. Examples of such reactive oxygen responsive genes and gene products are shown in the Reference, Sequence, Protein Group, Protein Group Matrix, MA_diff and MA_clust tables. These genes and/or products are responsible for effects on traits such as plant vigor and seed yield. The genes were discovered and characterized from a much larger set by experiments designed to find genes whose mRNA products changed in response to application of reactive oxygen, such as $H_2O_2$, to plants.

Manipulation of one or more reactive oxygen responsive gene activities is useful to modulate the following biological activities and/or phenotypes listed below. Reactive oxygen responsive genes and gene products can act alone or in combination. Useful combinations include reactive oxygen responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants.

Such reactive oxygen responsive genes and gene products can function to either increase or dampen the above phenotypes or activities either in response to changes in reactive oxygen concentration or in the absence of reactive oxygen fluctuations. The MA_diff Table(s) reports the transcript levels of the experiment (see EXPT ID: 108582, 108583, 108537, 108538, 108558, and H2O2 (relating to SMD 7523)). For transcripts that had higher levels in the samples than the control, a "+" is shown. A "−" is shown for when transcript levels were reduced in root tips as compared to the control. For more experimental detail see the Example section below.

Reactive Oxygen genes are those sequences that showed differential expression as compared to controls, namely those sequences identified in the MA_diff tables with a "+" or "−" indication.

Reactive Oxygen Genes Identified by Cluster Analyses of Differential Expression

Reactive Oxygen Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Reactive Oxygen genes is any group in the MA_clust that comprises a cDNA ID that also appears in Expt ID 108582, 108583, 108537, 108538, 108558, and H2O2 (relating to SMD 7523) of the MA_diff table(s).

Reactive Oxygen Genes Identified by Correlation to Genes that Cause Physiological Consequences Additionally, the differential expression data and the phenotypic observations can be merged to identify pathways or networks of Reactive Oxygen genes. A group in the MA_clust is considered a Reactive Oxygen pathway or network if the group comprises a cDNA ID that also appears in Knock-in or Knock-out tables that causes one or more of the phenotypes described in section above.

Reactive Oxygen Genes Identified by Amino Acid Sequence Similarity

Reactive Oxygen genes from other plant species typically encode polypeptides that share amino acid similarity to the sequences encoded by corn and *Arabidopsis* Reactive Oxygen genes. Groups of Reactive Oxygen genes are identified in the Protein Group table. In this table, any protein group that comprises a peptide ID that corresponds to a cDNA ID member of a Reactive Oxygen pathway or network is a group of proteins that also exhibits Reactive Oxygen functions/utilities.

Further, promoters of reactive oxygen responsive genes, as described in the Reference tables, for example, are useful to modulate transcription that is induced by reactive oxygen or any of the following phenotypes or biological activities below.

III.E.6.a. Use of Reactive Oxygen Responsive Genes to Modulate Phenotypes

Reactive oxygen responsive genes and gene products are useful to or modulate one or more phenotypes including pathogen tolerance and/or resistance; Avr/R locus sensitive; non-host sensitive; HR; SAR (e.g., where the reactive oxygen responsive gene and products are modulated in conjunction with any of the bacterial, fungal, virus, or other organism listed below); bacteria resistance, e.g. to *Erwinia stewartii*, *Pseudomonas syringae*, *Pseudomonas tabaci*, Stuart's wilt, etc.; fungal resistance including to downy mildews such as *Scleropthora macrospora*, *Sclerophthora rayissiae*, *Sclerospora graminicola*, *Peronosclerospora sorghi*, *Peronosclerospora philippinensis*, *Peronosclerospora sacchari*, *Peronosclerospora maydis*; rusts such as *Puccinia sorphi*, *Puccinia polysora*, *Physopella zeae*, etc.; other fungal diseases such as *Cercospora zeae-maydis*, *Colletotrichum graminicola*, *Fusarium monoliforme*, *Exserohilum turcicum*, *Bipolaris maydis*, *Phytophthora parasitica*, *Peronospora tabacina*, *Septoria*, etc.; virus or viroid resistance, e.g. to tobacco or cucumber mosaic virus, ringspot virus, necrosis virus, *pelargonium* leaf curl virus, red clover mottle virus, tomato bushy stunt virus, and like viruses; insect resistance, such as to aphids e.g. *Myzus persicae*; beetles, beetle larvae; etc.; nematodes, e.g. *Meloidogyne incognita; lepidoptera*, e.g. *Heliothus* spp. etc.; resistance specifically in primary or secondary leaves; stress tolerance; winter survival; cold tolerance; heavy metal tolerance, such as cadmium; physical wounding; increased organelle tolerance to redox stress, such as in mitochondria, and chloroplasts; cell death; apoptosis, including death of diseased tissue; senescence; fruit drop; biomass; fresh and dry weight during any time in plant life, such as maturation; number of flowers, seeds, branches, and/or leaves; seed yield, including number, size, weight, and/or harvest index; fruit yield, including number, size, weight, and/or harvest index; plant development; time to fruit maturity; cell wall strengthening and reinforcement; plant product quality, e.g. paper making quality); food additives; treatment of indications modulated by free radicals, and cancer To regulate any of the phenotype(s) above, activities of one or more of the reactive oxygen responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance to Alvarez et al., (1998) Cell 92: 773-784; Halhbrock and Scheel, (1989) Ann. Rev. Plant Physiol. Plant Mol. Biol. 40: 347-369; Lamb et al., (1997) Ann. Rev. Plant Mol. Biol. Plant Physio. 48: 251-275; Lapwood et al. (1984) Plant Pathol. 33: 13-20;

Levine et al. (1996) Curr. Biol. 6: 427-437; McKersie et al., (2000) Plant Physiol. 122(4): 1427-1437; Olson and Varner (1993) Plant J. 4: 887-892; Pastore et al., (2000), FEBS Lett 470(1): 88-92; Pastori et al., (1997) Plant Physiol. 113: 411-418. Romero-Puertas et al., (1999) Free Radic. Res. 1999 31 Suppl: S25-31; Shirataki et al., Anticancer Res 20(1A): 423-426 (2000); Wu et al., (1995) Plant Cell 7: 1357-1368;

III.E.6.b. Use of Reactive Oxygen Responsive Genes to Modulate Biochemical Activities The activities of one or more of the reactive oxygen responsive genes can be modulated to change biochemical or metabolic activities and/or pathways such as those noted below. Such biological activities are documented and can be measured according to the citations above and included in the Table below:

| PROCESS | BIOCHEMICAL OR METABOLIC ACTIVITIES AND/OR PATHWAYS | CITATIONS INCLUDING ASSAYS |
| --- | --- | --- |
| Reinforcement of Cell Walls | Modulation Of The Production Of ExtracTable Proline-Rich Protein | Bradley et al. 1992. Cell 70, 21-30 |
|  | Modulation Of Lignification | Mansouri et al. (1999) Physiol Plant 106: 355-362 |
| Stress, Disease, Pathogen Resistance and Wounding | Induction Of Pathogenesis Related Proteins, Phytoalexins And Many Defense Pathways. | Chamnongpol et. al. (1998) Proc. Nat. Acad Sci USA 12; 95: 5818-23. |
|  | Induction Of Detoxifying Enzymes Such As Glutathione S-Transferase And Ascorbate Peroxidase | Davis et al. (1993) Phytochemistry 32: 607-611. Chen et. al. Plant J. (1996) 10: 955-966 |
|  | Disease Resistance | Gadea et. al. (1999) Mol Gen Genet 262: 212-219 Wu et. al. (1995) Plant Cell 7: 1357-68 |
|  | Reactive Oxygen Generation Following Wounding And Changes In Physical Pressure | Orozco-Cardenas and Ryan (1999) Proc. Nat. Acad. Sci. USA 25; 96: 6553-7. Yahraus et al. (1995) Plant Physiol. 109: 1259-1266 |
|  | Modulation Of Genes Involved In Wound Repair And Cell Division Modulation Of Nitric Oxide Signaling Salicyclic Acid Accumulation And Signaling | LEGENDRE ET AL. (1993) PLANT PHYSIOL. 102: 233-240 DELLEDONNE ET AL. (1998) NATURE 394: 585-588 DURNER AND KLESSIG (1996) J. BIOL. CHEM. 271: 28492-501 |
| Programmed Cell Death | Induction Of Cell Death Pathway Genes | LEVINE ET AL. (1996) CURR. BIOL. 6: 427-437. REYNOLDS ET. AL. (1998) BIOCHEM. J. 330: 115-20 |

Other biological activities that can be modulated by the reactive oxygen responsive genes and their products are listed in the Reference tables. Assays for detecting such biological activities are described in the Protein Domain table.

Reactive oxygen responsive genes are characteristically differentially transcribed in response to fluctuating reactive oxygen levels or concentrations, whether internal or external to an organism or cell. The MA_diff table reports the changes in transcript levels of various reactive oxygen responsive genes in the aerial parts of a plant at 1 and 6 hours after the plant was sprayed with Silwett L-77 solution enriched with hydrogen peroxide as compared to plants sprayed with Silwett L-77 alone.

The data from this time course reveal a number of types of reactive oxygen responsive genes and gene products, including "early responders," and "delayed responders". Profiles of individual reactive oxygen responsive genes are shown in the Table below together with examples of which associated biological activities are modulated when the activities of one or more such genes vary in plants.

| GENE EXPRESSION LEVELS | FUNCTIONAL CATEGORY OF GENE | PHYSIOLOGICAL CONSequence | EXAMPLES OF BIOCHEMICAL ACTIVITY OF GENE PRODUCTS |
|---|---|---|---|
| Upregulated transcripts (Higher at 1 h Than 6 h) (Level at 1 h ≅ 6 h) | Early Responders To Reactive Oxygen | Perceiving Reactive Oxygen Response Transduction Pathways Initiating Specific Gene Transcription | Transcription Factors Kinases And Phosphatases Transporters Glutathione S-Transferase Heat Shock Proteins Salicylic Acid Response Pathway Proteins Jasmonic Acid Pathway Proteins Dehydrins Peroxidases Catalase Proteases Pathogen Response Proteins Ca 2+ Channel Blockers Phenylalanine Ammonia Lyase |
| Upregulated transcripts (Lower at 1 h Than 6 h) | Delayed Reactive Oxygen Responders | Maintenance Of Defence Pathways To Control Active Oxygen Activation Of Cell Death Pathways In Specific Cells | Transcription Factors Kinases And Phosphatases Reactive Oxygen Scavenging Enzymes Cell Wall And Cell Division/Growth Promoting Pathway Enzymes Pathogen Response Proteins Proteins Of Defence Pathways Proteases, Cellulases, Nucleases And Other Degrading Enzymes. Membrane Proteins Mitochondrial And Chloroplast Energy Related Proteins |
| Downregulated transcripts Level at 1 h ≅ 6 h Level at 6 h > 1 h. Down Regulated Transcripts (Level at 1 h > 6 h | Early Responder Repressors Of Reactive Oxygen Response Pathways Genes Of Pathways That Are Minimized In Response To Reactive Oxygen Delayed Responder Repressors Of Reactive Oxygen Response Pathways Genes Of Pathways That Are Minimised In Response To Reactive Oxygen | Negative Regulation Of Reactive Oxygen-Inducible Pathways Released Reduction In Activities Of Pathways Not Maintained Under High Reactive Oxygen Negative Regulation Of Reactive Oxygen Inducible Pathways Released Reduction In Activities Of Pathways Not Maintained Under Reactive Oxygen Programmed Cell Death | Transcription Factors Kinases And Phosphatases Chromatin Remodelling Proteins Metabolic Enzymes In Affected Cells Membrane Proteins And Cell Wall Proteins Transcription Factors Kinases And Phosphatases Chromatin Remodelling Proteins Metabolic Enzymes In Affected Cells Membrane Proteins And Cell Wall Proteins Many Proteins In Cells Undergoing Cell Death Or In Damaged Cells |

Further, promoters of reactive oxygen responsive genes, as described in the Reference tables, for example, are useful to modulate transcription that is induced by reactive oxygen or any of the following phenotypes or biological activities below.

III.E.7. Salicylic Acid Responsive Genes, Gene Components and Products

Plant defense responses can be divided into two groups: constitutive and induced. Salicylic acid (SA) is a signaling molecule necessary for activation of the plant induced defense system known as systemic acquired resistance or SAR. This response, which is triggered by prior exposure to avirulent pathogens, is long lasting and provides protection against a broad spectrum of pathogens. Another induced defense system is the hypersensitive response (HR). HR is far more rapid, occurs at the sites of pathogen (avirulent pathogens) entry and precedes SAR. SA is also the key signaling molecule for this defense pathway.

Changes in SA concentration in the surrounding environment or within a plant results in modulation of many genes and gene products. Examples of such SA responsive genes and gene products are shown in the Reference, Sequence, Protein Group, Protein Group Matrix, MA_diff and MA_clust tables. These genes and/or products are responsible for effects on traits such as plant vigor and seed yield. They were discovered and characterized from a much larger set by experiments designed to find genes whose mRNA products changed in response to SA treatment.

While SA responsive polynucleotides and gene products can act alone, combinations of these polynucleotides also affect growth and development. Useful combinations include different SA responsive polynucleotides and/or gene products that have similar transcription profiles or similar biological activities, and members of the same or similar biochemical pathways. In addition, the combination of SA responsive polynucleotides and/or gene product with another environmentally responsive polynucleotide is also useful because of the interactions that exist between hormone-regulated pathways, stress and pathogen induced pathways, nutritional pathways and development. Here, in addition to polynucleotides having similar transcription profiles and/or biological activities, useful combinations include polynucleotides that may have different transcription profiles but which participate in common and overlapping pathways.

Such SA responsive genes and gene products can function to either increase or dampen the above phenotypes or activities either in response to changes in SA concentration or in the absence of SA fluctuations. The MA_diff Table(s) reports the transcript levels of the experiment (see EXPT ID: 108586, 108587, 108515, 108552, 108471, 108472, 108469, 108470, 107953, 107960, 108443, 108440, 108441, 108475, 108476). For transcripts that had higher levels in the samples than the control, a "+" is shown. A "−" is shown for when transcript levels were reduced in root tips as compared to the control. For more experimental detail see the Example section below.

SA genes are those sequences that showed differential expression as compared to controls, namely those sequences identified in the MA_diff tables with a "+" or "−" indication.

SA Genes Identified by Cluster Analyses of Differential Expression

SA Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of SA genes is any group in the MA_clust that comprises a cDNA ID that also appears in Expt ID 108586, 108587, 108515, 108552, 108471, 108472, 108469, 108470, 107953, 107960, 108443, 108440, 108441, 108475, 108476 of the MA_diff table(s).

SA Genes Identified by Correlation to Genes that Cause Physiological Consequences Additionally, the differential expression data and the phenotypic observations can be merged to identify pathways or networks of SA genes. A group in the MA_clust is considered a SA pathway or network if the group comprises a cDNA ID that also appears in Knock-in or Knock-out tables that causes one or more of the phenotypes described in section above.

SA Genes Identified by Amino Acid Sequence Similarity

SA genes from other plant species typically encode polypeptides that share amino acid similarity to the sequences encoded by corn and *Arabidopsis* SA genes. Groups of SA genes are identified in the Protein Group table. In this table, any protein group that comprises a peptide ID that corresponds to a cDNA ID member of a SA pathway or network is a group of proteins that also exhibits SA functions/utilities.

Further, promoters of SA responsive genes, as described in the Reference tables, for example, are useful to modulate transcription that is induced by SA or any of the following phenotypes or biological activities below.

III.E.7.a. Use of Salicylic Acid-Responsive Genes to Modulate Phenotypes

SA responsive genes and gene products are useful to or modulate one or more phenotypes including pathogen tolerance and/or resistance; Avr/R locus Interactions; non-host interactions; HR; SAR, e.g., SA responsive genes and/or products in conjuction with any of the organisms listed below; resistance to bacteria e.g. to *Erwinia stewartii*, *Pseudomonas syringae*, *Pseudomonas tabaci*, Stuart's wilt, etc.; resistance to fungi e.g. to Downy mildews such as *Scleropthora macrospora*, *Sclerophthora rayissiae*, *Sclerospora graminicola*, *Peronosclerospora sorghi*, *Peronosclerospora philippinensis*, *Peronosclerospora sacchari*, *Peronosclerospora maydis*; rusts such As *Puccinia sorphi*, *Puccinia polysora*, *Physopella zeae*, etc.; and to other fungal diseases e.g. *Cercospora zeae-maydis*, *Colletotrichum graminicola*, *Fusarium monoliforme*, *Exserohilum turcicum*, *Bipolaris maydis*, *Phytophthora parasitica*, *Peronospora tabacina*, *Septoria*, etc.; resistance to viruses or viroids e.g., to Tobacco or Cucumber Mosaic Virus, Ringspot Virus, Necrosis Virus, *Pelargonium* Leaf Curl Virus, Red Clover Mottle Virus, Tomato Bushy Stunt Virus, and like viruses; resistance to insects, such as to aphids e.g. *Myzus persicae*; to beetles and beetle larvae; to lepidoptera larvae e.g. *Heliothus* etc.; resistance to nematodes, e.g. *Meloidogyne incognita* etc.; local resistance in primary (infected) or secondary (uninfected) leaves; stress tolerance; winter survival; cold tolerance; salt tolerance; heavy metal tolerance, such as cadmium; tolerance to physical wounding; increased organelle tolerance to redox stress (such as in mitochondria, and chloroplasts); cell death; programmed cell death, including death of diseased tissue and during senescence); fruit drop; biomass; fresh and dry weight during any time in plant life, such as maturation; number of flowers, seeds, branches, and/or leaves; seed yield, including number, size, weight, and/or harvest index; fruit yield, including number, size, weight, and/or harvest index; plant development; time to fruit maturity; cell wall strengthening and reinforcement; plant product quality; e.g. paper making quality); food additives; treatment of indications modulated by free radicals; and cancer.

To regulate any of the desired phenotype(s) above, activities of one or more of the SA responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Zhao et al. (1998, Plant Cell 10:359-70) and Alvarez et al. (1998, Cell 92: 733-84).

III.E.7.b. Use of Salicylic Acid-Responsive Genes to Modulate Biochemical Activities The activities of one or more of the SA responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATION INCLUDING ASSAYS |
|---|---|---|
| Protection From Microbial Pathogens | Systemic Acquired Resistance (SAR) Phytoalexin Biosynthesis PR Protein Biosynthesis Local Resistance Wound Response | Alvarez et al. (1998) Cell 92: 733-84 Lapwood et al. (1984) Plant Pathol. 33: 13-20 Davis et al. (1993) Phytochemistry 32: 607-11 |
| Cell Signaling | Modulation Of Reactive Oxygen Signaling Modulation Of No Signaling | Yahraus et al. (1995) Plant Physiol. 109: 1259-66 Alvarez et al. (1998) Cell 92: 773-784 Delledonne et al. (1998) Nature 394: 585-588 |
| Growth And Development | Lignification | Redman et al. (1999) Plant Physiol. 119: 795-804 |

Other biological activities that can be modulated by the SA responsive genes and gene products are listed in the Reference tables. Assays for detecting such biological activities are described in the Protein Domain table.

Salicylic acid responsive genes are characteristically differentially transcribed in response to fluctuating SA levels or concentrations, whether internal or external to an organism or cell. The MA_diff table reports the changes in transcript levels of various SA responsive genes in entire seedlings at 1 and 6 hours after the seedling was sprayed with a Hoagland's solution enriched with SA as compared to seedlings sprayed with Hoagland's solution only.

The data from this time course can be used to identify a number of types of SA responsive genes and gene products, including "early responders" and "delayed responders." Profiles of these different SA responsive genes are shown in the Table below together with examples of the kinds of associated biological activities.

| GENE EXPRESSION LEVELS | FUNCTIONAL CATEGORY OF GENE | PHYSIOLOGICAL CONSEQUENCES | EXAMPLES OF BIOCHEMICAL ACTIVITIES OF GENE PRODUCTS |
|---|---|---|---|
| Upregulated Genes (Level At 1 h ≅ 6 h) Or (Level At 1 h > 6 h) | Early Responders To SA | SA Perception SA Uptake Modulation Of SA Response Transduction Pathways | Transcription Factors Transporters, Kinases, Phosphatases, G-Proteins, LRR, DNA Remodelling Proteins |
| Upregulated Genes (Level At 1 h < 6 h) | Delayed Responders To SA | Specific Defensegene Transcription Initiation (E. G. Pr Genes, Pal | Proteases, PRProteins, Cellulases, Chitinases, Cutinases, Other Degrading Enzymes, Pal, Proteins Of Defense Pathways, Cell Wall Proteins Epoxide Hydrolases, Methyl Transferases |
| Downregulated (Level At 1 h ≅ 6 h) Or (Level At 6 h > 1 h) | Early Responder Repressors To SA Genes With Discontinued Expression Or UnsTable mRNA In The Presence Of SA | Negative Regulation Of SA Inducible Pathways Released | Transcription factors, kinases, phosphatases, G-proteins, LRR, transporters, calcium binding proteins, chromatin remodelling protein |
| Down-Regulated Transcripts (Level At 1 h > 6 h) | Delayed Responders To SA Metabolism Genes With Discontinued Expression Or UnsTable mRNA In The Presence Of SA | Negative Regulation Of SA Inducible Pathways Released | Transcription Factors, Kinases, Phosphatases, G-Proteins, LRR, Transporters, Calcium Binding Proteins, Chromatin Remodelling Protein |

Further, any desired sequence can be transcribed in similar temporal, tissue, or environmentally specific patterns as the SA responsive genes when the desired sequence is operably linked to a promoter of a SA responsive gene.

III.E.8. Nitric Oxide Responsive Genes, Gene Components and Products

The rate-limiting element in plant growth and yield is often its ability to tolerate suboptimal or stress conditions, including pathogen attack conditions, wounding and the presence of various other factors. To combat such conditions, plant cells deploy a battery of inducible defense responses, including synergistic interactions between nitric oxide (NO), reactive oxygen intermediates (ROS), and salicylic acid (SA). NO has been shown to play a critical role in the activation of innate immune and inflammatory responses in animals. At least part of this mammalian signaling pathway is present in plants, where NO is known to potentiate the hypersensitive response (HR). In addition, NO is a stimulator molecule in plant photomorphogensis.

Changes in nitric oxide concentration in the internal or surrounding environment, or in contact with a plant, results in modulation of many genes and gene products. Examples of such nitric oxide responsive genes and gene products are shown in the Reference and Sequence Tables. These genes and/or products are responsible for effects on traits such as plant vigor and seed yield. They were discovered and characterized from a much larger set by experiments designed to find genes whose mRNA products changed in response to nitric oxide treatment.

While nitric oxide responsive polynucleotides and gene products can act alone, combinations of these polynucleotides also affect growth and development. Useful combinations include different nitric oxide responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of the levels of such proteins is especially useful for altering phenotypes and biochemical activities of plants. In addition, the combination of a nitric oxide responsive polynucleotide and/or gene product with other environmentally responsive polynucleotides is also useful because of the interactions that exist between hormone-regulated pathways, stress pathways, pathogen stimulated pathways, nutritional pathways and development. Here, in addition to polynucleotides having similar transcription profiles and/or biological activities, useful combinations include polynucleotides that may have different transcription profiles but which participate in common or overlapping pathways. The MA_diff Table(s) reports the transcript levels of the experiment (see EXPT ID: 108584, 108585, 108526, 108527, 108559). For transcripts that had higher levels in the samples than the control, a "+" is shown. A "−" is shown for when transcript levels were reduced in root tips as compared to the control. For more experimental detail see the Example section below.

NO genes are those sequences that showed differential expression as compared to controls, namely those sequences identified in the MA_diff tables with a "+" or "−" indication.

NO Genes Identified by Cluster Analyses of Differential Expression

NO Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of NO genes is any group in the MA_clust that comprises a cDNA ID that also appears in Expt ID 108584, 108585, 108526, 108527, 108559 of the MA_diff table(s).

NO Genes Identified by Correlation to Genes that Cause Physiological Consequences Additionally, the differential expression data and the phenotypic observations can be merged to identify pathways or networks of NO genes. A group in the MA_clust is considered a NO pathway or network if the group comprises a cDNA ID that also appears in Knock-in or Knock-out tables that causes one or more of the phenotypes described in section above.

NO Genes Identified by Amino Acid Sequence Similarity

NO genes from other plant species typically encode polypeptides that share amino acid similarity to the sequences encoded by corn and *Arabidopsis* NO genes. Groups of NO genes are identified in the Protein Group table. In this table, any protein group that comprises a peptide ID that corresponds to a cDNA ID member of a NO pathway or network is a group of proteins that also exhibits NO functions/utilities.

Such nitric oxide responsive genes and gene products can function either to increase or dampen the above phenotypes or activities either in response to changes in nitric oxide concentration or in the absence of nitric oxide fluctuations. Further, promoters of nitric oxide responsive genes, as described in the Reference tables, for example, are useful to modulate transcription that is induced by nitric oxide or any of the following phenotypes or biological activities below.

III.E.8.a. Use of Nitric Oxide-Responsive Genes to Modulate Phenotypes:

Nitric oxide responsive genes and gene products are useful to or modulate one or more phenotypes including Stress Responses, Mediation of response to stresses, Disease resistance, Growth, Roots, Stems, Leaves, Cells, Promotes leaf cell elongation, Biomass; Fresh and Dry Weight during any time in plant life, such as at maturation; Size and/or Weight; Flowers, Seeds, Branches, Leaves, Roots, Development, Seed Development, Dormancy; Control rate and timing of germination, Prolongs seed storage and viability; and Senescence.

Further, any desired sequence can be transcribed in similar temporal, tissue, or environmentally specific patterns as the nitric responsive genes when the desired sequence is operably linked to a promoter of a nitric responsive gene.

To regulate any of the desired phenotype(s) above, activities of one or more of the nitric oxide responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998) Methods. Mol. Biol. 82: 259-266 and/or screened for variants as described in Winkler et al. (1998) Plant Physiol. 118: 743-50 and visually inspected for the desired phenotype. Alternatively, plants can be metabolically and/or functionally assayed according to Beligni and Lamattina (2000) Planta 210: 215-21), Lapwood et al (1984) Plant Pathol 33: 13-20, and/or Brown and Botstein (1999) Nature Genet. 21: 33-37.

III.E.8.b. Use of Nitric Oxide-Responsive Genes to Modulate Biochemical Activities:

The activities of one or more of the nitric oxide responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Stress Response | Programmed Cell Death | Levine et al (1996) Curr. Biol 6: 427-37 Sellins and Cohen (1991) Radiat. Res. 126: 88-95 |
| | Reactive Oxygen based Defence Pathways | Kumar and Klessig (2000) Mol. Plant Microbe Interact. 13: 347-351 |
| Disease Resistance | Microbial Pathogen resistance pathways | Lapwood et al (1984) Plant Pathol 33: 13-20 Kumar and Klessig (2000) Mol. Plant microbe interact.13: 347-351 Klessig et. al.(2000) Proc. Nat. Acad. Sci USA 97: 8849-8855 Delledonna et al(1998) Nature 394: 585-588 |
| | Programmed Cell Death | Levine et al (1996) Curr. Biol 6: 427-437 Sellins and Cohen (1991) Radiat. Res. 126: 88-95 |
| | Cellular Protectant Gene expression | Brown and Botstein (1999) Nat Genet 21: 33-37 |
| | Phytoalexin Biosynthesis | Davis et al. (1993) Phytochemistry 32: 607-611 |
| Signal Transduction | Regulation of hydrogen peroxide signaling | Wu et al. (1995) Plant Cell 7, 1357-1368 |
| Reorientation of nitrogen metabolism | Induction of ribosomal proteins, asparagine synthesis, proteases, Rnases | This study. Standard assays for detection of changes |
| Reorientation of sugar and energy metabolism | Induction of sugar transporters, ATPases, glycohydrolases, and glycolytic enzymes, for example | This study. Standard assays for detection of changes |

Other biological activities that can be modulated by the NO responsive genes and gene products are listed in the Reference Tables. Assays for detecting such biological activities are described in the Protein Domain table.

NO responsive genes are characteristically differentially transcribed in response to fluctuating NO levels or concentrations, whether internal or external to an organism or cell. The MA_diff table(s) report(s) the changes in transcript levels of various NO responsive genes in aerial tissues at 1 and 6 hours after a plant was sprayed with a Silwett L-77 solution enriched with 5 mM sodium nitroprus side, which is an NO donor. These changes are in comparison with plants sprayed with Silwett L-77 solution only.

The data from this time course can be used to identify a number of types of NO responsive genes and gene products, including "early responders" and "delayed responders" Profiles of these different nitric oxide responsive genes are shown in the Table below together with examples of the kinds of associated biological activities.

| GENE EXPRESSION LEVEL | FUNCTIONAL CATEGORY OF GENE | PHYSIOLOGICAL CONSEQUENCES | EXAMPLES OF BIOCHEMICAL ACTIVITY |
|---|---|---|---|
| Upregulated genes (level at 1 hour ≅ 6 hours) (level at 1 hour > 6 hours) | Early responder repressors to NO | NO Perception NO Uptake Modulation of NO Response Transduction Pathways | Transcription Factors Transporters Pathogen responsive proteins, salicylic and jasmonate pathway proteins |
| | | Specific Gene Transcription Initiation of Pathways to Optimize NO Response Pathways | Proteins to provide defence against active oxygen e.g. glutathione transferase, ascorbate free radical reductase, ascorbate peroxidase, nitrilase, heat shock proteins Proteins to reorient metabolism e.g. proteases, Rnases, proteasomes, asparagine synthetase, glycohydrolases, transporters |

-continued

| GENE EXPRESSION LEVEL | FUNCTIONAL CATEGORY OF GENE | PHYSIOLOGICAL CONSEQUENCES | EXAMPLES OF BIOCHEMICAL ACTIVITY |
|---|---|---|---|
| Upregulated transcripts (level at 1 hour < 6 hours) | Delayed NO responders | Maintenance of metabolism in presence of High NO Maintenace of disease defence pathways | Proteins to inhibit transport of nitric oxide Degradation enzymes NO Metabolic Pathway enzymes Pathogen responsive proteins, salicylic and jasmonate pathway proteins |
| | | Maintenance of pathways against reactive oxygen production | Proteins to provide defence against active oxygen e.g. glutathione transferase, ascorbate free radical reductase, ascorbate peroxidase, nitrilase, heat shock proteins |
| | | Maintenance of different metabolic programs | Proteins to reorient and sustain metabolism e.g. proteases, Rnases, proteasomes, asparagine synthetase, glycohydrolases, transporters, Proteins to inhibit transport of NO |
| Down Regulated Transcripts (level at 1 hours ≈ 6 hours) (level at 6 hours > 1 hour) | Early responders of NO utilization pathways | Selective cell death Negative regulation of NO utilization pathways released | Degradation enzymes Transcription factors Kinases and phosphatases Chromatin restructuring proteins |
| | Genes with discontinued expression or unsTable mRNA following nitric oxide uptake | Reorientation of metabolism | Transcription factors, metabolic enzymes, kinases and phosphatases, transporters, ribosomal proteins |
| | | Programmed cell death | Most proteins in cells undergoing cell death |
| Down Regulated Transcripts (level at 1 hour > 6 hours) | Delayed responder repressors of NO stress metabolism | Negative regulation of NO utilization pathways released | Transcription factors Kinases and phosphatases Chromatin restructuring proteins |
| | Genes with discontinued expression or unsTable mRNA following nitric oxide uptake | Reorientation of metabolism | Transcription factors, metabolic enzymes, kinases and phosphatases, transporters, ribosomal proteins. |
| | | Programmed cell death | Most proteins in cells undergoing programmed cell death |

Use of Promoters of No Responsive Genes

Promoters of NO responsive genes are useful for transcription of any desired polynucleotide or plant or non-plant origin. Further, any desired sequence can be transcribed in a similar temporal, tissue, or environmentally specific patterns as the NO responsive genes where the desired sequence is operably linked to a promoter of a NO responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.9. Osmotic Stress Responsive Genes, Gene Components and Products

The ability to endure and recover from osmotic and salt related stress is a major determinant of the geographical distribution and productivity of agricultural crops. Osmotic stress is a major component of stress imposed by saline soil and water deficit. Decreases in yield and crop failure frequently occur as a result of aberrant or transient environmental stress conditions even in areas considered suitable for the cultivation of a given species or cultivar. Only modest increases in the osmotic and salt tolerance of a crop species would have a dramatic impact on agricultural productivity. The development of genotypes with increased osmotic tolerance would provide a more reliable means to minimize crop losses and diminish the use of energy-costly practices to modify the soil environment.

Changes in the osmotic concentration of the surrounding environment or within a plant results in modulation of many genes and gene products. Examples of such osmotic stress responsive genes and gene products, including salt responsive genes, are shown in the Reference, Sequence, Protein Group, Protein Group Matrix, MA_diff and MA_clust tables. These genes and/or products are responsible for effects on traits such as plant vigor and seed yield.

While osmotic and/or salt stress responsive polynucleotides and gene products can act alone, combinations of these polynucleotides also affect growth and development. Useful combinations include different osmotic stress responsive polynucleotides and/or gene products that have similar transcription profiles or similar biological activities, and members of the same or similar biochemical pathways. In addition, the combination of an osmotic stress responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in a common pathway.

Such osmotic and/or salt stress responsive genes and gene products can function to either increase or dampen the above phenotypes or activities either in response to changes in osmotic concentration or in the absence of osmotic fluctuations. The MA_diff Table(s) reports the transcript levels of the experiment (see EXPT ID: 108570, 108571, 108541, 108542, 108553, 108539, 108540). For transcripts that had higher levels in the samples than the control, a "+" is shown. A "−" is shown for when transcript levels were reduced in root tips as compared to the control. For more experimental detail see the Example section below.

Osmotic Stress genes are those sequences that showed differential expression as compared to controls, namely those sequences identified in the MA_diff tables with a "+" or "−" indication.

Osmotic Stress Genes Identified by Cluster Analyses of Differential Expression

Osmotic Stress Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Osmotic Stress genes is any group in the MA_clust that comprises a cDNA ID that also appears in Expt ID 108570, 108571, 108541, 108542, 108553, 108539, 108540 of the MA_diff table(s).

Osmotic Stress Genes Identified by Correlation to Genes that Cause Physiological Consequences Additionally, the differential expression data and the phenotypic observations can be merged to identify pathways or networks of Osmotic Stress genes. A group in the MA_clust is considered a Osmotic Stress pathway or network if the group comprises a cDNA ID that also appears in Knock-in or Knock-out tables that causes one or more of the phenotypes described in section above.

Osmotic Stress Genes Identified by Amino Acid Sequence Similarity

Osmotic Stress genes from other plant species typically encode polypeptides that share amino acid similarity to the sequences encoded by corn and *Arabidopsis* Osmotic Stress genes. Groups of Osmotic Stress genes are identified in the Protein Group table. In this table, any protein group that comprises a peptide ID that corresponds to a cDNA ID member of a Osmotic Stress pathway or network is a group of proteins that also exhibits Osmotic Stress functions/utilities.

Further, promoters of osmotic stress responsive genes, as described in the Reference tables, for example, are useful to modulate transcription that is induced by osmotic stress or any of the following phenotypes or biological activities below.

III.E.9.a. Use of Osmotic Stress Responsive Genes to Modulate Phenotypes

Osmotic stress responsive genes and gene products are useful to or modulate one or more phenotypes including growth; roots; stems; leaves; development (such as cell growth by DNA synthesis and cell division, seed development (with regard to desiccation tolerance and dormancy, such as control rate of germination and prolongs seed storage and viability and senescence); stress responses; desiccation; drought; and salt.

To regulate any of the phenotype(s) above, activities of one or more of the osmotic stress responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to de Castro (1998, Phytochemistry 47: 689-694), Xu (1998, J Exp Bot 49: 573-582), Ausubel et al. (In: Current Protocols in Molecular Biology (1999) Volume 1, chapter 4, eds. Ausubel, Brent, Kingston, Moore, Seidman, Smith and Struhl, New York, N.Y.) and De Castro et al. (2000, Plant Physiol 122: 327-36)

III.E.9.b. Use of Osmotic Stress Responsive Genes to Modulate Biochemical Activities The activities of one or more of the osmotic stress responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Cell Growth And Differentiation | Regulation Of Osmolyte Synthesis | Yoshu et al. (1995) The Plant Journal 7: 751-60 |
| | Regulation Of Glycolate Pathway And Photoinhibition Of Photosystem II In Response To Stress | Streb et al. (1993) Physiologia Plantarum. 88: 590-598 |
| Gene Regulation | Transcriptional Regulation Of Osmotic Stress Induced Proteins Through DNA Binding Proteins | Current Protocols in Molecular Biology/edited by Frederick M. Ausubel . . . [et al.]. New York: Published by Greene Pub. Associates and Wiley-Interscience: J. Wiley, c1987 |
| | Transcriptional Regulation Of Osmotic Stress Induced Proteins Through Protein Phosphorylation And Dephosphorylation | Jonak (1996) Proceedings of the National Academy of Sciences of the United States of America, 93: 11274-11279; Monroy, A. et al., (1998) Analytical Biochemistry 265: 183-185; |
| | Regulation Of Osmotic Stress Induced Gene Protein Accumulation By Protein Protein Intereaction Between Osmotic Stress Regulated Genes And Protein Phosphatase 2C | McCright (1998) IN: Methods in Molecular Biology; Protein phosphatase protocols; Ludlow (1998) Humana Press Inc.; Suite 808, 999 Riverview Drive, Totowa, New Jersey 07512, USA.: 263-277. |
| | Transcriptional Regulation Of Heat Induced Genes Through Chromatin Remodeling | Luo and Dean (1999) Journal of the National Cancer Institute 91: 1288-1294; Chromatin protocols (1999) edited by Peter B. Becker. Totowa, N.J.: Humana Press |
| | Activity Of Abcisic Acid Regulated DNA Binding Proteins Accumulation Of RNA Binding Proteins That Regulate Osmotic Stress | Gubler et al. (1999) Plant Journal 17: 1-9 Sato (1995) Nucleic Acids Research 23: 2161-2167. |
| Stress Response | Synthesis And Metabolism Of Osmoprotectants Such As Betaine, Proline And Trehalase | Minocha et al. (1999) Plant Physiol and Biochem 37: 597-603 |
| | Regulation Of Sugar Transporters | Dejardin et al. (1999) Biochem J; 344 Pt 2: 503-9 |
| | Regulation Of Vacuolar Sodium/Proton Antiport Activity And The Detoxification Of Cations | Gaxiola et al. (1999) PNAS USA 96: 1480-1485 |
| | Regulation Of Intracellular Na+ And Li+ Ion Concentrations | Espinoza-Ruiz et al. (1999) The Plant Journal 20: 529-539 |
| | Regulation Of Universal Stress Protein Homologue Activity By Phosphorylation And Dephosphorylation. Regulation/Maintenance Of Protein Stability During Thermal Stress | Freestone et al. (1997) Journal of Molecular Biology, v. 274: 318-324 Walker (1996) Humana Press Inc. Suite 808, 999 Riverview Drive, Totowa, New Jersey 07512, USA |

-continued

| PROCESS | BIOCHEMICAL OR METABOLIC ACTIVITIES AND/OR PATHWAYS | CITATIONS INCLUDING ASSAYS |
|---|---|---|
| | Regulation Of Protein Degradation During Thermal Stress. | Vierstra (1996) Plant Molecular Biology, 32: 275-302. Vierstra and Callis (1999) Plant Molecular Biology, 41: 435-442 |
| Signal Transduction | Activation Of Stress Response Genes | Xinong et al. (1999) The Plant Journal 19: 569-578 |
| | Salt Tolerance | Piao (1999) Plant Physiol 19: 1527-1534 |
| | Calcium Mediated Stress Response | Subbaiah et al. (1994) Plant Physiology 105: 369-376 Kudla et al. (1999) PNAS USA 96: 4718-4723 |

Other biological activities that can be modulated by the osmotic stress responsive genes and gene products are listed in the Reference tables. Assays for detecting such biological activities are described in the Protein Domain table.

Osmotic stress responsive genes are characteristically differentially transcribed in response to fluctuating osmotic stress levels or concentrations, whether internal or external to an organism or cell. MA_diff table reports the changes in transcript levels of various osmotic stress responsive genes in aerial tissues of plants at 1 and 6 hours after the plants were sprayed with Hoagland's solution containing 20% PEG as compared to aerial tissues from plants sprayed with Hoagland's solution only.

The data from this time course can be used to identify a number of types of osmotic stress responsive genes and gene products, including "early responding," "sustained osmotic stress responders," "repressors of osmotic stress pathways" and "osmotic stress responders." Profiles of these different osmotic stress responsive genes are shown in the Table below together with examples of the kinds of associated biological activities.

| GENE EXPRESSION LEVELS | FUNCTIONAL CATEGORY OF GENES | PHYSIOLOGICAL CONSEQUENCES | EXAMPLES OF BIOCHEMICAL ACTIVITIES OF GENE PRODUCTS |
|---|---|---|---|
| Up Regulated Transcripts (Level At 1 Hour ≅ 6 Hours) (Level At 1 Hour > 6 Hours) | Early Responders To Osmotic Stress Universal Stress Response Genes Osmotic Stress Responders Abscisic Acid Biosynthesis And Perception | Osmotic Stress Perception Osmolyte Uptake Modulation Of Osmotic Stress Response Signal Transduction Pathways Specific Gene Transcription Initiation Specific Gene Transcription Repression Translation Activation Translation Repression Repression Of "Normal State" Pathways To Optimize Osmotic Stress Response Activation Of Stress Signaling Pathways Up Regulation Of Abscisic Acid Biosynthesis Pathway Protein Accumulation And Activity Scavenging Reactive Oxygen Species Modification Of Cell Wall Composition | Transcription Factors Transcription Coactivators Membrane Transporters Proline Biosynthesis Selective Inhibition Of Osmolyte Transport Protein Ubiquitination Protein Degradation Rna Binding Proteins Modification Of Protein Activity By Phosphatases, Kinases Synthesis And Or Activation Of Oxide Hydrolases, Suoeroxidedismutase, Iron Ascorbate Peroxidase Activation Of Signaling Pathway By Calcium Binding Proteins, Modification Of |

-continued

| GENE EXPRESSION LEVELS | FUNCTIONAL CATEGORY OF GENES | PHYSIOLOGICAL CONSEQUENCES | EXAMPLES OF BIOCHEMICAL ACTIVITIES OF GENE PRODUCTS |
|---|---|---|---|
| | | Up-Regulation Of Universal Stress Response Protein Accumulation | Protein Activity By Protein-Protein Interaction Change In Chromatin Structure And/Or Localized Dna Topology Modification Of Pre-Existing Translation Factors By Phosphorylation (Kinases) Or Dephosphorylation (Phosphatases) Synthesis Of New Translation Factors Abscisic Acid Biosynthesis |
| Up Regulated Transcripts (Level At 1 Hr < 6 Hr) | Sustained Osmotic Stress Responders Repressor Of Osmotic Stress Pathways Abscisic Acid Perception, Biosynthesis And Regulation | Osmolyte Adjustment And Adaptation Photosynthetic Activity Modification Activation Of "Normal State" Biosynthesis Genes Negative Regulation Of Osmotic Stress Pathways Negative Regulation Of Abscisic Acid Biosynthesis Acivation Of Abscisic Acid Degradation Pathway Cell Wall Composition Modification | Osmotic Stress Metabolic Pathways Sugar Biosynthetic Pathways Sugar Transporters Transcription Factors Transcription Coactivators Membrane Transporters Abscisic Acid Biosynthesis |
| Down-Regulated Transcripts (Level At 1 Hr ≈ 6 Hr) (Level At 6 Hr > 1 Hr) | Early Responder Repressors Of "Normal" State Of Metabolism Negative Regulators Of Abscisic Acid Biosynthesis And Perception. Positive Regulators Of "Normal State" Metabolic Pathways. | Metabolic Repression Specific Gene Transcription Initiation Specific Gene Transcription Repression Translation Activation Translation Repression Abscisic Acid Degradation Protein Degradation | Transcription Factors Transcription Coactivators Protein Degradation Rna Binding Proteins Modification Of Protein Activity By Phosphatases, Kinases Activation Of Signaling Pathway By Calcium Binding Proteins, Modification Of Protein Activity By Protein-Protein Interaction Change In Chromatin Structure And/Or Localized Dna Topology Modification Of Pre-Existing Translation Factors By Phosphorylation (Kinases) Or Dephosphorylation (Phosphatases) Synthesis Of New Translation Factors |

-continued

| GENE EXPRESSION LEVELS | FUNCTIONAL CATEGORY OF GENES | PHYSIOLOGICAL CONSEQUENCES | EXAMPLES OF BIOCHEMICAL ACTIVITIES OF GENE PRODUCTS |
|---|---|---|---|
| Down-Regulated Transcripts (Level At 1 Hr > 6 Hr) | Repressors Of "Normal" State Of Metabolism Genes With Discontinued Expression Or UnsTable mRNA In Presence Of Osmotic Stress Repressor Of Osmotic Stress Pathways Repressors Of Abscisic Acid Biosynthesis, Perception And Regulation | Osmotic Stress Adaptation Negative Regulation Of Abscisic Acid Biosynthesis Negative Regulation Of Osmotic Stress Response Pathways Genes Osmolyte Synthesis And Osmolyte Cellular Partitioning Readjustment Activation Of "Normal State" Metabolic Pathways | Transcription Factors Transcription Coactivators Protein Degradation Rna Binding Proteins Modification Of Protein Activity By Phosphatases, Kinases Activation Of Signaling Pathway By Calcium Binding Proteins, Modification Of Protein Activity By Protein-Protein Interaction Change In Chromatin Structure And/Or Localized Dna Topology Modification Of Pre-Existing Translation Factors By Phosphorylation (Kinases) Or Dephosphorylation (Phosphatases) Synthesis Of New Translation Factors Sugar Biosynthetic Pathways Sugar Transporters |

Further, any desired sequence can be transcribed in similar temporal, tissue, or environmentally specific patterns as the osmotic stress responsive genes when the desired sequence is operably linked to a promoter of an osmotic stress responsive gene.

III.E.10. Aluminum Responsive Genes, Gene Components and Products

Aluminum is toxic to plants in soluble form ($Al^{3+}$). Plants grown under aluminum stress have inhibited root growth and function due to reduced cell elongation, inhibited cell division and metabolic interference. As an example, protein inactivation frequently results from displacement of the Mg2+ cofactor with aluminum. These types of consequences result in poor nutrient and water uptake. In addition, because stress perception and response occur in the root apex, aluminum exposure leads to the release of organic acids, such as citrate, from the root as the plant attempts to prevent aluminum uptake.

The ability to endure soluble aluminum is a major determinant of the geographical distribution and productivity of agricultural crops. Decreases in yield and crop failure frequently occur as a result of aberrant, hot conditions even in areas considered suitable for the cultivation of a given species or cultivar. Only modest increases in the aluminum tolerance of crop species would have a dramatic impact on agricultural productivity. The development of genotypes with increased aluminum tolerance would provide a more reliable means to minimize crop losses and diminish the use of costly practices to modify the environment.

Microarray technology allows monitoring of gene expression levels for thousands of genes in a single experiment. This is achieved by simultaneously hybridizing two differentially labeled fluorescent cDNA pools to glass slides that contain spots of DNA (Schena et al. (1995) Science 270: 467-70). The *Arabidopsis* Functional Genomics Consortium (AFGC) has recently made public the results from such microarray experiments conducted with AFGC chips containing 10,000 non-redundant ESTs, selected from 37,000 randomly sequenced ESTs generated from mRNA of different tissues and developmental stages.

The sequences of the ESTs showing at least two-fold increases or decreases over the controls were identified, compared to the Ceres full-length cDNA and genomic sequence databanks, and identical Ceres clones identified. MA_diff table reports the results of this analysis, indicating those Ceres clones which are up or down regulated over controls, thereby indicating the Ceres clones which are aluminum response responsive genes.

The MA_diff Table(s) reports the transcript levels of the experiment (see EXPT ID: Aluminum (relating to SMD 7304, SMD 7305)). For transcripts that had higher levels in the samples than the control, a "+" is shown. A "−" is shown for when transcript levels were reduced in root tips as compared to the control. For more experimental detail see the Example section below.

Aluminum genes are those sequences that showed differential expression as compared to controls, namely those sequences identified in the MA_diff tables with a "+" or "−" indication.

Aluminum Genes Identified by Cluster Analyses of Differential Expression

Aluminum Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Aluminum genes is any group in the MA_clust that comprises a cDNA ID that also appears in Expt ID Aluminum (relating to SMD 7304, SMD 7305) of the MA_diff table(s).

Aluminum Genes Identified by Correlation to Genes that Cause Physiological Consequences Additionally, the differential expression data and the phenotypic observations can be merged to identify pathways or networks of Aluminum genes. A group in the MA_clust is considered a Aluminum pathway or network if the group comprises a cDNA ID that also appears in Knock-in or Knock-out tables that causes one or more of the phenotypes described in section above.

Aluminum Genes Identified by Amino Acid Sequence Similarity

Aluminum genes from other plant species typically encode polypeptides that share amino acid similarity to the sequences encoded by corn and *Arabidopsis* Aluminum genes. Groups of Aluminum genes are identified in the Protein Group table. In this table, any protein group that comprises a peptide ID that corresponds to a cDNA ID member of a Aluminum pathway or network is a group of proteins that also exhibits Aluminum functions/utilities.

III.E.10.a. Use of Aluminum Response Genes to Modulate Phenotypes

Changes in aluminum concentrations in a plant's surrounding environment results in modulation of many genes and gene products. Examples of such aluminum response genes and gene products are shown in the Reference and Sequence Tables. These genes and/or products are responsible for effects on traits such as plant vigor and seed yield.

While aluminum responsive polynucleotides and gene products can act alone, combinations of these polynucleotides also affect growth and development. Useful combinations include different aluminum responsive polynucleotides and/or gene products that have similar transcription profiles or similar biological activities, and members of the same or similar biochemical pathways. In addition, the combination of a aluminum responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in a common pathway.

Such aluminum responsive genes and gene products can function to either increase or dampen the above phenotypes or activities either in response to changes in aluminum concentration or in the absence of aluminum fluctuations.

More specifically, aluminum responsive genes and gene products are useful to or modulate one or more phenotypes including growth; roots (such as inhibition of root elongation); stems; leaves; whole plant; development (such as cell growth, elongation, and division) and mediates response to oxidative stress, calcium-mediated defense, antioxidant defense and pathogenesis.

To produce the desired phenotype(s) above, one or more of the aluminum response genes or gene products can be tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Li and Fleming (1999, FEBS Lett 461: 1-5), Delhaize et al. (1999, J Biol Chem 274: 7082-8), Sigimoto and Sakamoto (1997, Genes Genet Syst 72: 311-6), Esaki et al. (2000, Plant Physiol 122: 657-65), Leonard and Gerber (1988, Mutat Res 196: 247-57), Baisakhi et al. (2000, Mutat Res 465: 1-9), Ma (2000, Plant Cell Physiol 41: 383-90) and Koyama et al. (1999, Plant Cell 40: 482-8)

Alternatively, the activities of one or more of the aluminum responsive genes can be modulated to change biochemical or metabolic activities and/or pathways such as those noted below. Such biological activities can be measured according to the citations included in the Table below:

| GENERAL CATEGORY | BIOCHEMICAL OR METABOLIC ACTIVITIES AND/OR PATHWAYS | ASSAY |
| --- | --- | --- |
| Cell Growth and Development | Phospholipase D (PLD) activity | Toda et al. (1999) Biosci Biotechnol Biochem 63: 210-212 |
| | Regulation of Phosphtidylserine Synthase (PSS) | |
| | Cell wall strengthening | Hamel et al. (1998) Planta 205: 531-38 |
| Stress Response | Regulation of oxidative stress | Esaki et al. (2000) Plant Physiol 122: 657-655 |
| | Regulation of antioxidant defense and DNA repair | Baisakhi et al. (2000) Mutat Res 465: 1-9 |
| | Secretion of Organic Acids (e.g. maleate, citrate) from root apex | Koyama et al. (1999) Plant Cell 40: 482-8 |
| | Ca2+mediated Defense Responses Against Low pH | Plieth et al. (1999) Plant J 18: 634-50 |
| Signaling | H+ transport | Degenhardt et al. (1988) Plant Physil 117: 19-27 |
| | Auxin transport | Rashotte et al. (2000) Plant Physiol 122: 481-90 |

Other biological activities that can be modulated by aluminum response genes and their products are listed in the REFERENCE Table. Assays for detecting such biological activities are described in the Protein Domain table.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | responders to aluminum application | Aluminum perception Aluminum uptake and transport Aluminum metabolism Synthesis of secondary metabolites and/or proteins Modulation of aluminum response transduction pathways Specific gene transcription initiation | Transporters Metabolic enzymes Change in cell membrane structure and potential Kinases and phosphatases Transcription activators Change in chromatin structure and/or localized DNA topology |
| Down-regulated transcripts | responder to aluminum repressors of aluminum state of metabolism Genes with discontinued expression or unsTable mRNA in presence of aluminum | Negative regulation of aluminum pathways Changes in pathways and processes operating in cells Changes in other metabolisms than aluminum | Transcription factors Change in protein structure by phosphorylation (kinases) or dephosphorylation (phosphatases) Change in chromatin structure and/or DNA topology Stability of factors for protein synthesis and degradation Metabolic enzymes |

Use of Promoters of Aluminum Responsive Genes

Promoters of Aluminum responsive genes are useful for transcription of any desired polynucleotide or plant or non-plant origin. Further, any desired sequence can be transcribed in a similar temporal, tissue, or environmentally specific patterns as the Aluminum responsive genes where the desired sequence is operably linked to a promoter of a Aluminum responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.11. Cadmium Responsive Genes, Gene Components and Products

Cadmium (Cd) has both toxic and non-toxic effects on plants. Plants exposed to non-toxic concentrations of cadmium are blocked for viral disease due to the inhibition of systemic movement of the virus. Surprisingly, higher, toxic levels of Cd do not inhibit viral systemic movement, suggesting that cellular factors that interfere with the viral movement are triggered by non-toxic Cd concentrations but repressed in high Cd concentrations. Furthermore, exposure to non-toxic Cd levels appears to reverse posttranslational gene silencing, an inherent plant defense mechanism. Consequently, exploring the effects of Cd exposure has potential for advances in plant disease control in addition to soil bio-remediation and the improvement of plant performance in agriculture.

Changes in cadmium concentrations in a plant's surrounding environment results in modulation of many genes and gene products. Microarray technology allows monitoring of gene expression levels for thousands of genes in a single experiment. This is achieved by simultaneously hybridizing two differentially labeled fluorescent cDNA pools to glass slides that contain spots of DNA (Schena et al. (1995) Science 270: 467-70). The US Arabidopsis Functional Genomics Consortium (AFGC) has recently made public the results from such microarray experiments conducted with AFGC chips containing some 10,000 non-redundant ESTs, selected from about 37,000 randomly sequenced ESTs generated from mRNA of different tissues and developmental stages.

The sequences of the ESTs showing at least two-fold increases or decreases in plants treated with 10 µM cadmium compared with untreated plants were identified, compared to the Ceres full length cDNA and genomic sequence databanks, and the equivalent Ceres clones identified. The MA_diff table(s) report(s) the results of this analysis, indicating those Ceres clones which are up or down regulated over controls, thereby indicating the Ceres clones which represent cadmium responsive genes.

Examples of such cadmium responsive genes and gene products are shown in the Reference and Sequence Tables. These genes and/or products are responsible for effects on traits such as plant vigor and seed yield.

While cadmium responsive polynucleotides and gene products can act alone, combinations of these polynucleotides also affect growth and development. Useful combinations include different cadmium responsive polynucleotides and/or gene products that have similar transcription profiles or similar biological activities, and members of the same or similar biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants. In addition, the combination of a cadmium responsive polynucleotide and/or gene product with other environmentally responsive polynucleotides is also useful because of the interactions that exist between, for example, stress and pathogen induced pathways, nutritional pathways and development. Here, in addition to polynucleotides having similar transcription profiles and/or biological activities, useful combinations include polynucleotides that may have different transcription profiles but which participate in common or overlapping pathways.

The MA_diff Table(s) reports the transcript levels of the experiment (see EXPT ID: Cadium (relating to SMD 7427, SMD 7428)). For transcripts that had higher levels in the samples than the control, a "+" is shown. A "−" is shown for when transcript levels were reduced in root tips as compared to the control. For more experimental detail see the Example section below.

Cadium genes are those sequences that showed differential expression as compared to controls, namely those sequences identified in the MA_diff tables with a "+" or "−" indication.

Cadium Genes Identified by Cluster Analyses of Differential Expression

Cadium Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Cadium genes is any group in the MA_clust that comprises a cDNA ID that also appears in Expt ID Cadium (relating to SMD 7427, SMD 7428) of the MA_diff table(s).

Cadium Genes Identified by Correlation to Genes that Cause Physiological Consequences Additionally, the differential expression data and the phenotypic observations can be merged to identify pathways or networks of Cadium genes. A group in the MA_clust is considered a Cadium pathway or network if the group comprises a cDNA ID that also appears in Knock-in or Knock-out tables that causes one or more of the phenotypes described in section above.

Cadium Genes Identified by Amino Acid Sequence Similarity

Cadium genes from other plant species typically encode polypeptides that share amino acid similarity to the sequences encoded by corn and *Arabidopsis* Cadium genes. Groups of Cadium genes are identified in the Protein Group table. In this table, any protein group that comprises a peptide ID that corresponds to a cDNA ID member of a Cadium pathway or network is a group of proteins that also exhibits Cadium functions/utilities.

Such cadmium responsive genes and gene products can function to either increase or dampen phenotypes or activities either in response to changes in cadmium concentration or in the absence of cadmium fluctuations. Further, promoters of cadmium responsive genes, as described in the Reference tables, for example, are useful to modulate transcription that is induced by cadmium or any of the following phenotypes or biological activities below.

III.E.11.a. Use of Cadmium Responsive Genes, Gene Components and Products to Modulate Phenotypes Cadmium responsive genes and gene products are useful to or modulate one or more phenotypes including growth, roots, initiation and maintenance of cell division, stems, leaves, development, mitochondria, post-embryonic root meristem development, senescence, stress response, modulation of jasmonic acid and other stress control pathways, metabolic detoxification, heavy metals, plant and seed yield; and fruit yield.

Further, any desired sequence can be transcribed in similar temporal, tissue, or environmentally specific patterns as the cadmium responsive genes when the desired sequence is operably linked to a promoter of a cadmium responsive gene.

To regulate any of the phenotype(s) above, activities of one or more of the cadmium responsive genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998) Methods. Mol. Biol. 82:259-266) and/or screened for variants as in Winkler et al. (1998) Plant Physiol 118: 743-50 and visually inspected for the desired phenotype or metabolically and/or functionally assayed according to Ghoshroy et al. (1998, Plant J 13: 591-602), Citovsky et al. (1998, Plant J 16: 13-20), Clemens et al. (1999, EMBO J 18: 3325-33), Chen et al. (2000, Chemosphere 41: 229-34), Xian and Oliver (1998, Plant Cell 10: 1539-90), Romero-Peurtas et al. (1999, Free Rad Res 31: S25-31), Gaur and Noraho (1995, Biomed Environ Sci 8: 202-10), Thomine et al. (2000, PNAS USA 97: 4991-6), Howden et al. (1995, Plant Physiol 107: 1067-73), Kesseler and Brand (1994, Eur J Biochem 225: 907-22) and Vernoux et al. (2000, Plant Cell 12: 97-110).

III.E.10.b. Use of Cadmium-Responsive Genes, Gene Components and Products to Modulate Biochemical Activities The activities of one or more of the cadmium responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Growth, Differentiation and Development | Root Growth | Thomine et al. (2000) PNAS USA 97: 4991-6 |
| | Initiation and maintenance of cell division | Vernoux et al. (2000) Plant Cell 12: 97-110 |
| | Resistance to Cadmium-inhibition of root growth | |
| Metabolism | Cadmium sensing | Howden et al. (1995) Plant Physiol 107: 1067-73 |
| | Cadmium uptake and transport | Gaur and Noraho (1995) Biomed Environ Sci 8: 202-10 |

| PROCESS | BIOCHEMICAL OR METABOLIC ACTIVITIES AND/OR PATHWAYS | CITATIONS INCLUDING ASSAYS |
|---|---|---|
| Plant Defenses | Decreased cadmium transport Phytoremediation | Thomine et al. (2000) PNAS USA 97: 4991-6 |
| | Inhibition of oxidative phophorylation | Kesseler and Brand (1994) Eur. Biochem 225: 907-22 |
| | Viral resistance Inhibition of systemic movement of virus Block of viral disease | Ghoshroy et al. (1998) Plant J 13: 591-602 |
| | Detoxification of heavy metals | Clemens et al. (1999) EMBO J 18: 3325-33 |
| | Enhanced stress resistance | Romero-Peurtas et al. (1999) Free Rad Res 31: S25-31 |
| | Cadmium resistance via modulation of jasmonic acid signaling pathway | Xiang and Oliver (1998) Plant Cell 10: 1539-90 |
| Signaling | Relief of post-translational gene silencing | Citovsky et al. (1998) Plant J 16: 13-20 |

Other biological activities that can be modulated by the cadmium responsive genes and gene products are listed in the Reference tables. Assays for detecting such biological activities are described in the Protein Domain table.

Cadmium responsive genes are characteristically differentially transcribed in response to fluctuating cadmium levels or concentrations, whether internal or external to an organism or cell. The MA_diff table(s) report(s) the changes in transcript levels of various cadmium responsive genes following treatment with 10 µM cadmium, relative to untreated plants.

Profiles of some cadmium responsive genes are shown in the Table below together with examples of the kinds of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to cadmium Application Genes induced by cadmium | Cadmium perception Cadmium uptake and transport Cadmium metabolism Synthesis of secondary metabolites and/or proteins Modulation of cadmium response transduction pathways Specific gene transcription initiation Genes involved in inhibiting systemic movement of plant viral RNA Genes involved in post translational gene silencing | Transporters Metabolic enzymes Change in cell membrane structure and potential Kinases and Phosphatases Transcription activators Change in chromatin structure and/or localized DNA topology RNA binding proteins |
| Down-regulated transcripts | Responders to cadmium Genes repressed by cadmium Genes with discontinued expression or unsTable mRNA in presence of cadmium | Negative regulation of cadmium pathways released Changes in pathways and processes operating in cells Changes in metabolism other than cadmium pathways Genes involved in facilitating systemic movement of plant viral RNA Genes involved in promoting post translational gene silencing | Transcription factors Change in protein structure by phosphorylation (kinases) or Dephosphoryaltion (phosphatases) Change in chromatin structure and/or DNA topology Factors for protein synthesis and degradation Metabolic enzymes RNA binding proteins |

Use of Promoters of Cadmium Responsive Genes

Promoters of Cadmium responsive genes are useful for transcription of any desired polynucleotide or plant or non-plant origin. Further, any desired sequence can be transcribed in a similar temporal, tissue, or environmentally specific patterns as the Cadmium responsive genes where the desired sequence is operably linked to a promoter of a Cadmium responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.12. Disease Responsive Genes, Gene Components and Products

Often growth and yield are limited by the ability of a plant to tolerate stress conditions, including pathogen attack. To combat such conditions, plant cells deploy a battery of inducible defense responses, including the triggering of an oxidative burst and the transcription of pathogenesis-related protein (PR protein) genes. These responses depend on the recognition of a microbial avirulence gene product (avr) by a plant resistance gene product (R), and a series of downstream signaling events leading to transcription-independent and transcription-dependent disease resistance responses. Reactive oxygen species (ROS) such as $H_2O_2$ and NO from the oxidative burst plays a signaling role, including initiation of the hypersensitive response (HR) and induction of systemic acquired resistance (SAR) to secondary infection by unrelated pathogens. PR proteins are able to degrade the cell walls of invading microorganisms, and phytoalexins are directly microbicidal.

The presence of an avirulent pathogen and/or changes in the concentrations of $O_2^-$, $H_2O_2$ and NO in the environment surrounding a plant cell modulate the activities of many genes and, therefore, the levels of many gene products. Examples of tobacco mosaic virus (TMV) responsive genes and gene products, many of them operating through an ROS signaling system, are shown in The Reference and Sequence Tables. These genes and/or products are responsible for effects on traits such as plant vigor and seed yield. The genes were discovered and characterized from a much larger set by experiments designed to find genes whose mRNA products changed in response to application of TMV to plants.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing some 10,000 non-redundant ESTs, selected from about 37,000 randomly sequenced ESTs generated from mRNA of different tissues and developmental stages.

The sequences of the ESTs showing at least two-fold increases or decreases in response to TMV infection over the non infected controls were identified, compared to the Ceres full length cDNA and genomic sequence databanks, and equivalent Ceres clones identified. The MA_diff table(s) report(s) the results of this analysis, indicating those Ceres clones which are up or down regulated over controls, thereby indicating the Ceres clones which represent disease responsive genes.

Manipulation of one or more disease responsive gene activities is useful to modulate the biological processes and/or phenotypes listed below. Disease responsive genes and gene products can act alone or in combination. Useful combinations include disease responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants.

Such disease responsive genes and gene products can function to either increase or dampen the above phenotypes or activities either in response to changes in active oxygen concentration or in the absence of active oxygen fluctuations. The MA_diff Table(s) reports the transcript levels of the experiment (see EXPT ID: Disease (relating to SMD 7342, SMD 7343)). For transcripts that had higher levels in the samples than the control, a "+" is shown. A "−" is shown for when transcript levels were reduced in root tips as compared to the control. For more experimental detail see the Example section below.

Disease genes are those sequences that showed differential expression as compared to controls, namely those sequences identified in the MA_diff tables with a "+" or "−" indication.

Disease Genes Identified by Cluster Analyses of Differential Expression

Disease Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Disease genes is any group in the MA_clust that comprises a cDNA ID that also appears in Expt ID Disease (relating to SMD 7342, SMD 7343) of the MA_diff table(s).

Disease Genes Identified by Correlation to Genes that Cause Physiological Consequences Additionally, the differential expression data and the phenotypic observations can be merged to identify pathways or networks of Disease genes. A group in the MA_clust is considered a Disease pathway or network if the group comprises a cDNA ID that also appears in Knock-in or Knock-out tables that causes one or more of the phenotypes described in section above.

Disease Genes Identified by Amino Acid Sequence Similarity

Disease genes from other plant species typically encode polypeptides that share amino acid similarity to the sequences encoded by corn and *Arabidopsis* Disease genes. Groups of Disease genes are identified in the Protein Group table. In this table, any protein group that comprises a peptide ID that corresponds to a cDNA ID member of a Disease pathway or network is a group of proteins that also exhibits Disease functions/utilities.

Further, promoters of disease responsive genes, as described in the Reference tables, for example, are useful to modulate transcription that is induced by disease or any of the following phenotypes or biological activities below. Further, any desired sequence can be transcribed in similar temporal, tissue, or environmentally specific patterns as the disease responsive genes when the desired sequence is operably linked to a promoter of a disease responsive gene.

III.E.12.a. Use of Disease Responsive Genes, Gene Components and Products to Modulate Phenotypes Disease responsive genes and gene products are useful to or modulate one or more phenotypes including pathogen tolerance and/or resistance; Avr/R locus interactions; non-host interactions; HR; SAR; resistance to bacteria e.g. to *Erwinia stewartii, Pseudomonas syringae, Pseudomonas tabaci*, Stuart's wilt, etc.; resistance to fungi, e.g. to downy mildews such as *Scleropthora macrospora, Sclerophthora rayissiae, Sclerospora graminicola, Peronosclerospora sorghi, Peronosclerospora philippinensis, Peronosclerospora sacchari, Peronosclerospora maydis*; rusts such as *Puccinia sorphi, Puccinia polysora, Physopella zeae*, etc.; and to other fungal diseases e.g. *Cercospora zeae-maydis, Colletotrichum graminicola, Fusarium monoliforme, Exserohilum turcicum, Bipolaris maydis, Phytophthora parasitica, Peronospora tabacina, Septoria*, etc.; resistance to viruses or viroids e.g. to tobacco or cucumber mosaic virus, ringspot virus, necrosis virus, *pelargonium* leaf curl virus, red clover mottle virus, tomato bushy stunt virus, and like viruses; rrResistance to insects, such as to aphids e.g. *Myzus persicae*; to beetles and beetle larvae; to lepidoptera larvae, e.g. *Heliothus* etc.; resistance to Nematodes, e.g. *Meloidogyne incognita* etc.; local resistance in primary (infected) or secondary (uninfected) leaves; stress tolerance; winter survival; cold tolerance; salt tolerance; heavy metal tolerance, such as cadmium; tolerance to physical wounding; increased organelle tolerance to redox stress, such as in mitochondria, and chloroplasts; cell death; programmed cell death, including death of diseased tissue and during senescence; fruit drop; biomass; fresh and dry weight during any time in plant life, such as maturation; number of flowers, seeds, branches, and/or leaves; seed yield, including number, size, weight, and/or harvest index; fruit yield, including number, size, weight, and/or harvest index; plant development; time to fruit maturity; cell wall strengthening and reinforcement; plant product quality; paper making quality; food additives; treatment of indications modulated by free radicals; cancer; kinds of low molecular weight compounds such as phytoalexins; abundance of low molecular weight compounds such as phytoalexins; other phenotypes based on gene silencing.

To regulate any of the phenotype(s) above, activities of one or more of the disease responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance to Alvarez et al., (1998) Cell 92: 773-784; Halhbrock and Scheel, (1989) Ann. Rev. Plant Physiol. Plant Mol. Biol. 40: 347-369; Lamb et al., (1997) Ann. Rev. Plant Mol. Biol. Plant Physiol. 48: 251-275; Lapwood et al. (1984) Plant Pathol. 33: 13-20; Levine et al. (1996) Curr. Biol. 6: 427-437; McKersie et al., (2000) Plant Physiol. 122: 1427-1437; Olson and Varner (1993) Plant J. 4: 887-892; Pastore et al., (2000), FEBS Lett 470: 88-92; Pastori et al., (1997) Plant Physiol. 113: 411-418; Romero-Puertas et al., (1999) Free Radic. Res. 1999 31 Suppl: S25-31; Shirataki et al., Anticancer Res 20: 423-426 (2000); Wu et al., (1995) Plant Cell 7: 1357-1368.

III.E.12.b. Use of Disease Responsive Genes, Gene Components and Products to Modulate Biochemical Activities The activities of one or more of the disease responsive genes can be modulated to change biochemical or metabolic activities and/or pathways such as those noted below. Such biological activities are documented and can be measured according to the citations above and included in the Table below:

| PROCESS | BIOCHEMICAL OR METABOLIC ACTIVITIES AND/OR PATHWAYS | CITATIONS INCLUDING ASSAYS |
| --- | --- | --- |
| Resistance to Pathogens | Induction of ROS signaling pathways | Wu et. al. (1995) Plant Cell 7: 1357-68 |
| | Modulation of nitric oxide signaling | Delledonne et al. (1998) Nature 394: 585-588 |
| | Induction of PR proteins, phytoalexins, and defense pathways | Chamnongpol et. al. (1998) Proc. Nat. Acad Sci USA 12; 95: 5818-23. Davis et al. (1993) Phytochemistry 32: 607-611 |
| | Induction of cellular protectant genes such as glutathione S-transferase (GST) and ascorbate peroxidase | Chen et. al. Plant J. (1996) 10: 955-966 Gadea et. al. (1999) Mol Gen Genet 262: 212-219 Wu et. al. (1995) Plant Cell 7: 1357-68 |
| | ROS levels following wounding and changes in physical pressure | Orozco-Cardenas and Ryan (1999) Proc. Nat. Acad. Sci. USA 25; 96: 6553-7. Yahraus et al. (1995) Plant Physiol. 109: 1259-1266 |
| | Salicyclic acid levels and signaling | Durner and Klessig (1996) J.Biol. Chem. 271: 28492-501 |
| Responses to Wounding | Expression of genes Involved in wound repair and cell division | Legendre et al. (1993) Plant Physiol. 102: 233-240 |
| Responses to Environmental Stress | Expression of genes involved in responses to drought, cold, salt, heavy metals | Shi et al. (2000) Proc. Natl. Acad. Sci. USA 97: 6896-6901 |

-continued

| PROCESS | BIOCHEMICAL OR METABOLIC ACTIVITIES AND/OR PATHWAYS | CITATIONS INCLUDING ASSAYS |
|---|---|---|
| Reinforcement of Cell Walls | Modulation of the Production of ExtracTable Proline-Rich Protein | Bradley et al. (1992) Cell 70, 21-30 |
| | Modulation of Lignification | Mansouri et al. (1999) Physiol. Plant 106: 355-362 |
| Programmed Cell Death | Induction of PCD activating genes | Levine et al. (1996) Curr. Biol. 6: 427-437. Reynolds et. al. (1998) Biochem. J. 330: 115-20 |
| | Suppression of PCD suppressing genes | Pennell and Lamb (1997) Plant Cell 9, 1157-1168 |

Other biological activities that can be modulated by the disease responsive genes and their products are listed in the Reference Table. Assays for detecting such biological activities are described in the Protein Domain table.

Disease responsive genes are characteristically differentially transcribed in response to fluctuating levels of disease. The MA_diff table(s) report(s) the changes in transcript levels of various disease responsive genes in the aerial parts of a plant 3 days after the plant was sprayed with a suspension of TMV relative to control plants sprayed with water.

The data from this experiment reveal a number of types of disease responsive genes and gene products, including "early responders," and "delayed responders". Profiles of individual disease responsive genes are shown in the Table below with examples of which associated biological activities are modulated when the activities of one or more such genes vary in plants.

| GENE EXPRESSION LEVELS | FUNCTIONAL CATEGORY OF GENE | PHYSIOLOGICAL CONSequence | EXAMPLES OF BIOCHEMICAL ACTIVITY OF GENE PRODUCTS |
|---|---|---|---|
| Upregulated transcripts | Early Responders to Pathogens | ROS Perception and Response | Transcription factors, kinases, phosphatases, GTP-binding proteins (G-proteins), leucine rich repeat proteins (LRRs), transporters, calcium binding proteins, chromatin remodeling proteins |
| | | Initiation of Gene Transcription | Glutathione S-transferase (GST), heat shock proteins, salicylic acid (SA) response pathway proteins, jasmonate response pathway proteins, dehydrins, peroxidases, catalases |
| | Delayed Responders to Pathogens | Initiation of Defence Gene Transcription | Proteases, pathogen response (PR) proteins, cellulases, chitinases, cutinases, glucanases, other degrading enzymes, calcium channel blockers, phenylalanine ammonia lyase, proteins of defense pathways, cell wall proteins incuding proline rich proteins and glycine rich proteins, epoxide hydrolase, methyl transferases |
| | | Activation of cell death pathways | Transcription factors kinases, phosphatases, DNA surveillance proteins, p53, proteases, endonucleases, GTP-binding proteins (G-proteins), leucine rich repeat proteins (LRRs), transporters, calcium binding proteins, mitochondrial and chloroplast energy related proteins, ribosome inactivating proteins |

-continued

| GENE EXPRESSION LEVELS | FUNCTIONAL CATEGORY OF GENE | PHYSIOLOGICAL CONSequence | EXAMPLES OF BIOCHEMICAL ACTIVITY OF GENE PRODUCTS |
|---|---|---|---|
| | | Initiation of Cellular Protectant Gene Transcription | Reactive oxygen scavenging enzymes, GST, catalase, peroxidase, ascorbate oxidase |
| Downregulated transcripts | Early responders to pathogens | Negative regulation of pathogen inducible pathways released | Transcription factors, kinases, phosphatases, GTP-binding proteins (G-proteins), leucine rich repeat proteins (LRRs), transporters, calcium binding proteins, chromatin remodelling proteins |
| | Genes repressed by TMV | Negative regulation of ROS inducible pathways released | Transcription factors, kinases, phosphatases, GTP-binding proteins (G-proteins), leucine rich repeat proteins (LRRs), transporters, calcium binding proteins, chromatin remodelling proteins |
| | Delayed Responders to Pathogens | Negative regulation of pathogen inducible pathways released | Transcription factors, kinases, phosphatases, GTP-binding proteins (G-proteins), leucine rich repeat proteins (LRRs), transporters, calcium binding proteins, chromatin remodelling proteins |
| | Genes repressed by TMV | Negative regulation of genes suppressing programmed cell death released | Transcription factors, kinases, phosphatases, GTP-binding proteins (G-proteins), leucine rich repeat proteins (LRRs), transporters, calcium binding proteins, chromatin remodelling proteins |

Use of Promoters of Disease Responsive Genes

Promoters of Disease responsive genes are useful for transcription of any desired polynucleotide or plant or non-plant origin. Further, any desired sequence can be transcribed in a similar temporal, tissue, or environmentally specific patterns as the Disease responsive genes where the desired sequence is operably linked to a promoter of a Disease responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

II.E.13. Defense (LOL2) Responsive Genes, Gene Components and Products

Often growth and yield are limited by the ability of a plant to tolerate stress conditions, including pathogen attack. To combat such conditions, plant cells deploy a battery of inducible defense responses, including the triggering of an oxidative burst and the transcription of pathogenesis-related protein (PR protein) genes. Reactive oxygen species (ROS) such as $H_2O_2$ and NO from the oxidative burst play a signaling role, including initiation of the hypersensitive response (HR) and induction of systemic acquired resistance (SAR) to secondary infection by unrelated pathogens. Some PR proteins are able to degrade the cell walls of invading microorganisms, and phytoalexins are directly microbicidal. Other defense related pathways are regulated by salicylic acid (SA) or methyl jasmonate (MeJ).

These responses depend on the recognition of a microbial avirulence gene product (avr) by a plant resistance gene product (R), and a series of downstream signaling events leading to transcription-independent and transcription-dependent disease resistance responses. Current models suggest that R-gene-encoded receptors specifically interact with pathogen-encoded ligands to trigger a signal transduction cascade. Several components include ndr1 and eds1 loci. NDR1, EDS1, PR1, as well as PDF1.2, a MeJ regulated gene and Nim1, a SA regulated gene, are differentially regulated in plants with mutations in the LOL2 gene.

LOL2 shares a novel zinc finger motif with LSD1, a negative regulator of cell death and defense response. Due to an alternative splice site the LOL2 gene encodes two different proteins, one of which contains an additional, putative DNA binding motif. Northern analysis demonstrated that LOL2 transcripts containing the additional DNA binding motif are predominantly upregulated after treatment with both virulent and avirulent *Pseudomonas syringae* pv *maculicola* strains. Modulation in this gene can also confer enhanced resistance to virulent and avirulent *Peronospora parasitica* isolates Examples of LOL2 responsive genes and gene products are shown in the Reference, Sequence, Protein Group, Protein Group Matrix, MA_diff and MA_clust tables. These genes and/or products are responsible for effects on traits such as plant vigor, disease resistance, and seed yield. The genes were discovered and characterized from a much larger set by microarray experiments designed to find genes whose mRNA products changed when the LOL2 gene was mutated in plants.

Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing some about 10,000 non-redundant ESTs, selected from about 37,000 randomly sequenced ESTs generated from mRNA of different tissues and developmental stages.

The sequences of the ESTs showing at least two-fold increases or decreases in plants with the LOL2 mutation versus wildtype were obtained. Specifically, the plant line lol-2-2 tested, a loss of function mutation. The ESTs were compared to the Ceres full length cDNA and genomic sequence databanks, and equivalent Ceres clones identified. The MA_diff table reports the results of this analysis, indicating those Ceres clones which are up or down regulated over controls, thereby indicating the Ceres clones which represent LOL2 responsive genes.

Manipulation of one or more LOL2 responsive gene activities is useful to modulate the biological processes and/or phenotypes listed below. LOL2 responsive genes and gene products can act alone or in combination. Useful combinations include LOL2 responsive genes and/or gene products with similar transcription profiles, similar biological activities, or members of the same or functionally related biochemical pathways. Whole pathways or segments of pathways are controlled by transcription factor proteins and proteins controlling the activity of signal transduction pathways. Therefore, manipulation of such protein levels is especially useful for altering phenotypes and biochemical activities of plants.

Such LOL2 responsive genes and gene products can function to either increase or dampen the above phenotypes or activities either in response to changes in active LOL2 gene or in the absence. The MA_diff Table(s) reports the transcript levels of the experiment (see EXPT ID: lol2 (relating to SMD 8031, SMD 8032)). For transcripts that had higher levels in the samples than the control, a "+" is shown. A "−" is shown for when transcript levels were reduced in root tips as compared to the control. For more experimental detail see the Example section below.

Defense genes are those sequences that showed differential expression as compared to controls, namely those sequences identified in the MA_diff tables with a "+" or "−" indication.

Defense Genes Identified by Cluster Analyses of Differential Expression

Defense Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Defense genes is any group in the MA_clust that comprises a cDNA ID that also appears in Expt ID lol2 (relating to SMD 8031, SMD 8032) of the MA_diff table(s).

Defense Genes Identified by Correlation to Genes that Cause Physiological Consequences Additionally, the differential expression data and the phenotypic observations can be merged to identify pathways or networks of Defense genes. A group in the MA_clust is considered a Defense pathway or network if the group comprises a cDNA ID that also appears in Knock-in or Knock-out tables that causes one or more of the phenotypes described in section above.

Defense Genes Identified by Amino Acid Sequence Similarity

Defense genes from other plant species typically encode polypeptides that share amino acid similarity to the sequences encoded by corn and *Arabidopsis* Defense genes. Groups of Defense genes are identified in the Protein Group table. In this table, any protein group that comprises a peptide ID that corresponds to a cDNA ID member of a Defense pathway or network is a group of proteins that also exhibits Defense functions/utilities.

Further, promoters of LOL2 responsive genes, as described in the Reference tables, for example, are useful to modulate transcription that is induced by LOL2 responsive genes or any of the following phenotypes or biological activities below. Further, any desired sequence can be transcribed in similar temporal, tissue, or environmentally specific patterns as the LOL2 responsive genes when the desired sequence is operably linked to a promoter of a LOL2 responsive gene.

III.E.12.a. Use of Lol2 Responsive Genes, Gene Components and Products to Modulate Phenotypes LOL2 responsive genes and gene products are useful to or modulate one or more phenotypes including pathogen tolerance and/or resistance; Avr/r locus interactions; Non-Host interactions; HR; SAR, e.g., disease responsive genes acting in conjunction with infection with any of the organisms listed below; resistance to bacteria e.g. to *Erwinia stewartii, Pseudomonas syringae, Pseudomonas tabaci*, Stuart's wilt, etc.; resistance to fungi e.g. to downy mildews such as *Sclerophthora macrospora, Sclerophthora rayissiae, Sclerospora graminicola, Peronosclerospora sorghi, Peronosclerospora philippinensis, Peronosclerospora sacchari, Peronosclerospora maydis*; rusts such as *Puccinia sorphi, Puccinia polysora, Physopella zeae*, etc.; and to other fungal diseases e.g. *Cercospora zeae-maydis, Colletotrichum graminicola, Fusarium monoliforme, Exserohilum turcicum, Bipolaris maydis, Phytophthora parasitica, Peronospora tabacina, Septoria*, etc.; resistance to viruses or viroids e.g. to tobacco or cucumber mosaic virus, ringspot virus, necrosis virus, *pelargonium* leaf curl virus, red clover mottle virus, tomato bushy stunt virus, and like viruses; resistance to insects, such as to aphids e.g. *Myzus persicae*; to beetles and beetle larvae; to lepidoptera larvae, e.g. *Heliothus* etc.; resistance to nematodes, e.g. *Meloidogyne incognita* etc.; local resistance in primary (infected) or secondary (uninfected) leaves; stress tolerance; winter survival; cold tolerance; salt tolerance, heavy metal tolerance, such as cadmium; tolerance to physical wounding; increased organelle tolerance to redox stress, such as in mitochondria, and chloroplasts; cell death; programmed cell death, including death of diseased tissue and during senescence; fruit drop; biomass; fresh and dry weight during any time in plant life, such as maturation; number of flowers, seeds, branches, and/or leaves; seed yield, including number, size, weight, and/or harvest index; fruit yield, including number, size, weight, and/or harvest index; plant development; time to fruit maturity; cell wall strengthening and reinforcement; plant product quality; paper making quality; food additives; treatment of indications modulated by free radicals; cancer; kinds of low molecular weight compounds such as phytoalexins; abundance of low molecular weight compounds such as phytoalexins; and other phenotypes based on gene silencing.

To regulate any of the phenotype(s) above, activities of one or more of the LOL2 responsive genes or gene products can be modulated and the plants can be tested by screening for the desired trait. Specifically, the gene, mRNA levels, or protein levels can be altered in a plant utilizing the procedures described herein and the phenotypes can be screened for variants as in Winkler et al. (1998) Plant Physiol 118: 743-50 and assayed, for example, in accordance to Alvarez et al., (1998) Cell 92: 773-784; Halhbrock and Scheel, (1989) Ann. Rev. Plant Physiol. Plant Mol. Biol. 40: 347-369; Lamb et al., (1997) Ann. Rev. Plant Mol. Biol. Plant Physiol. 48: 251-275; Lapwood et al. (1984) Plant Pathol. 33: 13-20; Levine et al. (1996) Curr. Biol. 6: 427-437; McKersie et al., (2000) Plant Physiol. 122: 1427-1437; Olson and Varner (1993) Plant J. 4: 887-892; Pastore et al., (2000), FEBS Lett 470: 88-92; Pastori et al., (1997) Plant Physiol. 113: 411-418; Romero-Puertas et al., (1999) Free Radic. Res. 1999 31 Suppl: S25-31; Shirataki et al., Anticancer Res 20: 423-426 (2000); Wu et al., (1995) Plant Cell 7: 1357-1368.

III.E.12.b. Use of Defense Responsive Genes to Modulate Biochemical Activities

The activities of one or more of the defense (LOL2) responsive genes can be modulated to change biochemical or metabolic activities and/or pathways such as those noted below. Such biological activities are documented and can be measured according to the citations above and included in the Table below:

| PROCESS | BIOCHEMICAL OR METABOLIC ACTIVITIES AND/OR PATHWAYS | CITATIONS INCLUDING ASSAYS |
|---|---|---|
| Resistance To Pathogens | Induction Of ROS Signaling Pathways | Wu et. al. (1995) Plant Cell 7: 1357-68 |
| | Modulation Of Nitric Oxide Signaling | Delledonne et al. (1998) Nature 394: 585-588 |
| | Induction Of PR Proteins, Phytoalexins, And Defense Pathways | Chamnongpol et. al. (1998) Proc. Nat. Acad Sci USA 12; 95: 5818-23. Davis et al. (1993) Phytochemistry 32: 607-611 |
| | Induction Of Cellular Protectant Genes Such As Glutathione S-Transferase (GST) And Ascorbate Peroxidase | Chen et. al. Plant J. (1996) 10: 955-966 Gadea et. al. (1999) Mol Gen Genet 262: 212-219 Wu et.al.(1995) Plant Cell 7: 1357-68 |
| | ROS Levels Following Wounding And Changes In Physical Pressure | Orozco-Cardenas and Ryan (1999) Proc. Nat. Acad. Sci. USA 25; 96: 6553-7. Yahraus et al. (1995) Plant Physiol. 109: 1259-1266 |
| | Salicyclic Acid Levels And Signaling | Durner and Klessig (1996) J. Biol. Chem. 271: 28492-501 |
| Responses To Wounding | Expression Of Genes Involved In Wound Repair And Cell Division | Legendre et al. (1993) Plant Physiol. 102: 233-240 |
| Responses To Environmental Stress | Expression Of Genes Involved In Responses To Drought, Cold, Salt, Heavy Metals | Shi et al. (2000) Proc. Natl. Acad. Sci. USA 97: 6896-6901 |
| Reinforcement Of Cell Walls | Modulation Of The Production Of ExtracTable Proline-Rich Protein | Bradley et al. (1992) Cell 70, 21-30 |
| | Modulation Of Lignification | Mansouri et al. (1999) Physiol. Plant 106: 355-362 |
| Programmed Cell Death | Induction Of Pcd Activating Genes | Levine et al. (1996) Curr. Biol. 6: 427-437. Reynolds et.al. (1998) Biochem. J. 330: 115-20 |
| | Suppression Of PCD Suppressing Genes | Pennell and Lamb (1997) Plant Cell 9, 1157-1168 |

Other biological activities that can be modulated by the LOL2 responsive genes and their products are listed in the Reference tables. Assays for detecting such biological activities are described in the Protein Domain table.

LOL2 responsive genes are characteristically differentially transcribed in response to fluctuating levels of disease. MA_diff table reports the changes in transcript levels of various LOL2 responsive genes in the lol-2 line versus control plants.

The data from this experiment reveal a number of types of LOL2 responsive genes and gene products. Profiles of individual LOL2 responsive genes are shown in the Table below with examples of which associated biological activities are modulated when the activities of one or more such genes vary in plants.

| GENE EXPRESSION LEVELS | FUNCTIONAL CATEGORY OF GENE | PHYSIOLOGICAL CONSequence | EXAMPLES OF BIOCHEMICAL ACTIVITY OF GENE PRODUCTS |
|---|---|---|---|
| Upregulated transcripts | Early Responders to the LOL2 Mutation | ROS Perception and Response | Transcription factors, kinases, phosphatases, GTP-binding proteins (G-proteins), leucine rich repeat proteins (LRRs), transporters, calcium binding proteins, chromatin remodeling proteins |
| | | Initiation of Gene Transcription | Glutathione S-transferase (GST), heat shock proteins, salicylic acid (SA) response pathway proteins, jasmonate response pathway proteins, dehydrins, peroxidases, catalases |
| | Delayed Responders to the LOL2 Mutation | Initiation of Defence Gene Transcription | Proteases, pathogen response (PR) proteins, cellulases, chitinases, cutinases, glucanases, other degrading enzymes, calcium channel blockers, phenylalanine ammonia lyase, proteins of defense pathways, cell wall proteins incuding proline rich proteins and glycine rich proteins, epoxide hydrolase, methyl transferases |
| | | Activation of cell death pathways | Transcription factors kinases, phosphatases, DNA surveillance proteins, p53, proteases, endonucleases, GTP-binding proteins (G-proteins), leucine rich repeat proteins (LRRs), transporters, calcium binding proteins, mitochondrial and chloroplast energy related proteins, ribosome inactivating proteins |
| | | Initiation of Cellular Protectant Gene Transcription | Reactive oxygen scavenging enzymes, GST, catalase, peroxidase, ascorbate oxidase |
| Downregulated transcripts | Early Responders to the LOL2 Mutation | Negative regulation of LOL2 Mutation inducible pathways released | Transcription factors, kinases, phosphatases, GTP-binding proteins (G-proteins), leucine rich repeat proteins (LRRs), transporters, calcium binding proteins, chromatin remodelling proteins |
| | Genes Repressed by the LOL2 Mutation | Negative regulation of ROS inducible pathways released | Transcription factors, kinases, phosphatases, GTP-binding proteins (G-proteins), leucine rich repeat proteins (LRRs), transporters, calcium binding proteins, chromatin remodelling proteins |

-continued

| GENE EXPRESSION LEVELS | FUNCTIONAL CATEGORY OF GENE | PHYSIOLOGICAL CONSequence | EXAMPLES OF BIOCHEMICAL ACTIVITY OF GENE PRODUCTS |
|---|---|---|---|
| | Delayed Responders to the LOL2 Mutation | Negative regulation of LOL2 Mutation inducible pathways released | Transcription factors, kinases, phosphatases, GTP-binding proteins (G-proteins), leucine rich repeat proteins (LRRs), transporters, calcium binding proteins, chromatin remodelling proteins |
| | Genes Repressed By The LOL2 Mutation | Negative Regulation Of Genes Suppressing Programmed Cell Death Released | Transcription Factors, Kinases, Phosphatases, GTP-Binding Proteins (G-Proteins), Leucine Rich Repeat Proteins (Lrrs), Transporters, Calcium Binding Proteins, Chromatin Remodelling Proteins |

Use of Promoters of Defense Responsive Genes

Promoters of Defense responsive genes are useful for transcription of any desired polynucleotide or plant or non-plant origin. Further, any desired sequence can be transcribed in a similar temporal, tissue, or environmentally specific patterns as the Defense responsive genes where the desired sequence is operably linked to a promoter of a Defense responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.14. Iron Responsive Genes, Gene Components and Products

Iron (Fe) deficiency in humans is the most prevalent nutritional problem worldwide today. Increasing iron availability via diet is a sustainable malnutrition solution for many of the world's nations. One-third of the world's soils, however, are iron deficient. Consequently, to form a food-based solution to iron malnutrition, we need a better understanding of iron uptake, storage and utilization by plants. Furthermore, exposure to non-toxic Fe levels appears to affect inherent plant defense mechanisms. Consequently, exploring the effects of Fe exposure has potential for advances in plant disease resistance in addition to human nutrition.

Microarray technology allows monitoring of gene expression levels for thousands of genes in a single experiment. This is achieved by simultaneously hybridizing two differentially labeled fluorescent FeNA pools to glass slides that contain spots of DNA (Schena et al. (1995) Science 270: 467-70). The *Arabidopsis* Functional Genomics Consortium (AFGC) has recently made public the results from such microarray experiments conducted with AFGC chips containing 10,000 non-redundant ESTs, selected from 37,000 randomly sequenced ESTs generated from mRNA of different tissues and developmental stages.

The sequences of the ESTs showing at least two-fold increases or decreases over the controls were identified, compared to the Ceres full length FeNA and genomic sequence databanks, and identical Ceres clones identified. MA_diff table reports the results of this analysis, indicating those Ceres clones that are up or down regulated over controls, thereby indicating the Ceres clones which are iron responsive genes.

The MA_diff Table(s) reports the transcript levels of the experiment (see EXPT ID: Iron (relating to SMD 7114, SMD 7115, SMD 7125)). For transcripts that had higher levels in the samples than the control, a "+" is shown. A "−" is shown for when transcript levels were reduced in root tips as compared to the control. For more experimental detail see the Example section below.

Iron genes are those sequences that showed differential expression as compared to controls, namely those sequences identified in the MA_diff tables with a "+" or "−" indication.

Iron Genes Identified by Cluster Analyses of Differential Expression

Iron Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Iron genes is any group in the MA_clust that comprises a cDNA ID that also appears in Expt ID Iron (relating to SMD 7114, SMD 7115, SMD 7125) of the MA_diff table(s).

Iron Genes Identified by Correlation to Genes that Cause Physiological Consequences Additionally, the differential expression data and the phenotypic observations can be merged to identify pathways or networks of Iron genes. A group in the MA_clust is considered a Iron pathway or network if the group comprises a cDNA ID that also appears in Knock-in or Knock-out tables that causes one or more of the phenotypes described in section above.

Iron Genes Identified by Amino Acid Sequence Similarity

Iron genes from other plant species typically encode polypeptides that share amino acid similarity to the sequences encoded by corn and *Arabidopsis* Iron genes. Groups of Iron genes are identified in the Protein Group table. In this table, any protein group that comprises a peptide ID that corresponds to a cDNA ID member of a Iron pathway or network is a group of proteins that also exhibits Iron functions/utilities.

III.E.14.a. Use of Iron Responsive Genes to Modulate Phenotypes

Iron responsive genes and gene products are useful to or modulate one or more phenotypes including growth; roots; root hair formation; stems, leaves; development; senescence; plant nutrition; uptake and assimilation of organic compounds; uptake and assimilation of inorganic compounds; animal (including human) nutrition; improved dietary mineral nutrition; stress response metabolic detoxification; and heavy metals.

To improve any of the phenotype(s) above, activities of one or more of the iron responsive genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Schmidt et al. (2000, Plant Physiol 122:1109-18), Meagher (2000) Current Opinion in Plant Biology 3: 153-62), Deak (1999, Nature Biotechnology (1999, Nature Biotechnology 17: 192-96), Wei and Theil (2000, J. Biol Chem 275: 17488-93) and Vansuyt et al. (1997, FEBS Letters 410: 195-200).

III.E.14.b. Use of Iron-Responsive Genes, Gene Components and Products to Modulate Biochemical Activities The activities of one or more of the iron responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation and Development Metabolisms | Root Growth Initiation of root hairs | Robinson et al. (1999) Nature 397: 694-97 |
| | Iron sensing | Thomine et al. (2000) PNAS USA 97: 4991-6 |
| | Iron uptake and transport decreased iron transport | Thomine et al. (2000) PNAS USA 97: 4991-6 |
| | phytoremediation | Zhu (1999) Plant Physiol 119: 73-79 |
| Plant Defenses | Protection from oxidative damage | Deak (1999) Nature Biotechnology 17: 192-6 |
| Signaling | Specific gene transcription gene silencing | Brand and Perrimon (1993) Development 118: 401-415 |

Other biological activities that can be modulated by the iron responsive genes and gene products are listed in the REFERENCE Table. Assays for detecting such biological activities are described in the Protein Domain table.

Iron responsive genes are characteristically differentially transcribed in response to fluctuating iron levels or concentrations, whether internal or external to an organism or cell. MA_diff table reports the changes in transcript levels of various iron responsive genes.

The microarray comparison consists of probes prepared from root RNA of A. thaliana (Columbia) seedlings grown under iron-sufficient conditions and seedlings grown under iron-deficient. The data from this experiment reveal a number of types genes and gene products. Profiles of these different iron responsive genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
| --- | --- | --- | --- |
| Up regulated transcripts | responders to iron application | Iron perception Iron uptake and transport Iron metabolism Synthesis of secondary metabolites and/or proteins Modulation of iron response transduction pathways Specific gene transcription initiation | Transporters Metabolic enzymes Change in cell membrane structure and potential Kinases and phosphatases Transcription activators Change in chromatin structure and/or localized DNA topology |
| Down-regulated transcripts | responder to iron repressors of iron state of metabolism Genes with discontinued expression or unsTable mRNA in presence of iron | Negative regulation of iron pathways Changes in pathways and processes operating in cells Changes in other metabolisms than iron | Transcription factors Change in protein structure by phosphorylation (kinases) or dephosphoryaltion (phosphatases) Change in chromatin structure and/or DNA topology Stability of factors for protein synthesis and degradation Metabolic enzymes |

Use of Promoters of Iron Responsive Genes

Promoters of Iron responsive genes are useful for transcription of any desired polynucleotide or plant or non-plant origin. Further, any desired sequence can be transcribed in a similar temporal, tissue, or environmentally specific patterns as the Iron responsive genes where the desired sequence is operably linked to a promoter of a Iron responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.15. Shade Responsive Genes, Gene Components and Products

Plants sense the ratio of Red (R):Far Red (FR) light in their environment and respond differently to particular ratios. A low R:FR ratio, for example, enhances cell elongation and favors flowering over leaf production. The changes in R:FR ratios mimic and cause the shading response effects in plants. The response of a plant to shade in the canopy structures of agricultural crop fields influences crop yields significantly. Therefore manipulation of genes regulating the shade avoidance responses can improve crop yields. While phytochromes mediate the shade avoidance response, the down-stream factors participating in this pathway are largely unknown. One potential downstream participant, ATHB-2, is a member of the HD-Zip class of transcription factors and shows a strong and rapid response to changes in the R:FR ratio. ATHB-2 overexpressors have a thinner root mass, smaller and fewer leaves and longer hypocotyls and petioles. This elongation arises from longer epidermal and cortical cells, and a decrease in secondary vascular tissues, paralleling the changes observed in wild-type seedlings grown under conditions simulating canopy shade. On the other hand, plants with reduced ATHB-2 expression have a thick root mass and many larger leaves and shorter hypocotyls and petioles. Here, the changes in the hypocotyl result from shorter epidermal and cortical cells and increased proliferation of vascular tissue. Interestingly, application of Auxin is able to reverse the root phenotypic consequences of high ATHB-2 levels, restoring the wild-type phenotype. Consequently, given that ATHB-2 is tightly regulated by phytochrome, these data suggest that ATHB-2 may link the Auxin and phytochrome pathways in the shade avoidance response pathway.

Changes in R:FR ratios promote changes in gene expression. Microarray technology allows monitoring of gene expression levels for thousands of genes in a single experiment. This is achieved by hybridizing labeled fluorescent cDNA pools to glass slides that contain spots of DNA (Schena et al. (1995) Science 270: 467-70). The US *Arabidopsis* Functional Genomics Consortium (AFGC) has recently made public the results from such microarray experiments conducted with AFGC chips containing about 10,000 non-redundant ESTs, selected from about 37,000 randomly sequenced ESTs generated from mRNA of different tissues and developmental stages.

The sequences of the ESTs showing at least two-fold increases or decreases in plants given 4 hours of FR rich light after growth in high R:FR light compared with the controls of plants grown in high R:FR light only, were identified, compared to the Ceres full length cDNA and genomic sequence databanks, and equivalent Ceres clones identified. The MA_diff table(s) report(s) the results of this analysis, indicating those Ceres clones which are up or down regulated over controls, thereby indicating the Ceres clones which are shade avoidance responsive genes.

Examples of far red light induced, shade avoidance responsive genes and gene products are shown in the Reference and Sequence Tables. These genes and/or products are responsible for effects on traits such as plant vigor and seed yield.

While far red light, shade avoidance responsive polynucleotides and gene products can act alone, combinations of these polynucleotides also affect growth and development. Useful combinations include different shade avoidance responsive polynucleotides and/or gene products that have similar transcription profiles or similar biological activities, and members of the same or similar biochemical pathways. In addition, the combination of a shade avoidance responsive polynucleotide and/or gene product with another environmentally responsive polynucleotides is also useful because of the interactions that exist between hormone-regulated pathways, stress and pathogen induced pathways, nutritional pathways, light induced pathways and development. Here, in addition to polynucleotides having similar transcription profiles and/or biological activities, useful combinations include polynucleotides that may have different transcription profiles but which participate in common or overlapping pathways.

Such far red light induced shade avoidance responsive genes and gene products can function to either increase or dampen the above phenotypes or activities either in response to changes in far red light or in the absence of far red light fluctuations. The MA_diff Table(s) reports the transcript levels of the experiment (see EXPT ID: Shade (relating to SMD 8130, SMD 7230)). For transcripts that had higher levels in the samples than the control, a "+" is shown. A "−" is shown for when transcript levels were reduced in root tips as compared to the control. For more experimental detail see the Example section below.

Shade genes are those sequences that showed differential expression as compared to controls, namely those sequences identified in the MA_diff tables with a "+" or "−" indication.

Shade Genes Identified by Cluster Analyses of Differential Expression

Shade Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Shade genes is any group in the MA_clust that comprises a cDNA ID that also appears in Expt ID Shade (relating to SMD 8130, SMD 7230) of the MA_diff table(s).

Shade Genes Identified by Correlation to Genes that Cause Physiological Consequences Additionally, the differential expression data and the phenotypic observations can be merged to identify pathways or networks of Shade genes. A group in the MA_clust is considered a Shade pathway or network if the group comprises a cDNA ID that also appears in Knock-in or Knock-out tables that causes one or more of the phenotypes described in section above.

Shade Genes Identified by Amino Acid Sequence Similarity

Shade genes from other plant species typically encode polypeptides that share amino acid similarity to the sequences encoded by corn and *Arabidopsis* Shade genes. Groups of Shade genes are identified in the Protein Group table. In this table, any protein group that comprises a peptide ID that corresponds to a cDNA ID member of a Shade pathway or network is a group of proteins that also exhibits Shade functions/utilities.

Further, promoters of shade avoidance responsive genes, as described in the Reference tables, for example, are useful to modulate transcription that is induced by shade avoidance or any of the following phenotypes or biological activities below. Further, any desired sequence can be transcribed in similar temporal, tissue, or environmentally specific patterns as the shade avoidance responsive genes when the desired sequence is operably linked to a promoter of a circadian (clock) responsive gene.

III.E.15.a. Use of Far Red Responsive, Shade Avoidance Response Genes to Modulate Phenotypes High FR:R, shade avoidance responsive genes and gene products can be used to alter or modulate one or more phenotypes including growth; roots; elongation; lateral root formation; stems; elongation; expansion; leaves; expansion; carotenoid composition; development; cell; photosynthetic apparatus; efficiency; flower; flowering time; fruit; seed; dormancy; control rate and timing of germination; prolongs seed storage and viability; inhibition of hydrolytic enzyme synthesis; seed and fruit yield; senescence; abscission; leaf fall; flower longevity; differentiation; vascularization; and shade (avoidance) responses in plant architecture.

To regulate any of the phenotype(s) above, activities of one or more of the High FR:R light, shade avoidance responsive genes or gene products can be modulated and the plants tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and/or screened for variants as in Winkler et al. (1998) Plant Physiol 118: 743-50 and visually inspected for the desired phenotype or metabolically and/or functionally assayed according to Carabelli et al. (1996, PNAS USA 93: 3530-3535), Aguirrezabal and Tardieu (1996, J Exp Bot 47: 411-20), Heyer et al. (1995, Plant Physiol 109: 53-61), Garcia-Plazaola et al. (1997, J Exp Bot 48: 1667-74), Schwanz et al. (1996, J Exp Bot 47L 1941-50), Koehne et al. (1999, Biochem Biophys Acta 1412:94-107), Melis (1984, J Cell Biochem 24: 271-85), Steindeler et al. (1999, Development 126: 4235-45), Cruz (1997, J Exp Bot 48: 15-24), Stephanou and Manetas (1997, J Exp Bot 48: 1977-85), Grammatikopoulos et al (1999, J Exp Bot 50:517-21), Krause et al. (1999, Plant Physiol 121: 1349-58), Aukerman et al. (1997, Plant Cell 9: 1317-26), Wagner et al. (1997, Plant Cell 9: 731-43), Weinig (2000) Evolution Int J Org Evolution 54: 124-26), Cocburn et al. (1996, J Exp Bot 47: 647-53), Devlin et al. (1999, Plant Physiol 119: 909-15), Devlin et al. (1998, Plant Cell 10: 1479-87), Finlayson et al. (1998, Plant Physiol 116: 17-25), Morelli and Ruberti (2000, Plant Physiol 122: 621-26), Aphalo et al. (1999, J Exp Bot 50: 1629-34), Sims et al. (1999, J Exp Bot 50: 50: 645-53) and Ballare (1999, Trends Plant Sci 4: 97-102).

III.E.15.b. Use of Far Red Light, Shade Avoidance Responsive Genes to Modulate Biochemical Activities The activities of one or more of the far red light, shade avoidance responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
|---|---|---|
| Cell Growth and Differentiation | Cell Elongation | Carabelli et al. (1996) PNAS USA 93: 3530-35 |
| | Leaf Expansion | Heyer et al. (1995) Plant Physiol 109: 53-61 |
| Photosynthesis | Development of Photosynthetic Apparatus | Jagtap et al. (1998) J Exp Bot 49: 1715-21 |
| | | Melis (1984) J Cell Biochem 24: 271-285 |
| | | McCain (1995) Biophys J 69: 1105-10 |
| | Carotenoid Composition | Garcia-Plazaola et al (1997) J Exp Bot 48: 1667-74 |
| Carbon/Nitrogen Metabolism | Carbon and Nitrogen Assimilation | Cruz (1997) J Exp Bot 48: 15-24 |
| Far red light, shade avoidance response binding by transcription factors | | Newton AL, Sharpe BK, Kwan A, Mackay JP, Crossley M. J Biol Chem. 2000May19; 275(20): 15128-34; Lopez Ribera I, Ruiz-Avila L, Puigdomenech P. Biochem Biophys Res Commun. 1997 Jul 18; 236(2): 510-6; de Pater S, Greco V, Pham K, Memelink J, Kijne J. Nucleic Acids Res. 1996 Dec 1; 24(23): 4624-31. |
| Signaling | UV Light Perception | Stephanou and Manetas (1997) J Exp Bot 48: 1977-85 |
| | Far-red/Red Light Perception | Aukerman et al. (1997) Plant Cell 9: 1317-26 |
| | | Wagner et al. (1997) Plant Cell 9: 731-43 |
| | Interaction of "Shade Factor" with Ethylene Production/Transduction | Finlayson et al. (1998) Plant Physiol 116: 17-25 |

| PROCESS | BIOCHEMICAL OR METABOLIC ACTIVITIES AND/OR PATHWAYS | CITATIONS INCLUDING ASSAYS |
|---|---|---|
| | Interaction of "Shade Factor" with Auxin Production/Transduction | Reed et al. (1998) Plant Physiol 118: 1369-78 |
| | Plant to Plant signalling | Sims et al. (1999) J Exp Bot 50: 645-53 |

Other biological activities that can be modulated by shade avoidance response genes and their products are listed in the REF TABLES. Assays for detecting such biological activities are described in the Protein Domain table.

High FR:R, shade avoidance responsive genes are differentially transcribed in response to high FR:R ratios. The microarray comparison to reveal such genes consisted of probes prepared from RNA isolated from the aerial tissues of *A. thaliana* (Columbia) two-week old seedlings grown in high R:FR ratios compared to seedlings grown in high R:FR ratios followed by 4 hours of FR-rich light treatment. The data from this experiment reveal a number of types genes and gene products and examples of the classes of genes are given in the Table below.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to high FR:R light ratios Genes induced by high FR:R light ratio | Far red light perception Metabolism affected by far red light Synthesis of secondary metabolites and/or proteins Modulation of high FR:R light ratio transduction pathways Specific gene transcription initiation | Transporters Metabolic enzymes Change in cell membrane structure and potential Kinases and phosphatases Transcription activators Change in chromatin structure and/or localized DNA topology Leaf production factors |
| Down-regulated transcripts | Responders to high FR:R light ratios Genes repressed by high FR:R light ratio Genes with discontinued expression or unsTable mRNA during high FR:R ratio light | Changes in pathways and processes operating in cells Changes in metabolisms other than far red stimulated pathways | Transcription factors Change in protein structure by phosphorylation (kinases) or dephosphorylation (phosphatases) Change in chromatin structure and/or DNA topology Stability of factors for protein synthesis and degradation Metabolic enzymes Cell elongation factors Flowering promotion factors |

Use of Promoters of Shade Avoidance Genes

Promoters of Shade Avoidance genes are useful for transcription of any desired polynucleotide or plant or non-plant origin. Further, any desired sequence can be transcribed in a similar temporal, tissue, or environmentally specific patterns as the Shade Avoidance genes where the desired sequence is operably linked to a promoter of a Shade Avoidance gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.16. Sulfur Responsive Genes, Gene Components and Products

Sulfur is one of the important macronutrients required by plants. It is taken up from the soil solution by roots as in the form of sulfate anion which higher plants are dependent on to fulfill their nutritional sulfur requirement. After uptake from the soil, sulfate is either accumulated and stored in vacuole or it is assimilated into various organic compounds, e.g. cysteine, glutathione, methionine, etc. Thus, plants also serve as nutritional sulfur sources for animals. Sulfur can be assimilated in one of two ways: it is either incorporated as sulfate in a reaction called sulfation, or it is first reduced to sulfide, the substrate for cysteine synthesis. In plants, majority of sulfur is assimilated in reduced form.

Sulfur comprises a small by vital fraction of the atoms in many protein molecules. As disulfide bridges, the sulfur atoms aid in stabilizing the folded proteins, such cysteine residues. Cys is the first sulfur-containing amino acids, which in proteins form disulfide bonds that may affect the tertiary structures and enzyme activities. This redox balance is mediated by the disulfide/thiol interchange of thioredoxin or glutaredoxin using NADPH as an electron donor. Sulfur can also become sulfhydryl (SH) groups participating in the active sites of some enzymes and some enzymes require the aid of small molecules that contain sulfur. In addition, the machinery of photosynthesis includes some sulfur-containing compounds, such as ferrodoxin. Thus, sulfate assimilation plays important roles not only in the sulfur nutrition but also in the ubiquitous process that may regulate the biochemical reactions of various metabolic pathways.

Deficiency of sulfur leads to a marked chlorosis in younger leaves, which may become white in color. Other symptoms of sulfur deficiency also include weak stems and reduced growth. Adding sulfur fertilizer to plants can increase root development and a deeper green color of the leaves in sulfur-deficient plants. However, Sulfur is generally sufficient in soils for two reasons: it is a contaminant in potassium and other fertilizers and a product of industrial combustion. Sulfur limitation in plants is thus likely due to the limitation of the uptake and distribution of sulfate in plants. Seven cell type specific sulfate transporter genes have been isolated from *Arabidopsis*. In sulfate-starved plants, expression of the high-affinity transporter, AtST1-1, is induced in root epidermis and cortex for acquisition of sulfur. The low affinity transporter, AtST2-1 (AST68), accumulates in the root vascular tissue by sulfate starvation for root-to-shoot transport of sulfate. These studies have shown that the whole-plant process of sulfate transport is coordinately regulated by the expression of these 2 sulfate transporter genes under sulfur limited conditions. Recent studies have proposed that feeding of O-acetylserine, GSH and selenate may regulate the expression of AtST1-1 and AtST2-1 (AST68) in roots either positively or negatively. However, regulatory proteins that may directly control the expression of these genes have not been identified yet.

It has been established that there are regulatory interactions between assimilatory sulfate and nitrate reduction in plants. The two assimilatory pathways are very similar and well coordinated; deficiency for one element was shown to repress the other pathway. The coordination between them should be taken into consideration when one tries to alter one of pathways.

Microarray technology allows monitoring of gene expression levels for thousands of genes in a single experiment. This is achieved by simultaneously hybridizing two differentially labeled fluorescent cDNA pools to glass slides that contain spots of DNA (Schena et al. (1995) Science 270: 467-70). The *Arabidopsis* Functional Genomics Consortium (AFGC) has recently made public the results from such microarray experiments conducted with AFGC chips containing 10,000 non-redundant ESTs, selected from 37,000 randomly sequenced ESTs generated from mRNA of different tissues and developmental stages.

The sequences of the ESTs showing at least two-fold increases or decreases over the controls were identified, compared to the Ceres full-length cDNA and genomic sequence databanks, and identical Ceres clones identified. MA_diff table reports the results of this analysis, indicating those Ceres clones which are up or down regulated over controls, thereby indicating the Ceres clones which are sulfur response responsive genes.

The MA_diff Table(s) reports the transcript levels of the experiment (see EXPT ID: Sulfur (relating to SMD 8034, SMD 8035)). For transcripts that had higher levels in the samples than the control, a "+" is shown. A "−" is shown for when transcript levels were reduced in root tips as compared to the control. For more experimental detail see the Example section below.

Sulfur genes are those sequences that showed differential expression as compared to controls, namely those sequences identified in the MA_diff tables with a "+" or "−" indication.

Sulfur Genes Identified by Cluster Analyses of Differential Expression

Sulfur Genes Identified by Correlation to Genes that are Differentially Expressed As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Sulfur genes is any group in the MA_clust that comprises a cDNA ID that also appears in Expt ID Sulfur (relating to SMD 8034, SMD 8035) of the MA_diff table(s).

Sulfur Genes Identified by Correlation to Genes that Cause Physiological Consequences Additionally, the differential expression data and the phenotypic observations can be merged to identify pathways or networks of Sulfur genes. A group in the MA_clust is considered a Sulfur pathway or network if the group comprises a cDNA ID that also appears in Knock-in or Knock-out tables that causes one or more of the phenotypes described in section above.

Sulfur Genes Identified by Amino Acid Sequence Similarity

Sulfur genes from other plant species typically encode polypeptides that share amino acid similarity to the sequences encoded by corn and *Arabidopsis* Sulfur genes. Groups of Sulfur genes are identified in the Protein Group table. In this table, any protein group that comprises a peptide ID that corresponds to a cDNA ID member of a Sulfur pathway or network is a group of proteins that also exhibits Sulfur functions/utilities.

III.E.16.a. Use of Sulfur Responsive Genes to Modulate Phenotypes

Sulfur responsive genes and gene products are useful to or modulate one or more phenotypes including growth; roots; stems; leaves; development; chloroplasts and mitochondria; fruit development; seed development; seed storage proteins; senescence; differentiation; plastid/chloroplast and mitochondria differentiation; protection against oxidative damage; regulation of enzymes via redox control by thiol groups; metabolic detoxification; photosynthesis; and carbon dioxide fixation.

To improve any of the phenotype(s) above, activities of one or more of the sulfur responsive genes or gene products can be modulated and tested by screening for the desired trait. Specifically, the gene, mRNA levels, or protein levels can be altered in a plant utilizing the procedures described herein and the phenotypes can be assayed. As an example, a plant can be transformed according to Bechtold and Pelletier (1998, Methods. Mol. Biol. 82:259-266) and visually inspected for the desired phenotype or metabolically and/or functionally assayed according to Saito et al. (1994, Plant Physiol. 106: 887-95), Takahashi et al (1997, Proc. Natl. Acad. Sci. USA 94: 11102-07) and Koprivova et al. (2000, Plant Physiol. 122: 737-46).

III.E.16.b. Use of Sulfur-Responsive Genes, Gene Components and Products to Modulate Biochemical Activities The activities of one or more of the sulfur responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Growth, Differentiation and Development | Root Leaf Stem Chloroplast/Mitochondria development/differentiation | Klein and Klein (1988) Mineral Nutrition, In CM Wilson and J Gregory, eds Fundamentals of Plant Science. Harper and Row Publishers, Inc., NY, p163 Rost et al. (1984) The Absorption and Transport System, In R Bem, ed, Botany-A Brief Introduction to Plant Biology. John Wiley and Sons, NY, p96. Huluigue et al. (2000) Biochem Biophys Res Commun 271: 380-5 Kapazoglou et al. (2000) Eur J Biochem 267: 352-60 |
| | Seed storage protein synthesis | Kim et al. (1999) 209: 282-9 |
| Metabolisms | Sulfate uptake and transport | Takahashi et al. (1997) Proc Natl Acad Sci USA 94: 11102-07 |
| | Cysteine Biosynthesis | Saito et al. (1992) Proc Natl Acad Sci USA 89: 8078-82 Hesse et al. (1999) Amino Acids 16: 113-31 |
| | Methionine biosynthesis | Bourgis et al. (1999) Plant Cell 11: 1485-98 |
| | Carbon dioxide fixation in photosynthesis | Buchana (1991) Arch Biochem Biophys 288: 1-9 |
| | Thioredoxin reduction | Leustek and Saito (1999) Plant Phyiol 120: 637-43 Mamedova et al. (1999) FEBS Lett 462: 421-4 |
| | Nitrogen metabolism | Koprivova et al. (2000) Plant Physiol. 122: 737-46 Yamaguchi et al. (1999) Biosci Biotechnol Biochem 63: 762-6 |
| Plant Defenses | Reduction of oxidative stress - oxygen metabolism and reactive oxygen species Detoxification of toxins, xenobiotics and heavy metals | May et al. (1998) J Expt Bio 49: 649-67 Kreuz et al. (1996) Plant Physiol 111: 349-53 Zhao et al. (1998) Plant Cell 10: 359-70 |
| | Defense against pathogens or microbes | Kyung and Fleming (1997) J Food Prot 60: 67-71 |
| | Disease prevention by secondary sulfur-containing compounds | Fahey et al. (1997) Proc Natl Acad Sci USA 94: 10367-72 |
| | Activation of kinases and phosphatases | Davis et al. (1999) Plant Cell 11: 1179-90 |

Other biological activities that can be modulated by the sulfur responsive genes and gene products are listed in the REFERENCE Table. Assays for detecting such biological activities are described in the Protein Domain table.

Sulfur responsive genes are characteristically differentially transcribed in response to fluctuating sulfur levels or concentrations, whether internal or external to an organism or cell. MA_diff table reports the changes in transcript levels of various sulfur responsive genes.

Profiles of these different sulfur responsive genes are shown in the Table below with examples of associated biological activities.

| TRANSCRIPT LEVELS | TYPE OF GENES | PHYSIOLOGICAL CONSEQUENCES | EXAMPLES OF BIOCHEMICAL ACTIVITY |
|---|---|---|---|
| Up regulated transcripts | Responders to sulfur Application | Sulfur perception Sulfur uptake and transport Sulfur metabolism Synthesis of secondary metabolites and/or proteins Modulation of sulfur response transduction pathways Specific gene transcription initiation | Transporters Metabolic enzymes Change in cell membrane structure and potential Kinases and phosphatases Transcription activators Change in chromatin structure and/or localized DNA topology Redox control |
| Down-regulated transcripts | responder to sulfur repressors of sulfur state of metabolism Genes with discontinued expression or unsTable mRNA in presence of sulfur | Negative regulation of sulfur pathways Changes in pathways and processes operating in cells Changes in other metabolisms than sulfur | Transcription factors Change in protein structure by phosphorylation (kinases) or dephosphoryaltion (phosphatases) Change in chromatin structure and/or DNA topology Stability of factors for protein synthesis and degradation Metabolic enzymes |

Use of Promoters of Sulfur Responsive Genes

Promoters of Sulfur responsive genes are useful for transcription of any desired polynucleotide or plant or non-plant origin. Further, any desired sequence can be transcribed in a similar temporal, tissue, or environmentally specific patterns as the Sulfur responsive genes where the desired sequence is operably linked to a promoter of a Sulfur responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

III.E.17. Zinc Responsive Genes, Gene Components and Products

Phytoremediation of soils contaminated with toxic levels of heavy metals requires the understanding of plant metal transport and tolerance. The numerous *Arabidopsis thaliana* studies have given scientists the potential for dissection and elucidation of plant micronutrient/heavy metal uptake and accumulation pathways. It has been shown altered regulation of ZNT1, a Zn/Cd transporter, contributes to high Zn uptake. Isolation and characterization of Zn/Cd hyperaccumulation genes may allow expression in higher biomass plant species for efficient contaminated soil clean up. Identification of additional Zn transport, tolerance and nutrition-related genes involved in heavy metal accumulation will enable manipulation of increased uptake (for phytoremediation) as well as limitation of uptake or leak pathways that contribute to toxicity in crop plants. Additionally, Zn-binding ligands involved in Zn homeostasis or tolerance may be identified, as well as factors affecting the activity or expression of Zn binding transcription factors. Gene products acting in concert to effect Zn uptake, which would not have been identified in complementation experiments, including multimeric transporter proteins, could also be identified.

Microarray technology allows monitoring of gene expression levels for thousands of genes in a single experiment. This is achieved by simultaneously hybridizing two differentially labeled fluorescent cDNA pools to glass slides that contain spots of DNA (Schena et al. (1995) Science 270: 467-70). The *Arabidopsis* Functional Genomics Consortium (AFGC) has recently made public the results from such microarray experiments conducted with AFGC chips containing 10,000 non-redundant ESTs, selected from 37,000 randomly sequenced ESTs generated from mRNA of different tissues and developmental stages.

The sequences of the ESTs showing at least two-fold increases or decreases over the controls were identified, compared to the Ceres full-length cDNA and genomic sequence databanks, and identical Ceres clones identified. The Zn response information was then used in conjunction with the existing annotation to attribute biological function or utility to the full-length cDNA and corresponding genomic sequence.

The MA_diff Table(s) reports the transcript levels of the experiment (see EXPT ID: Zinc (relating to SMD 7310, SMD 7311)). For transcripts that had higher levels in the samples than the control, a "+" is shown. A "−" is shown for when transcript levels were reduced in root tips as compared to the control. For more experimental detail see the Example section below.

Zinc genes are those sequences that showed differential expression as compared to controls, namely those sequences identified in the MA_diff tables with a "+" or "−" indication.

Zinc Genes Identified by Cluster Analyses of Differential Expression

Zinc Genes Identified by Correlation to Genes that are Differentially Expressed

As described above, the transcription profiles of genes that act together are well correlated. Applicants not only have identified the genes that are differentially expressed in the microarray experiments, but also have identified the genes that act in concert with them. The MA_clust table indicates groups of genes that have well correlated transcription profiles and therefore participate in the same pathway or network.

A pathway or network of Zinc genes is any group in the MA_clust that comprises a cDNA ID that also appears in Expt ID Zinc (relating to SMD 7310, SMD 7311) of the MA_diff table(s).

Zinc Genes Identified by Correlation to Genes that Cause Physiological Consequences Additionally, the differential expression data and the phenotypic observations can be merged to identify pathways or networks of Zinc genes. A group in the MA_clust is considered a Zinc pathway or network if the group comprises a cDNA ID that also appears in Knock-in or Knock-out tables that causes one or more of the phenotypes described in section above.

Zinc Genes Identified by Amino Acid Sequence Similarity

Zinc genes from other plant species typically encode polypeptides that share amino acid similarity to the sequences encoded by corn and *Arabidopsis* Zinc genes. Groups of Zinc genes are identified in the Protein Group table. In this table, any protein group that comprises a peptide ID that corresponds to a cDNA ID member of a Zinc pathway or network is a group of proteins that also exhibits Zinc functions/utilities.

III.E.17.a. Use of Zn Transport, Tolerance and Nutrition-Related Genes to Modulate Phenotypes Changes in zinc concentration in the surrounding environment or in contact with a plant results in modulation of many genes and gene products. Examples of such zinc responsive genes and gene products are shown in the Reference, Sequence tables, Protein Group, Protein Group Matrix, MA_diff, and MA_clust tables. These genes and/or products are responsible for effects on traits such as plant vigor and seed yield.

While zinc responsive polynucleotides and gene products can act alone, combinations of these polynucleotides also affect growth and development. Useful combinations include different zinc responsive polynucleotides and/or gene products that have similar transcription profiles or similar biological activities, and members of the same or similar biochemical pathways. In addition, the combination of a zinc responsive polynucleotide and/or gene product with another environmentally responsive polynucleotide is also useful because of the interactions that exist between hormone-regulated pathways, stress pathways, nutritional pathways and development. Here, in addition to polynucleotides having similar transcription profiles and/or biological activities, useful combinations include polynucleotides that may have different transcription profiles but which participate in a common pathway.

Such zinc responsive genes and gene products can function to either increase or dampen the above phenotypes or activities either in response to changes in zinc concentration or in the absence of zinc fluctuations.

Zn transport, tolerance and nutrition-related genes and gene products can be used to alter or modulate one or more phenotypes including Zn uptake; transport of Zn or other heavy metals into roots; epidermal/cortical uptake; Xylem loading; Zn compartmentation; Xylem unloading; Phloem loading; efflux from cells to apoplast; sequestration in vacuoles/subcellular compartments; Zn tolerance; chelation of Zn; transport of Zn; metabolic and transcriptional control; activity of Zn binding enzymes; and activity of Zn binding transcription factors.

To improve any of the phenotype(s) above, activities of one or more of the Zn transport, tolerance and nutrition-related genes or gene products can be modulated and the plants can be tested by screening for the desired trait. Specifically, the gene, mRNA levels, or protein levels can be altered in a plant utilizing the procedures described herein and the phenotypes can be assayed, for example, in accordance to Lasat M M, Pence N S, Garvin D F, Ebbs S D, Kochian L V. J Exp Bot. 2000 January; 51(342):71-9; Grotz N, Fox T, Connolly E, Park W, Guerinot M L, Eide D. Proc Natl Acad Sci USA. 1998 Jun. 9; 95(12):7220-4; Crowder M W, Maiti M K, Banovic L, Makaroff C A. FEBS Lett. 1997 Dec. 1; 418(3):351-4; Hart J J, Norvell W A, Welch R M, Sullivan L A, Kochian L V. Plant Physiol. 1998 September; 118(1):219-26.

III.E.17.b. Use of Zn Transport, Tolerance and Nutrition-Related Genes to Modulate Biochemical Activities Alternatively, the activities of one or more of the zinc responsive genes can be modulated to change biochemical or metabolic activities and/or pathways such as those noted below. Such biological activities can be measured according to the citations included in the Table below:

| PROCESS | BIOCHEMICAL OR METABOLIC ACTIVITIES AND/OR PATHWAYS | CITATIONS INCLUDING ASSAYS |
| --- | --- | --- |
| Zn Uptake and Assimilation | Zn Influx | Lasat MM, Pence NS, Garvin DF, Ebbs SD, Kochian LV. J Exp Bot. 2000 January; 51(342): 71-9. |
| | Zn compartmentation | Hart JJ, Norvell WA, Welch RM, Sullivan LA, Kochian LV. Plant Physiol. 1998 September; 118(1): 219-26. |

-continued

| PROCESS | BIOCHEMICAL OR METABOLIC ACTIVITIES AND/OR PATHWAYS | CITATIONS INCLUDING ASSAYS |
|---|---|---|
| Zn binding by metabolic enzymes | | Crowder MW, Maiti MK, Banovic L, Makaroff CA. FEBS Lett. 1997 Dec 1; 418(3): 351-4; Kenzior AL, Folk WR. FEBS Lett. 1998 Dec 4; 440(3): 425-9. |
| Zn binding by transcription factors | | Newton AL, Sharpe BK, Kwan A, Mackay JP, Crossley M. J Biol Chem. 2000 May 19; 275(20): 15128-34; Lopez Ribera I, Ruiz-Avila L, Puigdomenech P. Biochem Biophys Res Commun. 1997 Jul 18; 236(2): 510-6; de Pater S, Greco V, Pham K, Memelink J, Kijne J. Nucleic Acids Res. 1996 Dec 1; 24(23): 4624-31. |
| Synthesis of proteins to chelate Zn and other metals | | Schafer HJ, Greiner S, Rausch T, Haag-Kerwer A. FEBS Lett. 1997 Mar 10; 404(2-3): 216-20. Rauser WE. Cell Biochem Biophys. 1999; 31(1): 19-48. |
| Synthesis of metabolites to chelate Zn and other metals | | Rauser WE. Cell Biochem Biophys. 1999; 31(1): 19-48. |

Other biological activities that can be modulated by Zn transport, tolerance and nutrition-related genes and their products are listed in the Reference tables. Assays for detecting such biological activities are described in the Protein Domain table.

Zn transport, tolerance and nutrition-related genes are differentially transcribed in response to low Zn concentrations. The microarray comparison consists of probes prepared from root RNA of *A. thaliana* (Columbia) seedlings hydroponically grown in complete nutrient medium (control) and Zn deficient seedlings grown in —Zn nutrient medium (experimental). The data from this experiment reveal a number of types genes and gene products. MA_diff table reports the changes in transcript levels of various zinc responsive genes in entire seedlings at 1 and 6 hours after a plant was sprayed with a Hoagland's solution enriched with zinc as compared to seedlings sprayed with Hoagland's solution only.

The data from this time course can be used to identify a number of types of zinc responsive genes and gene products, including "early responding," "high zinc responders," "repressors of zinc deprivation pathways" and "zinc deprivation responders." Profiles of these different zinc responsive genes are shown in the Table below with examples of associated biological activities.

| TRANSCRIPT LEVELS | TYPE OF GENE | PHYSIOLOGICAL CONSequence | EXAMPLES OF BIOCHEMICAL ACTIVITY |
|---|---|---|---|
| Upregulated transcripts (level at 1 hour ≅ 6 hours) (level at 1 hour > 6 hours) | Early responders to Zinc | Zinc Perception Zinc Uptake Modulation of Zinc Response Transduction Pathways Specific Gene Transcription Initiation | Transcription Factors Transporters |
| | Zinc Deprivation Responders | Repression of Pathways to Optimize Zinc Response Pathways | Inhibit Transport of Zinc Degradation |
| Level at 1 hour < 6 hours | Delayed Zinc Responders | | Zinc Metabolic Pathways |
| | Repressor of Zinc Deprivation Pathways | Negative Regulation of Zinc Pathways | |
| Down Regulated transcripts (Level at 1 hour ≅ 6 hours) (Level at 6 hours > 1 hour) | Early responder repressors of Zinc utilization Pathways | Negative Regulators of Zinc Utilization Pathways | Suppressing Zinc Requiring processes |
| Level at 1 hour > 6 hours | Genes with discontinued expression or unsTable mRNA following Zinc uptake | Changes in pathways and processes operating I cells | |

Use of Promoters of Zinc Responsive Genes

Promoters of Zinc responsive genes are useful for transcription of any desired polynucleotide or plant or non-plant origin. Further, any desired sequence can be transcribed in a similar temporal, tissue, or environmentally specific patterns as the Zinc responsive genes where the desired sequence is operably linked to a promoter of a Zinc responsive gene. The protein product of such a polynucleotide is usually synthesized in the same cells, in response to the same stimuli as the protein product of the gene from which the promoter was derived. Such promoter are also useful to produce antisense mRNAs to down-regulate the product of proteins, or to produce sense mRNAs to down-regulate mRNAs via sense suppression.

IV. Utilities of Particular Interest

Genes capable of modulating the phenotypes in the following table are useful produce the associated utilities in the table. Such genes can be identified by their cDNA ID number in the Knock-in and Knock-out Tables. That is, those genes noted in those Tables to have a phenotype as listed in the following column entitled "Phenotype Modulated by a Gene" are useful for the purpose identified in the corresponding position in the column entitled "Utilities".

| Phenotype Modulated by a Gene | | Utilities |
|---|---|---|
| Leaf shape | Cordate | decrease wind opacity, |
| | Cup-shaped | decrease lodging (plant fall over), |
| | Curled | increase biomass by making larger or different shaped leaves, |
| | Laceolate | improve the efficiency of mechanical harvesting, |
| | Lobed | decrease transpiration for better drought tolerance, |
| | Oval | changing leaf shape to collect and absorb water, |
| | Ovate | modulation of canopy structure and shading for altered irradiance close to the ground, |
| | Serrate | enhanced uptake of pesticides (herbicides, fungicides, etc), |
| | Trident | creation of ornamental leaf shapes, |
| | Undulate | increase resistance to pathogens by decreasing amount of water that collects on leaves, |
| | Vertically Oblong | change proporation of cell types in the leaves for enhanced photosynthesis, decreased transpiration, and enhanced |
| | Other Shapes | accumulation of desirable compounds including secondary metabolites in specialized cells, decrease insect feeding, |
| | Long petioles | decrease wind opacity, |
| | Short petioles | decrease lodging (plant fall over), increase biomass by better positioning of the leaf blade, decrease insect feeding, decrease transpiration for better drought tolerance, position leaves most effectively for photosynthetic efficiency |
| | Fused | ornamental applications to make distinctive plants, |
| Reduced fertility | Short siliques | increase or decrease the number of seeds in a fruit, increasing fruit size, modulating fruit shape to better fit harvesting or packaging requirements, useful for controlling dehisence and seed scatter |
| | Reduced fertility Sterility | useful in hybrid breeding programs, increasing fruit size, production of seedless fruit, useful as targets for gametocides, modulating fruit shape to better fit harvesting or packaging requirements, useful for controlling dehisence and seed scatter |
| | Flower size | useful for edible flowers useful for flower derived products such as fragrances useful for modulating seed size and number in combination with seed-specific genes value in the ornamental industry |

| Phenotype Modulated by a Gene | | Utilities |
|---|---|---|
| Stature | Large | increasing or decreasing plant biomass, |
| | Small | optimizing plant stature to increase yield under various diverse environmental conditions, e.g., when water or nutrients are limiting, |
| | Dwarfs | decreasing lodging, increasing fruit number and size, controlling shading and canopy effects |
| Meristems | | Change plant architecture, increase or decrease number of leaves as well as change the types of leaves to increase biomass, improve photosynthetic efficiency, create new varieties of ornamental plants with enhanced leaf design, preventing flowering to opimize vegetative growth, control of apical dominace, increase or decrease flowering time to fit season, water or fertilizer schedules, change arrangement of leaves on the stem (phyllotaxy) to optimize plant density, decrease insect feeding, or decrease pathogen infection, increase number of trichome/glandular trichome producing leaves targets for herbicides, generate ectopic meristems and ectopic growth of vegetative and floral tissues and seeds and fruits |
| Stem | Strong | modify lignin content/composition for creation of harder woods or reduce difficulty/costs in pulping for |
| | Weak | paper production or increase digestibility of forage crops, decrease lodging, modify cell wall polysaccharides in stems and fruits for improved texture and nutrition. increase biomass |
| | Late/Early Bolting | Break the need for long vernalization of vernalization-dependent crops, e.g., winter wheat, thereby increasing yield decrease or increase generaton time increase biomass |
| Lethals | Embryo-lethal | produce seedless fruit, use as herbicide targets |
| | Embryo-defective | produce seedless fruit, use as herbicide targets |
| | Seedling | use as herbicide targets, useful for metabolic engineering, |
| | Pigment-lethals | use as herbicide targets, increase photosynthetic efficiency |
| Pigment | Dark Green | Increase nutritional value, enhanced photosynthesis and carbon dioxide combustion and therefore increase plant vigor and biomass, enhanced photosynthetic efficiency and therefore increase plant vigor and biomass, prolong vegetative development, enhanced protection against pathogens, |
| | YGV1 | Useful as targets for herbicides, increase photosynthetic efficiency and therefore increase plant vigor and biomass, |
| | YGV2 | Useful as targets for herbicides, control of change from embryonic to adult organs, increase metabolic efficiency, increase photosynthetic efficiency and therefore increased plant vigor and biomass, |
| | YGV3 | Useful as targets for herbicides, nitrogen sensing/uptake/usage, increase metabolic efficiency and therefore increased plant vigor and biomass, |

-continued

| Phenotype Modulated by a Gene | | Utilities |
|---|---|---|
| | Interveinal chlorosis | to increase photosynthetic efficiency and therefore increase plant vigor and biomass to increase or decrease nitrogen transport and therefore increase plant vigor and biomass use as herbicide targets increase metabolic efficiency, |
| Roots | Short (primary root) | to access water from rainfall, to access rhizobia spray application, for anaerobic soils, useful to facilitate harvest of root crops, |
| | Thick (primary root) | useful for increasing biomass of root crops, for preventing plants dislodging during picking and harvesting, as root grafts, for animal feeds |
| | Branching (primary root) | modulation allows betters access to water, minerals, fertilizers, rhizobia prevent soil erosion, s increasing root biomass decrease root lodging, |
| | Long (lateral roots) | modulation allows improved access to water, nutrients, fertilizer, rhizobia, prevent soil erosion increase root biomass decrease root lodging modulation allows control on the depth of root growth in soil to access water and nutriennts modulation allows hormonal control of root growth and development (size) |
| | Agravitropic | modulation allows control on the depth of root growth in soil |
| | Curling (primary root) | modulation allows hormonal control of root growth and development (size) useful in anaerobic soils in allowing roots to stay close to surface harvesting of root crops |
| | Poor germination | |
| Trichome | Reduced Number Glabrous | Genes useful for decreasing transpiration, increased production of glandular trichomes for oil or other secreted chemicals of value, |
| | Increased Number | use as deterrent for insect herbivory and ovipostion modulation will increase resistance to UV light, |
| Wax mutants | | decrease insect herbivory and oviposition, compostion changes for the cosmetics industry, decrease transpiration, provide pathogen resistance, UV protection, modulation of leaf runoff properties and improved access for herbicides and fertilizers |
| Cotyledons | | modulation of seeds structure in legumes, increase nutritional value, improve seedling competion under field conditions, |
| Seeds | Transparent testa | genes useful for metabolic engineering anthocyanin and flavonoid pathways |
| | Light Dark | improved nutritional content |
| Flowers | Other | decrease petal abscission decrease pod shattering |
| Hypocotysl | Long | to improve germination rates to improve plant survivability |
| | Short | to improve germination rates to improve plant survivability |

V. Enhanced Foods

Animals require external supplies of amino acids that they cannot synthesize themselves. Also, some amino acids are required in larger quantities. The nutritional values of plants for animals and humans can thus be modified by regulating the amounts of the constituent amino acids that occur as free amino acids or in proteins. For instance, higher levels of lysine and/or methionine would enhance the nutritional value of corn seed. Applicants herein provide several methods for modulating the amino acid content:
(1) expressing a naturally occurring protein that has a high percentage of the desired amino acid(s);
(2) expressing a modified or synthetic coding sequence that has an enhanced percentage of the desired amino acids; or
(3) expressing the protein(s) that are capable of synthesizing more of the desired amino acids.

A specific example is expressing proteins with enhanced, for example, methionine content, preferentially in a corn or cereal seed used for animal nutrition or in the parts of plants used for nutritional purposes.

A protein is considered to have a high percentage of an amino acid if the amount of the desired amino acid is at least 1% of the total number of residues in a protein; more preferably 2% or greater. Amino acids of particular interest are tryptophan, lysine, methionine, phenylalanine, threonine leucine, valine, and isoleucine. Examples of naturally occurring proteins with a high percentage of any one of the amino acid of particular interest are listed in the Enhanced Amino Acid Table.

The sequence(s) encoding the selected protein(s) are operably linked to a promoter and other regulatory sequences and transformed into a plant as described below. The promoter is chosen optimally for promoting the desired level of expression of the protein in the selected organ e.g. a promoter highly functional in seeds. Modifications may be made to the sequence encoding the protein to ensure protein transport into, for example, organelles or storage bodies or its accumulation in the organ. Such modifications may include addition of signal sequences at or near the N terminus and amino acid residues to modify protein stability or appropriate glycosylation. Other modifications may be made to the transcribed nucleic acid sequence to enhance the stability or translatability of the mRNA, in order to ensure accumulation of more of the desired protein. Suitable versions of the gene construct and transgenic plants are selected on the basis of, for example, the improved amino acid content and nutritional value measured by standard biochemical tests and animal feeding trials.

VI. Use of Novel Genes to Facilitate Exploitation of Plants as Factories for the Synthesis of Valuable Molecules Plants and their constituent cells, tissues, and organs are factories that manufacture small organic molecules such as sugars, amino acids, fatty acids, vitamins, etc., as well as macromolecules such as proteins, nucleic acids, oils/fats and carbohydrates. Plants have long been a source of pharmaceutically beneficial chemicals; particularly, the secondary metabolites and hormone-related molecules synthesized by plants. Plants can also be used as factories to produce carbohydrates or lipids that comprises a carbon backbone useful as precursors of plastics, fiber, fuel, paper, pulp, rubber, solvents, lubricants, construction materials, detergents, and other cleaning materials. Plants can also generate other compounds that are of economic value, such as dyes, flavors, and fragrances. Both the intermediates as well as the end-products of plant bio-synthetic pathways have been found useful.

With the polynucleotides and polypeptides of the instant invention, modification of both in-vitro and in-vivo synthesis of such products is possible. One method of increasing the amount of either the intermediates or the end-products synthesized in a cell is to increase the expression of one or more proteins in the synthesis pathway as discussed below. Another method of increasing production of an intermediate is to inhibit expression of protein(s) that synthesize the end-product from the intermediate. Levels of end-products and intermediates can also be modified by changing the levels of enzymes that specifically change or degrade them. The kinds of molecules made can be also be modified by changing the genes encoding specific enzymes performing reactions at specific steps of the biosynthetic pathway. These genes can be from the same or a different organism. The molecular structures in the biosynthetic pathways can thus be modified or diverted into different branches of a pathway to make novel end-products.

Novel genes comprising selected promoters and sequences encoding enzymes are transformed into the selected plant to modify the levels, composition and/or structure of, without limitation:
Terpenoids
Alkaloids
Hormones, including brassinosteriods
Flavonoids
Steroids
Vitamins such as
   Retinol
   Riboflavin
   Thiamine
Caffeine
Morphine and other alkaloids
Peptides and amino acid synthesis
Antioxidants
Starches and lipids
Fatty acids
Fructose, mannose and other sugars
Glycerolipid
Citric acid
Lignin
Flavors
Fragrances
Essential oils
Colors or dyes
Gum
Gels
Waxes The modifications are made by designing one or more novel genes per application comprising promoters, to ensure production of the enzyme(s) in the relevant cells, in the right amount, and polynucleotides encoding the relevant enzyme. The promoters and polynucleotides are the subject of this application. The novel genes are transformed into the relevant species using standard procedures. Their effects are measured by standard assays for the specific chemical/biochemical products.

These polynucleotides and proteins of the invention that participate in the relevant pathways and are useful for changing production of the above chemicals and biochemicals are identified in the Reference tables by their enzyme function. More specifically, proteins of the invention that have the enzymatic activity of one of the entries in the following table entitled "Enzymes Effecting Modulation of Biological Pathways" are of interest to modulate the corresponding pathways to produce precursors or final products noted above that are of industrial use. Biological activities of particular interest are listed below.

Other polynucleotides and proteins that regulate where, when and to what extent a pathway is active in a plant are extremely useful for modulating the synthesis and accumulation of valuable chemicals. These elements including transcription factors, proteins involved in signal transduction and other proteins in the control of gene expression are described elsewhere in this application.

| Pathway Name | Enzyme Description | Comments |
| --- | --- | --- |
| Alkaloid biosynthesis I | Morphine 6-dehydrogenase | Also acts on other alkaloids, including codeine, normorphine and ethylmorphine, but only very slowly on 7,8-saturated derivatives such as dihydromorphine and dihydrocodeine In the reverse direction, also reduces naloxone to the 6-alpha-hydroxy analog Activated by 2-mercaptoethanol |
| | Codeinone reductase (NADPH) | Stereospecifically catalyses the reversible reduction of codeinone to codeine, which is a direct precursor of morphine in the opium poppy plant, Papaver somniferum |
| | Salutaridine reductase (NADPH) | Stereospecifically catalyses the reversible reduction of salutaridine to salutaridinol, which is a direct precursor of morphinan alkaloids in the poppy plant, Papaver somniferum |
| | (S)-stylopine synthase | Catalyses an oxidative reaction that does not incorporate oxygen into the product Forms the second methylenedioxy bridge of the protoberberine alkaloid stylopine from oxidative ring closure of adjacent phenolic and methoxy groups of cheilanthifoline |
| | (S)-cheilanthifoline synthase | Catalyses an oxidative reaction that does not incorporate oxygen into the product Forms the methylenedioxy bridge of the protoberberine alkaloid cheilanthifoline from oxidative ring closure of adjacent phenolic and methoxy groups of scoulerine |
| | Salutaridine synthase | Forms the morphinan alkaloid salutaridine by intramolecular phenol oxidation of reticuline without the incorporation of oxygen into the product |
| | (S)-canadine synthase | Catalyses an oxidative reaction that does not incorporate oxygen into the product Oxidation of the methoxyphenol group of the alkaloid tetrahydrocolumbamine results in the formation of the methylenedioxy bridge of canadine |
| | Protopine 6-monooxygenase | Involved in benzophenanthridine alkaloid synthesis in higher plants |
| | Dihydrosanguinarine 10-monooxygenase | Involved in benzophenanthridine alkaloid synthesis in higher plants |
| | Monophenol monooxygenase | A group of copper proteins that also catalyse the reaction of EC 1.10.3.1, if only 1,2-benzenediols are available as substrate |
| | L-amino acid oxidase | |
| | 1,2-dehydroreticulinium reductase (NADPH) | Stereospecifically reduces the 1,2-dehydroreticulinium ion to (R)-reticuline, which is a direct precursor of morphinan alkaloids in the poppy plant, papaver somniferum The enzyme does not catalyse the reverse reaction to any significant extent under physiological conditions |
| | Dihydrobenzo-phenanthridine oxidase | Also catalyzes: dihydrochelirubine + O(2) = chelirubine + H(2)O(2) Also catalyzes: dihydromacarpine + O(2) = macarpine + H(2)O(2) Found in higher plants Produces oxidized forms of the benzophenanthridine alkaloids |
| | Reticuline oxidase | The product of the reaction, (S)-scoulerine, is a precursor of protopine, protoberberine and benzophenanthridine alkaloid biosynthesis in plants Acts on (S)-reticuline and related compounds, converting the N-methyl group into the methylene bridge (`berberine bridge[PRIME]) of (S)-tetrahydroprotoberberines |

| Pathway Name | Enzyme Description | Comments |
|---|---|---|
| | 3[PRIME]-hydroxy-N-methyl-(S)-coclaurine 4[PRIME]-O-methyltransferase | Involved in isoquinoline alkaloid metabolism in plants Has also been shown to catalyse the methylation of (R,S)-laudanosoline, (S)-3[PRIME]-hydroxycoclaurine and (R,S)-7-O-methylnoraudanosoline |
| | (S)-scoulerine 9-O-methyltransferase | The product of this reaction is a precursor for protoberberine alkaloids in plants |
| | Columbamine O-methyltransferase | The product of this reaction is a protoberberine alkaloid that is widely distributed in the plant kingdom Distinct in specificity from EC 2.1.1.88 |
| | 10-hydroxydihydro-sanguinarine 10-O-methyltransferase | Part of the pathway for synthesis of benzophenanthridine alkaloids in plants |
| | 12-hydroxydi-hydrochelirubine 12-O-methyltransferase | Part of the pathway for synthesis of benzophenanthridine alkaloid macarpine in plants |
| | (R,S)-norcoclaurine 6-O-methyltransferase | Norcoclaurine is 6,7-dihydroxy-1-[(4-hydroxyphenyl)methyl]-1,2,3,4-tetrahydroisoquinoline The enzyme will also catalyse the 6-O-methylation of (R,S)-norlaudanosoline to form 6-O-methyl-norlaudanosoline, but this alkaloid has not been found to occur in plants |
| | Salutaridinol 7-O-acetyltransferase | At higher pH values the product, 7-O-acetylsalutaridinol, spontaneously closes the 4-> 5 oxide bridge by allylic elimination to form the morphine precursor thebaine From the opium poppy plant, *Papaver somniferum* |
| | Aspartate aminotransferase | Also acts on L-tyrosine, L-phenylalanine and L-tryptophan. This activity can be formed from EC 2.6.1.57 by controlled proteolysis |
| | Tyrosine aminotransferase | L-phenylalanine can act instead of L-tyrosine The mitochondrial enzyme may be identical with EC 2.6.1.1 The three isoenzymic forms are interconverted by EC 3.4.22.4 |
| | Aromatic amino acid transferase | L-methionine can also act as donor, more slowly Oxaloacetate can act as acceptor Controlled proteolysis converts the enzyme to EC 2.6.1.1 |
| | Tyrosine decarboxylase | The bacterial enzyme also acts on 3-hydroxytyrosine and, more slowly, on 3-hydroxyphenylalanine |
| | Aromatic-L-amino-acid decarboxylase | Also acts on L-tryptophan, 5-hydroxy-L-tryptophan and dihydroxy-L-phenylalanine (DOPA) |
| Alkaloid biosynthesis II | Tropine dehydrogenase | Oxidizes other tropan-3-alpha-ols, but not the corresponding beta-derivatives |
| | Tropinone reductase | |
| | Hyoscyamine (6S)-dioxygenase | |
| | 6-beta-hydroxyhyoscyamine epoxidase | |
| | Amine oxidase (copper-containing) | A group of enzymes including those oxidizing primary amines, diamines and histamine One form of EC 1.3.1.15 from rat kidney also catalyses this reaction |
| | Putrescine N-methyltransferase | |
| | Ornithine decarboxylase | |
| | Oxalyl-CoA decarboxylase | |
| | Phenylalanine ammonia-lyase | May also act on L-tyrosine |
| Androgen and estrogen metabolism | 3-beta-hydroxy-delta(5)-steroid dehydrogenase | Acts on 3-beta-hydroxyandrost-5-en-17-one to form androst-4-ene-3,17-dione and on 3-beta-hydroxypregn-5-en-20-one to form progesterone |
| | 11-beta-hydroxysteroid dehydrogenase | |
| | Estradiol 17-alpha-dehydrogenase | |

-continued

| Pathway Name | Enzyme Description | Comments |
|---|---|---|
| | 3-alpha-hydroxy-5-beta-androstane-17-one 3-alpha-dehydrogenase | |
| | 3-alpha (17-beta)-hydroxysteroid dehydrogenase (NAD+) | Also acts on other 17-beta-hydroxysteroids, on the 3-alpha-hydroxy group of pregnanes and bile acids, and on benzene dihydrodiol Different from EC 1.1.1.50 or EC 1.1.1.213 |
| | 3-alpha-hydroxysteroid dehydrogenase (B-specific) | Acts on other 3-alpha-hydroxysteroids and on 9-, 11- and 15-hydroxyprostaglandin B-specific with respect to NAD(+) or NADP(+) (cf. EC 1.1.1.213) |
| | 3(or 17)beta-hydroxysteroid dehydrogenase | Also acts on other 3-beta- or 17-beta-hydroxysteroids (cf EC 1.1.1.209) |
| | Estradiol 17 beta-dehydrogenase | Also acts on (S)-20-hydroxypregn-4-en-3-one and related compounds, oxidizing the (S)-20-group B-specific with respect to NAD(P)(+) |
| | Testosterone 17-beta-dehydrogenase | |
| | Testosterone 17-beta-dehydrogenase (NADP+) | Also oxidizes 3-hydroxyhexobarbital to 3-oxohexobarbital |
| | Steroid 11-beta-monooxygenase | Also hydroxylates steroids at the 18-position, and converts 18-hydroxycorticosterone into aldosterone |
| | Estradiol 6-beta-monooxygenase | |
| | Androst-4-ene-3,17-dione monooxygenase | Has a wide specificity A single enzyme from *Cylindrocarpon radicicola* (EC 1.14.13.54) catalyses both this reaction and that catalysed by EC 1.14.99.4 |
| | 3-oxo-5-alpha-steroid 4-dehydrogenase | |
| | 3-oxo-5-beta-steroid 4-dehydrogenase | |
| | UDP-glucuronosyltransferase | Family of enzymes accepting a wide range of substrates, including phenols, alcohols, amines and fatty acids Some of the activities catalysed were previously listed separately as EC 2.4.1.42, EC 2.4.1.59, EC 2.4.1.61, EC 2.4.1.76, EC 2.4.1.77, EC 2.4.1.84, EC 2.4.1.107 and EC 2.4.1.108 A temporary nomenclature for the various forms whose delineation is in a state of flux |
| | Steroid sulfotransferase | Broad specificity resembling EC 2.8.2.2, but also acts on estrone |
| | Alcohol sulfotransferase | Primary and secondary alcohols, including aliphatic alcohols, ascorbate, chloramphenicol, ephedrine and hydroxysteroids, but not phenolic steroids, can act as acceptors (cf. EC 2.8.2.15) |
| | Estrone sulfotransferase | |
| | Arylsulfatase | A group of enzymes with rather similar specificities |
| | Steryl-sulfatase | Also acts on some related steryl sulfates |
| | 17-alpha-hydroxyprogesterone aldolase | |
| | Steroid delta-isomerase | |
| C21-Steroid hormone metabolism | 3-beta-hydroxy-delta(5)-steroid dehydrogenase | Acts on 3-beta-hydroxyandrost-5-en-17-one to form androst-4-ene-3,17-dione and on 3-beta-hydroxypregn-5-en-20-one to form progesterone |
| | 11-beta-hydroxysteroid dehydrogenase | |
| | 20-alpha-hydroxysteroid dehydrogenase | A-specific with respect to NAD(P)(+) |
| | 3-alpha-hydroxysteroid dehydrogenase (B-specific) | Acts on other 3-alpha-hydroxysteroids and on 9-, 11- and 15-hydroxyprostaglandin B-specific with respect to NAD(+) or NADP(+) (cf. EC 1.1.1.213) |
| | 3-alpha(or 20-beta)-hydroxysteroid dehydrogenase | The 3-alpha-hydroxyl group or 20-beta-hydroxyl group of pregnane and androstane steroids can act as donors |

| Pathway Name | Enzyme Description | Comments |
|---|---|---|
| | Steroid 11-beta-monooxygenase | Also hydroxylates steroids at the 18-position, and converts 18-hydroxycorticosterone into aldosterone |
| | Corticosterone 18-monooxygenase | |
| | Cholesterol monooxygenase (side-chain cleaving) | The reaction proceeds in three stages, with hydroxylation at C-20 and C-22 preceding scission of the side-chain at C-20 |
| | Steroid 21-monooxygenase | |
| | Progesterone 11-alpha-monooxygenase | |
| | Steroid 17-alpha-monooxygenase | |
| | Cholestenone 5-beta-reductase | |
| | Cortisone beta-reductase | |
| | Progesterone 5-alpha-reductase | Testosterone and 20-alpha-hydroxy-4-pregnen-3-one can act in place of progesterone |
| | 3-oxo-5-beta-steroid 4-dehydrogenase | |
| | Steroid delta-isomerase | |
| Flavonoids, stilbene and lignin biosynthesis | Coniferyl-alcohol dehydrogenase | Specific for coniferyl alcohol; does not act on cinnamyl alcohol, 4-coumaryl alcohol or sinapyl alcohol |
| | Cinnamyl-alcohol dehydrogenase | Acts on coniferyl alcohol, sinapyl alcohol, 4-coumaryl alcohol and cinnamyl alcohol (cf. EC 1.1.1.194) |
| | Dihydrokaempferol 4-reductase | Also acts, in the reverse direction, on (+)-dihydroquercetin and (+)-dihydromyricetin Each dihydroflavonol is reduced to the corresponding cis-flavon-3,4-diol NAD(+) can act instead of NADP(+), more slowly Involved in the biosynthesis of anthocyanidins in plants |
| | Flavonone 4-reductase | Involved in the biosynthesis of 3-deoxyanthocyanidins from flavonones such as naringenin or eriodictyol |
| | Peroxidase | |
| | Caffeate 3,4-dioxygenase | |
| | Naringenin 3-dioxygenase | |
| | Trans-cinnamate 4-monooxygenase | Also acts on NADH, more slowly |
| | Trans-cinnamate 2-monooxygenase | |
| | Flavonoid 3[PRIME]-monooxygenase | Acts on a number of flavonoids, including naringenin and dihydrokaempferol Does not act on 4-coumarate or 4-coumaroyl-CoA |
| | Monophenol monooxygenase | A group of copper proteins that also catalyse the reaction of EC 1.10.3.1, if only 1,2-benzenediols are available as substrate |
| | Cinnamoyl-CoA reductase | Also acts on a number of substituted cinnamoyl esters of coenzyme A |
| | Caffeoyl-CoA O-methyltransferase | |
| | Luteolin O-methyltransferase | Also acts on luteolin-7-O-beta-D-glucoside |
| | Caffeate O-methyltransferase | 3,4-dihydroxybenzaldehyde and catechol can act as acceptor, more slowly |
| | Apigenin 4[PRIME]-O-methyltransferase | Converts apigenin into acacetin Naringenin (5,7,4[PRIME]-trihydroxyflavonone) can also act as acceptor, more slowly |
| | Quercetin 3-O-methyltransferase | Specific for quercetin. Related enzymes bring about the 3-O-methylation of other flavonols, such as galangin and kaempferol |
| | Isoflavone-7-O-beta-glucoside 6[PRIME][PRIME]-O-malonyltransferase | The 6-position of the glucose residue of formononetin can also act as acceptor Some other 7-O-glucosides of isoflavones, flavones and flavonols can also act, more slowly |
| | Pinosylvin synthase | Not identical with EC 2.3.1.74 or EC 2.3.1.95 |
| | Naringenin-chalcone synthase | In the presence of NADH and a reductase, 6[PRIME]-deoxychalcone is produced |

| Pathway Name | Enzyme Description | Comments |
|---|---|---|
| | Trihydroxystilbene synthase | Not identical with EC 2.3.1.74 or EC 2.3.1.146 |
| | Quinate O-hydroxycinnamoyltransferase | Caffeoyl-CoA and 4-coumaroyl-CoA can also act as donors, more slowly Involved in the biosynthesis of chlorogenic acid in sweet potato and, with EC 2.3.1.98 in the formation of caffeoyl-CoA in tomato |
| | Coniferyl-alcohol glucosyltransferase | Sinapyl alcohol can also act as acceptor |
| | 2-coumarate O-beta-glucosyltransferase | Coumarinate (cis-2-hydroxycinnamate) does not act as acceptor |
| | Scopoletin glucosyltransferase | |
| | Flavonol-3-O-glucoside L-rhamnosyltransferase | Converts flavonol 3-O-glucosides to 3-O-rutinosides Also acts, more slowly, on rutin, quercetin 3-O-galactoside and flavonol O3-rhamnosides |
| | Flavone 7-O-beta-glucosyltransferase | A number of flavones, flavonones and flavonols can function as acceptors Different from EC 2.4.1.91 |
| | Flavonol 3-O-glucosyltransferase | Acts on a variety of flavonols, including quercetin and quercetin 7-O-glucoside Different from EC 2.4.1.81 |
| | Flavone apiosyltransferase | 7-O-beta-D-glucosides of a number of flavonoids and of 4-substituted phenols can act as acceptors |
| | Coniferin beta-glucosidase | Also hydrolyzes syringin, 4-cinnamyl alcohol beta-glucoside, and, more slowly, some other aryl beta-glycosides A plant cell-wall enzyme involved in the biosynthesis of lignin |
| | Beta-glucosidase | Wide specificity for beta-D-glucosides. Some examples also hydrolyse one or more of the following: beta-D-galactosides, alpha-L-arabinosides, beta-D-xylosides, and beta-D-fucosides |
| | Chalcone isomerase | |
| | 4-coumarate--CoA ligase | |

| Pathway Name | Enzyme Description | Enzyme Comments |
|---|---|---|
| Ascorbate and aldarate metabolism | D-threo-aldose 1-dehydrogenase | Acts on L-fucose, D-arabinose and L-xylose The animal enzyme was also shown to act on L-arabinose, and the enzyme from *Pseudomonas caryophyllion* L-glucose |
| | L-threonate 3-dehydrogenase | |
| | Glucuronate reductase | Also reduces D-galacturonate May be identical with EC 1.1.1.2 |
| | Glucuronolactone reductase | |
| | L-arabinose 1-dehydrogenase | |
| | L-galactonolactone oxidase | Acts on the 1,4-lactones of L-galactonic, D-altronic, L-fuconic, D-arabinic and D-threonic acids Not identical with EC 1.1.3.8 (cf. EC 1.3.2.3) |
| | L-gulonolactone oxidase | The product spontaneously isomerizes to L-ascorbate |
| | L-ascorbate oxidase | |
| | L-ascorbate peroxidase | |
| | Ascorbate 2,3-dioxygenase | |
| | 2,5-dioxovalerate dehydrogenase | |
| | Aldehyde dehydrogenase (NAD+) | Wide specificity, including oxidation of D-glucuronolactone to D-glucarate Cf. EC 1.1.3.24 |
| | Galactonolactone dehydrogenase | |
| | Monodehydroascorbate reductase (NADH) | |

-continued

| Pathway Name | Enzyme Description | Enzyme Comments |
|---|---|---|
| | Glutathione dehydrogenase (ascorbate) | |
| | L-arabinonolactonase | |
| | Gluconolactonase | Acts on a wide range of hexono-1,5-lactones |
| | Uronolactonase | |
| | 1,4-lactonase | Specific for 1,4-lactones with 4-8 carbon atoms Does not hydrolyse simple aliphatic esters, acetylcholine, sugar lactones or substituted aliphatic lactones, e.g. 3-hydroxy-4-butyrolactone |
| | 2-dehydro-3-deoxyglucarate aldolase | |
| | L-arabinonate dehydratase | |
| | Glucarate dehydratase | |
| | 5-dehydro-4-deoxyglucarate dehydratase | |
| | Galactarate dehydratase | |
| | 2-dehydro-3-deoxy-L-arabinonate dehydratase | |
| Carbon fixation | Malate dehydrogenase | Also oxidizes some other 2-hydroxydicarboxylic acids |
| | Malate dehydrogenase (decarboxylating) | Does not decarboxylates added oxaloacetate |
| | Malate dehydrogenase (oxaloacetate decarboxylating) (NADP+) | Also decarboxylates added oxaloacetate |
| | Malate dehydrogenase (NADP+) | Activated by light |
| | Glyceraldehyde-3-phosphate dehydrogenase (NADP+) (phosphorylating) | |
| | Transketolase | Wide specificity for both reactants, e.g. converts hydroxypyruvate and R—CHO into CO(2) and R—CHOH—CO—CH(2)OH Transketolase from Alcaligenes faecalis shows high activity with D-erythrose as acceptor |
| | Aspartate aminotransferase | Also acts on L-tyrosine, L-phenylalanine and L-tryptophan. This activity can be formed from EC 2.6.1.57 by controlled proteolysis |
| | Alanine aminotransferase | 2-aminobutanoate acts slowly instead of alanine |
| | Sedoheptulokinase | |
| | Phosphoribulokinase | |
| | Pyruvate kinase | UTP, GTP, CTP, ITP and dATP can also act as donors Also phosphorylates hydroxylamine and fluoride in the presence of CO(2) |
| | Phosphoglycerate kinase | |
| | Pyruvate, phosphate dikinase | |
| | Fructose-bisphosphatase | The animal enzyme also acts on sedoheptulose 1,7-bisphosphate |
| | Sedoheptulose-bisphosphatase | |
| | Phosphoenolpyruvate carboxylase | |
| | Ribulose-bisphosphate carboxylase | Will utilize O(2) instead of CO(2), forming 3-phospho-D-glycerate and 2-phosphoglycolate |
| | Phosphoenolpyruvate carboxykinase (ATP) | |
| | Fructose-bisphosphate aldolase | Also acts on (3S,4R)-ketose 1-phosphates The yeast and bacterial enzymes are zinc proteins The enzymes increase electron-attraction by the carbonyl group, some |

| Pathway Name | Enzyme Description | Enzyme Comments |
|---|---|---|
| | | (Class I) forming a protonated imine with it, others (Class II), mainly of microbial origin, polarizing it with a metal ion, e.g zinc |
| | Phosphoketolase | |
| | Ribulose-phosphate 3-epimerase | Also converts D-erythrose 4-phosphate into D-erythrulose 4-phosphate and D-threose 4-phosphate |
| | Triosephosphate isomerase | |
| | Ribose 5-phosphate epimerase | Also acts on D-ribose 5-diphosphate and D-ribose 5-triphosphate |
| Phenylalanine metabolism | (R)-4-hydroxyphenyllactate dehydrogenase | Also acts, more slowly, on (R)-3-phenyllactate, (R)-3-(indole-3-yl)lactate and (R)-lactate |
| | Hydroxyphenyl-pyruvate reductase | Also acts on 3-(3,4-dihydroxyphenyl)lactate Involved with EC 2.3.1.140 in the biosynthesis of rosmarinic acid |
| | Aryl-alcohol dehydrogenase | A group of enzymes with broad specificity towards primary alcohols with an aromatic or cyclohex-1-ene ring, but with low or no activity towards short-chain aliphatic alcohols |
| | Peroxidase | |
| | Catechol 1,2-dioxygenase | Involved in the metabolism of nitro-aromatic compounds by a strain of *Pseudomonas putida* |
| | 2,3-dihydroxybenzoate 3,4-dioxygenase | |
| | 3-carboxyethylcatechol 2,3-dioxygenase | |
| | Catechol 2,3-dioxygenase | The enzyme from *Alcaligines* sp. strain O-1 has also been shown to catalyse the reaction: 3-Sulfocatechol + O(2) + H(2)O = 2-hydroxymuconate + bisulfite. It has been referred to as 3-sulfocatechol 2,3-dioxygenase. Further work will be necessary to show whether or not this is a distinct enzyme |
| | 4-hydroxyphenylpyruvate dioxygenase | |
| | Protocatechuate 3,4-dioxygenase | |
| | Hydroxyquinol 1,2-dioxygenase | The product isomerizes to 2-maleylacetate (cis-hex-2-enedioate) Highly specific; catechol and pyrogallol are acted on at less than 1% of the rate at which benzene-1,2,4-triol is oxidized |
| | Protocatechuate 4,5-dioxygenase | |
| | Phenylalanine 2-monooxygenase | Also catalyses a reaction similar to that of EC 1.4.3.2, forming 3-phenylpyruvate, NH(3) and H(2)O(2), but more slowly |
| | Anthranilate 1,2-dioxygenase (deaminating, decarboxylating) | |
| | Benzoate 1,2-dioxygenase | A system, containing a reductase which is an iron-sulfur flavoprotein (FAD), and an iron-sulfur oxygenase |
| | Toluene dioxygenase | A system, containing a reductase which is an iron-sulfur flavoprotein (FAD), an iron-sulfur oxygenase, and a ferredoxin Some other aromatic compounds, including ethylbenzene, 4-xylene and some halogenated toluenes, are converted into the corresponding cis-dihydrodiols |
| | Naphthalene 1,2-dioxygenase | A system, containing a reductase which is an iron-sulfur flavoprotein (FAD), an iron-sulfur oxygenase, and ferredoxin |
| | Benzene 1,2-dioxygenase | A system, containing a reductase which is an iron-sulfur flavoprotein, an iron-sulfur oxygenase and ferredoxin |

| Pathway Name | Enzyme Description | Enzyme Comments |
|---|---|---|
| | Salicylate 1-monooxygenase | |
| | Trans-cinnamate 4-monooxygenase | Also acts on NADH, more slowly |
| | Benzoate 4-monooxygenase | |
| | 4-hydroxybenzoate 3-monooxygenase | Most enzymes from *Pseudomonas* are highly specific for NAD(P)H (cf EC 1.14.13.33) |
| | 3-hydroxybenzoate 4-monooxygenase | Also acts on a number of analogs of 3-hydroxybenzoate substituted in the 2, 4, 5 and 6 positions |
| | 3-hydroxybenzoate 6-monooxygenase | Also acts on a number of analogs of 3-hydroxybenzoate substituted in the 2, 4, 5 and 6 positions NADPH can act instead of NADH, more slowly |
| | 4-hydroxybenzoate 3-monooxygenase (NAD(P)H) | The enzyme from *Corynebacterium cyclohexanicum* is highly specific for 4-hydroxybenzoate, but uses NADH and NADPH at approximately equal rates (cf. EC 1.14.13.2). It is less specific for NADPH than EC 1.14.13.2 |
| | Anthranilate 3-monooxygenase (deaminating) | The enzyme from *Aspergillus niger* is an iron protein; that from the yeast. Trichosporon cutaneum is a flavoprotein (FAD) |
| | Melilotate 3-monooxygenase | |
| | Phenol 2-monooxygenase | Also active with resorcinol and O-cresol |
| | Mandelate 4-monooxygenase | |
| | 3-hydroxybenzoate 2-monooxygenase | |
| | 4-cresol dehydrogenase (hydroxylating) | Phenazine methosulfate can act as acceptor A quinone methide is probably formed as intermediate The product is oxidized further to 4-hydroxybenzoate |
| | Benzaldehyde dehydrogenase (NAD+) | |
| | Aminomuconate-semialdehyde dehydrogenase | Also acts on 2-hydroxymuconate semialdehyde |
| | Phenylacetaldehyde dehydrogenase | |
| | 4-carboxy-2-hydroxymuconate-6-semialdehyde dehydrogenase | Does not act on unsubstituted aliphatic or aromatic aldehydes or glucose NAD(+) can replace NADP(+), but with lower affinity |
| | Aldehyde dehydrogenase (NAD(P)+) | |
| | Benzaldehyde dehydrogenase (NADP+) | |
| | Coumarate reductase | |
| | Cis-1,2-dihydrobenzene-1,2-diol dehydrogenase | |
| | Cis-1,2-dihydro-1,2-dihydroxynaphthalene dehydrogenase | Also acts, at half the rate, on cis-anthracene dihydrodiol and cis-phenanthrene dihydrodiol |
| | 2-enoate reductase | Acts, in the reverse direction, on a wide range of alkyl and aryl alpha,beta-unsaturated carboxylate ions 2-butenoate was the best substrate tested |
| | Maleylacetate reductase | |
| | Phenylalanine dehydrogenase | The enzyme from *Bacillus badius* and *Sporosarcina ureae* are highly specific for L-phenylalanine, that from *Bacillus sphaericus* also acts on L-tyrosine |
| | L-amino acid oxidase | |
| | Amine oxidase (flavin-containing) | Acts on primary amines, and usually also on secondary and tertiary amines |

| Pathway Name | Enzyme Description | Enzyme Comments |
|---|---|---|
| | Amine oxidase (copper-containing) | A group of enzymes including those oxidizing primary amines, diamines and histamine One form of EC 1.3.1.15 from rat kidney also catalyses this reaction |
| | D-amino-acid dehydrogenase | Acts to some extent on all D-amino acids except D-aspartate and D-glutamate |
| | Aralkylamine dehydrogenase | Phenazine methosulfate can act as acceptor Acts on aromatic amines and, more slowly, on some long-chain aliphatic amines, but not on methylamine or ethylamine (cf EC 1.4.99.3) |
| | Glutamine N-phenylacetyltransferase | |
| | Acetyl-CoA C-acyltransferase | |
| | D-amino-acid N-acetyltransferase | |
| | Phenylalanine N-acetyltransferase | Also acts, more slowly, on L-histidine and L-alanine |
| | Glycine N-benzoyltransferase | Not identical with EC 2.3.1.13 or EC 2.3.1.68 |
| | Aspartate aminotransferase | Also acts on L-tyrosine, L-phenylalanine and L-tryptophan. This activity can be formed from EC 2.6.1.57 by controlled proteolysis |
| | D-alanine aminotransferase | Acts on the D-isomers of leucine, aspartate, glutamate, aminobutyrate, norvaline and asparagine |
| | Tyrosine aminotransferase | L-phenylalanine can act instead of L-tyrosine The mitochondrial enzyme may be identical with EC 2.6.1.1 The three isoenzymic forms are interconverted by EC 3.4.22.4 |
| | Aromatic amino acid transferase | L-methionine can also act as donor, more slowly Oxaloacetate can act as acceptor Controlled proteolysis converts the enzyme to EC 2.6.1.1 |
| | Histidinol-phosphate aminotransferase | |
| | 3-oxoadipate CoA-transferase | |
| | 3-oxoadipate enol-lactonase | Acts on the product of EC 4.1.1.44 |
| | Carboxymethylene-butenolidase | |
| | 2-pyrone-4,6-dicarboxylate lactonase | The product isomerizes to 4-oxalmesaconate |
| | Hippurate hydrolase | Acts on various N-benzoylamino acids |
| | Amidase | |
| | Acylphosphatase | |
| | 2-hydroxymuconate-semialdehyde hydrolase | |
| | Aromatic-L-amino-acid decarboxylase | Also acts on L-tryptophan, 5-hydroxy-L-tryptophan and dihydroxy-L-phenylalanine (DOPA) |
| | Phenylpyruvate decarboxylase | Also acts on indole-3-pyruvate |
| | 4-carboxymucono-lactone decarboxylase | |
| | O-pyrocatechuate decarboxylase | |
| | Phenylalanine decarboxylase | Also acts on tyrosine and other aromatic amino acids |
| | 4-hydroxybenzoate decarboxylase | |
| | Protocatechuate decarboxylase | |
| | Benzoylformate decarboxylase | |
| | 4-oxalocrotonate decarboxylase | Involved in the meta-cleavage pathway for the degradation of phenols, cresols and catechols |
| | 4-hydroxy-4-methyl-2-oxoglutarate aldolase | Also acts on 4-hydroxy-4-methyl-2-oxoadipate and 4-carboxy-4-hydroxy-2-oxohexadioate |

-continued

| Pathway Name | Enzyme Description | Enzyme Comments |
|---|---|---|
| | 2-oxopent-4-enoate hydratase | Also acts, more slowly, on cis-2-oxohex-4-enoate, but not on the trans-isomer |
| | Phenylalanine ammonia-lyase | May also act on L-tyrosine |
| | Phenylalanine racemase (ATP-hydrolysing) | |
| | Mandelate racemase | |
| | Phenylpyruvate tautomerase | Also acts on other arylpyruvates |
| | 5-carboxymethyl-2-hydroxymuconate delta-isomerase | |
| | Muconolactone delta-isomerase | |
| | Muconate cycloisomerase | Also acts, in the reverse reaction, on 3-methyl-cis-cis-hexa-dienedioate and, very slowly, on cis-trans-hexadienedioate Not identical with EC 5.5.1.7 or EC 5.5.1.11 |
| | 3-carboxy-cis,cis-muconate cycloisomerase | |
| | Carboxy-cis,cis-muconate cyclase | |
| | Chloromuconate cycloisomerase | Spontaneous elimination of HCl produces cis-4-carboxymethylenebut-2-en-4-olide Also acts in reverse direction on 2-chloro-cis,cis-muconate Not identical with EC 5.5.1.1 or EC 5.5.1.11 |
| | Phenylacetate--CoA ligase | Phenoxyacetate can replace phenylacetate |
| | Benzoate--CoA ligase | Also acts on 2-, 3- and 4-fluorobenzoate, but only very slowly on the corresponding chlorobenzoates |
| | 4-hydroxybenzoate--CoA ligase | |
| | Phenylacetate--CoA ligase | Also acts, more slowly, on acetate, propanoate and butanoate, but not on hydroxy derivatives of phenylacetate and related compounds |
| Phenylalanine, tyrosine and tryptophan biosynthesis | Quinate 5-dehydrogenase | |
| | Shikimate 5-dehydrogenase | |
| | Quinate dehydrogenase (pyrroloquinoline-quinone) | |
| | Phenylalanine 4-monooxygenase | |
| | Prephenate dehydrogenase | This enzyme in the enteric bacteria also possesses chorismate mutase activity (EC 5.4.99.5) and converts chorismate into prephenate |
| | Prephenate dehydrogenase (NADP+) | |
| | Cyclohexadienyl dehydrogenase | Also acts on prephenate and D-prephenyllactate (cf. EC 1.3.1.12) |
| | 2-methyl-branched-chain-enoyl-CoA reductase | From *Ascaris suum* The reaction proceeds only in the presence of another flavoprotein (ETF = [PRIME]Electron-Transferring Flavoprotein[PRIME]) |
| | Phenylalanine dehydrogenase | The enzyme from *Bacillus badius* and *Sporosarcina ureae* are highly specific for L-phenylalanine, that from *Bacillus sphaericus* also acts on L-tyrosine |
| | L-amino acid oxidase | |
| | Anthranilate phosphoribosyl-transferase | In some organisms, this enzyme is part of a multifunctional protein together with one or more components of the system for biosynthesis of tryptophan (EC 4.1.1.48, EC 4.1.3.27, EC 4.2.1.20, and EC 5.3.1.24) |
| | 3-phosphoshikimate 1-carboxyvinyl-transferase | |

-continued

| Pathway Name | Enzyme Description | Enzyme Comments |
|---|---|---|
| | Aspartate aminotransferase | Also acts on L-tyrosine, L-phenylalanine and L-tryptophan. This activity can be formed from EC 2.6.1.57 by controlled proteolysis |
| | Tyrosine aminotransferase | L-phenylalanine can act instead of L-tyrosine The mitochondrial enzyme may be identical with EC 2.6.1.1 The three isoenzymic forms are interconverted by EC 3.4.22.4 |
| | Aromatic amino acid transferase | L-methionine can also act as donor, more slowly Oxaloacetate can act as acceptor Controlled proteolysis converts the enzyme to EC 2.6.1.1 |
| | Histidinol-phosphate aminotransferase | |
| | Shikimate kinase | |
| | Indole-3-glycerol-phosphate synthase | In some organisms, this enzyme is part of a multifunctional protein together with one or more components of the system for biosynthesis of tryptophan (EC 2.4.2.18, EC 4.1.3.27, EC 4.2.1.20, and EC 5.3.1.24) |
| | 2-dehydro-3-deoxyphosphoheptonate aldolase | |
| | Anthranilate synthase | In some organisms, this enzyme is part of a multifunctional protein together with one or more components of the system for biosynthesis of tryptophan (EC 2.4.2.18, EC 4.1.1.48, EC 4.2.1.20, and EC 5.3.1.24) The native enzyme in the complex with uses either glutamine or (less efficiently) NH(3). The enzyme separated from the complex uses NH(3) only |
| | 3-dehydroquinate dehydratase | |
| | Phosphopyruvate hydratase | Also acts on 3-phospho-D-erythronate |
| | Tryptophan synthase | Also catalyses the conversion of serine and indole into tryptophan and water and of indoleglycerol phosphate into indole and glyceraldehyde phosphate In some organisms, this enzyme is part of a multifunctional protein together with one or more components of the system for biosynthesis of tryptophan (EC 2.4.2.18, EC 4.1.1.48, EC 4.1.3.27, and EC 5.3.1.24) |
| | Prephenate dehydratase | This enzyme in the enteric bacteria also possesses chorismate mutase activity and converts chorismate into prephenate |
| | Carboxycyclohexadienyl dehydratase | Also acts on prephenate and D-prephenyllactate Cf. EC 4.2.1.51 |
| | 3-dehydroquinate synthase | The hydrogen atoms on C-7 of the substrate are retained on C-2 of the products |
| | Chorismate synthase | Shikimate is numbered so that the double-bond is between C-1 and C-2, but some earlier papers numbered in the reverse direction |
| | Phosphoribosylanthranilate isomerase | In some organisms, this enzyme is part of a multifunctional protein together with one or more components of the system for biosynthesis of tryptophan (EC 2.4.2.18, EC 4.1.1.48, EC 4.1.3.27, and EC 4.2.1.20) |
| | Chorismate mutase | |
| | Tyrosine--tRNA ligase | |
| | Phenylalanine--tRNA ligase | |
| Starch and sucrose metabolism | UDP-glucose 6-dehydrogenase | Also acts on UDP-2-deoxyglucose |
| | Glucoside 3-dehydrogenase | The enzyme acts on D-glucose, D-galactose, D-glucosides and D-galactosides, but D-glucosides react more rapidly than D-galactosides |

| Pathway Name | Enzyme Description | Enzyme Comments |
| --- | --- | --- |
| | CDP-4-dehydro-6-deoxyglucose reductase | Two proteins are involved but no partial reaction has been observed in the presence of either alone |
| | Phosphorylase | The recommended name should be qualified in each instance by adding the name of the natural substance, e.g. maltodextrin phosphorylase, starch phosphorylase, glycogen phosphorylase |
| | Levansucrase | Some other sugars can act as D-fructosyl acceptors |
| | Glycogen (starch) synthase | The recommended name varies according to the source of the enzyme and the nature of its synthetic product Glycogen synthase from animal tissues is a complex of a catalytic subunit and the protein glycogenin The enzyme requires glucosylated glycogenin as a primer; this is the reaction product of EC 2.4.1.186 A similar enzyme utilizes ADP-glucose (Cf. EC 2.4.1.21) |
| | Cellulose synthase (UDP-forming) | Involved in the synthesis of cellulose A similar enzyme utilizes GDP-glucose (Cf. EC 2.4.1.29) |
| | Sucrose synthase | |
| | Sucrose-phosphate synthase | |
| | Alpha,alpha-trehalose-phosphate synthase (UDP-forming) | See also EC 2.4.1.36 |
| | UDP-glucuronosyltransferase | Family of enzymes accepting a wide range of substrates, including phenols, alcohols, amines and fatty acids Some of the activities catalysed were previously listed separately as EC 2.4.1.42, EC 2.4.1.59, EC 2.4.1.61, EC 2.4.1.76, EC 2.4.1.77, EC 2.4.1.84, EC 2.4.1.107 and EC 2.4.1.108 A temporary nomenclature for the various forms whose delineation is in a state of flux |
| | 1,4-alpha-glucan branching enzyme | Converts amylose into amylopectin The recommended name requires a qualification depending on the product, glycogen or amylopectin, e.g. glycogen branching enzyme, amylopectin branching enzyme. The latter has frequently been termed Q-enzyme |
| | Cellobiose phosphorylase | |
| | Starch (bacterial glycogen) synthase | The recommended name various according to the source of the enzyme and the nature of its synthetic product, e.g. starch synthase, bacterial glycogen synthase A similar enzyme utilizes UDP-glucose (Cf. EC 2.4.1.11) |
| | 4-alpha-glucanotransferase | An enzymic activity of this nature forms part of the mammalian and Yeast glycogen branching system (see EC 3.2.1.33) |
| | Cellulose synthase (GDP-forming) | Involved in the synthesis of cellulose A similar enzyme utilizes UDP-glucose (Cf. EC 2.4.1.12) |
| | 1,3-beta-glucan synthase | |
| | Phenol beta-glucosyltransferase | Acts on a wide range of phenols |
| | Amylosucrase | |
| | Polygalacturonate 4-alpha-galacturonosyltransferase | |
| | Dextransucrase | |
| | Alpha,alpha-trehalose phosphorylase | |
| | Sucrose phosphorylase | In the forward reaction, arsenate may replace phosphate In the reverse reaction various ketoses and L-arabinose may replace D-fructose |

| Pathway Name | Enzyme Description | Enzyme Comments |
|---|---|---|
| | Maltose phosphorylase | |
| | 1,4-beta-D-xylan synthase | |
| | Hexokinase | D-glucose, D-mannose, D-fructose, sorbitol and D-glucosamine can act as acceptors ITP and dATP can act as donors The liver isoenzyme has sometimes been called glucokinase |
| | Phosphoglucokinase | |
| | Glucose-1,6-bisphosphate synthase | D-glucose 6-phosphate can act as acceptor, forming D-glucose 1,6-bisphosphate |
| | Glucokinase | A group of enzymes found in invertebrates and microorganisms highly specific for glucose |
| | Fructokinase | |
| | Glucose-1-phosphate phosphodismutase | |
| | Protein-N(PI)-phosphohistidine-sugar phosphotransferase | Comprises a group of related enzymes The protein substrate is a phosphocarrier protein of low molecular mass (9.5 Kd) A phosphoenzyme intermediate is formed The enzyme translocates the sugar it phosphorylates into bacteria Aldohexoses and their glycosides and alditols are phosphorylated on O-6; fructose and sorbose on O-1 Glycerol and disaccharides are also substrates |
| | Glucose-1-phosphate adenylyltransferase | |
| | Glucose-1-phosphate cytidylyltransferase | |
| | Glucose-1-phosphate guanylyltransferase | Also acts, more slowly, on D-mannose 1-phosphate |
| | UTP--glucose-1-phosphate uridylyltransferase | |
| | Pectinesterase | |
| | Trehalose-phosphatase | |
| | Sucrose-phosphatase | |
| | Glucose-6-phosphatase | Wide distribution in animal tissues Also catalyses potent transphosphorylations from carbamoyl phosphate, hexose phosphates, pyrophosphate, phosphoenolpyruvate and nucleoside di- and triphosphates, to D-glucose, D-mannose, 3-methyl-D-glucose, or 2-deoxy-D-glucose (cf. EC 2.7.1.62, EC 2.7.1.79, and EC 3.9.1.1) |
| | Alpha-amylase | Acts on starch, glycogen and related polysaccharides and oligosaccharides in a random manner; reducing groups are liberated in the alpha-configuration |
| | Oligo-1,6-glucosidase | Also hydrolyses palatinose The enzyme from intestinal mucosa is a single polypeptide chain also catalysing the reaction of EC 3.2.1.48 |
| | Maltose-6[PRIME]-phosphate glucosidase | Hydrolyses a variety of 6-phospho-D-glucosides, including maltose 6-phosphate, alpha[PRIME]alpha-trehalose 6-phosphate, sucrose 6-phosphate and p-nitrophenyl-alpha-D-glucopyranoside 6-phosphate (as a chromogenic substrate) The enzyme is activated by Fe(II), Mn(II), Co(II) and Ni(II). It is rapidly inactivated in air |
| | Polygalacturonase | |
| | Beta-amylase | Acts on starch, glycogen and related polysaccharides and oligosaccharides producing beta-maltose by an inversion |
| | Alpha-glucosidase | Group of enzymes whose specificity is directed mainly towards the exohydrolysis of 1,4-alpha-glucosidic linkages, and that hydrolyse oligosaccharides rapidly, relative to polysaccharides, which are hydrolysed relatively slowly, or not at all The |

| Pathway Name | Enzyme Description | Enzyme Comments |
|---|---|---|
| | Beta-glucosidase | intestinal enzyme also hydrolyses polysaccharides, catalysing the reactions of EC 3.2.1.3, and, more slowly, hydrolyses 1,6-alpha-D-glucose links Wide specificity for beta-D-glucosides. Some examples also hydrolyse one or more of the following: beta-D-galactosides, alpha-L-arabinosides, beta-D-xylosides, and beta-D-fucosides |
| | Beta-fructofuranosidase | Substrates include sucrose Also catalyses fructotransferase reactions |
| | Alpha,alpha-trehalase | |
| | Glucan 1,4-alpha-glucosidase | Most forms of the enzyme can rapidly hydrolyse 1,6-alpha-D-glucosidic bonds when the next bond in sequence is 1,4, and some preparations of this enzyme hydrolyse 1,6- and 1,3-alpha-D-glucosidic bonds in other polysaccharides This entry covers all such enzymes acting on polysaccharides more rapidly than on oligosaccharides EC 3.2.1.20 from mammalian intestine can catalyse similar reactions |
| | Beta-glucuronidase | |
| | Amylo-1,6-glucosidase | In mammals and yeast this enzyme is linked to a glycosyltransferase similar to EC 2.4.1.25; together these two activities constitute the glycogen debranching system |
| | Xylan 1,4-beta-xylosidase | Also hydrolyses xylobiose Some other exoglycosidase activities have been found associated with this enzyme in sheep liver |
| | Glucan endo-1,3-beta-D-glucosidase | Very limited action on mixed-link (1,3-1,4-)-beta-D-glucans Hydrolyses laminarin, paramylon and pachyman Different from EC 3.2.1.6 |
| | Cellulase | Will also hydrolyse 1,4-linkages in beta-D-glucans also containing 1,3-linkages |
| | Sucrose alpha-glucosidase | This enzyme is isolated from intestinal mucosa as a single polypeptide chain also displaying activity towards isomaltose (oligo-1,6-glucosidase, cf. EC 3.2.1.10) |
| | Cyclomaltodextrinase | Also hydrolyses linear maltodextrin |
| | Glucan 1,3-beta-glucosidase | Acts on oligosaccharides but very slowly on laminaribiose |
| | Levanase | |
| | Galacturan 1,4-alpha-galacturonidase | |
| | Glucan 1,4-beta-glucosidase | Acts on 1,4-beta-D-glucans and related oligosaccharides Cellobiose is hydrolysed, very slowly |
| | Cellulose 1,4-beta-cellobiosidase | |
| | Alpha,alpha-phosphotrehalase | |
| | ADP-sugar diphosphatase | Has a distinct specificity from the UDP-sugar pyrophosphatase (EC 3.6.1.45) |
| | Nucleotide pyrophosphatase | Substrates include NAD(+), NADP(+), FAD, CoA and also ATP and ADP |
| | UDP-glucuronate decarboxylase | |
| | CDP-glucose 4,6-dehydratase | |
| | CDP-abequose epimerase | |
| | UDP-glucuronate 4-epimerase | |
| | Glucose-6-phosphate isomerase | Also catalyses the anomerization of D-glucose 6-phosphate |
| | Phosphoglucomutase | Maximum activity is only obtained in the presence of alpha-D-glucose 1,6-bisphosphate. This bisphosphate is an intermediate in the reaction, being formed by transfer of a phosphate residue from the enzyme to the substrate, but the dissociation of bisphosphate from the |

| Pathway Name | Enzyme Description | Enzyme Comments |
|---|---|---|
| | | enzyme complex is much slower than the overall isomerization Also, more slowly, catalyses the interconversion of 1-phosphate and 6-phosphate isomers of many other alpha-D-hexoses, and the interconversion of alpha-D-ribose 1-phosphate and 5-phosphate |
| Tryptophan metabolism | Beta-phosphoglucomutase Maltose alpha-D-glucosyltransferase Indole-3-lactate dehydrogenase Indole-3-acetaldehyde reductase (NADH) Indole-3-acetaldehyde reductase (NADPH) 3-hydroxyacyl-CoA dehydrogenase | Also oxidizes S-3-hydroxyacyl-N-acylthioethanolamine and S-3-hydroxyacylhydrolipoate Some enzymes act, more slowly, with NADP(+) Broad specificity to acyl chain-length (cf. EC 1.1.1.211) |
| | O-aminophenol oxidase | Isophenoxazine may be formed by a secondary condensation from the initial oxidation product |
| | Catalase | This enzyme can also act as a peroxidase (EC 1.11.1.7) for which several organic substances, especially ethanol, can act as a hydrogen donor A manganese protein containing Mn(III) in the resting state, which also belongs here, is often called pseudocatalase Enzymes from some microorganisms, such as Penicillium simplicissimum, which exhibit both catalase and peroxidase activity, have sometimes been referred to as catalase-peroxidase |
| | 7,8-dihydroxykynurenate 8,8A-dioxygenase Tryptophan 2,3-dioxygenase | Broad specificity towards tryptamine and derivatives including D- and L-tryptophan, 5-hydroxytryptophan and serotonin |
| | Indole 2,3-dioxygenase | The enzyme from jasminum is a flavoprotein containing copper, and forms anthranilate as the final product One enzyme from Tecoma stans is also a flavoprotein containing copper and uses three atoms of oxygen per molecule of indole, to form anthranil (3,4-benzisoxazole) A second enzyme from Tecoma stans, which is not a flavoprotein, uses four atoms of oxygen and forms anthranilate as the final product |
| | 2,3-dihydroxyindole 2,3-dioxygenase Indoleamine-pyrrole 2,3-dioxygenase | Acts on many substituted and unsubstituted indoleamines, including melatonin Involved in the degradation of melatonin |
| | 3-hydroxyanthranilate 3,4-dioxygenase | The product of the reaction spontaneously rearrange to quinolinic acid (quin) |
| | Tryptophan 2-monooxygenase Tryptophan 2[PRIME]-dioxygenase | Acts on a number of indolyl-3-alkane derivatives, oxidizing the 3-side-chain in the 2[PRIME]-position. Best substrates are L-tryptophan and 5-hydroxy-L-tryptophan |

| Pathway Name | Enzyme Description | Enzyme Comments |
|---|---|---|
| | Kynurenine 3-monooxygenase | |
| | Unspecific monooxygenase | Acts on a wide range of substrates including many xenobiotics, steroids, fatty acids, vitamins and prostaglandins Reactions catalysed include hydroxylation, epoxidation, N-oxidation, sulfooxidation, N-, S- and O-dealkylations, desulfation, deamination, and reduction of azo, nitro, and N-oxide groups |
| | Anthranilate 3-monooxygenase | |
| | Tryptophan 5-monooxygenase | Activated by phosphorylation, catalysed by a CA(2+)-activated protein kinase |
| | Kynurenine 7,8-hydroxylase | |
| | Aldehyde dehydrogenase (NAD+) | Wide specificity, including oxidation of D-glucuronolactone to D-glucarate |
| | Aminomuconate-semialdehyde dehydrogenase | Also acts on 2-hydroxymuconate semialdehyde |
| | Aldehyde oxidase | Also oxidizes quinoline and pyridine derivatives May be identical with EC 1.1.3.22 |
| | Indole-3-acetaldehyde oxidase | Also oxidizes indole-3-aldehyde and acetaldehyde, more slowly |
| | Oxoglutarate dehydrogenase (lipoamide) | Component of the multienzyme 2-oxoglutarate dehydrogenase complex |
| | Kynurenate-7,8-dihydrodiol dehydrogenase | |
| | Glutaryl-CoA dehydrogenase | |
| | L-amino acid oxidase | |
| | Amine oxidase (flavin-containing) | Acts on primary amines, and usually also on secondary and tertiary amines |
| | Amine oxidase (copper-containing) | A group of enzymes including those oxidizing primary amines, diamines and histamine One form of EC 1.3.1.15 from rat kidney also catalyses this reaction |
| | Acetylindoxyl oxidase | |
| | Acetylserotonin O-methyltransferase | Some other hydroxyindoles also act as acceptor, more slowly |
| | Indole-3-pyruvate C-methyltransferase | |
| | Amine N-methyltransferase | A wide range of primary, secondary, and tertiary amines can act as acceptors, including tryptamine, aniline, nicotine and a variety of drugs and other xenobiotics |
| | Aralkylamine N-acetyltransferase | Narrow specificity towards aralkylamines, including serotonin Not identical with EC 2.3.1.5 |
| | Acetyl-CoA C-acetyltransferase | |
| | Tryptophan aminotransferase | Also acts on 5-hydroxytryptophan and, to a lesser extent on the phenyl amino acids |
| | Kynurenine--oxoglutarate aminotransferase | Also acts on 3-hydroxykynurenine |
| | Thioglucosidase | Has a wide specificity for thioglycosides |
| | Amidase | |
| | Formamidase | Also acts, more slowly, on acetamide, propanamide and butanamide |
| | Arylformamidase | Also acts on other aromatic formylamines |
| | Nitrilase | Acts on a wide range of aromatic nitriles including (indole-3-yl)-acetonitrile and also on some aliphatic nitriles, and on the corresponding acid amides (cf. EC 4.2.1.84) |
| | Kynureninase | Also acts on 3[PRIME]-hydroxykynurenine and some other (3-arylcarbonyl)-alanines |

| Pathway Name | Enzyme Description | Enzyme Comments |
| --- | --- | --- |
| | Aromatic-L-amino-acid decarboxylase | Also acts on L-tryptophan, 5-hydroxy-L-tryptophan and dihydroxy-L-phenylalanine (DOPA) |
| | Phenylpyruvate decarboxylase | Also acts on indole-3-pyruvate |
| | Aminocarboxymuconate-semialdehyde decarboxylase | The product rearranges non-enzymically to picolinate |
| | Tryptophanase | Also catalyses the synthesis of tryptophan from indole and serine Also catalyses 2,3-elimination and beta-replacement reactions of some indole-substituted tryptophan analogs of L-cysteine, L-serine and other 3-substituted amino acids |
| | Enoyl-CoA hydratase | Acts in the reverse direction With cis-compounds, yields (3R)-3-hydroxyacyl-CoA (cf. EC 4.2.1.74) |
| | Nitrile hydratase | Acts on short-chain aliphatic nitriles, converting them into the corresponding acid amides Does not act on these amides or on aromatic nitriles (cf EC 3.5.5.1) |
| | Tryptophan--tRNA ligase | |
| Tyrosine metabolism | Alcohol dehydrogenase | Acts on primary or secondary alcohols or hemiacetals The animal, but not the yeast, enzyme acts also on cyclic secondary alcohols |
| | (R)-4-hydroxyphenyllactate dehydrogenase | Also acts, more slowly, on (R)-3-phenyllactate, (R)-3-(indole-3-yl)lactate and (R)-lactate |
| | Hydroxyphenylpyruvate reductase | Also acts on 3-(3,4-dihydroxyphenyl)lactate Involved with EC 2.3.1.140 in the biosynthesis of rosmarinic acid |
| | Aryl-alcohol dehydrogenase | A group of enzymes with broad specificity towards primary alcohols with an aromatic or cyclohex-1-ene ring, but with low or no activity towards short-chain aliphatic alcohols |
| | Catechol oxidase | Also acts on a variety of substituted catechols Many of these enzymes also catalyse the reaction listed under EC 1.14.18.1; this is especially true for the classical tyrosinase |
| | Iodide peroxidase | |
| | 3,4-dihydroxyphenylacetate 2,3-dioxygenase | |
| | 4-hydroxyphenylpyruvate dioxygenase | |
| | Stizolobate synthase | The intermediate product undergoes ring closure and oxidation, with NAD(P)(+) as acceptor, to stizolobic acid |
| | Stizolobinate synthase | The intermediate product undergoes ring closure and oxidation, with NAD(P)(+) as acceptor, to stizolobinic acid |
| | Gentisate 1,2-dioxygenase | |
| | Homogentisate 1,2-dioxygenase | |
| | 4-hydroxyphenylacetate 1-monooxygenase | Also acts on 4-hydroxyhydratropate forming 2-methylhomogentisate and on 4-hydroxyphenoxyacetate forming hydroquinone and glycolate |
| | 4-hydroxyphenylacetate 3-monooxygenase | |
| | Tyrosine N-monooxygenase | |
| | Hydroxyphenylacetonitrile 2-monooxygenase | |
| | Tyrosine 3-monooxygenase | Activated by phosphorylation, catalysed by EC 2.7.1.128 |
| | Dopamine-beta-monooxygenase | Stimulated by fumarate |

| Pathway Name | Enzyme Description | Enzyme Comments |
|---|---|---|
| | Monophenol monooxygenase | A group of copper proteins that also catalyse the reaction of EC 1.10.3.1, if only 1,2-benzenediols are available as substrate |
| | Succinate-semialdehyde dehydrogenase (NAD(P)+) | |
| | Aryl-aldehyde dehydrogenase | Oxidizes a number of aromatic aldehydes, but not aliphatic aldehydes |
| | Aldehyde dehydrogenase (NAD+) | Wide specificity, including oxidation of D-glucuronolactone to D-glucarate |
| | 4-carboxy-2-hydroxymuconate-6-semialdehyde dehydrogenase | Does not act on unsubstituted aliphatic or aromatic aldehydes or glucose NAD(+) can replace NADP(+), but with lower affinity |
| | Aldehyde dehydrogenase (NAD(P)+) | |
| | 4-hydroxyphenylacetaldehyde dehydrogenase | With EC 4.2.1.87, brings about the metabolism of octopamine in *Pseudomonas* |
| | Aldehyde oxidase | Also oxidizes quinoline and pyridine derivatives May be identical with EC 1.1.3.22 |
| | L-amino acid oxidase | |
| | Amine oxidase (flavin-containing) | Acts on primary amines, and usually also on secondary and tertiary amines |
| | Amine oxidase (copper-containing) | A group of enzymes including those oxidizing primary amines, diamines and histamine One form of EC 1.3.1.15 from rat kidney also catalyses this reaction |
| | Aralkylamine dehydrogenase | Phenazine methosulfate can act as acceptor Acts on aromatic amines and, more slowly, on some long-chain aliphatic amines, but not on methylamine or ethylamine (cf EC 1.4.99.3) |
| | Phenol O-methyltransferase | Acts on a wide variety of simple alkyl-, methoxy- and halo-phenols |
| | Tyramine N-methyltransferase | Has some activity on phenylethylamine analogs |
| | Phenylethanolamine N-methyltransferase | Acts on various phenylethanolamines; converts noradrenalin into adrenalin |
| | Catechol O-methyltransferase | The mammalian enzymes act more rapidly on catecholamines such as adrenaline or noradrenaline than on catechols |
| | Glutamine N-phenylacetyltransferase | |
| | Rosmarinate synthase | Involved with EC 1.1.1.237 in the biosynthesis of rosmarinic acid |
| | Hydroxymandelonitrile glucosyltransferase | 3,4-dihydroxymandelonitrile can also act as acceptor |
| | Aspartate aminotransferase | Also acts on L-tyrosine, L-phenylalanine and L-tryptophan. This activity can be formed from EC 2.6.1.57 by controlled proteolysis |
| | Dihydroxyphenylalanine aminotransferase | |
| | Tyrosine aminotransferase | L-phenylalanine can act instead of L-tyrosine The mitochondrial enzyme may be identical with EC 2.6.1.1 The three isoenzymic forms are interconverted by EC 3.4.22.4 |
| | Aromatic amino acid transferase | L-methionine can also act as donor, more slowly Oxaloacetate can act as acceptor Controlled proteolysis converts the enzyme to EC 2.6.1.1 |
| | Histidinol-phosphate aminotransferase | |
| | Fumarylacetoacetase | Also acts on other 3,5- and 2,4-dioxo acids |
| | Acylpyruvate hydrolase | Acts on formylpyruvate, 2,4-dioxopentanoate, 2,4-dioxohexanoate and 2,4-dioxoheptanoate |

-continued

| Pathway Name | Enzyme Description | Enzyme Comments |
|---|---|---|
| | Tyrosine decarboxylase | The bacterial enzyme also acts on 3-hydroxytyrosine and, more slowly, on 3-hydroxyphenylalanine |
| | Aromatic-L-amino-acid decarboxylase | Also acts on L-tryptophan, 5-hydroxy-L-tryptophan and dihydroxy-L-phenylalanine (DOPA) |
| | Gentisate decarboxylase | |
| | 5-oxopent-3-ene-1,2,5-tricarboxylate decarboxylase | |
| | Tyrosine phenol-lyase | Also slowly catalyses pyruvate formation from D-tyrosine, S-methyl-L-cysteine, L-cysteine, L-serine and D-serine |
| | (S)-norcoclaurine synthase | The reaction makes a 6-membered ring by forming a bond between C-6 of the 3,4-dihydroxyphenyl group of the dopamine and C-1 of the aldehyde in the imine formed between the substrates The product is the precursor of the benzylisoquinoline alkaloids in plants Will also catalyse the reaction of 4-(2-aminoethyl)benzene-1,2-diol + (3,4-dihydroxyphenyl)acetaldehyde to form (S)-norlaudanosoline, but this alkaloid has not been found to occur in plants |
| | Dihydroxyphenylalanine ammonia-lyase | |
| | Phenylalanine ammonia-lyase | May also act on L-tyrosine |
| | Maleylacetoacetate isomerase | Also acts on maleylpyruvate |
| | Maleylpyruvate isomerase | |
| | Phenylpyruvate tautomerase | Also acts on other arylpyruvates |
| | 5-carboxymethyl-2-hydroxymuconate delta-isomerase | |
| | Tyrosine 2,3-aminomutase | |
| | Phenylacetate--CoA ligase | Also acts, more slowly, on acetate, propanoate and butanoate, but not on hydroxy derivatives of phenylacetate and related compounds |

VII. Promoters as Sentinels

Useful promoters include those that are capable of facilitating preferential transcription, i.e. tissue-specific or developmentally regulated gene expression and being a component of facile systems to evaluate the metabolic/physiological state of a plant cell, tissue or organ. Many such promoters are included in this application. Operably linking a sequence to these promoters that can act as a reporter and inserting the construct into a plant allows detection of the preferential in plantar transcription. For example, the quantitative state of responses to environmental conditions can be detected by using a plant having a construct that contains a stress-inducible promoter linked to and controlling expression of a sequence encoding GFP. The greater the stress promoter is induced, the greater the levels of fluorescence from GFP will be produced and this provides a measure of the level of stress being expressed by the plant and/or the ability of the plant to respond internally to the stress.

More specifically, using this system the activities of any metabolic pathway (catabolic and anabolic), stress-related pathways as on any plant gene repeated activity can be monitored. In addition, assays can be developed using this sentinel system to select for superior genotypes with greater yield characteristics or to select for plants with altered responses to chemical, herbicide, or plant growth regulators or to identify chemical, herbicides or plant growth regulators by their response on such sentinels.

Specifically, a promoter that is regulated in plants in the desired way, is operably linked to a reporter such as GFP, RFP, etc., and the constructs are introduced into the plant of interest. The behavior of the reporter is monitored using technologies typically specific for that reporter. With GFP, RFP, etc., it could typically be by microscopy of whole plants, organs, tissues or cells under excitation by an appropriate wavelength of UV light.

VIII. How to Make Different Embodiments of the Invention

The invention relates to (I) polynucleotides and methods of use thereof, such as
 IA. Probes, Primers and Substrates;
 IB. Methods of Detection and Isolation;
 B.1. Hybridization;
 B.2. Methods of Mapping;
 B.3. Southern Blotting;
 B.4. Isolating cDNA from Related Organisms;
 B.5. Isolating and/or Identifying Orthologous Genes
 IC. Methods of Inhibiting Gene Expression C.1. Antisense
C.2. Ribozyme Constructs;
C.3. Chimeraplasts;
C.4 Co-Suppression;
C.5. Transcriptional Silencing
C.6. Other Methods to Inhibit Gene Expression
ID. Methods of Functional Analysis;
IE. Promoter Sequences and Their Use;
IF. UTRs and/or Intron Sequences and Their Use; and
IG. Coding Sequences and Their Use.

The invention also relates to (II) polypeptides and proteins and methods of use thereof, such
IIA. Native Polypeptides and Proteins
A.1 Antibodies
A.2 In Vitro Applications
IIB. Polypeptide Variants, Fragments and Fusions
B.1 Variants
B.2 Fragments
B.3 Fusions The invention also includes (III) methods of modulating polypeptide production, such as
IIIA. Suppression
A.1 Antisense
A.2 Ribozymes
A.3 Co-suppression
A.4 Insertion of Sequences into the Gene to be Modulated
A.5 Promoter Modulation
A.6 Expression of Genes containing Dominant-Negative Mutations
IIIB. Enhanced Expression
B.1 Insertion of an Exogenous Gene
B.2 Promoter Modulation The invention further concerns (IV) gene constructs and vector construction, such as
IVA. Coding Sequences
IVB. Promoters
IVC. Signal Peptides The invention still further relates to
V. Transformation Techniques
I. Polynucleotides Exemplified SDFs of the invention represent fragments of the genome of corn, wheat, rice, soybean or *Arabidopsis* and/or represent mRNA expressed from that genome. The isolated nucleic acid of the invention also encompasses corresponding fragments of the genome and/or cDNA complement of other organisms as described in detail below.

Polynucleotides of the invention can be isolated from polynucleotide libraries using primers comprising sequences similar to those described, in the attached Reference, Sequences Protein Group, and Protein Group Matrix Tables or complements thereof. See, for example, the methods described in Sambrook et al., supra.

Alternatively, the polynucleotides of the invention can be produced by chemical synthesis. Such synthesis methods are described below.

It is contemplated that the nucleotide sequences presented herein may contain some small percentage of errors. These errors may arise in the normal course of determination of nucleotide sequences. Sequence errors can be corrected by obtaining seeds deposited under the accession numbers cited above, propagating them, isolating genomic DNA or appropriate mRNA from the resulting plants or seeds thereof, amplifying the relevant fragment of the genomic DNA or mRNA using primers having a sequence that flanks the erroneous sequence, and sequencing the amplification product.

I.A. Probes, Primers and Substrates

SDFs of the invention can be applied to substrates for use in array applications such as, but not limited to, assays of global gene expression, for example under varying conditions of development, growth conditions. The arrays can also be used in diagnostic or forensic methods (WO95/35505, U.S. Pat. No. 5,445,943 and U.S. Pat. No. 5,410,270).

Probes and primers of the instant invention will hybridize to a polynucleotide comprising a sequence in or encoded by those in the Reference, Sequence, Protein Group, and Protein Group Matrix tables or fragments or complement thereof. Though many different nucleotide sequences can encode an amino acid sequence, the sequences of the reference and Sequence table or sequences that encode polypeptides or fragments thereof described in Protein Group and Protein Group Matrix tables are generally preferred for encoding polypeptides of the invention. However, the sequence of the probes and/or primers of the instant invention need not be identical to those in the Reference and Sequence tables or the complements thereof. For example, some variation in probe or primer sequence and/or length can allow additional family members to be detected, as well as orthologous genes and more taxonomically distant related sequences. Similarly, probes and/or primers of the invention can include additional nucleotides that serve as a label for detecting the formed duplex or for subsequent cloning purposes.

Probe length will vary depending on the application. For use as primers, probes are 12-40 nucleotides, preferably 18-30 nucleotides long. For use in mapping, probes are preferably 50 to 500 nucleotides, preferably 100-250 nucleotides long. For Southern hybridizations, probes as long as several kilobases can be used as explained below.

The probes and/or primers can be produced by synthetic procedures such as the triester method of Matteucci et al. *J. Am. Chem. Soc.* 103:3185(1981); or according to Urdea et al. *Proc. Natl. Acad.* 80:7461 (1981) or using commercially available automated oligonucleotide synthesizers.

I.B. Methods of Detection and Isolation

The polynucleotides of the invention can be utilized in a number of methods known to those skilled in the art as probes and/or primers to isolate and detect polynucleotides, including, without limitation: Southerns, Northerns, Branched DNA hybridization assays, polymerase chain reaction, and microarray assays, and variations thereof. Specific methods given by way of examples, and discussed below include:
Hybridization
Methods of Mapping
Southern Blotting
Isolating cDNA from Related Organisms
Isolating and/or Identifying Orthologous Genes.

Also, the nucleic acid molecules of the invention can used in other methods, such as high density oligonucleotide hybridizing assays, described, for example, in U.S. Pat. Nos. 6,004,753; 5,945,306; 5,945,287; 5,945,308; 5,919,686; 5,919,661; 5,919,627; 5,874,248; 5,871,973; 5,871,971; and 5,871,930; and PCT Pub. Nos. WO 9946380; WO 9933981; WO 9933870; WO 9931252; WO 9915658; WO 9906572; WO 9858052; WO 9958672; and WO 9810858.

B.1. Hybridization

The isolated SDFs of the Reference and Sequence tables or SDFs encoding polypeptides of the Protein Group and Protein Group Matrix tables or fragments thereof of the present invention can be used as probes and/or primers for detection and/or isolation of related polynucleotide sequences through hybridization. Hybridization of one nucleic acid to another constitutes a physical property that defines the subject SDF of the invention and the identified related sequences. Also, such hybridization imposes structural limitations on the pair. A good general discussion of the factors for determining hybridization conditions is provided by Sambrook et al. ("Molecular Cloning, a Laboratory Manual, 2nd ed., c. 1989 by Cold Spring Harbor Laboratory Press, Cold Spring Harbor, N.Y.; see esp., chapters 11 and 12). Additional considerations and details of the physical chemistry of hybridization are provided by G. H. Keller and M. M. Manak "DNA Probes", $2^{nd}$ Ed. pp. 1-25, c. 1993 by Stockton Press, New York, N.Y.

Depending on the stringency of the conditions under which these probes and/or primers are used, polynucleotides exhibiting a wide range of similarity to those in the Reference and Sequence or encoding polypeptides of the Protein Group and Protein Group Matrix tables or fragments thereof can be detected or isolated. When the practitioner wishes to examine the result of membrane hybridizations under a variety of stringencies, an efficient way to do so is to perform the hybridization under a low stringency condition, then to wash the hybridization membrane under increasingly stringent conditions.

When using SDFs to identify orthologous genes in other species, the practitioner will preferably adjust the amount of target DNA of each species so that, as nearly as is practical, the same number of genome equivalents are present for each species examined. This prevents faint signals from species having large genomes, and thus small numbers of genome equivalents per mass of DNA, from erroneously being interpreted as absence of the corresponding gene in the genome.

The probes and/or primers of the instant invention can also be used to detect or isolate nucleotides that are "identical" to the probes or primers. Two nucleic acid sequences or polypeptides are said to be "identical" if the sequence of nucleotides or amino acid residues, respectively, in the two sequences is the same when aligned for maximum correspondence as described below.

Isolated polynucleotides within the scope of the invention also include allelic variants of the specific sequences presented in the Reference, Sequence, Protein Group, and Protein Group Matrix tables. The probes and/or primers of the invention can also be used to detect and/or isolate polynucleotides exhibiting at least 80% sequence identity with the sequences of the reference, Sequence or encoding polypeptides of the Protein Group and Protein Group Matrix tables or fragments thereof.

With respect to nucleotide sequences, degeneracy of the genetic code provides the possibility to substitute at least one base of the base sequence of a gene with a different base without causing the amino acid sequence of the polypeptide produced from the gene to be changed. Hence, the DNA of the present invention may also have any base sequence that has been changed from a sequence in the Reference, Sequence, Protein Group, and Protein Group Matrix tables by substitution in accordance with degeneracy of genetic code. References describing codon usage include: Carels et al., *J. Mol. Evol.* 46: 45 (1998) and Fennoy et al., *Nucl. Acids Res.* 21(23): 5294 (1993).

B.2. Mapping

The isolated SDF DNA of the invention can be used to create various types of genetic and physical maps of the genome of corn, *Arabidopsis*, soybean, rice, wheat, or other plants. Some SDFs may be absolutely associated with particular phenotypic traits, allowing construction of gross genetic maps. While not all SDFs will immediately be associated with a phenotype, all SDFs can be used as probes for identifying polymorphisms associated with phenotypes of interest. Briefly, one method of mapping involves total DNA isolation from individuals. It is subsequently cleaved with one or more restriction enzymes, separated according to mass, transferred to a solid support, hybridized with SDF DNA and the pattern of fragments compared. Polymorphisms associated with a particular SDF are visualized as differences in the size of fragments produced between individual DNA samples after digestion with a particular restriction enzyme and hybridization with the SDF. After identification of polymorphic SDF sequences, linkage studies can be conducted. By using the individuals showing polymorphisms as parents in crossing programs, F2 progeny recombinants or recombinant inbreds, for example, are then analyzed. The order of DNA polymorphisms along the chromosomes can be determined based on the frequency with which they are inherited together versus independently. The closer two polymorphisms are together in a chromosome the higher the probability that they are inherited together. Integration of the relative positions of all the polymorphisms and associated marker SDFs can produce a genetic map of the species, where the distances between markers reflect the recombination frequencies in that chromosome segment.

The use of recombinant inbred lines for such genetic mapping is described for *Arabidopsis* by Alonso-Blanco et al. (*Methods in Molecular Biology*, vol. 82, "*Arabidopsis Protocols*", pp. 137-146, J. M. Martinez-Zapater and J. Salinas, eds., c. 1998 by Humana Press, Totowa, N.J.) and for corn by Burr ("Mapping Genes with Recombinant Inbreds", pp. 249-254. In Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; Gardiner, J. et al., (1993) *Genetics* 134: 917). This procedure, however, is not limited to plants and can be used for other organisms (such as yeast) or for individual cells.

The SDFs of the present invention can also be used for simple sequence repeat (SSR) mapping. Rice SSR mapping is described by Morgante et al. (*The Plant Journal* (1993) 3: 165), Panaud et al. (*Genome* (1995) 38: 1170); Senior et al. (*Crop Science* (1996) 36: 1676), Taramino et al. (*Genome* (1996) 39: 277) and Ahn et al. (*Molecular and General Genetics* (1993) 241: 483-90). SSR mapping can be achieved using various methods. In one instance, polymorphisms are identified when sequence specific probes contained within an SDF flanking an SSR are made and used in polymerase chain reaction (PCR) assays with template DNA from two or more individuals of interest. Here, a change in the number of tandem repeats between the SSR-flanking sequences produces differently sized fragments (U.S. Pat. No. 5,766,847). Alternatively, polymorphisms can be identified by using the PCR fragment produced from the SSR-flanking sequence specific primer reaction as a probe against Southern blots representing different individuals (U. H. Refseth et al., (1997) *Electrophoresis* 18: 1519).

Genetic and physical maps of crop species have many uses. For example, these maps can be used to devise positional cloning strategies for isolating novel genes from the mapped crop species. In addition, because the genomes of closely related species are largely syntenic (that is, they display the same ordering of genes within the genome), these maps can be used to isolate novel alleles from relatives of crop species by positional cloning strategies.

The various types of maps discussed above can be used with the SDFs of the invention to identify Quantitative Trait Loci (QTLs). Many important crop traits, such as the solids content of tomatoes, are quantitative traits and result from the combined interactions of several genes. These genes reside at different loci in the genome, oftentimes on different chromosomes, and generally exhibit multiple alleles at each locus.

The SDFs of the invention can be used to identify QTLs and isolate specific alleles as described by de Vicente and Tanksley (*Genetics* 134:585 (1993)). In addition to isolating QTL alleles in present crop species, the SDFs of the invention can also be used to isolate alleles from the corresponding QTL of wild relatives. Transgenic plants having various combinations of QTL alleles can then be created and the effects of the combinations measured. Once a desired allele combination has been identified, crop improvement can be accomplished either through biotechnological means or by directed conventional breeding programs (for review see Tanksley and McCouch, *Science* 277:1063 (1997)).

In another embodiment, the SDFs can be used to help create physical maps of the genome of corn, *Arabidopsis* and related species. Where SDFs have been ordered on a genetic map, as described above, they can be used as probes to discover which clones in large libraries of plant DNA fragments in YACs, BACs, etc. contain the same SDF or similar sequences, thereby facilitating the assignment of the large DNA fragments to chromosomal positions. Subsequently, the large BACs, YACs, etc. can be ordered unambiguously by more detailed studies of their sequence composition (e.g. Marra et al. (1997) Genomic Research 7:1072-1084) and by using their end or other sequences to find the identical sequences in other cloned DNA fragments. The overlapping of DNA sequences in this way allows large contigs of plant sequences to be built that, when sufficiently extended, provide a complete physical map of a chromosome. Sometimes the SDFs themselves will provide the means of joining cloned sequences into a contig.

The patent publication WO95/35505 and U.S. Pat. Nos. 5,445,943 and 5,410,270 describe scanning multiple alleles of a plurality of loci using hybridization to arrays of oligonucleotides. These techniques are useful for each of the types of mapping discussed above.

Following the procedures described above and using a plurality of the SDFs of the present invention, any individual can be genotyped. These individual genotypes can be used for the identification of particular cultivars, varieties, lines, ecotypes and genetically modified plants or can serve as tools for subsequent genetic studies involving multiple phenotypic traits.

B.3 Southern Blot Hybridization

The sequences from Reference and Sequence and those encoding polypeptides of Protein Group and Protein Group Matrix tables or fragments thereof can be used as probes for various hybridization techniques. These techniques are useful for detecting target polynucleotides in a sample or for determining whether transgenic plants, seeds or host cells harbor a gene or sequence of interest and thus might be expected to exhibit a particular trait or phenotype.

In addition, the SDFs from the invention can be used to isolate additional members of gene families from the same or different species and/or orthologous genes from the same or different species. This is accomplished by hybridizing an SDF to, for example, a Southern blot containing the appropriate genomic DNA or cDNA. Given the resulting hybridization data, one of ordinary skill in the art could distinguish and isolate the correct DNA fragments by size, restriction sites, sequence and stated hybridization conditions from a gel or from a library.

Identification and isolation of orthologous genes from closely related species and alleles within a species is particularly desirable because of their potential for crop improvement. Many important crop traits, such as the solid content of tomatoes, result from the combined interactions of the products of several genes residing at different loci in the genome. Generally, alleles at each of these loci can make quantitative differences to the trait. By identifying and isolating numerous alleles for each locus from within or different species, transgenic plants with various combinations of alleles can be created and the effects of the combinations measured. Once a more favorable allele combination has been identified, crop improvement can be accomplished either through biotechnological means or by directed conventional breeding programs (Tanksley et al. *Science* 277:1063(1997)).

The results from hybridizations of the SDFs of the invention to, for example, Southern blots containing DNA from another species can also be used to generate restriction fragment maps for the corresponding genomic regions. These maps provide additional information about the relative positions of restriction sites within fragments, further distinguishing mapped DNA from the remainder of the genome.

Physical maps can be made by digesting genomic DNA with different combinations of restriction enzymes.

Probes for Southern blotting to distinguish individual restriction fragments can range in size from 15 to 20 nucleotides to several thousand nucleotides. More preferably, the probe is 100 to 1,000 nucleotides long for identifying members of a gene family when it is found that repetitive sequences would complicate the hybridization. For identifying an entire corresponding gene in another species, the probe is more preferably the length of the gene, typically 2,000 to 10,000 nucleotides, but probes 50-1,000 nucleotides long might be used. Some genes, however, might require probes up to 1,500 nucleotides long or overlapping probes constituting the full-length sequence to span their lengths.

Also, while it is preferred that the probe be homogeneous with respect to its sequence, it is not necessary. For example, as described below, a probe representing members of a gene family having diverse sequences can be generated using PCR to amplify genomic DNA or RNA templates using primers derived from SDFs that include sequences that define the gene family.

For identifying corresponding genes in another species, the next most preferable probe is a cDNA spanning the entire coding sequence, which allows all of the mRNA-coding fragment of the gene to be identified. Probes for Southern blotting can easily be generated from SDFs by making primers having the sequence at the ends of the SDF and using corn or *Arabidopsis* genomic DNA as a template. In instances where the SDF includes sequence conserved among species, primers including the conserved sequence can be used for PCR with genomic DNA from a species of interest to obtain a probe.

Similarly, if the SDF includes a domain of interest, that fragment of the SDF can be used to make primers and, with appropriate template DNA, used to make a probe to identify genes containing the domain. Alternatively, the PCR products can be resolved, for example by gel electrophoresis, and cloned and/or sequenced. Using Southern hybridization, the variants of the domain among members of a gene family, both within and across species, can be examined.

B.4.1 Isolating DNA from Related Organisms

The SDFs of the invention can be used to isolate the corresponding DNA from other organisms. Either cDNA or genomic DNA can be isolated. For isolating genomic DNA, a lambda, cosmid, BAC or YAC, or other large insert genomic library from the plant of interest can be constructed using standard molecular biology techniques as described in detail by Sambrook et al. 1989 (Molecular Cloning: A Laboratory Manual, $2^{nd}$ ed. Cold Spring Harbor Laboratory Press, New York) and by Ausubel et al. 1992 (Current Protocols in Molecular Biology, Greene Publishing, New York).

To screen a phage library, for example, recombinant lambda clones are plated out on appropriate bacterial medium using an appropriate E. coli host strain. The resulting plaques are lifted from the plates using nylon or nitrocellulose filters. The plaque lifts are processed through denaturation, neutralization, and washing treatments following the standard protocols outlined by Ausubel et al. (1992). The plaque lifts are hybridized to either radioactively labeled or non-radioactively labeled SDF DNA at room temperature for about 16 hours, usually in the presence of 50% formamide and 5×SSC (sodium chloride and sodium citrate) buffer and blocking reagents. The plaque lifts are then washed at 42° C. with 1% Sodium Dodecyl Sulfate (SDS) and at a particular concentration of SSC. The SSC concentration used is dependent upon the stringency at which hybridization occurred in the initial Southern blot analysis performed. For example, if a fragment hybridized under medium stringency (e.g., Tm–20° C.), then this condition is maintained or preferably adjusted to a less stringent condition (e.g., Tm–30° C.) to wash the plaque lifts. Positive clones show detectable hybridization e.g., by exposure to X-ray films or chromogen formation. The positive clones are then subsequently isolated for purification using the same general protocol outlined above. Once the clone is purified, restriction analysis can be conducted to narrow the region corresponding to the gene of interest. The restriction analysis and succeeding subcloning steps can be done using procedures described by, for example Sambrook et al. (1989) cited above.

The procedures outlined for the lambda library are essentially similar to those used for YAC library screening, except that the YAC clones are harbored in bacterial colonies. The YAC clones are plated out at reasonable density on nitrocellulose or nylon filters supported by appropriate bacterial medium in petri plates. Following the growth of the bacterial clones, the filters are processed through the denaturation, neutralization, and washing steps following the procedures of Ausubel et al. 1992. The same hybridization procedures for lambda library screening are followed.

To isolate cDNA, similar procedures using appropriately modified vectors are employed. For instance, the library can be constructed in a lambda vector appropriate for cloning cDNA such as λgt11. Alternatively, the cDNA library can be made in a plasmid vector. cDNA for cloning can be prepared by any of the methods known in the art, but is preferably prepared as described above. Preferably, a cDNA library will include a high proportion of full-length clones.

B. 5. Isolating and/or Identifying Orthologous Genes

Probes and primers of the invention can be used to identify and/or isolate polynucleotides related to those in the Reference, Sequence, Protein Group, and Protein Group Matrix tables. Related polynucleotides are those that are native to other plant organisms and exhibit either similar sequence or encode polypeptides with similar biological activity. One specific example is an orthologous gene. Orthologous genes have the same functional activity. As such, orthologous genes may be distinguished from homologous genes. The percentage of identity is a function of evolutionary separation and, in closely related species, the percentage of identity can be 98 to 100%. The amino acid sequence of a protein encoded by an orthologous gene can be less than 75% identical, but tends to be at least 75% or at least 80% identical, more preferably at least 90%, most preferably at least 95% identical to the amino acid sequence of the reference protein.

To find orthologous genes, the probes are hybridized to nucleic acids from a species of interest under low stringency conditions, preferably one where sequences containing as much as 40-45% mismatches will be able to hybridize. This condition is established by $T_m$–40° C. to Tm–48° C. (see below). Blots are then washed under conditions of increasing stringency. It is preferable that the wash stringency be such that sequences that are 85 to 100% identical will hybridize. More preferably, sequences 90 to 100% identical will hybridize and most preferably only sequences greater than 95% identical will hybridize. One of ordinary skill in the art will recognize that, due to degeneracy in the genetic code, amino acid sequences that are identical can be encoded by DNA sequences as little as 67% identical or less. Thus, it is preferable, for example, to make an overlapping series of shorter probes, on the order of 24 to 45 nucleotides, and individually hybridize them to the same arrayed library to avoid the problem of degeneracy introducing large numbers of mismatches.

As evolutionary divergence increases, genome sequences also tend to diverge. Thus, one of skill will recognize that searches for orthologous genes between more divergent species will require the use of lower stringency conditions compared to searches between closely related species. Also, degeneracy of the genetic code is more of a problem for searches in the genome of a species more distant evolutionarily from the species that is the source of the SDF probe sequences.

Therefore the method described in Bouckaert et al., U.S. Ser. No. 60/121,700, filed Feb. 25, 1999, hereby incorporated in its entirety by reference, can be applied to the SDFs of the present invention to isolate related genes from plant species which do not hybridize to the corn Arabidopsis, soybean, rice, wheat, and other plant sequences of the reference, Sequence, Protein Group, and Protein Group Matrix tables.

Identification of the relationship of nucleotide or amino acid sequences among plant species can be done by comparing the nucleotide or amino acid sequences of SDFs of the present application with nucleotide or amino acid sequences of other SDFs such as those present in applications listed in the table below:

The SDFs of the invention can also be used as probes to search for genes that are related to the SDF within a species. Such related genes are typically considered to be members of a gene family. In such a case, the sequence similarity will often be concentrated into one or a few fragments of the sequence. The fragments of similar sequence that define the gene family typically encode a fragment of a protein or RNA that has an enzymatic or structural function. The percentage of identity in the amino acid sequence of the domain that defines the gene family is preferably at least 70%, more preferably 80 to 95%, most preferably 85 to 99%. To search for members of a gene family within a species, a low stringency hybridization is usually performed, but this will depend upon the size, distribution and degree of sequence divergence of domains that define the gene family. SDFs encompassing regulatory regions can be used to identify coordinately expressed genes by using the regulatory region sequence of the SDF as a probe.

In the instances where the SDFs are identified as being expressed from genes that confer a particular phenotype, then the SDFs can also be used as probes to assay plants of different species for those phenotypes.

I.C. Methods to Inhibit Gene Expression

The nucleic acid molecules of the present invention can be used to inhibit gene transcription and/or translation. Example of such methods include, without limitation:

Antisense Constructs;
Ribozyme Constructs;
Chimeraplast Constructs;

Co-Suppression;
Transcriptional Silencing; and
Other Methods of Gene Expression.

C.1 Antisense

In some instances it is desirable to suppress expression of an endogenous or exogenous gene. A well-known instance is the FLAVOR-SAVOR™ tomato, in which the gene encoding ACC synthase is inactivated by an antisense approach, thus delaying softening of the fruit after ripening. See for example, U.S. Pat. No. 5,859,330; U.S. Pat. No. 5,723,766; Oeller, et al, *Science*, 254:437-439(1991); and Hamilton et al, *Nature*, 346:284-287 (1990). Also, timing of flowering can be controlled by suppression of the FLOWERING LOCUS C (FLC); high levels of this transcript are associated with late flowering, while absence of FLC is associated with early flowering (S. D. Michaels et al., *Plant Cell* 11:949 (1999). Also, the transition of apical meristem from production of leaves with associated shoots to flowering is regulated by TERMINAL FLOWER1, APETALA1 and LEAFY. Thus, when it is desired to induce a transition from shoot production to flowering, it is desirable to suppress TFL1 expression (S. J. Liljegren, *Plant Cell* 11:1007 (1999)). As another instance, arrested ovule development and female sterility result from suppression of the ethylene forming enzyme but can be reversed by application of ethylene (D. De Martinis et al., *Plant Cell* 11:1061 (1999)). The ability to manipulate female fertility of plants is useful in increasing fruit production and creating hybrids.

In the case of polynucleotides used to inhibit expression of an endogenous gene, the introduced sequence need not be perfectly identical to a sequence of the target endogenous gene. The introduced polynucleotide sequence will typically be at least substantially identical to the target endogenous sequence.

Some polynucleotide SDFs in the Reference, Sequence, Protein Group, and Protein Group Matrix tables represent sequences that are expressed in corn, wheat, rice, soybean *Arabidopsis* and/or other plants. Thus the invention includes using these sequences to generate antisense constructs to inhibit translation and/or degradation of transcripts of said SDFs, typically in a plant cell.

To accomplish this, a polynucleotide segment from the desired gene that can hybridize to the mRNA expressed from the desired gene (the "antisense segment") is operably linked to a promoter such that the antisense strand of RNA will be transcribed when the construct is present in a host cell. A regulated promoter can be used in the construct to control transcription of the antisense segment so that transcription occurs only under desired circumstances.

The antisense segment to be introduced generally will be substantially identical to at least a fragment of the endogenous gene or genes to be repressed. The sequence, however, need not be perfectly identical to inhibit expression. Further, the antisense product may hybridize to the untranslated region instead of or in addition to the coding sequence of the gene. The vectors of the present invention can be designed such that the inhibitory effect applies to other proteins within a family of genes exhibiting homology or substantial homology to the target gene.

For antisense suppression, the introduced antisense segment sequence also need not be full length relative to either the primary transcription product or the fully processed mRNA. Generally, a higher percentage of sequence identity can be used to compensate for the use of a shorter sequence. Furthermore, the introduced sequence need not have the same intron or exon pattern, and homology of non-coding segments may be equally effective. Normally, a sequence of between about 30 or 40 nucleotides and the full length of the transcript can be used, though a sequence of at least about 100 nucleotides is preferred, a sequence of at least about 200 nucleotides is more preferred, and a sequence of at least about 500 nucleotides is especially preferred.

C.2. Ribozymes

It is also contemplated that gene constructs representing ribozymes and based on the SDFs in the Reference and Sequence tables or those encoding polypeptides of the Protein Group and Protein Group Matrix tables and fragment thereof are an object of the invention. Ribozymes can also be used to inhibit expression of genes by suppressing the translation of the mRNA into a polypeptide. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs, which are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus, *solanum nodiflorum* mottle virus and subterranean clover mottle virus. The design and use of target RNA-specific ribozymes is described in Haseloff et al. *Nature*, 334:585 (1988).

Like the antisense constructs above, the ribozyme sequence fragment necessary for pairing need not be identical to the target nucleotides to be cleaved, nor identical to the sequences in the Reference and Sequence tables or those encoding polypeptide of the Protein Group and Protein Group Matrix tables or fragments thereof. Ribozymes may be constructed by combining the ribozyme sequence and some fragment of the target gene which would allow recognition of the target gene mRNA by the resulting ribozyme molecule. Generally, the sequence in the ribozyme capable of binding to the target sequence exhibits a percentage of sequence identity with at least 80%, preferably with at least 85%, more preferably with at least 90% and most preferably with at least 95%, even more preferably, with at least 96%, 97%, 98% or 99% sequence identity to some fragment of a sequence in the Reference, Sequence, Protein Group, and Protein Group Matrix tables or the complement thereof. The ribozyme can be equally effective in inhibiting mRNA translation by cleaving either in the untranslated or coding regions. Generally, a higher percentage of sequence identity can be used to compensate for the use of a shorter sequence. Furthermore, the introduced sequence need not have the same intron or exon pattern, and homology of non-coding segments may be equally effective.

C.3. Chimeraplasts

The SDFs of the invention, such as those described by Reference, Sequence, Protein Group, and Protein Group Matrix tables, can also be used to construct chimeraplasts that can be introduced into a cell to produce at least one specific nucleotide change in a sequence corresponding to the SDF of the invention. A chimeraplast is an oligonucleotide comprising DNA and/or RNA that specifically hybridizes to a target region in a manner which creates a mismatched base-pair. This mismatched base-pair signals the cell's repair enzyme machinery which acts on the mismatched region resulting in the replacement, insertion or deletion of designated nucleotide(s). The altered sequence is then expressed by the cell's normal cellular mechanisms. Chimeraplasts can be designed to repair mutant genes, modify genes, introduce site-specific mutations, and/or act to interrupt or alter normal gene function (U.S. Pat. Nos. 6,010,907 and 6,004,804; and PCT Pub. No. WO99/58723 and WO99/07865).

C.4. Sense Suppression

The SDFs of the reference, Sequence, Protein Group, and Protein Group Matrix tables of the present invention are also useful to modulate gene expression by sense suppression. Sense suppression represents another method of gene suppression by introducing at least one exogenous copy or fragment of the endogenous sequence to be suppressed.

Introduction of expression cassettes in which a nucleic acid is configured in the sense orientation with respect to the promoter into the chromosome of a plant or by a self-replicating virus has been shown to be an effective means by which to induce degradation of mRNAs of target genes. For an example of the use of this method to modulate expression of endogenous genes see, Napoli et al., *The Plant Cell* 2:279 (1990), and U.S. Pat. Nos. 5,034,323, 5,231,020, and 5,283,184. Inhibition of expression may require some transcription of the introduced sequence.

For sense suppression, the introduced sequence generally will be substantially identical to the endogenous sequence intended to be inactivated. The minimal percentage of sequence identity will typically be greater than about 65%, but a higher percentage of sequence identity might exert a more effective reduction in the level of normal gene products. Sequence identity of more than about 80% is preferred, though about 95% to absolute identity would be most preferred. As with antisense regulation, the effect would likely apply to any other proteins within a similar family of genes exhibiting homology or substantial homology to the suppressing sequence.

C.5. Transcriptional Silencing

The nucleic acid sequences of the invention, including the SDFs of the reference, Sequence, Protein Group, and Protein Group Matrix tables, and fragments thereof, contain sequences that can be inserted into the genome of an organism resulting in transcriptional silencing. Such regulatory sequences need not be operatively linked to coding sequences to modulate transcription of a gene. Specifically, a promoter sequence without any other element of a gene can be introduced into a genome to transcriptionally silence an endogenous gene (see, for example, Vaucheret, H et al. (1998) The Plant Journal 16: 651-659). As another example, triple helices can be formed using oligonucleotides based on sequences from Reference, Sequence, Protein Group, and Protein Group Matrix tables, fragments thereof, and substantially similar sequence thereto. The oligonucleotide can be delivered to the host cell and can bind to the promoter in the genome to form a triple helix and prevent transcription. An oligonucleotide of interest is one that can bind to the promoter and block binding of a transcription factor to the promoter. In such a case, the oligonucleotide can be complementary to the sequences of the promoter that interact with transcription binding factors.

C.6. Other Methods to Inhibit Gene Expression

Yet another means of suppressing gene expression is to insert a polynucleotide into the gene of interest to disrupt transcription or translation of the gene.

Low frequency homologous recombination can be used to target a polynucleotide insert to a gene by flanking the polynucleotide insert with sequences that are substantially similar to the gene to be disrupted. Sequences from Reference, Sequence, Protein Group, and Protein Group Matrix tables, fragments thereof, and substantially similar sequence thereto can be used for homologous recombination.

In addition, random insertion of polynucleotides into a host cell genome can also be used to disrupt the gene of interest. Azpiroz-Leehan et al., *Trends in Genetics* 13:152 (1997). In this method, screening for clones from a library containing random insertions is preferred to identifying those that have polynucleotides inserted into the gene of interest. Such screening can be performed using probes and/or primers described above based on sequences from Reference, Sequence, Protein Group, and Protein Group Matrix tables, fragments thereof, and substantially similar sequence thereto. The screening can also be performed by selecting clones or $R_1$ plants having a desired phenotype.

I.D. Methods of Functional Analysis

The constructs described in the methods under I.C. above can be used to determine the function of the polypeptide encoded by the gene that is targeted by the constructs.

Down-regulating the transcription and translation of the targeted gene in the host cell or organisms, such as a plant, may produce phenotypic changes as compared to a wild-type cell or organism. In addition, in vitro assays can be used to determine if any biological activity, such as calcium flux, DNA transcription, nucleotide incorporation, etc., are being modulated by the down-regulation of the targeted gene.

Coordinated regulation of sets of genes, e.g., those contributing to a desired polygenic trait, is sometimes necessary to obtain a desired phenotype. SDFs of the invention representing transcription activation and DNA binding domains can be assembled into hybrid transcriptional activators. These hybrid transcriptional activators can be used with their corresponding DNA elements (i.e., those bound by the DNA-binding SDFs) to effect coordinated expression of desired genes (J. J. Schwarz et al., *Mol. Cell. Biol.* 12:266 (1992), A. Martinez et al., *Mol. Gen. Genet.* 261:546 (1999)).

The SDFs of the invention can also be used in the two-hybrid genetic systems to identify networks of protein-protein interactions (L. McAlister-Henn et al., *Methods* 19:330 (1999), J.C. Hu et al., *Methods* 20:80 (2000), M. Golovkin et al., *J. Biol. Chem.* 274:36428 (1999), K. Ichimura et al., *Biochem. Biophys. Res. Comm.* 253:532 (1998)). The SDFs of the invention can also be used in various expression display methods to identify important protein-DNA interactions (e.g. B. Luo et al., *J. Mol. Biol.* 266:479 (1997)).

I.E. Promoters

The SDFs of the invention are also useful as structural or regulatory sequences in a construct for modulating the expression of the corresponding gene in a plant or other organism, e.g. a symbiotic bacterium. For example, promoter sequences associated to SDFs of the reference, Sequence, Protein Group, and Protein Group Matrix tables of the present invention can be useful in directing expression of coding sequences either as constitutive promoters or to direct expression in particular cell types, tissues, or organs or in response to environmental stimuli.

With respect to the SDFs of the present invention a promoter is likely to be a relatively small portion of a genomic DNA (gDNA) sequence located in the first 2000 nucleotides upstream from an initial exon identified in a gDNA sequence or initial "ATG" or methionine codon or translational start site in a corresponding cDNA sequence. Such promoters are more likely to be found in the first 1000 nucleotides upstream of an initial ATG or methionine codon or translational start site of a cDNA sequence corresponding to a gDNA sequence. In particular, the promoter is usually located upstream of the transcription start site. The fragments of a particular gDNA sequence that function as elements of a promoter in a plant cell will preferably be found to hybridize to gDNA sequences presented and described in the Reference table at medium or high stringency, relevant to the length of the probe and its base composition.

Promoters are generally modular in nature. Promoters can consist of a basal promoter that functions as a site for assembly of a transcription complex comprising an RNA polymerase, for example RNA polymerase II. A typical transcription complex will include additional factors such as $TF_{II}B$, $TF_{II}D$, and $TF_{II}E$. Of these, $TF_{II}D$ appears to be the only one to bind DNA directly. The promoter might also contain one or more enhancers and/or suppressors that function as binding sites for additional transcription factors that have the function of modulating the level of transcription with respect to tissue specificity and of transcriptional responses to particular environmental or nutritional factors, and the like.

Short DNA sequences representing binding sites for proteins can be separated from each other by intervening sequences of varying length. For example, within a particular functional module, protein binding sites may be constituted by regions of 5 to 60, preferably 10 to 30, more preferably 10 to 20 nucleotides. Within such binding sites, there are typically 2 to 6 nucleotides that specifically contact amino acids of the nucleic acid binding protein. The protein binding sites are usually separated from each other by 10 to several hundred nucleotides, typically by 15 to 150 nucleotides, often by 20 to 50 nucleotides. DNA binding sites in promoter elements often display dyad symmetry in their sequence. Often elements binding several different proteins, and/or a plurality of sites that bind the same protein, will be combined in a region of 50 to 1,000 basepairs.

Elements that have transcription regulatory function can be isolated from their corresponding endogenous gene, or the desired sequence can be synthesized, and recombined in constructs to direct expression of a coding region of a gene in a desired tissue-specific, temporal-specific or other desired manner of inducibility or suppression. When hybridizations are performed to identify or isolate elements of a promoter by hybridization to the long sequences presented in the Reference tables, conditions are adjusted to account for the above-described nature of promoters. For example short probes, constituting the element sought, are preferably used under low temperature and/or high salt conditions. When long probes, which might include several promoter elements are used, low to medium stringency conditions are preferred when hybridizing to promoters across species.

If a nucleotide sequence of an SDF, or part of the SDF, functions as a promoter or fragment of a promoter, then nucleotide substitutions, insertions or deletions that do not substantially affect the binding of relevant DNA binding proteins would be considered equivalent to the exemplified nucleotide sequence. It is envisioned that there are instances where it is desirable to decrease the binding of relevant DNA binding proteins to silence or down-regulate a promoter, or conversely to increase the binding of relevant DNA binding proteins to enhance or up-regulate a promoter and vice versa. In such instances, polynucleotides representing changes to the nucleotide sequence of the DNA-protein contact region by insertion of additional nucleotides, changes to identity of relevant nucleotides, including use of chemically-modified bases, or deletion of one or more nucleotides are considered encompassed by the present invention. In addition, fragments of the promoter sequences described by Reference tables and variants thereof can be fused with other promoters or fragments to facilitate transcription and/or transcription in specific type of cells or under specific conditions.

Promoter function can be assayed by methods known in the art, preferably by measuring activity of a reporter gene operatively linked to the sequence being tested for promoter function. Examples of reporter genes include those encoding luciferase, green fluorescent protein, GUS, neo, cat and bar.

I.F. UTRs and Junctions

Polynucleotides comprising untranslated (UTR) sequences and intron/exon junctions are also within the scope of the invention. UTR sequences include introns and 5' or 3' untranslated regions (5' UTRs or 3' UTRs). Fragments of the sequences shown in the Reference and Sequence tables can comprise UTRs and intron/exon junctions.

These fragments of SDFs, especially UTRs, can have regulatory functions related to, for example, translation rate and mRNA stability. Thus, these fragments of SDFs can be isolated for use as elements of gene constructs for regulated production of polynucleotides encoding desired polypeptides.

Introns of genomic DNA segments might also have regulatory functions. Sometimes regulatory elements, especially transcription enhancer or suppressor elements, are found within introns. Also, elements related to stability of heteronuclear RNA and efficiency of splicing and of transport to the cytoplasm for translation can be found in intron elements. Thus, these segments can also find use as elements of expression vectors intended for use to transform plants.

Just as with promoters UTR sequences and intron/exon junctions can vary from those shown in the Reference and Sequence tables. Such changes from those sequences preferably will not affect the regulatory activity of the UTRs or intron/exon junction sequences on expression, transcription, or translation unless selected to do so. However, in some instances, down- or up-regulation of such activity may be desired to modulate traits or phenotypic or in vitro activity.

I.G. Coding Sequences

Isolated polynucleotides of the invention can include coding sequences that encode polypeptides comprising an amino acid sequence encoded by sequences described in the Reference and Sequence tables or an amino acid sequence presented in the Reference, Sequence, Protein Group, and Protein Group Matrix tables.

A nucleotide sequence encodes a polypeptide if a cell (or a cell free in vitro system) expressing that nucleotide sequence produces a polypeptide having the recited amino acid sequence when the nucleotide sequence is transcribed and the primary transcript is subsequently processed and translated by a host cell (or a cell free in vitro system) harboring the nucleic acid. Thus, an isolated nucleic acid that encodes a particular amino acid sequence can be a genomic sequence comprising exons and introns or a cDNA sequence that represents the product of splicing thereof. An isolated nucleic acid encoding an amino acid sequence also encompasses heteronuclear RNA, which contains sequences that are spliced out during expression, and mRNA, which lacks those sequences.

Coding sequences can be constructed using chemical synthesis techniques or by isolating coding sequences or by modifying such synthesized or isolated coding sequences as described above.

In addition to coding sequences encoding the polypeptide sequences of the reference, Sequence, Protein Group, and Protein Group Matrix tables, which are native to corn, *Arabidopsis*, soybean, rice, wheat, and other plants, the isolated polynucleotides can be polynucleotides that encode variants, fragments, and fusions of those native proteins. Such polypeptides are described below in part II.

In variant polynucleotides generally, the number of substitutions, deletions or insertions is preferably less than 20%, more preferably less than 15%; even more preferably less than 10%, 5%, 3% or 1% of the number of nucleotides comprising a particularly exemplified sequence. It is generally expected that non-degenerate nucleotide sequence changes that result in 1 to 10, more preferably 1 to 5 and most preferably 1 to 3 amino acid insertions, deletions or substitutions will not greatly affect the function of an encoded polypeptide. The most preferred embodiments are those wherein 1 to 20, preferably 1 to 10, most preferably 1 to 5 nucleotides are added to, or deleted from and/or substituted in the sequences specifically disclosed in the Reference and Sequence tables or polynucleotides that encode polypeptides of the Protein Group, and Protein Group Matrix tables or fragments thereof.

Insertions or deletions in polynucleotides intended to be used for encoding a polypeptide preferably preserve the reading frame. This consideration is not so important in instances when the polynucleotide is intended to be used as a hybridization probe.

II. Polypeptides and Proteins

IIA. Native Polypeptides and Proteins

Polypeptides within the scope of the invention include both native proteins as well as variants, fragments, and fusions thereof. Polypeptides of the invention are those encoded by any of the six reading frames of sequences shown in the Reference and Sequence tables, preferably encoded by the three frames reading in the 5' to 3' direction of the sequences as shown.

Native polypeptides include the proteins encoded by the sequences shown in the Reference and Sequence tables. Such native polypeptides include those encoded by allelic variants.

Polypeptide and protein variants will exhibit at least 75% sequence identity to those native polypeptides of the Reference and Sequence tables. More preferably, the polypeptide variants will exhibit at least 85% sequence identity; even more preferably, at least 90% sequence identity; more preferably at least 95%, 96%, 97%, 98%, or 99% sequence identity. Fragments of polypeptide or fragments of polypeptides will exhibit similar percentages of sequence identity to the relevant fragments of the native polypeptide. Fusions will exhibit a similar percentage of sequence identity in that fragment of the fusion represented by the variant of the native peptide.

Polypeptide and protein variants of the invention will exhibit at least 75% sequence identity to those motifs or consensus sequences of the Protein Group and Protein Group Matrix tables. More preferably, the polypeptide variants will exhibit at least 85% sequence identity; even more preferably, at least 90% sequence identity; more preferably at least 95%, 96%, 97%, 98%, or 99% sequence identity. Fragments of polypeptide or fragments of polypeptides will exhibit similar percentages of sequence identity to the relevant fragments of the native polypeptide that are indicated in the Protein Group table. Fusions will exhibit a similar percentage of sequence identity in that fragment of the fusion represented by the variant of the native peptide.

Furthermore, polypeptide variants will exhibit at least one of the functional properties of the native protein. Such properties include, without limitation, protein interaction, DNA interaction, biological activity, immunological activity, receptor binding, signal transduction, transcription activity, growth factor activity, secondary structure, three-dimensional structure, etc. As to properties related to in vitro or in vivo activities, the variants preferably exhibit at least 60% of the activity of the native protein; more preferably at least 70%, even more preferably at least 80%, 85%, 90% or 95% of at least one activity of the native protein.

One type of variant of native polypeptides comprises amino acid substitutions, deletions and/or insertions. Conservative substitutions are preferred to maintain the function or activity of the polypeptide.

Within the scope of percentage of sequence identity described above, a polypeptide of the invention may have additional individual amino acids or amino acid sequences inserted into the polypeptide in the middle thereof and/or at the N-terminal and/or C-terminal ends thereof. Likewise, some of the amino acids or amino acid sequences may be deleted from the polypeptide.

A.1 Antibodies

Isolated polypeptides can be utilized to produce antibodies. Polypeptides of the invention can generally be used, for example, as antigens for raising antibodies by known techniques. The resulting antibodies are useful as reagents for determining the distribution of the antigen protein within the tissues of a plant or within a cell of a plant. The antibodies are also useful for examining the production level of proteins in various tissues, for example in a wild-type plant or following genetic manipulation of a plant, by methods such as Western blotting.

Antibodies of the present invention, both polyclonal and monoclonal, may be prepared by conventional methods. In general, the polypeptides of the invention are first used to immunize a suitable animal, such as a mouse, rat, rabbit, or goat. Rabbits and goats are preferred for the preparation of polyclonal sera due to the volume of serum obtainable, and the availability of labeled anti-rabbit and anti-goat antibodies as detection reagents. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 µg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization.

Polyclonal antisera is obtained by bleeding the immunized animal into a glass or plastic container, incubating the blood at 25° C. for one hour, followed by incubating the blood at 4° C. for 2-18 hours. The serum is recovered by centrifugation (e.g., 1,000×g for 10 minutes). About 20-50 ml per bleed may be obtained from rabbits.

Monoclonal antibodies are prepared using the method of Kohler and Milstein, *Nature* 256: 495 (1975), or modification thereof. Typically, a mouse or rat is immunized as described above. However, rather than bleeding the animal to extract serum, the spleen (and optionally several large lymph nodes) is removed and dissociated into single cells. If desired, the spleen cells can be screened (after removal of nonspecifically adherent cells) by applying a cell suspension to a plate, or well, coated with the protein antigen. B-cells producing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected Mab-secreting hybridomas are then cultured either in vitro (e.g., in tissue culture bottles or hollow fiber reactors), or in vivo (as ascites in mice).

Other methods for sustaining antibody-producing B-cell clones, such as by EBV transformation, are known.

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TNB) to a blue pigment, quantifiable with a spectrophotometer.

A.2 In Vitro Applications of Polypeptides

Some polypeptides of the invention will have enzymatic activities that are useful in vitro. For example, the soybean trypsin inhibitor (Kunitz) family is one of the numerous families of proteinase inhibitors. It comprises plant proteins which have inhibitory activity against serine proteinases from the trypsin and subtilisin families, thiol proteinases and aspartic proteinases. Thus, these peptides find in vitro use in protein purification protocols and perhaps in therapeutic settings requiring topical application of protease inhibitors.

Delta-aminolevulinic acid dehydratase (EC 4.2.1.24) (ALAD) catalyzes the second step in the biosynthesis of heme, the condensation of two molecules of 5-aminolevulinate to form porphobilinogen and is also involved in chlorophyll biosynthesis (Kaczor et al. (1994) Plant Physiol. 1-4: 1411-7; Smith (1988) Biochem. J. 249: 423-8; Schneider (1976) Z. naturforsch. [C] 31: 55-63). Thus, ALAD proteins can be used as catalysts in synthesis of heme derivatives. Enzymes of biosynthetic pathways generally can be used as catalysts for in vitro synthesis of the compounds representing products of the pathway.

Polypeptides encoded by SDFs of the invention can be engineered to provide purification reagents to identify and purify additional polypeptides that bind to them. This allows one to identify proteins that function as multimers or elucidate signal transduction or metabolic pathways. In the case of DNA binding proteins, the polypeptide can be used in a similar manner to identify the DNA determinants of specific binding (S. Pierrou et al., *Anal. Biochem.* 229:99 (1995), S. Chusacultanachai et al., *J. Biol. Chem.* 274:23591 (1999), Q. Lin et al., *J. Biol. Chem.* 272:27274 (1997)).

II.B. Polypeptide Variants, Fragments, and Fusions

Generally, variants, fragments, or fusions of the polypeptides encoded by the maximum length sequence (MLS) can exhibit at least one of the activities of the identified domains and/or related polypeptides described in Sections (C) and (D) of The Reference tables corresponding to the MLS of interest.

II.B.(1) Variants

A type of variant of the native polypeptides comprises amino acid substitutions. Conservative substitutions, described above (see II.), are preferred to maintain the function or activity of the polypeptide. Such substitutions include conservation of charge, polarity, hydrophobicity, size, etc. For example, one or more amino acid residues within the sequence can be substituted with another amino acid of similar polarity that acts as a functional equivalent, for example providing a hydrogen bond in an enzymatic catalysis. Substitutes for an amino acid within an exemplified sequence are preferably made among the members of the class to which the amino acid belongs. For example, the nonpolar (hydrophobic) amino acids include alanine, leucine, isoleucine, valine, proline, phenylalanine, tryptophan and methionine. The polar neutral amino acids include glycine, serine, threonine, cysteine, tyrosine, asparagine, and glutamine. The positively charged (basic) amino acids include arginine, lysine and histidine. The negatively charged (acidic) amino acids include aspartic acid and glutamic acid.

Within the scope of percentage of sequence identity described above, a polypeptide of the invention may have additional individual amino acids or amino acid sequences inserted into the polypeptide in the middle thereof and/or at the N-terminal and/or C-terminal ends thereof. Likewise, some of the amino acids or amino acid sequences may be deleted from the polypeptide. Amino acid substitutions may also be made in the sequences; conservative substitutions being preferred.

One preferred class of variants are those that comprise (1) the domain of an encoded polypeptide and/or (2) residues conserved between the encoded polypeptide and related polypeptides. For this class of variants, the encoded polypeptide sequence is changed by insertion, deletion, or substitution at positions flanking the domain and/or conserved residues.

Another class of variants includes those that comprise an encoded polypeptide sequence that is changed in the domain or conserved residues by a conservative substitution.

Yet another class of variants includes those that lack one of the in vitro activities, or structural features of the encoded polypeptides. One example is polypeptides or proteins produced from genes comprising dominant negative mutations. Such a variant may comprise an encoded polypeptide sequence with non-conservative changes in a particular domain or group of conserved residues.

II.A.(2) Fragments

Fragments of particular interest are those that comprise a domain identified for a polypeptide encoded by an MLS of the instant invention and variants thereof. Also, fragments that comprise at least one region of residues conserved between an MLS encoded polypeptide and its related polypeptides are of great interest. Fragments are sometimes useful as polypeptides corresponding to genes comprising dominant negative mutations are.

II.A.(3) Fusions

Of interest are chimeras comprising (1) a fragment of the MLS encoded polypeptide or variants thereof of interest and (2) a fragment of a polypeptide comprising the same domain. For example, an AP2 helix encoded by a MLS of the invention fused to second AP2 helix from ANT protein, which comprises two AP2 helices. The present invention also encompasses fusions of MLS encoded polypeptides, variants, or fragments thereof fused with related proteins or fragments thereof.

Definition of Domains

The polypeptides of the invention may possess identifying domains as shown in The Reference tables. Specific domains within the MLS encoded polypeptides are indicated in The Reference tables. In addition, the domains within the MLS encoded polypeptide can be defined by the region that exhibits at least 70% sequence identity with the consensus sequences listed in the detailed description below of each of the domains.

The majority of the protein domain descriptions given in the protein domain table are obtained from Prosite (available on the internet) and Pfam (also available on the internet). Examples of domain descriptions are listed in the Protein Domain table.

A. Activities of Polypeptides Comprising Signal Peptides

Polypeptides comprising signal peptides are a family of proteins that are typically targeted to (1) a particular organelle or intracellular compartment, (2) interact with a particular molecule or (3) for secretion outside of a host cell. Example of polypeptides comprising signal peptides include, without limitation, secreted proteins, soluble proteins, receptors, proteins retained in the ER, etc.

These proteins comprising signal peptides are useful to modulate ligand-receptor interactions, cell-to-cell communication, signal transduction, intracellular communication, and activities and/or chemical cascades that take part in an organism outside or within of any particular cell.

One class of such proteins are soluble proteins which are transported out of the cell. These proteins can act as ligands that bind to receptor to trigger signal transduction or to permit communication between cells.

Another class is receptor proteins which also comprise a retention domain that lodges the receptor protein in the membrane when the cell transports the receptor to the surface of the cell. Like the soluble ligands, receptors can also modulate signal transduction and communication between cells.

In addition the signal peptide itself can serve as a ligand for some receptors. An example is the interaction of the ER targeting signal peptide with the signal recognition particle (SRP). Here, the SRP binds to the signal peptide, halting translation, and the resulting SRP complex then binds to docking proteins located on the surface of the ER, prompting transfer of the protein into the ER.

A description of signal peptide residue composition is described below in Subsection IV.C.1.

III. Methods of Modulating Polypeptide Production

It is contemplated that polynucleotides of the invention can be incorporated into a host cell or in-vitro system to modulate polypeptide production. For instance, the SDFs prepared as described herein can be used to prepare expression cassettes useful in a number of techniques for suppressing or enhancing expression.

An example are polynucleotides comprising sequences to be transcribed, such as coding sequences, of the present invention can be inserted into nucleic acid constructs to modulate polypeptide production. Typically, such sequences to be transcribed are heterologous to at least one element of the nucleic acid construct to generate a chimeric gene or construct.

Another example of useful polynucleotides are nucleic acid molecules comprising regulatory sequences of the present invention. Chimeric genes or constructs can be generated when the regulatory sequences of the invention linked to heterologous sequences in a vector construct. Within the scope of invention are such chimeric gene and/or constructs.

Also within the scope of the invention are nucleic acid molecules, whereof at least a part or fragment of these DNA molecules are presented in the Reference and Sequence tables or polynucleotide encoding polypeptides of the Protein Group or Protein Group Matrix tables of the present application, and wherein the coding sequence is under the control of its own promoter and/or its own regulatory elements. Such molecules are useful for transforming the genome of a host cell or an organism regenerated from said host cell for modulating polypeptide production.

Additionally, a vector capable of producing the oligonucleotide can be inserted into the host cell to deliver the oligonucleotide.

More detailed description of components to be included in vector constructs are described both above and below.

Whether the chimeric vectors or native nucleic acids are utilized, such polynucleotides can be incorporated into a host cell to modulate polypeptide production. Native genes and/or nucleic acid molecules can be effective when exogenous to the host cell.

Methods of modulating polypeptide expression includes, without limitation:
  Suppression methods, such as
    Antisense
    Ribozymes
    Co-suppression
    Insertion of Sequences into the Gene to be Modulated
    Regulatory Sequence Modulation.
  as well as Methods for Enhancing Production, such as
    Insertion of Exogenous Sequences; and
    Regulatory Sequence Modulation.

III.A. Suppression

Expression cassettes of the invention can be used to suppress expression of endogenous genes which comprise the SDF sequence. Inhibiting expression can be useful, for instance, to tailor the ripening characteristics of a fruit (Oeller et al., *Science* 254:437 (1991)) or to influence seed size (WO98/07842) or to provoke cell ablation (Mariani et al., Nature 357: 384-387 (1992).

As described above, a number of methods can be used to inhibit gene expression in plants, such as antisense, ribozyme, introduction of exogenous genes into a host cell, insertion of a polynucleotide sequence into the coding sequence and/or the promoter of the endogenous gene of interest, and the like.

III.A.1. Antisense

An expression cassette as described above can be transformed into host cell or plant to produce an antisense strand of RNA. For plant cells, antisense RNA inhibits gene expression by preventing the accumulation of mRNA which encodes the enzyme of interest, see, e.g., Sheehy et al., *Proc. Nat. Acad. Sci. USA,* 85:8805 (1988), and Hiatt et al., U.S. Pat. No. 4,801,340.

III.A.2. Ribozymes

Similarly, ribozyme constructs can be transformed into a plant to cleave mRNA and down-regulate translation.

III.A.3. Co-Suppression

Another method of suppression is by introducing an exogenous copy of the gene to be suppressed. Introduction of expression cassettes in which a nucleic acid is configured in the sense orientation with respect to the promoter has been shown to prevent the accumulation of mRNA. A detailed description of this method is described above.

III.A.4. Insertion of Sequences into the Gene to be Modulated

Yet another means of suppressing gene expression is to insert a polynucleotide into the gene of interest to disrupt transcription or translation of the gene.

Homologous recombination could be used to target a polynucleotide insert to a gene using the Cre-Lox system (A. C. Vergunst et al., *Nucleic Acids Res.* 26:2729 (1998), A.C. Vergunst et al., *Plant Mol. Biol.* 38:393 (1998), H. Albert et al., *Plant J.* 7:649 (1995)).

In addition, random insertion of polynucleotides into a host cell genome can also be used to disrupt the gene of interest. Azpiroz-Leehan et al., *Trends in Genetics* 13:152 (1997). In this method, screening for clones from a library containing random insertions is preferred for identifying those that have polynucleotides inserted into the gene of interest. Such screening can be performed using probes and/or primers described above based on sequences from the Reference and Sequence tables or polynucleotides encoding polypeptides of the Protein Group or Protein Group Matrix tables, fragments thereof, and substantially similar sequence thereto. The screening can also be performed by selecting clones or any transgenic plants having a desired phenotype.

III.A.5. Regulatory Sequence Modulation

The SDFs described in the Reference and Sequence tables or polynucleotides encoding polypeptides of the Protein Group or Protein Group Matrix tables, and fragments thereof are examples of nucleotides of the invention that contain regulatory sequences that can be used to suppress or inactivate transcription and/or translation from a gene of interest as discussed in I.C.5.

III.A.6. Genes Comprising Dominant-Negative Mutations

When suppression of production of the endogenous, native protein is desired it is often helpful to express a gene comprising a dominant negative mutation. Production of protein variants produced from genes comprising dominant negative mutations is a useful tool for research Genes comprising dominant negative mutations can produce a variant polypeptide which is capable of competing with the native polypeptide, but which does not produce the native result. Consequently, over expression of genes comprising these mutations can titrate out an undesired activity of the native protein. For example, The product from a gene comprising a dominant negative mutation of a receptor can be used to constitutively activate or suppress a signal transduction cascade, allowing examination of the phenotype and thus the trait(s) controlled by that receptor and pathway. Alternatively, the protein arising from the gene comprising a dominant-negative mutation can be an inactive enzyme still capable of binding to the same substrate as the native protein and therefore competes with such native protein.

Products from genes comprising dominant-negative mutations can also act upon the native protein itself to prevent activity. For example, the native protein may be active only as a homo-multimer or as one subunit of a hetero-multimer. Incorporation of an inactive subunit into the multimer with native subunit(s) can inhibit activity.

Thus, gene function can be modulated in host cells of interest by insertion into these cells vector constructs comprising a gene comprising a dominant-negative mutation.

III.B. Enhanced Expression

Enhanced expression of a gene of interest in a host cell can be accomplished by either (1) insertion of an exogenous gene; or (2) promoter modulation.

III.B.1. Insertion of an Exogenous Gene

Insertion of an expression construct encoding an exogenous gene can boost the number of gene copies expressed in a host cell.

Such expression constructs can comprise genes that either encode the native protein that is of interest or that encode a variant that exhibits enhanced activity as compared to the native protein. Such genes encoding proteins of interest can be constructed from the sequences from the Reference and Sequence tables or polynucleotides encoding polypeptides of the Protein Group or Protein Group Matrix tables, fragments thereof, and substantially similar sequence thereto.

Such an exogenous gene can include either a constitutive promoter permitting expression in any cell in a host organism or a promoter that directs transcription only in particular cells or times during a host cell life cycle or in response to environmental stimuli.

III.B.2. Regulatory Sequence Modulation

The SDFs of the Reference and Sequence tables, and fragments thereof, contain regulatory sequences that can be used to enhance expression of a gene of interest. For example, some of these sequences contain useful enhancer elements. In some cases, duplication of enhancer elements or insertion of exogenous enhancer elements will increase expression of a desired gene from a particular promoter. As other examples, all 11 promoters require binding of a regulatory protein to be activated, while some promoters may need a protein that signals a promoter binding protein to expose a polymerase binding site. In either case, over-production of such proteins can be used to enhance expression of a gene of interest by increasing the activation time of the promoter.

Such regulatory proteins are encoded by some of the sequences in the Reference and Sequence tables or polynucleotides encoding polypeptides of the Protein Group or Protein Group Matrix tables, fragments thereof, and substantially similar sequences thereto.

Coding sequences for these proteins can be constructed as described above.

IV. Gene Constructs and Vector Construction

To use isolated SDFs of the present invention or a combination of them or parts and/or mutants and/or fusions of said SDFs in the above techniques, recombinant DNA vectors which comprise said SDFs and are suitable for transformation of cells, such as plant cells, are usually prepared. The SDF construct can be made using standard recombinant DNA techniques (Sambrook et al. 1989) and can be introduced to the species of interest by *Agrobacterium*-mediated transformation or by other means of transformation (e.g., particle gun bombardment) as referenced below.

The vector backbone can be any of those typical in the art such as plasmids, viruses, artificial chromosomes, BACs, YACs and PACs and vectors of the sort described by (a) BAC: Shizuya et al., Proc. Natl. Acad. Sci. USA 89: 8794-8797 (1992); Hamilton et al., Proc. Natl. Acad. Sci. USA 93: 9975-9979 (1996);

(b) YAC: Burke et al., Science 236:806-812 (1987);

(c) PAC: Sternberg N. et al., Proc Natl Acad Sci USA. January; 87(1):103-7 (1990);

(d) Bacteria-Yeast Shuttle Vectors: Bradshaw et al., Nucl Acids Res 23: 4850-4856 (1995);

(e) Lambda Phage Vectors: Replacement Vector, e.g., Frischauf et al., J. Mol Biol 170: 827-842 (1983); or Insertion vector, e.g., Huynh et al., In: Glover N M (ed) DNA Cloning: A practical Approach, Vol. 1 Oxford: IRL Press (1985);

(f) T-DNA gene fusion vectors: Walden et al., Mol Cell Biol 1: 175-194 (1990); and (g) Plasmid vectors: Sambrook et al., infra.

Typically, a vector will comprise the exogenous gene, which in its turn comprises an SDF of the present invention to be introduced into the genome of a host cell, and which gene may be an antisense construct, a ribozyme construct chimeraplast, or a coding sequence with any desired transcriptional and/or translational regulatory sequences, such as promoters, UTRs, and 3' end termination sequences. Vectors of the invention can also include origins of replication, scaffold attachment regions (SARs), markers, homologous sequences, introns, etc.

A DNA sequence coding for the desired polypeptide, for example a cDNA sequence encoding a full length protein, will preferably be combined with transcriptional and translational initiation regulatory sequences which will direct the transcription of the sequence from the gene in the intended tissues of the transformed plant.

For example, for over-expression, a plant promoter fragment may be employed that will direct transcription of the gene in all tissues of a regenerated plant. Alternatively, the plant promoter may direct transcription of an SDF of the invention in a specific tissue (tissue-specific promoters) or may be otherwise under more precise environmental control (inducible promoters).

If proper polypeptide production is desired, a polyadenylation region at the 3'-end of the coding region is typically included. The polyadenylation region can be derived from the natural gene, from a variety of other plant genes, or from T-DNA.

The vector comprising the sequences from genes or SDF or the invention may comprise a marker gene that confers a selectable phenotype on plant cells. The vector can include promoter and coding sequence, for instance. For example, the marker may encode biocide resistance, particularly antibiotic resistance, such as resistance to kanamycin, G418, bleomycin, hygromycin, or herbicide resistance, such as resistance to chlorosulfuron or phosphinothricin.

IV.A. Coding Sequences

Generally, the sequence in the transformation vector and to be introduced into the genome of the host cell does not need to be absolutely identical to an SDF of the present invention. Also, it is not necessary for it to be full length, relative to either the primary transcription product or fully processed mRNA. Furthermore, the introduced sequence need not have the same intron or exon pattern as a native gene. Also, heterologous non-coding segments can be incorporated into the coding sequence without changing the desired amino acid sequence of the polypeptide to be produced.

IV.B. Promoters

As explained above, introducing an exogenous SDF from the same species or an orthologous SDF from another species are useful to modulate the expression of a native gene corresponding to that SDF of interest. Such an SDF construct can be under the control of either a constitutive promoter or a highly regulated inducible promoter (e.g., a copper inducible promoter). The promoter of interest can initially be either endogenous or heterologous to the species in question. When re-introduced into the genome of said species, such promoter becomes exogenous to said species. Over-expression of an SDF transgene can lead to co-suppression of the homologous endogeneous sequence thereby creating some alterations in the phenotypes of the transformed species as demonstrated by similar analysis of the chalcone synthase gene (Napoli et al., *Plant Cell* 2:279 (1990) and van der Krol et al., *Plant Cell* 2:291 (1990)). If an SDF is found to encode a protein with desirable characteristics, its over-production can be controlled so that its accumulation can be manipulated in an organ- or tissue-specific manner utilizing a promoter having such specificity.

Likewise, if the promoter of an SDF (or an SDF that includes a promoter) is found to be tissue-specific or developmentally regulated, such a promoter can be utilized to drive or facilitate the transcription of a specific gene of interest (e.g., seed storage protein or root-specific protein). Thus, the level of accumulation of a particular protein can be manipulated or its spatial localization in an organ- or tissue-specific manner can be altered.

IV. C Signal Peptides

SDFs of the present invention containing signal peptides are indicated in the Reference, Sequence, the Protein Group and Protein Group Matrix tables. In some cases it may be desirable for the protein encoded by an introduced exogenous or orthologous SDF to be targeted (1) to a particular organelle intracellular compartment, (2) to interact with a particular molecule such as a membrane molecule or (3) for secretion outside of the cell harboring the introduced SDF. This will be accomplished using a signal peptide.

Signal peptides direct protein targeting, are involved in ligand-receptor interactions and act in cell to cell communication. Many proteins, especially soluble proteins, contain a signal peptide that targets the protein to one of several different intracellular compartments. In plants, these compartments include, but are not limited to, the endoplasmic reticulum (ER), mitochondria, plastids (such as chloroplasts), the vacuole, the Golgi apparatus, protein storage vessicles (PSV) and, in general, membranes. Some signal peptide sequences are conserved, such as the Asn-Pro-Ile-Arg amino acid motif found in the N-terminal propeptide signal that targets proteins to the vacuole (Marty (1999) *The Plant Cell* 11: 587-599). Other signal peptides do not have a consensus sequence per se, but are largely composed of hydrophobic amino acids, such as those signal peptides targeting proteins to the ER (Vitale and Denecke (1999) *The Plant Cell* 11: 615-628). Still others do not appear to contain either a consensus sequence or an identified common secondary sequence, for instance the chloroplast stromal targeting signal peptides (Keegstra and Cline (1999) *The Plant Cell* 11: 557-570). Furthermore, some targeting peptides are bipartite, directing proteins first to an organelle and then to a membrane within the organelle (e.g. within the thylakoid lumen of the chloroplast; see Keegstra and Cline (1999) *The Plant Cell* 11: 557-570). In addition to the diversity in sequence and secondary structure, placement of the signal peptide is also varied. Proteins destined for the vacuole, for example, have targeting signal peptides found at the N-terminus, at the C-terminus and at a surface location in mature, folded proteins. Signal peptides also serve as ligands for some receptors.

These characteristics of signal proteins can be used to more tightly control the phenotypic expression of introduced SDFs. In particular, associating the appropriate signal sequence with a specific SDF can allow sequestering of the protein in specific organelles (plastids, as an example), secretion outside of the cell, targeting interaction with particular receptors, etc. Hence, the inclusion of signal proteins in constructs involving the SDFs of the invention increases the range of manipulation of SDF phenotypic expression. The nucleotide sequence of the signal peptide can be isolated from characterized genes using common molecular biological techniques or can be synthesized in vitro.

In addition, the native signal peptide sequences, both amino acid and nucleotide, described in the Reference, Sequence, Protein Group or Protein Group Matrix tables can be used to modulate polypeptide transport. Further variants of the native signal peptides described in the Reference, Sequence, Protein Group or Protein Group Matrix tables are contemplated. Insertions, deletions, or substitutions can be made. Such variants will retain at least one of the functions of the native signal peptide as well as exhibiting some degree of sequence identity to the native sequence.

Also, fragments of the signal peptides of the invention are useful and can be fused with other signal peptides of interest to modulate transport of a polypeptide.

V. Transformation Techniques

A wide range of techniques for inserting exogenous polynucleotides are known for a number of host cells, including, without limitation, bacterial, yeast, mammalian, insect and plant cells.

Techniques for transforming a wide variety of higher plant species are well known and described in the technical and scientific literature. See, e.g. Weising et al., *Ann. Rev. Genet.* 22:421 (1988); and Christou, Euphytica, v. 85, n. 1-3:13-27, (1995).

DNA constructs of the invention may be introduced into the genome of the desired plant host by a variety of conventional techniques. For example, the DNA construct may be introduced directly into the genomic DNA of the plant cell using techniques such as electroporation and microinjection of plant cell protoplasts, or the DNA constructs can be introduced directly to plant tissue using ballistic methods, such as DNA particle bombardment. Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria (McCormac et al., *Mol. Biotechnol.* 8:199 (1997); Hamilton, *Gene* 200:107 (1997)); Salomon et al. *EMBO J.* 3:141 (1984); Herrera-Estrella et al. *EMBO J.* 2:987 (1983).

Microinjection techniques are known in the art and well described in the scientific and patent literature. The introduction of DNA constructs using polyethylene glycol precipitation is described in Paszkowski et al. *EMBO J.* 3:2717 (1984). Electroporation techniques are described in Fromm et al. *Proc. Natl Acad. Sci. USA* 82:5824 (1985). Ballistic transformation techniques are described in Klein et al. *Nature* 327:773 (1987). *Agrobacterium tumefaciens*-mediated transformation techniques, including disarming and use of binary or co-integrate vectors, are well described in the scientific literature. See, for example Hamilton, C M., *Gene* 200:107 (1997); Müller et al. *Mol. Gen. Genet.* 207:171 (1987); Komari et al. *Plant J.* 10:165 (1996); Venkateswarlu et al. *Biotechnology* 9:1103 (1991) and Gleave, A P., *Plant Mol. Biol.* 20:1203 (1992); Graves and Goldman, *Plant Mol. Biol.* 7:34 (1986) and Gould et al., *Plant Physiology* 95:426 (1991).

Transformed plant cells which are derived by any of the above transformation techniques can be cultured to regenerate a whole plant that possesses the transformed genotype and thus the desired phenotype such as seedlessness. Such regeneration techniques rely on manipulation of certain phytohormones in a tissue culture growth medium, typically relying on a biocide and/or herbicide marker which has been introduced together with the desired nucleotide sequences. Plant regeneration from cultured protoplasts is described in Evans et al., *Protoplasts Isolation and Culture* in "Handbook of Plant Cell Culture," pp. 124-176, MacMillan Publishing Company, New York, 1983; and Binding, *Regeneration of Plants, Plant Protoplasts*, pp. 21-73, CRC Press, Boca Raton, 1988. Regeneration can also be obtained from plant callus, explants, organs, or parts thereof. Such regeneration techniques are described generally in Klee et al. *Ann. Rev. of Plant Phys.* 38:467 (1987). Regeneration of monocots (rice) is described by Hosoyama et al. (*Biosci. Biotechnol. Biochem.* 58:1500 (1994)) and by Ghosh et al. (*J. Biotechnol.* 32:1 (1994)). The nucleic acids of the invention can be used to confer desired traits on essentially any plant.

Thus, the invention has use over a broad range of plants, including species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannesetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and, *Zea*.

One of skill will recognize that after the expression cassette is stably incorporated in transgenic plants and confirmed to be operable, it can be introduced into other plants by sexual crossing. Any of a number of standard breeding techniques can be used, depending upon the species to be crossed.

The particular sequences of SDFs identified are provided in the attached Reference and Sequence tables.

IX. Definitions

The following terms are utilized throughout this application:

Allelic variant: An "allelic variant" is an alternative form of the same SDF, which resides at the same chromosomal locus in the organism. Allelic variations can occur in any portion of the gene sequence, including regulatory regions. Allelic variants can arise by normal genetic variation in a population. Allelic variants can also be produced by genetic engineering methods. An allelic variant can be one that is found in a naturally occurring plant, including a cultivar or ecotype. An allelic variant may or may not give rise to a phenotypic change, and may or may not be expressed. An allele can result in a detectable change in the phenotype of the trait represented by the locus. A phenotypically silent allele can give rise to a product.

Alternatively spliced messages: Within the context of the current invention, "alternatively spliced messages" refers to mature mRNAs originating from a single gene with variations in the number and/or identity of exons, introns and/or intron-exon junctions.

Chimeric: The term "chimeric" is used to describe genes, as defined supra, or contructs wherein at least two of the elements of the gene or construct, such as the promoter and the coding sequence and/or other regulatory sequences and/or filler sequences and/or complements thereof, are heterologous to each other.

Constitutive Promoter: Promoters referred to herein as "constitutive promoters" actively promote transcription under most, but not necessarily all, environmental conditions and states of development or cell differentiation. Examples of constitutive promoters include the cauliflower mosaic virus (CaMV) 35S transcript initiation region and the 1' or 2' promoter derived from T-DNA of *Agrobacterium tumefaciens*, and other transcription initiation regions from various plant genes, such as the maize ubiquitin-1 promoter, known to those of skill.

Coordinately Expressed: The term "coordinately expressed," as used in the current invention, refers to genes that are expressed at the same or a similar time and/or stage and/or under the same or similar environmental conditions.

Domain: Domains are fingerprints or signatures that can be used to characterize protein families and/or parts of proteins. Such fingerprints or signatures can comprise conserved (1) primary sequence, (2) secondary structure, and/or (3) three-dimensional conformation. Generally, each domain has been associated with either a family of proteins or motifs. Typically, these families and/or motifs have been correlated with specific in-vitro and/or in-vivo activities. A domain can be any length, including the entirety of the sequence of a protein. Detailed descriptions of the domains, associated families and motifs, and correlated activities of the polypeptides of the instant invention are described below. Usually, the polypeptides with designated domain(s) can exhibit at least one activity that is exhibited by any polypeptide that comprises the same domain(s).

Endogenous: The term "endogenous," within the context of the current invention refers to any polynucleotide, polypeptide or protein sequence which is a natural part of a cell or organisms regenerated from said cell.

Exogenous: "Exogenous," as referred to within, is any polynucleotide, polypeptide or protein sequence, whether chimeric or not, that is initially or subsequently introduced into the genome of an individual host cell or the organism regenerated from said host cell by any means other than by a sexual cross. Examples of means by which this can be accomplished are described below, and include *Agrobacterium*-mediated transformation (of dicots—e.g. Salomon et al. *EMBO J.* 3:141 (1984); Herrera-Estrella et al. *EMBO J.* 2:987 (1983); of monocots, representative papers are those by Escudero et al., *Plant J.* 10:355 (1996), Ishida et al., *Nature Biotechnology* 14:745 (1996), May et al., *Bio/Technology* 13:486 (1995)), biolistic methods (Armaleo et al., *Current Genetics* 17:97 1990)), electroporation, in planta techniques, and the like. Such a plant containing the exogenous nucleic acid is referred to here as a $T_0$ for the primary transgenic plant and $T_1$ for the first generation. The term "exogenous" as used herein is also intended to encompass inserting a naturally found element into a non-naturally found location.

Filler sequence: As used herein, "filler sequence" refers to any nucleotide sequence that is inserted into DNA construct to evoke a particular spacing between particular components such as a promoter and a coding region and may provide an additional attribute such as a restriction enzyme site.

Gene: The term "gene," as used in the context of the current invention, encompasses all regulatory and coding sequence contiguously associated with a single hereditary unit with a genetic function (see SCHEMATIC 1). Genes can include non-coding sequences that modulate the genetic function that include, but are not limited to, those that specify polyadenylation, transcriptional regulation, DNA conformation, chromatin conformation, extent and position of base methylation and binding sites of proteins that control all of these. Genes comprised of "exons" (coding sequences), which may be interrupted by "introns" (non-coding sequences), encode proteins. A gene's genetic function may require only RNA expression or protein production, or may only require binding of proteins and/or nucleic acids without associated expression. In certain cases, genes adjacent to one another may share sequence in such a way that one gene will overlap the other. A gene can be found within the genome of an organism, artificial chromosome, plasmid, vector, etc., or as a separate isolated entity.

Gene Family: "Gene family" is used in the current invention to describe a group of functionally related genes, each of which encodes a separate protein.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence originates from, are considered heterologous to said coding sequence. Elements operatively linked in nature and -contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Homologous gene: In the current invention, "homologous gene" refers to a gene that shares sequence similarity with the gene of interest. This similarity may be in only a fragment of the sequence and often represents a functional domain such as, examples including without limitation a DNA binding domain, a domain with tyrosine kinase activity, or the like. The functional activities of homologous genes are not necessarily the same.

Inducible Promoter: An "inducible promoter" in the context of the current invention refers to a promoter which is regulated under certain conditions, such as light, chemical concentration, protein concentration, conditions in an organism, cell, or organelle, etc. A typical example of an inducible promoter, which can be utilized with the polynucleotides of the present invention, is PARSK1, the promoter from the *Arabidopsis* gene encoding a serine-threonine kinase enzyme, and which promoter is induced by dehydration, abscissic acid and sodium chloride (Wang and Goodman, *Plant J.* 8:37 (1995)) Examples of environmental conditions that may affect transcription by inducible promoters include anaerobic conditions, elevated temperature, or the presence of light.

Intergenic region: "Intergenic region," as used in the current invention, refers to nucleotide sequence occurring in the genome that separates adjacent genes.

Mutant gene: In the current invention, "mutant" refers to a heritable change in DNA sequence at a specific location. Mutants of the current invention may or may not have an associated identifiable function when the mutant gene is transcribed.

Orthologous Gene: In the current invention "orthologous gene" refers to a second gene that encodes a gene product that performs a similar function as the product of a first gene. The orthologous gene may also have a degree of sequence similarity to the first gene. The orthologous gene may encode a polypeptide that exhibits a degree of sequence similarity to a polypeptide corresponding to a first gene. The sequence similarity can be found within a functional domain or along the entire length of the coding sequence of the genes and/or their corresponding polypeptides.

Percentage of sequence identity: "Percentage of sequence identity," as used herein, is determined by comparing two optimally aligned sequences over a comparison window, where the fragment of the polynucleotide or amino acid sequence in the comparison window may comprise additions or deletions (e.g., gaps or overhangs) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman *Add. APL. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci.* (*USA*) 85: 2444 (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by inspection. Given that two sequences have been identified for comparison, GAP and BESTFIT are preferably employed to determine their optimal alignment. Typically, the default values of 5.00 for gap weight and 0.30 for gap weight length are used. The term "substantial sequence identity" between polynucleotide or polypeptide sequences refers to polynucleotide or polypeptide comprising a sequence that has at least 80% sequence identity, preferably at least 85%, more preferably at least 90% and most preferably at least 95%, even more preferably, at least 96%, 97%, 98% or 99% sequence identity compared to a reference sequence using the programs.

Plant Promoter: A "plant promoter" is a promoter capable of initiating transcription in plant cells and can drive or facilitate transcription of a fragment of the SDF of the instant invention or a coding sequence of the SDF of the instant invention. Such promoters need not be of plant origin. For example, promoters derived from plant viruses, such as the CaMV35S promoter or from *Agrobacterium tumefaciens* such as the T-DNA promoters, can be plant promoters. A typical example of a plant promoter of plant origin is the maize ubiquitin-1 (ubi-1) promoter known to those of skill.

Promoter: The term "promoter," as used herein, refers to a region of sequence determinants located upstream from the start of transcription of a gene and which are involved in recognition and binding of RNA polymerase and other proteins to initiate and modulate transcription. A basal promoter is the minimal sequence necessary for assembly of a transcription complex required for transcription initiation. Basal promoters frequently include a "TATA box" element usually located between 15 and 35 nucleotides upstream from the site of initiation of transcription. Basal promoters also sometimes include a "CCAAT box" element (typically a sequence CCAAT) (SEQ ID NO:200515) and/or a GGGCG sequence (SEQ ID NO:200516), usually located between 40 and 200 nucleotides, preferably 60 to 120 nucleotides, upstream from the start site of transcription.

Public sequence: The term "public sequence," as used in the context of the instant application, refers to any sequence that has been deposited in a publicly accessible database. This term encompasses both amino acid and nucleotide sequences. Such sequences are publicly accessible, for example, on the BLAST databases on the NCBI FTP web site (accessible at ncbi.nlm.gov/blast). The database at the NCBI GTP site utilizes "gi" numbers assigned by NCBI as a unique identifier for each sequence in the databases, thereby providing a non-redundant database for sequence from various databases, including GenBank, EMBL, DBBJ, (DNA Database of Japan) and PDB (Brookhaven Protein Data Bank).

Regulatory Sequence: The term "regulatory sequence," as used in the current invention, refers to any nucleotide sequence that influences transcription or translation initiation and rate, and stability and/or mobility of the transcript or polypeptide product. Regulatory sequences include, but are not limited to, promoters, promoter control elements, protein binding sequences, 5' and 3' UTRs, transcriptional start site, termination sequence, polyadenylation sequence, introns, certain sequences within a coding sequence, etc.

Related Sequences: "Related sequences" refer to either a polypeptide or a nucleotide sequence that exhibits some degree of sequence similarity with a sequence described by The Reference tables and The Sequence tables.

Scaffold Attachment Region (SAR): As used herein, "scaffold attachment region" is a DNA sequence that anchors chromatin to the nuclear matrix or scaffold to generate loop domains that can have either a transcriptionally active or inactive structure (Spiker and Thompson (1996) Plant Physiol. 110: 15-21).

Sequence-determined DNA fragments (SDFs): "Sequence-determined DNA fragments" as used in the current invention are isolated sequences of genes, fragments of genes, intergenic regions or contiguous DNA from plant genomic DNA or cDNA or RNA the sequence of which has been determined.

Signal Peptide: A "signal peptide" as used in the current invention is an amino acid sequence that targets the protein for secretion, for transport to an intracellular compartment or organelle or for incorporation into a membrane. Signal peptides are indicated in the tables and a more detailed description located below.

Specific Promoter: In the context of the current invention, "specific promoters" refers to a subset of inducible promoters that have a high preference for being induced in a specific tissue or cell and/or at a specific time during development of an organism. By "high preference" is meant at least 3-fold, preferably 5-fold, more preferably at least 10-fold still more preferably at least 20-fold, 50-fold or 100-fold increase in transcription in the desired tissue over the transcription in any other tissue. Typical examples of temporal and/or tissue specific promoters of plant origin that can be used with the polynucleotides of the present invention, are: PTA29, a promoter which is capable of driving gene transcription specifically in tapetum and only during anther development (Koltonow et al., *Plant Cell* 2:1201 (1990); RCc2 and RCc3, promoters that direct root-specific gene transcription in rice (Xu et al., *Plant Mol. Biol.* 27:237 (1995); TobRB27, a root-specific promoter from tobacco (Yamamoto et al., *Plant Cell* 3:371 (1991)). Examples of tissue-specific promoters under developmental control include promoters that initiate transcription only in certain tissues or organs, such as root, ovule, fruit, seeds, or flowers. Other suitable promoters include those from genes encoding storage proteins or the lipid body membrane protein, oleosin. A few root-specific promoters are noted above.

Stringency: "Stringency" as used herein is a function of probe length, probe composition (G+C content), and salt concentration, organic solvent concentration, and temperature of hybridization or wash conditions. Stringency is typically compared by the parameter $T_m$, which is the temperature at which 50% of the complementary molecules in the hybridization are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship of hybridization conditions to $T_m$ (in ° C.) is expressed in the mathematical equation $$T_m = 81.5 - 16.6(\log_{10}[\text{Na}^+]) + 0.41(\% \text{ G+C}) - (600/N) \quad (1)$$

where N is the length of the probe. This equation works well for probes 14 to 70 nucleotides in length that are identical to the target sequence. The equation below for $T_m$ of DNA-DNA hybrids is useful for probes in the range of 50 to greater than 500 nucleotides, and for conditions that include an organic solvent (formamide).

$$T_m = 81.5 + 16.6 \log\{[\text{Na}^+]/(1+0.7[\text{Na}^+])\} + 0.41(\% \text{ G+C}) - 500/L\,0.63(\% \text{ formamide}) \quad (2)$$

where L is the length of the probe in the hybrid. (P. Tijessen, "Hybridization with Nucleic Acid Probes" in Laboratory Techniques in Biochemistry and Molecular Biology, P.C. vand der Vliet, ed., c. 1993 by Elsevier, Amsterdam.) The $T_m$ of equation (2) is affected by the nature of the hybrid; for DNA-RNA hybrids $T_m$ is 10-15° C. higher than calculated, for RNA-RNA hybrids $T_m$ is 20-25° C. higher. Because the $T_m$ decreases about 1° C. for each 1% decrease in homology when a long probe is used (Bonner et al., *J. Mol. Biol.* 81:123 (1973)), stringency conditions can be adjusted to favor detection of identical genes or related family members.

Equation (2) is derived assuming equilibrium and therefore, hybridizations according to the present invention are most preferably performed under conditions of probe excess and for sufficient time to achieve equilibrium. The time required to reach equilibrium can be shortened by inclusion of a hybridization accelerator such as dextran sulfate or another high volume polymer in the hybridization buffer.

Stringency can be controlled during the hybridization reaction or after hybridization has occurred by altering the salt and temperature conditions of the wash solutions used. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

Substantially free of: A composition containing A is "substantially free of" B when at least 85% by weight of the total A+B in the composition is A. Preferably, A comprises at least about 90% by weight of the total of A+B in the composition, more preferably at least about 95% or even 99% by weight. For example, a plant gene or DNA sequence can be considered substantially free of other plant genes or DNA sequences.

Translational start site: In the context of the current invention, a "translational start site" is usually an ATG in the cDNA transcript, more usually the first ATG. A single cDNA, however, may have multiple translational start sites.

Transcription start site: "Transcription start site" is used in the current invention to describe the point at which transcription is initiated. This point is typically located about 25 nucleotides downstream from a TFIID binding site, such as a TATA box. Transcription can initiate at one or more sites within the gene, and a single gene may have multiple transcriptional start sites, some of which may be specific for transcription in a particular cell-type or tissue.

Untranslated region (UTR): A "UTR" is any contiguous series of nucleotide bases that is transcribed, but is not translated. These untranslated regions may be associated with particular functions such as increasing mRNA message stability. Examples of UTRs include, but are not limited to polyadenylation signals, terminations sequences, sequences located between the transcriptional start site and the first exon (5' UTR) and sequences located between the last exon and the end of the mRNA (3' UTR).

Variant: The term "variant" is used herein to denote a polypeptide or protein or polynucleotide molecule that differs from others of its kind in some way. For example, polypeptide and protein variants can consist of changes in amino acid sequence and/or charge and/or post-translational modifications (such as glycosylation, etc).

X. Examples

The invention is illustrated by way of the following examples. The invention is not limited by these examples as the scope of the invention is defined solely by the claims following.

Example 1 cDNA Preparation

A number of the nucleotide sequences disclosed in the Reference and Sequence tables or polynucleotides encoding polypeptides of the Protein Group or Protein Group Matrix tables, herein as representative of the SDFs of the invention can be obtained by sequencing genomic DNA (gDNA) and/or cDNA from corn plants grown from HYBRID SEED #35A19, purchased from Pioneer Hi-Bred International, Inc., Supply Management, P.O. Box 256, Johnston, Iowa 50131-0256.

A number of the nucleotide sequences disclosed in the Reference and Sequence tables or polynucleotides encoding polypeptides of the Protein Group or Protein Group Matrix tables, herein as representative of the SDFs of the invention can also be obtained by sequencing genomic DNA from *Arabidopsis thaliana*, Wassilewskija ecotype or by sequencing cDNA obtained from mRNA from such plants as described below. This is a true breeding strain. Seeds of the plant are available from the *Arabidopsis* Biological Resource Center at the Ohio State University, under the accession number CS2360. Seeds of this plant were deposited under the terms and conditions of the Budapest Treaty at the American Type Culture Collection, Manassas, Va. on Aug. 31, 1999, and were assigned ATCC No. PTA-595.

Other methods for cloning full-length cDNA are described, for example, by Seki et al., *Plant Journal* 15:707-720 (1998) "High-efficiency cloning of *Arabidopsis* full-length cDNA by biotinylated Cap trapper"; Maruyama et al., *Gene* 138:171 (1994) "Oligo-capping a simple method to replace the cap structure of eukaryotic mRNAs with oligoribonucleotides"; and WO 96/34981.

Tissues were, or each organ was, individually pulverized and frozen in liquid nitrogen. Next, the samples were homogenized in the presence of detergents and then centrifuged. The debris and nuclei were removed from the sample and more detergents were added to the sample. The sample was centrifuged and the debris was removed. Then the sample was applied to a 2M sucrose cushion to isolate polysomes. The RNA was isolated by treatment with detergents and proteinase K followed by ethanol precipitation and centrifugation. The polysomal RNA from the different tissues was pooled according to the following mass ratios: 15/15/1 for male inflorescences, female inflorescences and root, respectively. The pooled material was then used for cDNA synthesis by the methods described below.

Starting material for cDNA synthesis for the exemplary corn cDNA clones with sequences presented in the Reference and Sequence tables or polynucleotides encoding polypeptides of the Protein Group or Protein Group Matrix tables was poly(A)-containing polysomal mRNAs from inflorescences and root tissues of corn plants grown from HYBRID SEED #35A19. Male inflorescences and female (pre- and post-fertilization) inflorescences were isolated at various stages of development. Selection for poly(A) containing polysomal RNA was done using oligo d(T) cellulose columns, as described by Cox and Goldberg, "Plant Molecular Biology: A Practical Approach", pp. 1-35, Shaw ed., c. 1988 by IRL, Oxford. The quality and the integrity of the polyA+RNAs were evaluated.

Starting material for cDNA synthesis for the exemplary *Arabidopsis* cDNA clones with sequences presented in the Reference and Sequence tables or polynucleotides encoding polypeptides of the Protein Group or Protein Group Matrix tables was polysomal RNA isolated from the top-most inflorescence tissues of *Arabidopsis thaliana* Wassilewskija (Ws.) and from roots of *Arabidopsis thaliana* Landsberg erecta (L. er.), also obtained from the *Arabidopsis* Biological Resource Center. Nine parts inflorescence to every part root was used, as measured by wet mass. Tissue was pulverized and exposed to liquid nitrogen. Next, the sample was homogenized in the presence of detergents and then centrifuged. The debris and nuclei were removed from the sample and more detergents were added to the sample. The sample was centrifuged and the debris was removed and the sample was applied to a 2M sucrose cushion to isolate polysomal RNA. Cox et al., "Plant Molecular Biology: A Practical Approach", pp. 1-35, Shaw ed., c. 1988 by IRL, Oxford. The polysomal RNA was used for cDNA synthesis by the methods described below. Polysomal mRNA was then isolated as described above for corn cDNA. The quality of the RNA was assessed electrophoretically.

Following preparation of the mRNAs from various tissues as described above, selection of mRNA with intact 5' ends and specific attachment of an oligonucleotide tag to the 5' end of such mRNA was performed using either a chemical or enzymatic approach. Both techniques take advantage of the presence of the "cap" structure, which characterizes the 5' end of most intact mRNAs and which comprises a guanosine generally methylated once, at the 7 position.

The chemical modification approach involves the optional elimination of the 2',3'-cis diol of the 3' terminal ribose, the oxidation of the 2',3'-cis diol of the ribose linked to the cap of the 5' ends of the mRNAs into a dialdehyde, and the coupling of the such obtained dialdehyde to a derivatized oligonucleotide tag. Further detail regarding the chemical approaches for obtaining mRNAs having intact 5' ends are disclosed in International Application No. WO96/34981 published Nov. 7, 1996.

The enzymatic approach for ligating the oligonucleotide tag to the intact 5' ends of mRNAs involves the removal of the phosphate groups present on the 5' ends of uncapped incomplete mRNAs, the subsequent decapping of mRNAs having intact 5' ends and the ligation of the phosphate present at the 5' end of the decapped mRNA to an oligonucleotide tag. Further detail regarding the enzymatic approaches for obtaining mRNAs having intact 5' ends are disclosed in Dumas Milne Edwards J. B. (Doctoral Thesis of Paris VI University, Le clonage des ADNc complets: difficultés et perspectives nouvelles. Apports pour l'étude de la régulation de l'expression de la tryptophane hydroxylase de rat, 20 Dec. 1993), EP 0 625572 and Kato et al., Gene 150:243-250 (1994).

In both the chemical and the enzymatic approach, the oligonucleotide tag has a restriction enzyme site (e.g. an EcoRI site) therein to facilitate later cloning procedures. Following attachment of the oligonucleotide tag to the mRNA, the integrity of the mRNA is examined by performing a Northern blot using a probe complementary to the oligonucleotide tag.

For the mRNAs joined to oligonucleotide tags using either the chemical or the enzymatic method, first strand cDNA synthesis is performed using an oligo-dT primer with reverse transcriptase. This oligo-dT primer can contain an internal tag of at least 4 nucleotides, which can be different from one mRNA preparation to another. Methylated dCTP is used for cDNA first strand synthesis to protect the internal EcoRI sites from digestion during subsequent steps. The first strand cDNA is precipitated using isopropanol after removal of RNA by alkaline hydrolysis to eliminate residual primers.

Second strand cDNA synthesis is conducted using a DNA polymerase, such as Klenow fragment and a primer corresponding to the 5' end of the ligated oligonucleotide. The primer is typically 20-25 bases in length. Methylated dCTP is used for second strand synthesis in order to protect internal EcoRI sites in the cDNA from digestion during the cloning process.

Following second strand synthesis, the full-length cDNAs are cloned into a phagemid vector, such as pBlueScript™ (Stratagene). The ends of the full-length cDNAs are blunted with T4 DNA polymerase (Biolabs) and the cDNA is digested with EcoRI. Since methylated dCTP is used during cDNA synthesis, the EcoRI site present in the tag is the only hemi-methylated site; hence the only site susceptible to EcoRI digestion. In some instances, to facilitate subcloning, an Hind III adapter is added to the 3' end of full-length cDNAs.

The full-length cDNAs are then size fractionated using either exclusion chromatography (AcA, Biosepra) or electrophoretic separation which yields 3 to 6 different fractions. The full-length cDNAs are then directionally cloned either into pBlueScript™ using either the EcoRI and SmaI restriction sites or, when the Hind III adapter is present in the full-length cDNAs, the EcoRI and Hind III restriction sites. The ligation mixture is transformed, preferably by electroporation, into bacteria, which are then propagated under appropriate antibiotic selection.

Clones containing the oligonucleotide tag attached to full-length cDNAs are selected as follows.

The plasmid cDNA libraries made as described above are purified (e.g. by a column available from Qiagen). A positive selection of the tagged clones is performed as follows. Briefly, in this selection procedure, the plasmid DNA is converted to single stranded DNA using phage F1 gene II endonuclease in combination with an exonuclease (Chang et al., Gene 127:95 (1993)) such as exonuclease III or T7 gene 6 exonuclease. The resulting single stranded DNA is then purified using paramagnetic beads as described by Fry et al., Biotechniques 13: 124 (1992). Here the single stranded DNA is hybridized with a biotinylated oligonucleotide having a sequence corresponding to the 3' end of the oligonucleotide tag. Preferably, the primer has a length of 20-25 bases. Clones including a sequence complementary to the biotinylated oligonucleotide are selected by incubation with streptavidin coated magnetic beads followed by magnetic capture. After capture of the positive clones, the plasmid DNA is released from the magnetic beads and converted into double stranded DNA using a DNA polymerase such as ThermoSequenase™ (obtained from Amersham Pharmacia Biotech). Alternatively, protocols such as the Gene Trapper™ kit (Gibco BRL) can be used. The double stranded DNA is then transformed, preferably by electroporation, into bacteria. The percentage of positive clones having the 5' tag oligonucleotide is typically estimated to be between 90 and 98% from dot blot analysis.

Following transformation, the libraries are ordered in microtiter plates and sequenced. The *Arabidopsis* library was deposited at the American Type Culture Collection on Jan. 7, 2000 as "*E-coli* liba 010600" under the accession number PTA-1161.

A. Example 2

Southern Hybridizations

The SDFs of the invention can be used in Southern hybridizations as described above. The following describes extraction of DNA from nuclei of plant cells, digestion of the nuclear DNA and separation by length, transfer of the separated fragments to membranes, preparation of probes for hybridization, hybridization and detection of the hybridized probe.

The procedures described herein can be used to isolate related polynucleotides or for diagnostic purposes. Moderate stringency hybridization conditions, as defined above, are described in the present example. These conditions result in detection of hybridization between sequences having at least 70% sequence identity. As described above, the hybridization and wash conditions can be changed to reflect the desired percentage of sequence identity between probe and target sequences that can be detected.

In the following procedure, a probe for hybridization is produced from two PCR reactions using two primers from genomic sequence of *Arabidopsis thaliana*. As described above, the particular template for generating the probe can be any desired template.

The first PCR product is assessed to validate the size of the primer to assure it is of the expected size. Then the product of the first PCR is used as a template, with the same pair of primers used in the first PCR, in a second PCR that produces a labeled product used as the probe.

Fragments detected by hybridization, or other bands of interest, can be isolated from gels used to separate genomic DNA fragments by known methods for further purification and/or characterization.

Buffers for Nuclear DNA Extraction
1. 10×HB

| 1000 ml | | |
|---|---|---|
| 40 mM spermidine | 10.2 g | Spermine (Sigma S-2876) and spermidine (Sigma S-2501) |
| 10 mM spermine | 3.5 g | Stabilize chromatin and the nuclear membrane |
| 0.1M EDTA (disodium) | 37.2 g | EDTA inhibits nuclease |
| 0.1M Tris | 12.1 g | Buffer |
| 0.8M KCl | 59.6 g | Adjusts ionic strength for stability of nuclei |

Adjust pH to 9.5 with 10 N NaOH. It appears that there is a nuclease present in leaves. Use of pH 9.5 appears to inactivate this nuclease.

2. 2 M sucrose (684 g per 1000 ml)
Heat about half the final volume of water to about 50° C. Add the sucrose slowly then bring the mixture to close to final volume; stir constantly until it has dissolved. Bring the solution to volume.

3. Sarkosyl solution (lyses nuclear membranes)

| 1000 ml | |
|---|---|
| N-lauroyl sarcosine (Sarkosyl) | 20.0 g |
| 0.1M Tris | 12.1 g |
| 0.04M EDTA (Disodium) | 14.9 g |

Adjust the pH to 9.5 after all the components are dissolved and bring up to the proper volume.

4. 20% TRITON® X-100
80 ml TRITON® X-100
320 ml 1×HB (w/o β-ME and PMSF)
Prepare in advance; TRITON® takes some time to dissolve A. Procedure
1. Prepare 1×"H" buffer (keep ice-cold during use)

| 1000 ml | |
|---|---|
| 10X HB | 100 ml |
| 2 M sucrose | 250 ml a non-ionic osmoticum |
| Water | 634 ml |
| Added just before use: | |
| 100 mM PMSF* | 10 ml a protease inhibitor; protects nuclear membrane proteins |
| β-mercaptoethanol | 1 ml inactivates nuclease by reducing disulfide bonds |

*100 mM PMSF (phenyl methyl sulfonyl fluoride, Sigma P-7626) (add 0.0875 g to 5 ml 100% ethanol)

2. Homogenize the tissue in a blender (use 300-400 ml of 1×HB per blender). Be sure that you use 5-10 ml of HB buffer per gram of tissue. Blenders generate heat so be sure to keep the homogenate cold. It is necessary to put the blender in ice periodically.

3. Add the 20% TRITON® X-100 (25 ml per liter of homogenate) and gently stir on ice for 20 min. This lyses plastid, but not nuclear, membranes.

4. Filter the tissue suspension through several nylon filters into an ice-cold beaker. The first filtration is through a 250-micron membrane; the second is through an 85-micron membrane; the third is through a 50-micron membrane; and the fourth is through a 20-micron membrane. Use a large funnel to hold the filters. Filtration can be sped up by gently squeezing the liquid through the filters.

5. Centrifuge the filtrate at 1200×g for 20 min. at 4° C. to pellet the nuclei.

6. Discard the dark green supernatant. The pellet will have several layers to it. One is starch; it is white and gritty. The nuclei are gray and soft. In the early steps, there may be a dark green and somewhat viscous layer of chloroplasts.

Wash the pellets in about 25 ml cold H buffer (with TRITON® X-100) and resuspend by swirling gently and pipetting. After the pellets are resuspended.

Pellet the nuclei again at 1200-1300×g. Discard the supernatant.

Repeat the wash 3-4 times until the supernatant has changed from a dark green to a pale green. This usually happens after 3 or 4 resuspensions. At this point, the pellet is typically grayish white and very slippery. The TRITON® X-100 in these repeated steps helps to destroy the chloroplasts and mitochondria that contaminate the prep.

Resuspend the nuclei for a final time in a total of 15 ml of H buffer and transfer the suspension to a sterile 125 ml Erlenmeyer flask.

7. Add 15 ml, dropwise, cold 2% Sarkosyl, 0.1 M Tris, 0.04 M EDTA solution (pH 9.5) while swirling gently. This lyses the nuclei. The solution will become very viscous.

8. Add 30 grams of CsCl and gently swirl at room temperature until the CsCl is in solution. The mixture will be gray, white and viscous.

9. Centrifuge the solution at 11,400×g at 4° C. for at least 30 min. The longer this spin is, the firmer the protein pellicle.

10. The result is typically a clear green supernatant over a white pellet, and (perhaps) under a protein pellicle. Carefully remove the solution under the protein pellicle and above the pellet. Determine the density of the solution by weighing 1 ml of solution and add CsCl if necessary to bring to 1.57 g/ml. The solution contains dissolved solids (sucrose etc) and the refractive index alone will not be an accurate guide to CsCl concentration.

11. Add 20 μl of 10 mg/ml EtBr per ml of solution.

12. Centrifuge at 184,000×g for 16 to 20 hours in a fixed-angle rotor.

13. Remove the dark red supernatant that is at the top of the tube with a plastic transfer pipette and discard. Carefully remove the DNA band with another transfer pipette. The DNA band is usually visible in room light; otherwise, use a long wave UV light to locate the band.

14. Extract the ethidium bromide with isopropanol saturated with water and salt. Once the solution is clear, extract at least two more times to ensure that all of the EtBr is gone. Be very gentle, as it is very easy to shear the DNA at this step. This extraction may take a while because the DNA solution tends to be very viscous. If the solution is too viscous, dilute it with TE.

15. Dialyze the DNA for at least two days against several changes (at least three times) of TE (10 mM Tris, 1 mM EDTA, pH 8) to remove the cesium chloride.
16. Remove the dialyzed DNA from the tubing. If the dialyzed DNA solution contains a lot of debris, centrifuge the DNA solution at least at 2500×g for 10 min. and carefully transfer the clear supernatant to a new tube. Read the A260 concentration of the DNA.
17. Assess the quality of the DNA by agarose gel electrophoresis (1% agarose gel) of the DNA. Load 50 ng and 100 ng (based on the OD reading) and compare it with known and good quality DNA. Undigested lambda DNA and a lambda-HindIII-digested DNA are good molecular weight makers.

Protocol for Digestion of Genomic DNA

Protocol:

1. The relative amounts of DNA for different crop plants that provide approximately a balanced number of genome equivalent is given in Table 3. Note that due to the size of the wheat genome, wheat DNA will be underrepresented. Lambda DNA provides a useful control for complete digestion.
2. Precipitate the DNA by adding 3 volumes of 100% ethanol. Incubate at −20° C. for at least two hours. Yeast DNA can be purchased and made up at the necessary concentration, therefore no precipitation is necessary for yeast DNA.
3. Centrifuge the solution at 11,400×g for 20 min. Decant the ethanol carefully (be careful not to disturb the pellet). Be sure that the residual ethanol is completely removed either by vacuum desiccation or by carefully wiping the sides of the tubes with a clean tissue.
4. Resuspend the pellet in an appropriate volume of water. Be sure the pellet is fully resuspended before proceeding to the next step. This may take about 30 min.
5. Add the appropriate volume of 10× reaction buffer provided by the manufacturer of the restriction enzyme to the resuspended DNA followed by the appropriate volume of enzymes. Be sure to mix it properly by slowly swirling the tubes.
6. Set-up the lambda digestion-control for each DNA that you are digesting.
7. Incubate both the experimental and lambda digests overnight at 37° C. Spin down condensation in a microfuge before proceeding.
8. After digestion, add 2 μl of loading dye (typically 0.25% bromophenol blue, 0.25% xylene cyanol in 15% Ficoll or 30% glycerol) to the lambda-control digests and load in 1% TPE-agarose gel (TPE is 90 mM Tris-phosphate, 2 mM EDTA, pH 8). If the lambda DNA in the lambda control digests are completely digested, proceed with the precipitation of the genomic DNA in the digests.
9. Precipitate the digested DNA by adding 3 volumes of 100% ethanol and incubating in −20° C. for at least 2 hours (preferably overnight).
   EXCEPTION: Arabidopsis and yeast DNA are digested in an appropriate volume; they don't have to be precipitated.
10. Resuspend the DNA in an appropriate volume of TE (e.g., 22 μl×50 blots=1100 μl) and an appropriate volume of 10× loading dye (e.g., 2.4 μl×50 blots=120 μl). Be careful in pipetting the loading dye—it is viscous. Be sure you are pipetting the correct volume.

TABLE 3

Some guide points in digesting genomic DNA.

| Species | Genome Size | | Size Relative to Arabidopsis | Genome Equivalent to 2 μg Arabidopsis DNA | Amount of DNA per blot |
|---|---|---|---|---|---|
| Arabidopsis | 120 | Mb | 1X | 1X | 2 μg |
| Brassica | 1,100 | Mb | 9.2X | 0.54X | 10 μg |
| Corn | 2,800 | Mb | 23.3X | 0.43X | 20 μg |
| Cotton | 2,300 | Mb | 19.2X | 0.52X | 20 μg |
| Oat | 11,300 | Mb | 94X | 0.11X | 20 μg |
| Rice | 400 | Mb | 3.3X | 0.75X | 5 μg |
| Soybean | 1,100 | Mb | 9.2X | 0.54X | 10 μg |
| Sugarbeet | 758 | Mb | 6.3X | 0.8X | 10 μg |
| Sweetclover | 1,100 | Mb | 9.2X | 0.54X | 10 μg |
| Wheat | 16,000 | Mb | 133X | 0.08X | 20 μg |
| Yeast | 15 | Mb | 0.12X | 1X | 0.25 μg |

Protocol for Southern Blot Analysis

The digested DNA samples are electrophoresed in 1% agarose gels in 1×TPE buffer. Low voltage; overnight separations are preferred. The gels are stained with EtBr and photographed.

1. For blotting the gels, first incubate the gel in 0.25 N HCl (with gentle shaking) for about 15 min.
2. Then briefly rinse with water. The DNA is denatured by 2 incubations. Incubate (with shaking) in 0.5 M NaOH in 1.5 M NaCl for 15 min.
3. The gel is then briefly rinsed in water and neutralized by incubating twice (with shaking) in 1.5 M Tris pH 7.5 in 1.5 M NaCl for 15 min.
4. A nylon membrane is prepared by soaking it in water for at least 5 min, then in 6×SSC for at least 15 min. before use. (20×SSC is 175.3 g NaCl, 88.2 g sodium citrate per liter, adjusted to pH 7.0.)
5. The nylon membrane is placed on top of the gel and all bubbles in between are removed. The DNA is blotted from the gel to the membrane using an absorbent medium, such as paper toweling and 6×SCC buffer. After the transfer, the membrane may be lightly brushed with a gloved hand to remove any agarose sticking to the surface.
6. The DNA is then fixed to the membrane by UV crosslinking and baking at 80° C. The membrane is stored at 4° C. until use.

B. Protocol for PCR Amplification of Genomic Fragments in Arabidopsis

Amplification Procedures:

1. Mix the following in a 0.20 ml PCR tube or 96-well PCR plate:

| Volume | Stock | Final Amount or Conc. |
|---|---|---|
| 0.5 μl | ~10 ng/μl genomic DNA[1] | 5 ng |
| 2.5 μl | 10× PCR buffer | 20 mM Tris, 50 mM KCl |
| 0.75 μl | 50 mM MgCl$_2$ | 1.5 mM |
| 1 μl | 10 pmol/μl Primer 1 (Forward) | 10 pmol |
| 1 μl | 10 pmol/μl Primer 2 (Reverse) | 10 pmol |
| 0.5 μl | 5 mM dNTPs | 0.1 mM |
| 0.1 μl | 5 units/μl Platinum Taq ™ (Life Technologies, Gaithersburg, MD) DNA Polymerase | 1 units |
| (to 25 μl) | Water | |

[1]Arabidopsis DNA is used in the present experiment, but the procedure is a general one.

2. The template DNA is amplified using a Perkin Elmer 9700 PCR machine:
1) 94° C. for 10 min. followed by

| 2)<br>5 cycles: | 3)<br>5 cycles: | 4)<br>25 cycles: |
|---|---|---|
| 94° C. - 30 sec | 94° C. - 30 sec | 94° C. - 30 sec |
| 62° C. - 30 sec | 58° C. - 30 sec | 53° C. - 30 sec |
| 72° C. - 3 min | 72° C. - 3 min | 72° C. - 3 min |

5) 72° C. for 7 min. Then the reactions are stopped by chilling to 4° C.

The procedure can be adapted to a multi-well format if necessary.

Quantification and Dilution of PCR Products:
1. The product of the PCR is analyzed by electrophoresis in a 1% agarose gel. A linearized plasmid DNA can be used as a quantification standard (usually at 50, 100, 200, and 400 ng). These will be used as references to approximate the amount of PCR products. HindIII-digested Lambda DNA is useful as a molecular weight marker. The gel can be run fairly quickly; e.g., at 100 volts. The standard gel is examined to determine that the size of the PCR products is consistent with the expected size and if there are significant extra bands or smeary products in the PCR reactions.
2. The amounts of PCR products can be estimated on the basis of the plasmid standard.
3. For the small number of reactions that produce extraneous bands, a small amount of DNA from bands with the correct size can be isolated by dipping a sterile 10-μl tip into the band while viewing though a UV Transilluminator. The small amount of agarose gel (with the DNA fragment) is used in the labeling reaction.

C. Protocol for PCR-Dig-Labeling of DNA
Solutions:
Reagents in PCR reactions (diluted PCR products, 10×PCR Buffer, 50 mM $MgCl_2$, 5 U/μl Platinum Taq Polymerase, and the primers)
10×dNTP+DIG-11-dUTP [1:5]: (2 mM dATP, 2 mM dCTP, 2 mM dGTP, 1.65 mM dTTP, 0.35 mM DIG-11-dUTP)
10×dNTP+DIG-11-dUTP [1:10]: (2 mM dATP, 2 mM dCTP, 2 mM dGTP, 1.81 mM dTTP, 0.19 mM DIG-11-dUTP)
10×dNTP+DIG-11-dUTP [1:15]: (2 mM dATP, 2 mM dCTP, 2 mM dGTP, 1.875 mM dTTP, 0.125 mM DIG-11-dUTP)
TE buffer (10 mM Tris, 1 mM EDTA, pH 8)
Maleate buffer: In 700 ml of deionized distilled water, dissolve 11.61 g maleic acid and 8.77 g NaCl. Add NaOH to adjust the pH to 7.5. Bring the volume to 1 L. Stir for 15 min. and sterilize.
10% blocking solution: In 80 ml deionized distilled water, dissolve 1.16 g maleic acid. Next, add NaOH to adjust the pH to 7.5. Add 10 g of the blocking reagent powder (Boehringer Mannheim, Indianapolis, Ind., Cat. no. 1096176). Heat to 60° C. while stirring to dissolve the powder. Adjust the volume to 100 ml with water. Stir and sterilize.
1% blocking solution: Dilute the 10% stock to 1% using the maleate buffer.
Buffer 3 (100 mM Tris, 100 mM NaCl, 50 mM $MgCl_2$, pH9.5). Prepared from autoclaved solutions of 1M Tris pH 9.5, 5 M NaCl, and 1 M $MgCl_2$ in autoclaved distilled water.

Procedure:
1. PCR reactions are performed in 25 μl volumes containing:

| | |
|---|---|
| PCR buffer | 1X |
| $MgCl_2$ | 1.5 mM |
| 10X dNTP + DIG-11-dUTP | 1X (please see the note below) |
| Platinum Taq ™ Polymerase | 1 unit |
| 10 pg probe DNA | |
| 10 pmol primer 1 | |

Note:

| | Use for: |
|---|---|
| 10X dNTP + DIG-11-dUTP (1:5) | <1 kb |
| 10X dNTP + DIG-11-dUTP (1:10) | 1 kb to 1.8 kb |
| 10X dNTP + DIG-11-dUTP (1:15) | >1.8 kb |

2. The PCR reaction uses the following amplification cycles:
1) 94° C. for 10 min.

| 2)<br>5 cycles: | 3)<br>5 cycles: | 4)<br>25 cycles: |
|---|---|---|
| 95° C. - 30 sec | 95° C. - 30 sec | 95° C. - 30 sec |
| 61° C. - 1 min | 59° C. - 1 min | 51° C. - 1 min |
| 73° C. - 5 min | 75° C. - 5 min | 73° C. - 5 min |

5) 72° C. for 8 min. The reactions are terminated by chilling to 4° C. (hold).
3. The products are analyzed by electrophoresis- in a 1% agarose gel, comparing to an aliquot of the unlabelled probe starting material.
4. The amount of DIG-labeled probe is determined as follows:
Make serial dilutions of the diluted control DNA in dilution buffer (TE: 10 mM Tris and 1 mM EDTA, pH 8) as shown in the following table:

| DIG-labeled control DNA starting conc. | Stepwise Dilution | Final Conc. (Dilution Name) |
|---|---|---|
| 5 ng/μl | 1 μl in 49 μl TE | 100 pg/μl (A) |
| 100 pg/μl (A) | 25 μl in 25 μl TE | 50 pg/μl (B) |
| 50 pg/μl (B) | 25 μl in 25 μl TE | 25 pg/μl (C) |
| 25 pg/μl (C) | 20 μl in 30 μl TE | 10 pg/μl (D) | a. Serial deletions of a DIG-labeled standard DNA ranging from 100 pg to 10 pg are spotted onto a positively charged nylon membrane, marking the membrane lightly with a pencil to identify each dilution.
b. Serial dilutions (e.g., 1:50, 1:2500, 1:10,000) of the newly labeled DNA probe are spotted.
c. The membrane is fixed by UV crosslinking.
d. The membrane is wetted with a small amount of maleate buffer and then incubated in 1% blocking solution for 15 min at room temp.
e. The labeled DNA is then detected using alkaline phosphatase conjugated anti-DIG antibody (Boehringer Mannheim, Indianapolis, Ind., cat. no. 1093274) and an NBT substrate according to the manufacture's instruction.
f. Spot intensities of the control and experimental dilutions are then compared to estimate the concentration of the PCR-DIG-labeled probe.

D. Prehybridization and Hybridization of Southern Blots

Solutions:

| 100% Formamide | purchased from Gibco |
| 20X SSC per L: | (1X = 0.15M NaCl, 0.015M Na₃citrate) 175 g NaCl 87.5 g Na₃citrate 2H₂0 |

20% Sarkosyl (N-lauroyl-sarcosine)
20% SDS (sodium dodecyl sulphate)
10% Blocking Reagent: In 80 ml deionized distilled water, dissolve 1.16 g maleic acid. Next, add NaOH to adjust the pH to 7.5. Add 10 g of the blocking reagent powder. Heat to 60° C. while stirring to dissolve the powder. Adjust the volume to 100 ml with water. Stir and sterilize.

Prehybridization Mix:

| Final Concentration | Components | Volume (per 100 ml) | Stock |
| --- | --- | --- | --- |
| 50% | Formamide | 50 ml | 100% |
| 5X | SSC | 25 ml | 20X |
| 0.1% | Sarkosyl | 0.5 ml | 20% |
| 0.02% | SDS | 0.1 ml | 20% |
| 2% | Blocking Reagent | 20 ml | 10% |
|  | Water | 4.4 ml |  |

General Procedures:
1. Place the blot in a heat-sealable plastic bag and add an appropriate volume of prehybridization solution (30 ml/100 cm$^2$) at room temperature. Seal the bag with a heat sealer, avoiding bubbles as much as possible. Lay down the bags in a large plastic tray (one tray can accommodate at least 4-5 bags). Ensure that the bags are lying flat in the tray so that the prehybridization solution is evenly distributed throughout the bag. Incubate the blot for at least 2 hours with gentle agitation using a waver shaker.
2. Denature DIG-labeled DNA probe by incubating for 10 min. at 98° C. using the PCR machine and immediately cool it to 4° C.
3. Add probe to prehybridization solution (25 ng/ml; 30 ml=750 ng total probe) and mix well but avoid foaming. Bubbles may lead to background.
4. Pour off the prehybridization solution from the hybridization bags and add new prehybridization and probe solution mixture to the bags containing the membrane.
5. Incubate with gentle agitation for at least 16 hours.
6. Proceed to medium stringency post-hybridization wash:
   Three times for 20 min. each with gentle agitation using 1×SSC, 1% SDS at 60° C.
   All wash solutions must be prewarmed to 60° C. Use about 100 ml of wash solution per membrane.
   To avoid background keep the membranes fully submerged to avoid drying in spots; agitate sufficiently to avoid having membranes stick to one another.
7. After the wash, proceed to immunological detection and CSPD development.

E. Procedure for Immunological Detection with CSPD

Solutions:

| Buffer 1: | Maleic acid buffer (0.1M maleic acid, 0.15M NaCl; adjusted to pH 7.5 with NaoH) |
| Washing buffer: | Maleic acid buffer with 0.3% (v/v) Tween 20. |
| Blocking stock solution | 10% blocking reagent in buffer 1. Dissolve (10X concentration): blocking reagent powder (Boehringer Mannheim, Indianapolis, IN, cat. no. 1096176) by constantly stirring on a 65° C. heating block or heat in a microwave, autoclave and store at 4° C. |
| Buffer 2 (1X blocking solution): | Dilute the stock solution 1:10 in Buffer 1. |
| Detection buffer: | 0.1M Tris, 0.1M NaCl, pH 9.5 |

Procedure:
1. After the post-hybridization wash the blots are briefly rinsed (1-5 min.) in the maleate washing buffer with gentle shaking.
2. Then the membranes are incubated for 30 min. in Buffer 2 with gentle shaking.
3. Anti-DIG-AP conjugate (Boehringer Mannheim, Indianapolis, Ind., cat. no. 1093274) at 75 mU/ml (1:10,000) in Buffer 2 is used for detection. 75 ml of solution can be used for 3 blots.
4. The membrane is incubated for 30 min. in the antibody solution with gentle shaking.
5. The membrane are washed twice in washing buffer with gentle shaking. About 250 mls is used per wash for 3 blots.
6. The blots are equilibrated for 2-5 min in 60 ml detection buffer.
7. Dilute CSPD (1:200) in detection buffer. (This can be prepared ahead of time and stored in the dark at 4° C.). The following steps must be done individually. Bags (one for detection and one for exposure) are generally cut and ready before doing the following steps.
8. The blot is carefully removed from the detection buffer and excess liquid removed without drying the membrane. The blot is immediately placed in a bag and 1.5 ml of CSPD solution is added. The CSPD solution can be spread over the membrane. Bubbles present at the edge and on the surface of the blot are typically removed by gentle rubbing. The membrane is incubated for 5 min. in CSPD solution.
9. Excess liquid is removed and the membrane is blotted briefly (DNA side up) on WHATMAN® 3MM paper. Do not let the membrane dry completely.
10. Seal the damp membrane in a hybridization bag and incubate for 10 min at 37° C. to enhance the luminescent reaction.
11. Expose for 2 hours at room temperature to X-ray film. Multiple exposures can be taken. Luminescence continues for at least 24 hours and signal intensity increases during the first hours.

Example 3

Microarray Experiments and Results

Example 3

Microarray Experiments and Results

1. Sample Tissue Preparation
(a) Roots
Seeds of *Arabidopsis thaliana* (Ws) were sterilized in full strength bleach for less than 5 min., washed more than 3 times in sterile distilled deionized water and plated on MS agar plates. The plates were placed at 4° C. for 3 nights and then placed vertically into a growth chamber having 16 hr light/8 hr dark cycles, 23° C., 70% relative humidity and ~11,000

LUX. After 2 weeks, the roots were cut from the agar, flash frozen in liquid nitrogen and stored at −80° C. (EXPT REP: 108439 and 108434)

(b) Root Hairless Mutants

Plants mutant at the rhl gene locus lack root hairs. This mutation is maintained as a heterozygote.

Seeds of *Arabidopsis thaliana* (Landsberg erecta) mutated at the rhl gene locus were sterilized using 30% bleach with 1 ul/ml 20% TRITON®-X 100 and then vernalized at 4° C. for 3 days before being plated onto GM agar plates. Plates were placed in growth chamber with 16 hr light/8 hr. dark, 23° C., 14,500-15,900 LUX, and 70% relative humidity for germination and growth.

After 7 days, seedlings were inspected for root hairs using a dissecting microscope. Mutants were harvested and the cotyledons removed so that only root tissue remained. Tissue was then flash frozen in liquid nitrogen and stored at −80 C. (EXPT REP: 108433)

*Arabidopsis thaliana* (Landsberg erecta) seedlings grown and prepared as above were used as controls. (EXPT REP: 108433)

Alternatively, seeds of *Arabidopsis thaliana* (Landsberg erecta), heterozygous for the rhl1 (root hairless) mutation, were surface-sterilized in 30% bleach containing 0.1% TRITON® X-100 and further rinsed in sterile water. They were then vernalized at 4° C. for 4 days before being plated onto MS agar plates. The plates were maintained in a growth chamber at 24° C. with 16 hr light/8 hr dark for germination and growth. After 10 days, seedling roots that expressed the phenotype (i.e. lacking root hairs) were cut below the hypocotyl junction, frozen in liquid nitrogen and stored at −80° C. Those seedlings with the normal root phenotype (heterozygous or wt) were collected as described for the mutant and used as controls.

(c) Rosette Leaves, Stems, and Siliques

*Arabidopsis thaliana* (Ws) seed was vernalized at 4° C. for 3 days before sowing in Metro-mix soil type 350. Flats were placed in a growth chamber having 16 hr light/8 hr dark, 80% relative humidity, 23° C. and 13,000 LUX for germination and growth. After 3 weeks, rosette leaves, stems, and siliques (see EXPT REP: 108436, 108437 and 108438) were harvested, flash frozen in liquid nitrogen and stored at −80° C. until use. After 4 weeks, siliques (<5 mm, 5-10 mm and >10 mm) were harvested, flash frozen in liquid nitrogen and stored at −80° C. until use. 5 week old whole plants (used as controls) were harvested, flash frozen in liquid nitrogen and kept at −80° C. until RNA was isolated.

(d) Trichomes

*Arabidopsis thaliana* (Colombia glabrous) inflorescences were used as a control and CS8143 (hairy inflorescence ecotype) inflorescences, having increased trichomes, were used as the experimental sample.

Approximately 10 µl of each type of seed was sown on a flat of 350 soil (containing 0.03% marathon) and vernalized at 4° C. for 3 days. Plants were then grown at room temperature under florescent lighting. Young inflorescences were collected at 30 days for the control plants and 37 days for the experimental plants. Each inflorescence was cut into one-half inch (½") pieces, flash frozen in liquid nitrogen and stored at −80° C. until RNA was isolated.

(e) Germination

*Arabidopsis thaliana* seeds (ecotype Ws) were sterilized in bleach and rinsed with sterile water. The seeds were placed in 100 mm petri plates containing soaked autoclaved filter paper. Plates were foil-wrapped and left at 4° C. for 3 nights to vernalize. After cold treatment, the foil was removed and plates were placed into a growth chamber having 16 hr light/8 hr dark cycles, 23° C., 70% relative humidity and ~11,000 lux. Seeds were collected 1 d (EXPT REP: 108461), 2 d (EXPT REP: 108462), 3 d (EXPT REP: 108463) and 4 d (EXPT REP: 108464) later, flash frozen in liquid nitrogen and stored at −80° C. until RNA was isolated.

(f) Shoot Apical Meristem

*Arabidopsis thaliana* (Landsberg erecta) plants mutant at the stm gene locus lack shoot meristems, produce aerial rosettes, have a reduced number of flowers per inflorescence, as well as a reduced number of petals, stamens and carpels, and is female sterile. This mutation is maintained as a heterozygote.

Seeds of *Arabidopsis thaliana* (Landsberg erecta) mutated at the stm locus were sterilized using 30% bleach with 1 ul/ml 20% TRITON®-X100. The seeds were vernalized at 4° C. for 3 days before being plated onto GM agar plates. Half were then put into a 22° C., 24 hr light growth chamber and half in a 24° C. 16 hr light/8 hr dark growth chamber having 14,500-15,900 LUX, and 70% relative humidity for germination and growth.

After 7 days, seedlings were examined for leaf primordia using a dissecting microscope. Presence of leaf primordia indicated a wild type phenotype. Mutants were selected based on lack of leaf primordia. Mutants were then harvested and hypocotyls removed leaving only tissue in the shoot region. Tissue was then flash frozen in liquid nitrogen and stored at −80° C.

Control tissue was isolated from 5 day old Landsberg erecta seedlings grown in the same manner as above. Tissue from the shoot region was harvested in the same manner as the stm tissue, but only contained material from the 24° C., 16 hr light/8 hr dark long day cycle growth chamber. (EXPT REP: 108453)

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 8 days. Seedlings were carefully removed from the sand and the outer layers of leaf shealth removed. About 2 mm sections were cut and flash frozen in liquid nitrogen prior to storage at −80° C. The tissues above the shoot apices (~1 cm long) were cut, treated as above and used as control tissue.

(g) Abscissic acid (ABA)

Seeds of *Arabidopsis thaliana* (ecotype Wassilewskija) were sown in trays and left at 4° C. for 4 days to vernalize. They were then transferred to a growth chamber having grown 16 hr light/8 hr dark, 13,000 LUX, 70% humidity, and 20° C. and watered twice a week with 1 L of 1× Hoagland's solution. Approximately 1,000 14 day old plants were spayed with 200-250 mls of 100 µM ABA in a 0.02% solution of the detergent SILWET L-77®. Whole seedlings, including roots, were harvested within a 15 to 20 minute time period at 1 hr and 6 hr after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 100 µM ABA for treatment. Control plants were treated with water. After 6 hr and 24 hr, aerial and root tissues were separated and flash frozen in liquid nitrogen prior to storage at −80° C.

(h) Auxin Responsive

Seeds of *Arabidopsis thaliana* (ecotype Wassilewskija) were sown in trays and left at 4° C. for 4 days to vernalize. They were then transferred to a growth chamber having 16 hr light/8 hr dark, 13,000 LUX, 70% humidity, 20° C. and watered twice a week with 1 L of 1× Hoagland's solution (recipe recited in Feldmann et al., (1987) Mol. Gen. Genet. 208: 1-9 and described as complete nutrient solution). Approximately 1,000 14 day old plants were spayed with 200-250 mls of 100 µM NAA in a 0.02% solution of the detergent SILWET L-77®. Aerial tissues (everything above the soil line) were harvested within a 15 to 20 minute time period 1 hr and 6 hrs after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 100 µM NAA for treatment. Control plants were treated with water. After 6 hr and 24 hr, aerial and root tissues were separated and flash frozen in liquid nitrogen prior to storage at −80° C.

(i) Cytokinin

Seeds of *Arabidopsis thaliana* (ecotype Wassilewskija) were sown in trays and left at 4° C. for 4 days to vernalize. They were then transferred to a growth chamber having 16 hr light/8 hr dark, 13,000 LUX, 70% humidity, 20° C. temperature and watered twice a week with 1 L of 1× Hoagland's solution. Approximately 1,000 14 day old plants were spayed with 200-250 mls of 100 µM BA in a 0.02% solution of the detergent SILWET L-77®. Aerial tissues (everything above the soil line) were harvested within a 15 to 20 minute time period 1 hr and 6 hrs after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 100 µM BA for treatment. Control plants were treated with water. After 6 hr, aerial and root tissues were separated and flash frozen in liquid nitrogen prior to storage at −80° C.

(j) Brassinosteroid Responsive

Two separate experiments were performed, one with epi-brassinolide and one with the brassinosteroid biosynthetic inhibitor brassinazole.

In the epi-brassinolide experiments, seeds of wild-type *Arabidopsis thaliana* (ecotype Wassilewskija) and the brassinosteroid biosynthetic mutant dwf4-1 were sown in trays and left at 4° C. for 4 days to vernalize. They were then transferred to a growth chamber having 16 hr light/8 hr dark, 11,000 LUX, 70% humidity and 22° C. temperature. Four week old plants were spayed with a 1 µM solution of epi-brassinolide and shoot parts (unopened floral primordia and shoot apical meristems) harvested three hours later. Tissue was flash-frozen in liquid nitrogen and stored at −80° C. (EXPT REP 108480)

In the brassinazole experiments, seeds of wild-type *Arabidopsis thaliana* (ecotype Wassilewskija) were grown as described above. Four week old plants were spayed with a 1 µM solution of brassinazole and shoot parts (unopened floral primordia and shoot apical meristems) harvested three hours later. Tissue was flash-frozen in liquid nitrogen and stored at −80° C. (EXPT REP 108481)

In addition to the spray experiments, tissue was prepared from two different mutants; (1) a dwf4-1 knock out mutant (EXPT REP: 108478) and (2) a mutant overexpressing the dwf4-1 gene (EXPT REP: 108479).

Seeds of wild-type *Arabidopsis thaliana* (ecotype Wassilewskija) and of the dwf4-1 knock out and overexpressor mutants were sown in trays and left at 4° C. for 4 days to vernalize. They were then transferred to a growth chamber having 16 hr light/8 hr dark, 11,000 LUX, 70% humidity and 22° C. temperature. Tissue from shoot parts (unopened floral primordia and shoot apical meristems) was flash-frozen in liquid nitrogen and stored at −80° C.

Another experiment was completed with seeds of *Arabidopsis thaliana* (ecotype Wassilewskija) were sown in trays and left at 4° C. for 4 days to vernalize. They were then transferred to a growth chamber. Plants were grown under long-day (16 hr light: 8 hr. dark) conditions, 13,000 LUX light intensity, 70% humidity, 20° C. temperature and watered twice a week with 1 L 1× Hoagland's solution (recipe recited in Feldmann et al., (1987) Mol. Gen. Genet. 208: 1-9 and described as complete nutrient solution). Approximately 1,000 14 day old plants were spayed with 200-250 mls of 0.1 µM Epi-Brassinolite in 0.02% solution of the detergent SILWET L-77®. At 1 hr. and 6 hrs. after treatment aerial tissues were harvested within a 15 to 20 minute time period and flash-frozen in liquid nitrogen.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 0.1 µM epi-brassinolide for treatment. Control plants were treated with distilled deionized water. After 24 hr, aerial and root tissues were separated and flash frozen in liquid nitrogen prior to storage at −80° C.

(k) Gibberillic Acid

Seeds of *Arabidopsis thaliana* (ecotype Wassilewskija) were sown in trays and left at 4° C. for 4 days to vernalize. They were then transferred to a growth chamber having 16 hr light/8 hr. dark, 13,000 LUX, 70% humidity, 20° C. and watered twice a week with 1 L of 1× Hoagland's solution. Approximately 1,000 14 day old plants were spayed with 200-250 mls of 100 µM gibberillic acid in a 0.02% solution of the detergent SILWET L-77®. At 1 hr. and 6 hrs. after treatment, aerial tissues (everything above the soil line) were harvested within a 15 to 20 minute time period, flash-frozen in liquid nitrogen and stored at −80° C.

Alternatively, seeds of *Arabidopsis thaliana* (ecotype Ws) were sown in Metro-mix soil type 350 and left at 4° C. for 3 days to vernalize. They were then transferred to a growth chamber having 16 hr light/8 hr dark, 13,000 LUX, 80% humidity, 20° C. temperature and watered every four days with 1.5 L water. 14 days after germination, plants were sprayed with 100 µM gibberillic acid or with water. Aerial tissues were harvested 1 hr (EXPT REP: 108484), 6 hrs (EXPT REP: 108485), 12 hrs (EXPT REP: 108486), and 24 hrs post-treatment, flash frozen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 100 µM gibberillic acid for treatment. Control plants were treated with water. After 1 hr, 6 hr and 12 hr, aerial and root tissues were separated and flash frozen in liquid nitrogen prior to storage at −80° C.

(1) Nitrogen: High to Low

Wild type *Arabidopsis thaliana* seeds (ecotype Ws) were surface sterilized with 30% CLOROX®, 0.1% TRITON® X-100 for 5 minutes. Seeds were then rinsed with 4-5 exchanges of sterile double distilled deionized water. Seeds were vernalized at 4° C. for 2-4 days in darkness. After cold treatment, seeds were plated on modified 1×MS media (without $NH_4NO_3$ or $KNO_3$), 0.5% sucrose, 0.5 g/L MES pH5.7, 1% phytagar and supplemented with $KNO_3$ to a final concentration of 60 mM (high nitrate modified 1×MS media). Plates were then grown for 7 days in a Percival growth chamber at 22° C. with 16 hr. light/8 hr dark.

Germinated seedlings were then transferred to a sterile flask containing 50 mL of high nitrate modified 1×MS liquid media. Seedlings were grown with mild shaking for 3 additional days at 22° C. in 16 hr. light/8 hr dark (in a Percival growth chamber) on the high nitrate modified 1×MS liquid media.

After three days of growth on high nitrate modified 1×MS liquid media, seedlings were transferred either to a new sterile flask containing 50 mL of high nitrate modified 1×MS liquid media or to low nitrate modified 1×MS liquid media (containing 20 □M $KNO_3$). Seedlings were grown in these media conditions with mild shaking at 22° C. in 16 hr light/8 hr dark for the appropriate time points and whole seedlings harvested for total RNA isolation via the TRIZOL® method (LifeTech.). The time points used for the microarray experiments were 10 min. (EXPT REP: 108454) and 1 hour (EXPT REP: 108455) time points for both the high and low nitrate modified 1×MS media.

Alternatively, seeds that were surface sterilized in 30% bleach containing 0.1% TRITON® X-100 and further rinsed in sterile water, were planted on MS agar, (0.5% sucrose) plates containing 50 mM $KNO_3$ (potassium nitrate). The seedlings were grown under constant light (3500 LUX) at 22° C. After 12 days, seedlings were transferred to MS agar plates containing either 1 mM $KNO_3$ or 50 mM $KNO_3$. Seedlings transferred to agar plates containing 50 mM $KNO_3$ were treated as controls in the experiment. Seedlings transferred to plates with 1 mM $KNO_3$ were rinsed thoroughly with sterile MS solution containing 1 mM $KNO_3$. There were ten plates per transfer. Root tissue was collected and frozen in 15 mL Falcon tubes at various time points which included 1 hour, 2 hours, 3 hours, 4 hours, 6 hours, 9 hours, 12 hours, 16 hours, and 24 hours.

Maize 35A19 Pioneer hybrid seeds were sown on flats containing sand and grown in a CONVIRON® growth chamber at 25° C., 16 hr light/8 hr dark, ~13,000 LUX and 80% relative humidity. Plants were watered every three days with double distilled deionized water. Germinated seedlings are allowed to grow for 10 days and were watered with high nitrate modified 1×MS liquid media (see above). On day 11, young corn seedlings were removed from the sand (with their roots intact) and rinsed briefly in high nitrate modified 1×MS liquid media. The equivalent of half a flat of seedlings were then submerged (up to their roots) in a beaker containing either 500 mL of high or low nitrate modified 1×MS liquid media (see above for details).

At appropriate time points, seedlings were removed from their respective liquid media, the roots separated from the shoots and each tissue type flash frozen in liquid nitrogen and stored at −80° C. This was repeated for each time point. Total RNA was isolated using the TRIZOL® method (see above) with root tissues only.

Corn root tissues isolated at the 4 hr and 16 hr time points were used for the microarray experiments. Both the high and low nitrate modified 1×MS media were used.

(m) Nitrogen: Low to High

*Arabidopsis thaliana* ecotype Ws seeds were sown on flats containing 4 L of a 1:2 mixture of Grace Zonolite vermiculite and soil. Flats were watered with 3 L of water and vernalized at 4° C. for five days. Flats were placed in a CONVIRON® growth chamber having 16 hr light/8 hr dark at 20° C., 80% humidity and 17,450 LUX. Flats were watered with approximately 1.5 L of water every four days. Mature, bolting plants (24 days after germination) were bottom treated with 2 L of either a control (100 mM mannitol pH 5.5) or an experimental (50 mM ammonium nitrate, pH 5.5) solution. Roots, leaves and siliques were harvested separately 30, 120 and 240 minutes after treatment, flash frozen in liquid nitrogen and stored at −80° C.

Hybrid maize seed (Pioneer hybrid 35A19) were aerated overnight in deionized water. Thirty seeds were plated in each flat, which contained 4 liters of Grace zonolite vermiculite. Two liters of water were bottom fed and flats were kept in a CONVIRON® growth chamber with 16 hr light/8 hr dark at 20° C. and 80% humidity. Flats were watered with 1 L of tap water every three days. Five day old seedlings were treated as described above with 2 L of either a control (100 mM mannitol pH 6.5) solution or 1 L of an experimental (50 mM ammonium nitrate, pH 6.8) solution. Fifteen shoots per time point per treatment were harvested 10, 90 and 180 minutes after treatment, flash frozen in liquid nitrogen and stored at −80° C.

Alternatively, seeds of *Arabidopsis thaliana* (ecotype Wassilewskija) were left at 4° C. for 3 days to vernalize. They were then sown on vermiculite in a growth chamber having 16 hours light/8 hours dark, 12,000-14,000 LUX, 70% humidity, and 20° C. They were bottom-watered with tap water, twice weekly. Twenty-four days old plants were sprayed with either water (control) or 0.6% ammonium nitrate at 4 µL/cm² of tray surface. Total shoots and some primary roots were cleaned of vermiculite, flash-frozen in liquid nitrogen and stored at −80° C.

(n) Methyl Jasmonate

Seeds of *Arabidopsis thaliana* (ecotype Wassilewskija) were sown in trays and left at 4° C. for 4 days to vernalize before being transferred to a growth chamber having 16 hr light/8 hr. dark, 13,000 LUX, 70% humidity, 20° C. temperature and watered twice a week with 1 L of a 1× Hoagland's solution. Approximately 1,000 14 day old plants were spayed with 200-250 mls of 0.001% methyl jasmonate in a 0.02% solution of the detergent SILWET L-77®. At 1 hr and 6 hrs after treatment, whole seedlings, including roots, were harvested within a 15 to 20 minute time period, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 0.001% methyl jasmonate for treatment. Control plants were treated with water. After 24 hr, aerial and root tissues were separated and flash frozen in liquid nitrogen prior to storage at −80° C.

(O) Salicylic Acid

Seeds of *Arabidopsis thaliana* (ecotype Wassilewskija) were sown in trays and left at 4° C. for 4 days to vernalize before being transferred to a growth chamber having 16 hr light/8 hr. dark, 13,000 LUX, 70% humidity, 20° C. temperature and watered twice a week with 1 L of a 1× Hoagland's solution. Approximately 1,000 14 day old plants were spayed with 200-250 mls of 5 mM salicylic acid (solubilized in 70% ethanol) in a 0.02% solution of the detergent SILWET L-77®. At 1 hr and 6 hrs after treatment, whole seedlings, including roots, were harvested within a 15 to 20 minute time period flash-frozen in liquid nitrogen and stored at −80° C.

Alternatively, seeds of wild-type *Arabidopsis thaliana* (ecotype Columbia) and mutant CS3726 were sown in soil type 200 mixed with osmocote fertilizer and Marathon insecticide and left at 4° C. for 3 days to vernalize. Flats were incubated at room temperature with continuous light. Sixteen days post germination plants were sprayed with 2 mM SA, 0.02% SilwettL-77 or control solution (0.02% SilwettL-77. Aerial parts or flowers were harvested 1 hr (EXPT REP: 108471 and 108472), 4 hr (EXPT REP: 108469 and 108470), 6 hr (EXPT REP: 108440,) 24 hr (EXPT REP: 108443, 107953 and 107960) and 3 weeks (EXPT REP: 108475, 108476) post-treatment flash frozen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 2 mM SA for treatment. Control plants were treated with water. After 12 hr and 24 hr, aerial and root tissues were separated and flash frozen in liquid nitrogen prior to storage at −80° C.

(P) Wounding

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 70% humidity and 20° C. After 14 days, the leaves were wounded with forceps. Aerial tissues were harvested 1 hour and 6 hours after wounding. Aerial tissues from unwounded plants served as controls. Tissues were flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were wounded (one leaf nicked by scissors) and placed in 1-liter beakers of water for treatment. Control plants were treated not wounded. After 1 hr and 6 hr aerial and root tissues were separated and flash frozen in liquid nitrogen prior to storage at −80° C.

(q) Drought Stress

Seeds of *Arabidopsis thaliana* (Wassilewskija) were sown in pots and left at 4° C. for three days to vernalize before being transferred to a growth chamber having 16 hr light/8 hr dark, 150,000-160,000 LUX, 20° C. and 70% humidity. After 14 days, aerial tissues were cut and left to dry on 3MM WHATMAN® paper in a petri-plate for 1 hour and 6 hours. Aerial tissues exposed for 1 hour and 6 hours to 3 MM WHATMAN® paper wetted with 1× Hoagland's solution served as controls. Tissues were harvested, flash-frozen in liquid nitrogen and stored at −80° C.

Alternatively, *Arabidopsis thaliana* (Ws) seed was vernalized at 4° C. for 3 days before sowing in Metromix soil type 350. Flats were placed in a growth chamber with 23° C., 16 hr light/8 hr. dark, 80% relative humidity, ~13,000 LUX for germination and growth. Plants were watered with 1-1.5 L of water every four days. Watering was stopped 16 days after germination for the treated samples, but continued for the control samples. Rosette leaves and stems (EXPT REP 108477, 108482 and 108483), flowers (see EXPT REP: 108473, 108474) and siliques were harvested 2 d, 3 d, 4 d, 5 d, 6 d and 7 d (EXPT REP: 108473) after watering was stopped. Tissue was flash frozen in liquid nitrogen and kept at −80° C. until RNA was isolated. Flowers and siliques were also harvested on day 8 from plants that had undergone a 7 d drought treatment followed by 1 day of watering (EXPT REP: 108474). Control plants (whole plants) were harvested after 5 weeks, flash frozen in liquid nitrogen and stored as above.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in empty 1-liter beakers at room temperature for treatment. Control plants were placed in water. After 1 hr, 6 hr, 12 hr and 24 hr aerial and root tissues were separated and flash frozen in liquid nitrogen prior to storage at −80° C.

(R) Osmotic Stress

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C., and 70% humidity. After 14 days, the aerial tissues were cut and placed on 3 MM WHATMAN® paper in a petri-plate wetted with 20% PEG (polyethylene glycol-$M_r$ 8,000) in 1× Hoagland's solution. Aerial tissues on 3 MM WHATMAN® paper containing 1× Hoagland's solution alone served as the control. Aerial tissues were harvested at 1 hour and 6 hours after treatment, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 20% PEG (polyethylene glycol-$M_r$ 8,000) for treatment. Control plants were treated with water. After 1 hr and 6 hr aerial and root tissues were separated and flash frozen in liquid nitrogen prior to storage at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 150 mM NaCl for treatment. Control plants were treated with water. After 1 hr, 6 hr, and 24 hr aerial and root tissues were separated and flash frozen in liquid nitrogen prior to storage at −80° C.

(S) Heat Shock Treatment

Seeds of *Arabidopsis thaliana* (Wassilewskija) were sown in trays and left at 4° C. for three days to vernalize before being transferred to a growth chamber with 16 hr light/8 hr dark, 12,000-14,000 LUX, 70% humidity and 20° C., fourteen day old plants were transferred to a 42° C. growth chamber and aerial tissues were harvested 1 hr and 6 hr after transfer. Control plants were left at 20° c. and aerial tissues were harvested. Tissues were flashfrozen in liquid nitrogen and stored at −80° c.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers containing 42° C. water for treatment. Control plants were treated with water at 25° C. After 1 hr and 6 hr aerial and root tissues were separated and flash frozen in liquid nitrogen prior to storage at −80° C.

(T) Cold Shock Treatment

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C. and 70% humidity. Fourteen day old plants were transferred to a 4° C. dark growth chamber and aerial tissues were harvested 1 hour and 6 hours later. Control plants were maintained at 20° C. and covered with foil to avoid exposure to light. Tissues were flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers containing 4° C. water for treatment. Control plants were treated with water at 25° C. After 1 hr and 6 hr aerial and root tissues were separated and flash frozen in liquid nitrogen prior to storage at −80° C.

(U) Oxidative Stress-Hydrogen Peroxide Treatment

Seeds of *Arabidopsis thaliana* (Wassilewskija) were sown in trays and left at 4° C. for three days to vernalize. Before being transferred to a growth chamber having 16 hr light/8 hr dark, 12,000-14,000 LUX, 20° C. and 70% humidity. Fourteen day old plants were sprayed with 5 mM $H_2O_2$ (hydrogen peroxide) in a 0.02% Silwett L-77 solution. Control plants were sprayed with a 0.02% Silwett L-77 solution. Aerial tissues were harvested 1 hour and 6 hours after spraying, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 5 mM $H_2O_2$ for treatment. Control plants were treated with water. After 1 hr, 6 hr and 24 hr, aerial and root tissues were separated and flash frozen in liquid nitrogen prior to storage at −80° C.

(V) Nitric Oxide Treatment

Seeds of *Arabidopsis thaliana* (Wassilewskija) were sown in trays and left at 4° C. for three days to vernalize before being transferred to a growth chamber having 16 hr light/8 hr dark, 12,000-14,000 LUX, 20° C. and 70% humidity. Fourteen day old plants were sprayed with 5 mM sodium nitroprusside in a 0.02% Silwett L-77 solution. Control plants were sprayed with a 0.02% Silwett L-77 solution. Aerial tissues were harvested 1 hour and 6 hours after spraying, flash-frozen in liquid nitrogen and stored at −80° C.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 7 days. Seedlings were carefully removed from the sand and placed in 1-liter beakers with 5 mM nitroprusside for treatment. Control plants were treated with water. After 1 hr, 6 hr and 12 hr, aerial and root tissues were separated and flash frozen in liquid nitrogen prior to storage at −80° C.

(w) S4 Immature Buds, Inflorescence Meristem

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. Inflorescences containing immature floral buds [stages 1-12; Smyth et al., 1990] as well as the inflorescence meristem were harvested and flash frozen in liquid nitrogen.

(x) S5 Flowers (Opened)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. Mature, unpollinated flowers [stages 12-14; Smyth et al. 1990] were harvested and flash frozen in liquid nitrogen.

(y) S6 Siliques (All Stages)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. Siliques bearing developing seeds containing post fertilization through pre-heart stage [0-72 hours after fertilization (HAF)], heart-through early curled cotyledon stage [72-120 HAF] and late-curled cotyledon stage [>120 HAF] embryos were harvested separately and pooled prior to RNA isolation in a mass ratio of 1:1:1. The tissues were then flash frozen in liquid nitrogen. Description of the stages of *Arabidopsis* embryogenesis used were reviewed by Bowman (1994).

(Z) *Arabidopsis* Endosperm mea/mea Fruits 0-10 mm

Seeds of *Arabidopsis thaliana* heterozygous for the fertilization-independent endosperm1 (fie1) [Ohad et al., 1996; ecotype Landsberg erecta (Ler)] were sown in pots and left at 4° C. for two to three days to vernalize. Kiyo sue et al. (1999) subsequently determined that fie1 was allelic to the gametophytic maternal effect mutant medea (Grossniklaus et al., 1998). Imbibed seeds were then transferred to a growth chamber. Plants were grown under long-day (16 hr light: 8 hr dark) conditions, 7000-8000 LUX light intensity, 70% humidity, and 22° C. temperature. 1-2 siliques (fruits) bearing developing seeds just prior to dessication [9 days after flowering (DAF)] were selected from each plant and were hand-dissected to identify wild-type, mea/+ heterozygotes, and mea/mea homozygous mutant plants. At this stage, homozygous mea/mea plants produce short siliques that contain >70% aborted seed and can be distinguished from those produced by wild-type (100% viable seed) and mea/+ heterozygous (50% viable seed) plants (Ohad et al., 1996; Grossniklaus et al., 1998; Kiyosue et al., 1999). Siliques 0-10 mm in length containing developing seeds 0-9 DAF produced by homozygous mea/mea plants were harvested and flash frozen in liquid nitrogen.

Pods 0-10 mm (Control Tissue for Sample 70)

Seeds of *Arabidopsis thaliana* heterozygous for the fertilization-independent endosperm1 (fie1) [Ohad et al., 1996; ecotype Landsberg erecta (Ler)] were sown in pots and left at 4° C. for two to three days to vernalize. Kiyo sue et al. (1999) subsequently determined that fie1 was allelic to the gametophytic maternal effect mutant medea (Grossniklaus et al., 1998). Imbibed seeds were then transferred to a growth chamber. Plants were grown under long-day (16 hr light: 8 hr dark) conditions, 7000-8000 LUX light intensity, 70% humidity, and 22° C. temperature. 1-2 siliques (fruits) bearing developing seeds just prior to dessication [9 days after flowering (DAF)] were selected from each plant and were hand-dissected to identify wild-type, mea/+ heterozygotes, and mea/mea homozygous mutant plants. At this stage, homozygous mea/mea plants produce short siliques that contain >70% aborted seed and can be distinguished from those produced by wild-type (100% viable seed) and mea/+ heterozygous (50% viable seed) plants (Ohad et al., 1996; Grossniklaus et al., 1998; Kiyosue et al., 1999). Siliques 0-10 mm in length containing developing seeds 0-9 DAF produced by segregating wild-type plants were opened and the seeds removed. The remaining tissues (pods minus seed) were harvested and flash frozen in liquid nitrogen.

(Aa) *ARABIDOPSIS* SEEDS

Fruits (Pod+Seed) 0-5 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques 0-5 mm in length containing post fertilization through pre-heart stage [0-72 hours after fertilization (HAP)] embryos were harvested and flash frozen in liquid nitrogen.

Fruits(Pod+Seed) 5-10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques 5-10 mm in length containing heart-through early upturned-U-stage [72-120 hours after fertilization (HAF)] embryos were harvested and flash frozen in liquid nitrogen.

Fruits(Pod+Seed)>10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Siliques >10 mm in length containing green, late upturned-U-stage [>120 hours after fertilization (HAF)-9 days after flowering (DAF)] embryos were harvested and flash frozen in liquid nitrogen.

Green Pods 5-10 mm (Control Tissue for Samples 72-74)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques 5-10 mm in length containing developing seeds 72-120 hours after fertilization (HAF)] were opened and the seeds removed. The remaining tissues (green pods minus seed) were harvested and flash frozen in liquid nitrogen.

Green Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques >10 mm in length containing developing seeds up to 9 days after flowering (DAF)] were opened and the seeds removed and harvested and flash frozen in liquid nitrogen.

Brown Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Yellowing siliques >10 mm in length containing brown, dessicating seeds >11 days after flowering (DAF)] were opened and the seeds removed and harvested and flash frozen in liquid nitrogen.

Green/Brown Seeds from Fruits >10 mm

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature. 3-4 siliques (fruits) bearing developing seeds were selected from at least 3 plants and were hand-dissected to determine what developmental stage(s) were represented by the enclosed embryos. Description of the stages of *Arabidopsis* embryogenesis used in this determination were summarized by Bowman (1994). Silique lengths were then determined and used as an approximate determinant for embryonic stage. Green siliques >10 mm in length containing both green and brown seeds >9 days after flowering (DAF)] were opened and the seeds removed and harvested and flash frozen in liquid nitrogen.

Mature Seeds (24 Hours after Imbibition)

Mature dry seeds of *Arabidopsis thaliana* (ecotype Wassilewskija) were sown onto moistened filter paper and left at 4° C. for two to three days to vernalize. Imbibed seeds were then transferred to a growth chamber [16 hr light: 8 hr dark conditions, 7000-8000 LUX light intensity, 70% humidity, and 22° C. temperature], the emerging seedlings harvested after 48 hours and flash frozen in liquid nitrogen.

Mature Seeds (Dry)

Seeds of *Arabidopsis thaliana* (ecotype Wassilewskija) were sown in pots and left at 4° C. for two to three days to vernalize. They were then transferred to a growth chamber. Plants were grown under long-day (16 hr light: 8 hr dark) conditions, 7000-8000 LUX light intensity, 70% humidity, and 22° C. temperature and taken to maturity. Mature dry seeds are collected, dried for one week at 28° C., and vernalized for one week at 4° C. before used as a source of RNA.

Ovules

Seeds of *Arabidopsis thaliana* heterozygous for pistillata (pi) [ecotype Landsberg erecta (Ler)] were sown in pots and left at 4° C. for two to three days to vernalize. They were then transferred to a growth chamber. Plants were grown under long-day (16 hr light: 8 hr dark) conditions, 7000-8000 LUX light intensity, 76% humidity, and 24° C. temperature. Inflorescences were harvested from seedlings about 40 days old. The inflorescences were cut into small pieces and incubated in the following enzyme solution (pH 5) at room temperature for 0.5-1 hr.: 0.2% pectolyase Y-23, 0.04% pectinase, 5 mM MES, 3% Sucrose and MS salts (1900 mg/l $KNO_3$, 1650 mg/l $NH_4NO_3$, 370 mg/l $MgSO_4.7\ H_2O$, 170 mg/l $KH_2PO_4$, 440 mg/l $CaCl_2.\ 2\ H_2O$, 6.2 mg/l $H_3BO_3$, 15.6 mg/l $MnSO_4.4\ H_2O$, 8.6 mg/l $ZnSO_4.7\ H_2O$, 0.25 mg/l $NaMoO_4.\ 2\ H_2O$, 0.025 mg/l $CuCO_4.5\ H_2O$, 0.025 mg/l $CoCl_2.6\ H_2O$, 0.83 mg/l KI, 27.8 mg/l $FeSO_4.\ 7\ H_2O$, 37.3 mg/l Disodium EDTA, pH 5.8). At the end of the incubation the mixture of inflorescence material and enzyme solution was passed through a size 60 sieve and then through a sieve with a pore size of 125 μm. Ovules greater than 125 μm in diameter were collected, rinsed twice in B5 liquid medium (2500 mg/l $KNO_3$, 250 mg/l $MgSO_4.7\ H_2O$, 150 mg/l $NaH2PO_4.H_2O$, 150 mg/l $CaCl_2.2\ H_2O$, 134 mg/l $(NH4)2\ CaCl_2.SO_4$, 3 mg/l $H_3BO_3$, 10 mg/l $MnSO_4.4\ H_2O$, 2 $ZnSO_4.7\ H_2O$, 0.25 mg/l $NaMoO_4.2\ H_2O$, 0.025 mg/l $CuCO_4.5\ H_2O$, 0.025 mg/l $CoCl_2.6\ H_2O$, 0.75 mg/l KI, 40 mg/l EDTA sodium ferric salt, 20 g/l sucrose, 10 mg/l Thiamine hydrochloride, 1 mg/l Pyridoxine hydrochloride, 1 mg/l Nicotinic acid, 100 mg/l myo-inositol, pH 5.5)), rinsed once in deionized water and flash frozen in liquid nitrogen. The supernatant from the 125 μm sieving was passed through subsequent sieves of 50 μm and 32 μm. The tissue retained in the 32 μm sieve was collected and mRNA prepared for use as a control.

(bb) Herbicide Treatment

*Arabidopsis thaliana* (Ws) seeds were sterilized for 5 min. with 30% bleach, 50 μl TRITON® in a total volume of 50 ml. Seeds were vernalized at 4° C. for 3 days before being plated onto GM agar plates at a density of about 144 seeds per plate. Plates were incubated in a Percival growth chamber having 16 hr light/8 hr dark, 80% relative humidity, 22° C. and 11,000 LUX for 14 days.

Plates were sprayed (~0.5 mls/plate) with water, Finale (1.128 g/L), GLEAN® (1.88 g/L), ROUNDUP® (0.01 g/L) or Trimec (0.08 g/L). Tissue was collected and flash frozen in liquid nitrogen at the following time points: 0, 1, 2, 4 (EXPT REP: 107871 (Finale), 107881 (GLEAN®), 107896 (ROUNDUP) and 107886 (Trimec)), 8, 12(EXPT REP: 108467 (Finale), 108468 (GLEAN®), 108465 (ROUNDUP) and 108466, 107891 (Trimec)), and 24 hours. Frozen tissue was stored at −80° C. prior to RNA isolation.

(cc) Ap2

Seeds of *Arabidopsis thaliana* (ecotype Landesberg erecta) and floral mutant apetala2 (Jofuku et al., 1994, Plant Cell 6:1211-1225) were sown in pots and left at 4° C. for two to three days to vernalize. They were then transferred to a growth chamber. Plants were grown under long-day (16 hr light, 8 hr dark) conditions 7000-8000 LUX light intensity, 70% humidity and 22° C. temperature. Inflorescences containing immature floral buds (stages 1-7; Bowman, 1994) as well as the inflorescence meristem were harvested and flash-frozen. Polysomal polyA+RNA was isolated from tissue according to Cox and Goldberg, 1988).

(dd) Protein Degradation

*Arabidopsis thaliana* (ecotype Ws) wild-type and 13B12-1 (homozygous) mutant seed were sown in pots containing Metro-mix 350 soil and incubated at 4° C. for four days. Vernalized seeds were germinated in the greenhouse (16 hr light/8 hr dark) over a 7 day period. Mutant seedlings were sprayed with 0.02% (active ingredient) Finale to confirm their transgenic standing. Plants were grown until the mutant phenotype (either multiple pistils in a single flower and/or multiple branching per node) was apparent. Young inflorescences immediately forming from the multiple-branched stems were cut and flash frozen in liquid nitrogen. Young inflorescences from wild-type plants grown in parallel and under identical conditions were collected as controls. All collected tissue was stored at −80° C. until RNA isolation. (EXPT REP 108451)

(ee) Root Tips

Seeds of *Arabidopsis thaliana* (ecotye Ws) were placed on MS plates and vernalized at 4° C. for 3 days before being placed in a 25° C. growth chamber having 16 hr light/8 hr dark, 70% relative humidity and about 3 W/m². After 6 days, young seedlings were transferred to flasks containing B5 liquid medium, 1% sucrose and 0.05 mg/l indole-3-butyric acid. Flasks were incubated at room temperature with 100 rpm agitation. Media was replaced weekly. After three weeks, roots were harvested and incubated for 1 hr with 2% pectinase, 0.2% cellulase, pH 7 before straining through a #80 (Sigma) sieve. The root body material remaining on the sieve (used as the control) was flash frozen and stored at −80° C. until use. The material that passed through the #80 sieve was strained through a #200 (Sigma) sieve and the material remaining on the sieve (root tips) was flash frozen and stored at −80° C. until use. Approximately 10 mg of root tips were collected from one flask of root culture.

Seeds of maize hybrid 35A (Pioneer) were sown in water-moistened sand in flats (10 rows, 5-6 seed/row) and covered with clear, plastic lids before being placed in a growth chamber having 16 hr light (25° C.)/8 hr dark (20° C.), 75% relative humidity and 13,000-14,000 LUX. Covered flats were watered every three days for 8 days. Seedlings were carefully removed from the sand and the root tips (~2 mm long) were removed and flash frozen in liquid nitrogen prior to storage at −80° C. The tissues above the root tips (~1 cm long) were cut, treated as above and used as control tissue.

(ff) rt1

The rt1 allele is a variation of rt1 rootless1 and is recessive. Plants displaying the rt1 phenotype have few or no secondary roots.

Seed from plants segregating for rt1 were sown on sand and placed in a growth chamber having 16 hr light/8 hr dark, 13,000 LUX, 70% humidity and 20° C. temperature. Plants were watered every three days with tap water. Eleven (11) day old seedlings were carefully removed from the sand, keeping the roots intact. rd-type seedlings were separated from their wild-type counterparts and the root tissue isolated. Root tissue from normal seedlings (control) and rt1 mutants were flash frozen in liquid nitrogen and stored at −80° C. until use.

(gg) Imbibed Seed

Seeds of maize hybrid 35A (Pioneer) were sown in water-moistened sand in covered flats (10 rows, 5-6 seed/row) and covered with clear, plastic lids before being placed in a growth chamber having 16 hr light (25° C.)/8 hr dark (20° C.), 75% relative humidity and 13,000-14,000 LUX. One day after sowing, whole seeds were flash frozen in liquid nitrogen prior to storage at −80° C. Two days after sowing, embryos and endosperm were isolated and flash frozen in liquid nitrogen prior to storage at −80° C. On days 3-6, aerial tissues, roots and endosperm were isolated and flash frozen in liquid nitrogen prior to storage at −80° C.

(hh) Rough Sheath2-R (rs2-R) Mutants (1400-6/S-17)

This experiment was conducted to identify abnormally expressed genes in the shoot apex of rough sheath2-R (rs2-R) mutant plants. rs2 encodes a myb domain DNA binding protein that functions in repression of several shoot apical meristem expressed homeobox genes. Two homeobox gene targets are known for rs2 repression, rough sheath1, liguleless 3. The recessive loss of function phenotype of rs2-R homozygous plants is described in Schneeberger et al. 1998 *Development* 125: 2857-2865.

The seed stock genetically segregates 1:1 for rs2-R/rs2-R: rs2-R/+

Preparation of tissue samples: 160 seedlings pooled from 2 and 3 week old plants grown in sand. Growth conditions; CONVIRON® #107 @ 12 hr days/12 hr night, 25° C., 75% humidity. Shoot apex was dissected to include leaf three and older. (Pictures available upon request).
1) rough sheath2-R homozygous (mutant) shoot apex
2) rough sheath2-R heterozygous (wt, control) shoot apex (ii) Leaf Mutant 3642:

Mutant 3642 is a recessive mutation that causes abnormal leaf development. The leaves of mutant 3642 plants are characterized by leaf twisting and irregular leaf shape. Mutant 3642 plants also exhibit abnormally shaped floral organs which results in reduced fertility.

Seed segregating for the mutant phenotype was sown in Metro-mix 350 soil and grown in a CONVIRON® growth chamber with watering by sub-irrigation twice a week. Environmental conditions were set at 20 degrees Celsius, 70% humidity with an 8 hour day, 16 hour night light regime. Plants were harvested after 4 weeks of growth and the entire aerial portion of the plant was harvested and immediately frozen in liquid nitrogen and stored at −80 C. Mutant phenotype plants were harvested separately from normal phenotype plants, which serve as the control tissue.

(jj) Flowers (Green, White or Buds)

Approximately 10 μl of *Arabidopsis thaliana* seeds (ecotype Ws) were sown on 350 soil (containing 0.03% marathon) and vernalized at 4 C for 3 days. Plants were then grown at room temperature under fluorescent lighting until flowering. Flowers were harvested after 28 days in three different categories. Buds that had not opened at all and were completely green were categorized as "flower buds" (also referred to as green buds by the investigator). Buds that had started to open, with white petals emerging slightly were categorized as "green flowers" (also referred to as white buds by the investigator). Flowers that had opened mostly (with no silique elongation) with white petals completely visible were categorized as "white flowers" (also referred to as open flowers by the investigator). Buds and flowers were harvested with forceps, flash frozen in liquid nitrogen and stored at −80 C until RNA was isolated.

2. Microarray Hybridization Procedures

Microarray technology provides the ability to monitor mRNA transcript levels of thousands of genes in a single experiment. These experiments simultaneously hybridize two differentially labeled fluorescent cDNA pools to glass slides that have been previously spotted with cDNA clones of the same species. Each arrayed cDNA spot will have a corresponding ratio of fluorescence that represents the level of disparity between the respective mRNA species in the two sample pools. Thousands of polynucleotides can be spotted on one slide, and each experiment generates a global expression pattern.

Coating Slides

The microarray consists of a chemically coated microscope slide, referred herein as a "chip" with numerous polynucleotide samples arrayed at a high density. The poly-L-lysine coating allows for this spotting at high density by providing a hydrophobic surface, reducing the spreading of spots of DNA solution arrayed on the slides. Glass microscope slides (Gold Seal #3010 manufactured by Gold Seal Products, Portsmouth, N.H., USA) were coated with a 0.1% W/V solution of Poly-L-lysine (Sigma, St. Louis, Mo.) using the following protocol:

1. Slides were placed in slide racks (Shandon Lipshaw #121). The racks were then put in chambers (Shandon Lipshaw #121).
2. Cleaning solution was prepared:
    70 g NaOH was dissolved in 280 mL ddH2O.
    420 mL 95% ethanol was added. The total volume was 700 mL (=2×350 mL); it was stirred until completely mixed.
    If the solution remained cloudy, ddH$_2$O was added until clear.
3. The solution was poured into chambers with slides; the chambers were covered with glass lids. The solution was mixed on an orbital shaker for 2 hr.
4. The racks were quickly transferred to fresh chambers filled with ddH$_2$O. They were rinsed vigorously by plunging racks up and down.
    Rinses were repeated 4× with fresh ddH$_2$O each time, to remove all traces of NaOH-ethanol.
5. Polylysine solution was prepared:
    0 mL poly-L-lysine+70 mL tissue culture PBS in 560 mL water, using plastic graduated cylinder and beaker.
6. Slides were transferred to polylysine solution and shaken for 1 hr.
7. The rack was transferred to a fresh chambers filled with ddH$_2$O. It was plunged up and down 5× to rinse.

8. The slides were centrifuged on microtiter plate carriers (paper towels were placed below the rack to absorb liquid) for 5 min. @ 500 rpm. The slide racks were transferred to empty chambers with covers.
9. Slide racks were dried in a 45 C oven for 10 min.
10. The slides were stored in a closed plastic slide box.
11. Normally, the surface of lysine coated slides was not very hydrophobic immediately after this process, but became increasingly hydrophobic with storage. A hydrophobic surface helped ensure that spots didn't run together while printing at high densities. After they aged for 10 days to a month the slides were ready to use. However, coated slides that have been sitting around for long periods of time were usually too old to be used. This was because they developed opaque patches, visible when held to the light, and these resulted in high background hybridization from the fluorescent probe.

Alternatively, precoated glass slides were purchased from TeleChem International, Inc. (Sunnyvale, Calif., 94089; catalog number SMM-25, Superamine substrates).

PCR Amplification of cDNA Clone Inserts

Polynucleotides were amplified from *Arabidopsis* cDNA clones using insert specific probes. The resulting 100 uL PCR reactions were purified with QIAQUICK® 96 PCR purification columns (Qiagen, Valencia, Calif., USA) and eluted in 30 uL of 5 mM Tris. 8.5 uL of the elution were mixed with 1.5 uL of 20×SSC to give a final spotting solution of DNA in 3×SSC. The concentrations of DNA generated from each clone varied between 10-100 ng/ul, but were usually about 50 ng/ul.

Arraying of PCR Products on Glass Slides

PCR products from cDNA clones were spotted onto the poly-L-Lysine coated glass slides using an arrangement of quill-tip pins (ChipMaker 3 spotting pins; Telechem, International, Inc., Sunnyvale, Calif., USA) and a robotic arrayer (PixSys 3500, Cartesian Technologies, Irvine, Calif., USA). Around 0.5 nl of a prepared PCR product was spotted at each location to produce spots with approximately 100 um diameters. Spot center-to-center spacing was from 180 um to 210 um depending on the array. Printing was conducted in a chamber with relative humidity set at 50%.

Slides containing maize sequences were purchased from Agilent Technology (Palo Alto, Calif. 94304).

Post-Processing of Slides

After arraying, slides were processed through a series of steps—rehydration, UV cross-linking, blocking and denaturation—required prior to hybridization. Slides were rehydrated by placing them over a beaker of warm water (DNA face down), for 2-3 sec, to distribute the DNA more evenly within the spots, and then snap dried on a hot plate (DNA side, face up). The DNA was then cross-linked to the slides by UV irradiation (60-65 mJ; 2400 Stratalinker, Stratagene, La Jolla, Calif., USA).

Following this a blocking step was performed to modify remaining free lysine groups, and hence minimize their ability to bind labeled probe DNA. To achieve this the arrays were placed in a slide rack. An empty slide chamber was left ready on an orbital shaker. The rack was bent slightly inwards in the middle, to ensure the slides would not run into each other while shaking. The blocking solution was prepared as follows:

3×350-ml glass chambers (with metal tops) were set to one side, and a large round Pyrex dish with $dH_2O$ was placed ready in the microwave. At this time, 15 ml sodium borate was prepared in a 50 ml conical tube.

6-g succinic anhydride was dissolved in approx. 325-350 mL 1-methyl-2-pyrrolidinone. Rapid addition of reagent was crucial.

a. Immediately after the last flake of the succinic anhydride dissolved, the 15-mL sodium borate was added.
b. Immediately after the sodium borate solution mixed in, the solution was poured into an empty slide chamber.
c. The slide rack was plunged rapidly and evenly in the solution. It was vigorously shaken up and down for a few seconds, making sure slides never left the solution.
d. It was mixed on an orbital shaker for 15-20 min. Meanwhile, the water in the Pyrex dish (enough to cover slide rack) was heated to boiling.

Following this, the slide rack was gently plunge in the 95 C water (just stopped boiling) for 2 min. Then the slide rack was plunged 5× in 95% ethanol. The slides and rack were centrifuged for 5 min. @ 500 rpm. The slides were loaded quickly and evenly onto the carriers to avoid streaking. The arrays were used immediately or store in slide box.

The Hybridization process began with the isolation of mRNA from the two tissues (see "Isolation of total RNA" and "Isolation of mRNA", below) in question followed by their conversion to single stranded cDNA (see "Generation of probes for hybridization", below). The cDNA from each tissue was independently labeled with a different fluorescent dye and then both samples were pooled together. This final differentially labeled cDNA pool was then placed on a processed microarray and allowed to hybridize (see "Hybridization and wash conditions", below).

Isolation of Total RNA

Approximately 1 g of plant tissue was ground in liquid nitrogen to a fine powder and transferred into a 50-ml centrifuge tube containing 10 ml of TRIZOL® reagent. The tube was vigorously vortexed for 1 min and then incubated at room temperature for 10-20 min. on an orbital shaker at 220 rpm. Two ml of chloroform was added to the tube and the solution vortexed vigorously for at least 30-sec before again incubating at room temperature with shaking. The sample was then centrifuged at 12,000×g (10,000 rpm) for 15-20 min at 4° C. The aqueous layer was removed and mixed by inversion with 2.5 ml of 1.2 M NaCl/0.8 M Sodium Citrate and 2.5 ml of isopropyl alcohol added. After a 10 min. incubation at room temperature, the sample was centrifuged at 12,000×g (10,000 rpm) for 15 min at 4° C. The pellet was washed with 70% ethanol, re-centrifuged at 8,000 rpm for 5 min and then air dried at room temperature for 10 min. The resulting total RNA was dissolved in either TE (10 mM Tris-HCl, 1 mM EDTA, pH 8.0) or DEPC (diethylpyrocarbonate) treated deionized water (RNAse-free water). For subsequent isolation of mRNA using the Qiagen kit, the total RNA pellet was dissolved in RNAse-free water.

Isolation of mRNA mRNA was isolated using the Qiagen OLIGOTEX® mRNA Spin-Column protocol (Qiagen, Valencia, Calif.). Briefly, 500 μl OBB buffer (20 mM Tris-C1, pH 7.5, 1 M NaCl, 2 mM EDTA, 0.2% SDS) was added to 500 μl of total RNA (0.5-0.75 mg) and mixed thoroughly. The sample was first incubated at 70° C. for 3 min, then at room temperature for 10 minutes and finally centrifuged for 2 min at 14,000-18,000×g. The pellet was resuspended in 400 μl OW2 buffer (10 mM Tris-C1, pH 7.5, 150 mM NaCl, 1 mM EDTA) by vortexing, the resulting solution placed on a small spin column in a 1.5 ml RNase-free microcentrifuge tube and centrifuged for 1 min at 14,000-18,000×g. The spin column was transferred to a new 1.5 ml RNase-free microcentrifuge tube and washed with 400 μl of OW2 buffer. To release the isolated mRNA from the resin, the spin column was again transferred to a new RNase-free 1.5 ml microcentrifuge tube, 20-100 μl 70° C. OEB buffer (5 mM Tris-C1, pH 7.5) added and the resin resuspended in the resulting solution via pipeting. The mRNA solution was collected after centrifuging for 1 min at 14,000-18,000×g.

Alternatively, mRNA was isolated using the Stratagene Poly(A) Quik mRNA Isolation Kit (Startagene, La Jolla, Calif.). Here, up to 0.5 mg of total RNA (maximum volume of 1 ml) was incubated at 65° C. for 5 minutes, snap cooled on ice and 0.1× volumes of 10× sample buffer (10 mM Tris-HCl (pH 7.5), 1 mM EDTA (pH 8.0) 5 M NaCl) added. The RNA sample was applied to a prepared push column and passed through the column at a rate of ~1 drop every 2 sec. The solution collected was reapplied to the column and collected as above. 200 µl of high salt buffer (10 mM Tris-HCl (pH 7.5), 1 mM EDTA, 0.5 NaCl) was applied to the column and passed through the column at a rate of ~1 drop every 2 sec. This step was repeated and followed by three low salt buffer (10 mM Tris-HCl (pH 7.5), 1 mM EDTA, 0.1 M NaCl) washes preformed in a similar manner. mRNA was eluted by applying to the column four separate 200 µl aliquots of elution buffer (10 mM Tris-HCl (pH 7.5), 1 mM EDTA) preheated to 65° C. Here, the elution buffer was passed through the column at a rate of 1 drop/sec. The resulting mRNA solution was precipitated by adding 0.1× volumes of 10× sample buffer, 2.5 volumes of ice-cold 100% ethanol, incubating overnight at −20° C. and centrifuging at 14,000-18,000×g for 20-30 min at 4° C. The pellet was washed with 70% ethanol and air dried for 10 min. at room temperature before resuspension in RNase-free deionized water.

Preparation of Yeast Controls

Plasmid DNA was isolated from the following yeast clones using Qiagen filtered maxiprep kits (Qiagen, Valencia, Calif.): YAL022c(Fun26), YAL031c(Fun21), YBR032w, YDL131w, YDL182w, YDL194w, YDL196w, YDR050c and YDR116c. Plasmid DNA was linearized with either BsrBI (YAL022c(Fun26), YAL031c(Fun21), YDL131w, YDL182w, YDL194w, YDL196w, YDR050c) or aflIII (YBR032w, YDR116c) and isolated.

In Vitro Transcription of Yeast Clones

The following solution was incubated at 37° C. for 2 hours: 17 µl of isolated yeast insert DNA (1 rig), 20 µl 5× buffer, 10 µl 100 mM DTT, 2.5 µl (100 U) RNasin, 20 µl 2.5 mM (ea.) rNTPs, 2.7 (40 U) SP6 polymerase and 27.8 µl RNase-free deionized water. 2 (2 U) Ampli DNase I was added and the incubation continued for another 15 min. 10 µl 5M NH$_4$OAC and 100 µl phenol:chloroform:isoamyl alcohol (25:24:1) were added, the solution vortexed and then centrifuged to separate the phases. To precipitate the RNA, 250 µl ethanol was added and the solution incubated at −20° C. for at least one hour. The sample was then centrifuged for 20 min at 4° C. at 14,000-18,000×g, the pellet washed with 500 µl of 70% ethanol, air dried at room temperature for 10 min and resuspended in 100 µl of RNase-free deionized water. The precipitation procedure was then repeated.

Alternatively, after the two-hour incubation, the solution was extracted with phenol/chloroform once before adding 0.1 volume 3M sodium acetate and 2.5 volumes of 100% ethanol. The solution was centrifuged at 15,000 rpm, 4° C. for 20 minutes and the pellet resuspended in RNase-free deionized water. The DNase I treatment was carried out at 37° C. for 30 minutes using 2 U of Ampli DNase I in the following reaction condition: 50 mM Tris-HCl (pH 7.5), 10 mM MgCl$_2$. The DNase I reaction was then stopped with the addition of NH$_4$OAC and phenol:chloroform:isoamyl alcohol (25:24:1), and RNA isolated as described above.

0.15-2.5 ng of the in vitro transcript RNA from each yeast clone were added to each plant mRNA sample prior to labeling to serve as positive (internal) probe controls.

Generation of Probes for Hybridization
Generation of Labeled Probes for Hybridization from First-Strand cDNA Hybridization probes were generated from isolated mRNA using an Atlas™ Glass Fluorescent Labeling Kit (Clontech Laboratories, Inc., Palo Alto, Calif., USA). This entails a two step labeling procedure that first incorporates primary aliphatic amino groups during cDNA synthesis and then couples fluorescent dye to the cDNA by reaction with the amino functional groups. Briefly, 5 µg of oligo(dT)$_{18}$ primer d(TTTTTTTTTTTTTTTTTTV) (SEQ ID NO:200517) was mixed with Poly A+mRNA (1.5-2 µg mRNA isolated using the Qiagen OLIGOTEX® mRNA Spin-Column protocol or the Stratagene Poly(A) Quik mRNA Isolation protocol (Stratagene, La Jolla, Calif., USA)) in a total volume of 25 µl. The sample was incubated in a thermocycler at 70° C. for 5 min, cooled to 48° C. and 10 µl of 5×cDNA Synthesis Buffer (kit supplied), 5 µl 10×dNTP mix (dATP, dCTP, dGTP, dTTP and aminoallyl-dUTP; kit supplied), 7.5 µl deionized water and 2.5 µl MMLV Reverse Transcriptase (500 U) added. The reaction was then incubated at 48° C. for 30 minutes, followed by 1 hr incubation at 42° C. At the end of the incubation the reaction was heated to 70° C. for 10 min, cooled to 37° C. and 0.5 µl (5 U) RNase H added, before incubating for 15 min at 37° C. The solution was vortexed for 1 min after the addition of 0.5 µl 0.5 M EDTA and 5 µl of QuickClean Resin (kit supplied) then centrifuged at 14,000-18,000×g for 1 min. After removing the supernatant to a 0.45 µm spin filter (kit supplied), the sample was again centrifuged at 14,000-18,000×g for 1 min, and 5.5 µl 3 M sodium acetate and 137.5 µl of 100% ethanol added to the sample before incubating at −20° C. for at least 1 hr. The sample was then centrifuged at 14,000-18,000×g at 4° C. for 20 min, the resulting pellet washed with 500 µl 70% ethanol, air-dried at room temperature for 10 min and resuspended in 10 µl of 2× fluorescent labeling buffer (kit provided). 10 µl each of the fluorescent dyes Cy3 and Cy5 (Amersham Pharmacia (Piscataway, N.J., USA); prepared according to Atlas™ kit directions of Clontech) were added and the sample incubated in the dark at room temperature for 30 min.

The fluorescently labeled first strand cDNA was precipitated by adding 2 µl 3M sodium acetate and 50 µl 100% ethanol, incubated at −20° C. for at least 2 hrs, centrifuged at 14,000-18,000×g for 20 min, washed with 70% ethanol, air-dried for 10 min and dissolved in 100 µl of water.

Alternatively, 3-4 µg mRNA, 2.5 (~8.9 ng of in vitro translated mRNA) µl yeast control and 3 µg oligo dTV (TTTTTTTTTTTTTTTTTTT(A/C/G); Sequence ID No.: SEQ ID NO:200518) were mixed in a total volume of 24.7 µl. The sample was incubated in a thermocycler at 70° C. for 10 min. before chilling on ice. To this, 8 µl of 5× first strand buffer (SuperScript II RNase H-Reverse Transcriptase kit from Invitrogen (Carlsbad, Calif. 92008); cat no. 18064022), 0.8° C. of aa-dUTP/dNTP mix (50×; 25 mM dATP, 25 mM dGTP, 25 mM dCTP, 15 mM dTTP, 10 mM aminoallyl-dUTP), 4 µl of 0.1 M DTT and 2.5 µl (500 units) of Superscript R.T.II enzyme (Stratagene) were added. The sample was incubated at 42° C. for 2 hours before a mixture of 10° C. of 1M NaOH and 10° C. of 0.5 M EDTA were added. After a 15 minute incubation at 65° C., 25 µl of 1 M Tris pH 7.4 was added. This was mixed with 450 µl of water in a Microcon 30 column before centrifugation at 11,000×g for 12 min. The column was washed twice with 450 µl (centrifugation at 11,000 g, 12 min.) before eluting the sample by inverting the Microcon column and centrifuging at 11,000×g for 20 seconds. Sample was dehydrated by centrifugation under vacuum and stored at −20° C.

Each reaction pellet was dissolved in 9 µl of 0.1 M carbonate buffer (0.1M sodium carbonate and sodium bicarbonate, pH=8.5-9) and 4.5 µl of this placed in two microfuge tubes. 4.5 µl of each dye (in DMSO) were added and the mixture incubated in the dark for 1 hour. 4.5 µl of 4 M hydroxylamine was added and again incubated in the dark for 15 minutes.

Regardless of the method used for probe generation, the probe was purified using a Qiagen PCR cleanup kit (Qiagen, Valencia, Calif., USA), and eluted with 100 ul EB (kit provided). The sample was loaded on a Microcon YM-30 (Millipore, Bedford, Mass., USA) spin column and concentrated to 4-5 ul in volume. Probes for the maize microarrays were generated using the Fluorescent Linear Amplification Kit (cat. No. G2556A) from Agilent Technologies (Palo Alto, Calif.).

Hybridization and Wash Conditions

The following Hybridization and Washing Condition were developed:

Hybridization Conditions:

Labeled probe was heated at 95° C. for 3 min and chilled on ice. Then 25 □L of the hybridization buffer which was warmed at 42 C was added to the probe, mixing by pipetting, to give a final concentration of:

50% formamide
  4×SSC
  0.03% SDS
5×Denhardt's solution
0.1 µg/ml single-stranded salmon sperm DNA The probe was kept at 42 C. Prior to the hybridization, the probe was heated for 1 more min., added to the array, and then covered with a glass cover slip. Slides were placed in hybridization chambers (Telechem, Sunnyvale, Calif.) and incubated at 42° C. overnight.

Washing Conditions:

A. Slides were washed in 1×SSC+0.03% SDS solution at room temperature for 5 minutes,
B. Slides were washed in 0.2×SSC at room temperature for 5 minutes,
C. Slides were washed in 0.05×SSC at room temperature for 5 minutes.

After A, B, and C, slides were spun at 800×g for 2 min. to dry. They were then scanned.

Maize microarrays were hybridized according to the instructions included Fluorescent Linear Amplification Kit (cat. No. G2556A) from Agilent Technologies (Palo Alto, Calif.).

Scanning of Slides

The chips were scanned using a ScanArray 3000 or 5000 (General Scanning, Watertown, Mass., USA). The chips were scanned at 543 and 633 nm, at 10 um resolution to measure the intensity of the two fluorescent dyes incorporated into the samples hybridized to the chips.

Data Extraction and Analysis

The images generated by scanning slides consisted of two 16-bit TIFF images representing the fluorescent emissions of the two samples at each arrayed spot. These images were then quantified and processed for expression analysis using the data extraction software Imagene™ (Biodiscovery, Los Angeles, Calif., USA). Imagene output was subsequently analyzed using the analysis program Genespring™ (Silicon Genetics, San Carlos, Calif., USA). In Genespring, the data was imported using median pixel intensity measurements derived from Imogene output. Background subtraction, ratio calculation and normalization were all conducted in Genespring. Normalization was achieved by breaking the data in to 32 groups, each of which represented one of the 32 pin printing regions on the microarray. Groups consist of 360 to 550 spots. Each group was independently normalized by setting the median of ratios to one and multiplying ratios by the appropriate factor.

The results of the microarray experiments are reported in the MA_DIFF Table as described above in the section entitled "Brief Description of the Individual Tables".

Example 4

AFLP Experiments and Results

Production of Samples mRNA was prepared from 27 plant tissues. Based on preliminary cDNA-AFLP analysis with a few primer combinations, 11 plant tissues and/or pooled samples were selected. Samples were selected to give the greatest representation of unique band upon electrophoresis. The final 11 samples or pooled samples used in the cDNA-AFLP analysis were:

| | |
|---|---|
| S1 | Dark adapted seedlings |
| S2 | Roots/Etiolated Seedlings |
| S3 | Mature leaves, soil grown |
| S4 | Immature buds, inflorescence meristem |
| S5 | Flowers opened |
| S6 | Siliques, all stages |
| S7 | Senescing leaves (just beginning to yellow) |
| S8 | Callus Inducing medium |
| | Callus shoot induction |
| | Callus root induction |
| S9 | Wounding |
| | Methyl-jasmonate-treated |
| S10 | Oxidative stress |
| | Drought stress |
| | Oxygen Stress-flooding |
| S11 | Heat treated light grown seedling |
| | Cold treated light grown seedlings | cDNA from each of the 11 samples was digested with two restriction endonucleases, namely TaqI and MseI. TaqI and MseI adapters were then ligated to the restriction enzyme fragments. Using primers to these adapters that were specific in sequence (i.e. without extensions), the restriction fragments were subjected to cycles of non-radioactive pre-amplification.

Selective PCR

In order to limit the number of fragments or bands on each lane of the AFLP gel, fragments were subjected to another round of selective radioactive polymerase chain amplification. The TaqI primers used in this amplification were 5'-labelled with $P^{33}$. For these amplifications, the TaqI primers had two extra nucleotides at their 3' end and the MseI primers had three extra nucleotides at their 3' end. This resulted in 16 primer designs for the TaqI primer and 64 primer designs for the MseI primer. Altogether, this gave rise to a total of 1024 primer designs. Fragments generated in this selective amplification protocol were run with labeled molecular weight markers on polyacrylamide gels to separate fragments in the size range of 100-600 nucleotides.

Following gel electrophoresis, profiles were analyzed with a phosphorimager. From these images, electronic files, giving the mobilities of all bands on the gels and their intensities in each of the samples, were compiled.

All unique bands were cut out of the gels. The gel pieces were placed in 96 well plates for elution and their plate designation was linked to their electrophoretic mobilities recorded in the electronic files. The eluted fragments were then subjected to another round of amplification, this time using reamplification primers (see below). After amplification, DNA fragments were sequenced.

A computer database was established linking the mobilities of all the bands observed on the cDNA-AFLP gels with the sequence of the correspondingly isolated fragment. The sequence allowed for identification of the gene from which the cDNA-AFLP fragment was derived, allowing for a linkage of band mobility with the transcript of a specific gene. Also linked to the band mobilities were their intensities recorded for each of the eleven samples used in constructing the database.

This cDNA-AFLP analysis with TaqI/MseI and 1024 primer combinations was repeated using the enzymes NlaIII in place of TaqI, and Csp6I in place of MseI.

Using the Database for the Transcript Profiling of Experimental Samples

Experimental Samples were subjected to cDNA-AFLP as described above, resulting in electronic files recording band mobilities and intensities. Through use of the database established above, band mobilities could be linked to specific cDNAs, and therefore genes. Furthermore, the linkage with the intensities in the respective samples allowed for the quantification of specific cDNAs in these samples, and thus the relative concentration of specific transcripts in the samples, indicating the level to which specific genes were expressed.

```
Reamplification primers
99G24
                                        (SEQ ID NO: 200519)
CGCCAGGGTTTTCCCAGTCACGAC|ACGACTCACT|gatgagtcctgagtaa|
M13 forward            +10        MseI+0

99G20
                                        (SEQ ID NO: 200520)
AGCGGATAACAATTTCACACAGGA|CACACTGGTA|tagactgcgtaccga|
M13 reverse            +10        TaqI+0
```

Purification of the Reamplifiction Reaction Before Sequencing

| | |
|---|---|
| 5 µl | reamplification reaction |
| 0.25 µl | 10xPCR buffer |
| 0.33 µl | Shrimp Alkaline Phosphatase (Amersham Life Science) |
| 0.033 µl | Exonuclease I (USB) |
| 0.297 µl | SAP dilution buffer |
| 1.59 µl | MQ |
| 7.5 µl | total |

30' 37° C.
10' 80° C.
4° C.

Sample Preparation

S1: Dark Adapted Seedlings:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 8 days, the seedlings were foil-wrapped and harvested after two days.

S2: Roots/Etiolated Seedlings:

Seeds of *Arabidopsis thaliana* (wassilewskija) were germinated on solid germination media (1×MS salts, 1×MS vitamins, 20 g/L sucrose, 50 mg/L MES pH 5.8) in the dark. Tissues were harvested 14 days later.

S3: Mature Leaves, Soil Grown:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. Leaves were harvested 17 days later from plants that had not yet bolted.

S4: Immature Buds, Inflorescence Meristem:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark.

S5: Flowers, Opened:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark.

S6: Siliques, all Stages:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark.

S7: Senescing Leaves (Just Beginning to Yellow):

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. When the plant had leaves that were less than 50% yellow, the leaves that were just beginning to yellow were harvested.

S8:

Callus Inducing Medium:

Seeds of *Arabidopsis thaliana* (wassilewskija) were surface sterilized (1 min-75% Ethanol, 6 min-bleach 100%+Tween 20, rinse) and incubated on MS medium containing 2,4-Dichlorophenoxyacetic acid (2,4-D) 1 mg/l and Kinetin 1 mg/l in the dark for 3 weeks to generate primary callus. Hypocotyls and roots of the seedling were swollen after a week after incubation in this callus induction medium and subsequently callus was initiated from these swollen areas.

Callus Shoot Induction:

Primary calluses were transferred to the fresh callus induction medium for another 2 weeks growth to generate secondary callus. Secondary callus were transferred to shoot induction medium containing MS basal medium and Benzyladenine (BA) 2 mg/l and Naphthaleneacetic acid (NAA)).1 mg/l for 2 weeks growth in the light before it was harvested and frozen and sent to Keygene. Many shoot meristems were observed under the microscope.

Callus Root Induction:

Secondary calluses were transferred to root induction medium containing MS basal medium, sucrose 1% and Indolebutyric acid (IBA) 0.05 mg/l in the dark. Many root primordia were observed under microscope after 10 days in the root induction medium. Those callus tissue were harvested and frozen and sent to Keygene.

S9:

Wounding:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 20 days, leaves of plants were wounded with pliers. Wounded leaves were harvested I hour and 4 hours after wounding.

Methyl Jasmonate Treatment:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 13 days, plants were sprayed with 0.001% methyl jasmonate. Leaves were harvested 1.5 hours and 6 hours after spraying S10:

Oxidative Stress:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 24 days, a few leaves were inoculated with a mixture of 2.5 mM D-glucose, 2.5 U/mL glucose oxidase in 20 mM sodium phosphate buffer pH 6.5. After an hour, 3 hours, or 5 hours after inoculation, whole plant, except for the inoculated leaves, was harvested. This sample was mixed with sample from plants that were sitting in full sun (152,000 LUX) for 2 hours or four hours.

Drought Stress:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 20 days, aerial tissues were harvested and left to dry in 3MM WHATMAN® paper for 1 hour or 4 hours.

Oxygen Stress:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 21 days, the plant was flooded by immersing its pot in a beaker of tap water. After 6 days, the upper tissues were harvested.

S11: Heat-Treated Light Grown Seedlings:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. Over a 5 hour period, the temperature was raised to 42° C. at the rate of approximately 4° C. per hour. After 1 hour at 42° C., the aerial tissues were collected. This sample was mixed with an equal volume of sample that went through a heat-recovery treatment namely bringing down the temperature to 22° C. from 42° C. over a 5 hour period at the rate of 4° C. per hour.

Cold-Treated Light Grown Seedlings:

Seeds of *Arabidopsis thaliana* (wassilewskija) were sown in pots and left at 4° C. for two to three days to vernalize. They were transferred to a growth chamber after three days. The intensity of light in the growth chamber was 7000-8000 LUX, temperature was 22° C., with 16 h light and 8 h dark. After 18 days, the plant was transferred to 4° C. for an hour before the aerial tissues were harvested. This sample was mixed with aerial tissues from another plant that was transferred to 4° C. for 27 hours before being harvested.

Analysis of Data:

Intensity:

The intensity of the band corresponds to the value in each lane marked S1, S2 etc.

P-values:

The data shows P-values of each of the samples 1-11. P-values are calculated using the following formula 2*(1−NORMDIST(ABS(Sx−AVERAGE(of S1 to S11, not including Sx))/STDEV(of S1 to S11 not including Sx),0,1,TRUE)) using Excel functions.

The equivalent mathematical formula of P-value is as follows:

$$\int \varphi(x)dx, \text{ integrated from } a \text{ to } \infty,$$

where $\varphi(x)$ is a normal distribution:

where $a = |Sx - \mu|$ $\sigma(S1 \ldots S11,$ not including $Sx)$;

where $\mu$ = is the average of the intensities of all samples except $Sx$, $$= \frac{(\Sigma S1 \ldots Sn) - Sx}{n - 1}$$

where $\sigma(S1 \ldots S11,$ not including $Sx)$ = the standard deviation of all sample intensities except $Sx$.

Results:

The results are shown in the MA diff tables.

Example 5

Transformation of Carrot Cells

Transformation of plant cells can be accomplished by a number of methods, as described above. Similarly, a number of plant genera can be regenerated from tissue culture following transformation. Transformation and regeneration of carrot cells as described herein is illustrative.

Single cell suspension cultures of carrot (*Daucus carota*) cells are established from hypocotyls of cultivar Early Nantes in $B_5$ growth medium (O. L. Gamborg et al., *Plant Physiol.* 45:372 (1970)) plus 2,4-D and 15 mM $CaCl_2$ ($B_5$-44 medium) by methods known in the art. The suspension cultures are subcultured by adding 10 ml of the suspension culture to 40 ml of $B_5$-44 medium in 250 ml flasks every 7 days and are maintained in a shaker at 150 rpm at 27° C. in the dark.

The suspension culture cells are transformed with exogenous DNA as described by Z. Chen et al. *Plant Mol. Bio.* 36:163 (1998). Briefly, 4-days post-subculture cells are incubated with cell wall digestion solution containing 0.4 M sorbitol, 2% driselase, 5 mM MES (2-[N-Morpholino]ethanesulfonic acid) pH 5.0 for 5 hours. The digested cells are pelleted gently at 60×g for 5 min. and washed twice in W5 solution containing 154 mM NaCl, 5 mM KCl, 125 mM $CaCl_2$ and 5 mM glucose, pH 6.0. The protoplasts are suspended in MC solution containing 5 mM MES, 20 mM $CaCl_2$, 0.5 M mannitol, pH 5.7 and the protoplast density is adjusted to about $4 \times 10^6$ protoplasts per ml.

15-60 μg of plasmid DNA is mixed with 0.9 ml of protoplasts. The resulting suspension is mixed with 40% polyethylene glycol (MW 8000, PEG 8000), by gentle inversion a few times at room temperature for 5 to 25 min. Protoplast culture medium known in the art is added into the PEG-DNA-protoplast mixture. Protoplasts are incubated in the culture medium for 24 hour to 5 days and cell extracts can be used for assay of transient expression of the introduced gene. Alternatively, transformed cells can be used to produce transgenic callus, which in turn can be used to produce transgenic plants, by methods known in the art. See, for example, Nomura and Komamine, *Plt. Phys.* 79:988-991 (1985), *Identification and Isolation of Single Cells that Produce Somatic Embryos in Carrot Suspension Cultures*.

Example 6

Phenotype Screens and Results

A: Triparental Mating and Vacuum Infiltration Transformation of Plants

Standard laboratory techniques are as described in Sambrook et al. (1989) unless otherwise stated. Single colonies of *Agrobacterium* C58C1Rif, *E. coli* helper strain HB101 and the *E. coli* strain containing the transformation construct to be mobilized into *Agrobacterium* were separately inoculated into appropriate growth media and stationary cultures produced. 100 μl of each of the three cultures were mixed gently, plated on YEB (5 g Gibco beef extract, 1 g Bacto yeast extract, 1 g Bacto peptone, 5 g sucrose, pH 7.4) solid growth media and incubated overnight at 28° C. The bacteria from the triparental mating were collected in 2 ml of lambda buffer (20 mM Tris (pH 7.5), 100 mM NaCl, 10 mM $MgCl_2$) and serial dilutions made. An aliquot of the each dilution was then plated and incubated for 2 days at 28° C. on YEB plates supplemented with 100 μg/ml rifampicin and 100 μg/ml carbenicillin for calculation of the number of acceptor cells and on YEB plates supplemented with 100 μg/ml rifampicin, 100 μg/ml carbenicillin and 100 μg/ml spectinomycin for selection of transconjugant cells. The cointegrate structure of purified transconjugants was verified via Southern blot hybridization.

A transconjugant culture was prepared for vacuum infiltration by inoculating 1 ml of a stationary culture arising from a single colony into liquid YEB media and incubating at 28° C. for approximately 20 hours with shaking (220 rpm) until the OD taken at 600 nm was 0.8-1.0. The culture was then pelleted (8000 rpm, 10 min, 4° C. in a Sorvall SLA 3000 rotor) and the bacteria resuspended in infiltration medium (0.5×MS salts, 5% w/v sucrose, 10 μg/l BAP, 200 μl/l SILWET L-77®, pH 5.8) to a final $OD_{600}$ of 1.0. This prepared transconjugant culture was used within 20 minutes of preparation.

Wild-type plants for vacuum infiltration were grown in 4-inch pots containing Metromix 200 and Osmocote. Briefly, seeds of *Arabidopsis thaliana* (ecotype Wassilewskija) were sown in pots and left at 4° C. for two to four days to vernalize. They were then transferred to 22-25° C. and grown under long-day (16 hr light: 8 hr dark) conditions, sub-irrigated with water. After bolting, the primary inflorescence was removed and, after four to eight days, the pots containing the plants were inverted in the vacuum chamber to submerge all of the plants in the prepared transconjugant culture. Vacuum was drawn for two minutes before pots were removed, covered with plastic wrap and incubated in a cool room under darkness or very low light for one to two days. The plastic wrap was then removed, the plants returned to their previous growing conditions and subsequently produced (T1) seed collected.

B: Selection of T-DNA Insertion Lines

Approximately 10,750 seeds from the initial vacuum infiltrated plants were sown per flat of Metromix 350 soil. Flats were vernalized for four to five days at 4° C. before being transferred to 22-25° C. and grown under long-day (16 hr light: 8 hr dark) conditions, sub-irrigated with water. Approximately seven to ten days after germination, the (T1) seedlings were sprayed with 0.02% Finale herbicide (AgrEvo). After another five to seven days, herbicide treatment was repeated. Herbicide resistant T1 plants were allowed to self-pollinate and T2 seed were collected from each individual. In the few cases where the T1 plant produced few seed, the T2 seed was planted in bulk, the T2 plants allowed to self-pollinate and T3 seed collected.

C: Phenotype Screening

Approximately 40 seed from each T2 (or T3) line were planted in a 4-inch pot containing either Sunshine mix or Metromix 350 soil. Pots were vernalized for four to five days at 4° C. before being transferred to 22-25° C. and grown under long-day (16 hr light: 8 hr dark) conditions, sub-irrigated with water. A first phenotype screen was conducted by visually inspecting the seedlings five to seven days after germination and aberrant phenotypes noted. Plants were then sprayed with Finale herbicide within four days (i.e. about seven to nine days after germination). The second visual screen was conducted on surviving T2 (or T3) plants about sixteen to seventeen days after germination and the final screen was conducted after the plants had bolted and formed siliques. Here, the third and fourth green siliques were collected and aberrant phenotypes noted. The Knock-in and Knock-out Tables contain descriptions of identified phenotypes.

Alternative, seed were surface sterilized and transferred to agar solidified medium containing Murashige and Skoog salts (1×), 1% sucrose (wt/v) pH 5.7 before autoclaving. Seed were cold treated for 48 hours and transferred to long days [16 hours light and 8 hours dark], 25° C. Plants were screened at 5 and 10 days.

In another screen, seed were surface sterilized and transferred to agar solidified medium containing Murashige and Skoog salts (1×), and combinations of various nitrogen and sucrose amounts as specified below:

Medium 1: no sucrose, 20.6 mM $NH_4NO_3$, 18.8 mM $KNO_3$;

Medium 2: 0.5% sucrose, 20.6 mM $NH_4NO3$, 18.8 mM $KNO_3$;

Medium 3: 3% sucrose, 20.6 mM $NH_4NO_3$, 18.8 mM $KNO_3$;

Medium 4: no sucrose, 20.6 μM $NH_4NO_3$, 18.8 μM $KNO_3$;

Medium 5: 0.5% sucrose, 20.6 μM $NH_4NO_3$, 18.8 μM $KNO_3$; and

Medium 6: 3% sucrose, 20.6 μM $NH_4NO_3$, 18.8 μM $KNO_3$.

The 0.5% sucrose was the control concentration for the sucrose. The low nitrogen, 20.6 μM $NH_4NO_3$, 18.8 μM $KNO_3$, is the control for the nitrogen. Seed were cold treated for 48 hours and transferred to long days [16 hours light and 8 hours dark], 25° C. Plants were screened at 2, 5, and 10 days.

D: TAIL-PCR and Fragment Sequencing

Rosette leaves were collected from each putative mutant and crushed between parafilm and FTA paper (Life Technologies). Two 2 $mm^2$ hole punches were isolated from each FTA sample and washed according to the manufacturer's instructions by vortexing with 200 ul of the provided FTA purification reagent. The FTA reagent was removed and the washing procedure repeated two more times. The sample was then washed twice with 200 ul of FTA TE (10 mM Tris, 0.1 mM EDTA, pH 8.0) and vortexing prior to PCR.

```
                                               (SEQ ID NO: 200521)
AD2: 5' NGTCGASWGANAWGAA 3'  (128-fold degeneracy)
     S = G or C, W = A or T, and N = A, G,
     C, or T (SEQ ID NO: 200522)
LB1: 5' GTTTAACTGCGGCTCAACTGTCT 3'

(SEQ ID NO: 200523)
LB2: 5' CCCATAGACCCTTACCGCTTTAGTT 3'
```

-continued (SEQ ID NO: 200524)
LB3: 5' GAAAGAAAAAGAGGTATAACTGGTA 3'

The extent to which the left and right borders of the T-DNA insert were intact was measured for each line by PCR. The following components were mixed for PCR: 1 2 mm² FTA sample, 38.75 µl distilled water, 5 µl 10× Platinum PCR buffer (Life Technologies), 2 µl 50 mM MgCl$_2$, 1 µl 10 mM dNTPs, 1 µl 10 µM primer LB1 (or RB1 for analysis of the right border), 1 µl 10 µM primer LB3R (or RB3R for analysis of the right border) and 1.25 U Platinum Taq (Life Technologies). Cycling conditions were: 94° C., 10 sec.; thirty cycles of 94° C., 1 sec.—54° C., 1 sec. —72° C., 1 sec.; 72° C., 4 sec. The expected band size for an intact left border is bp, while an intact right border generates a by band.

Fragments containing left or right border T-DNA sequence and adjacent genomic DNA sequence were obtained via PCR. First product PCR reactions use the following reaction mixture: 1 2 mm² FTA sample, 12.44 µl distilled water, 2 µl 10× Platinum PCR buffer (Life Technologies), 0.6 µl 50 mM MgCl$_2$, 0.4 µl 10 mM dNTPs, 0.4 µl 10 µM primer LB1 (or RB1 for analysis of the right border), 3 µl 20 µM primer AD2 and 0.8 U Platinum Taq (Life Technologies). Cycling conditions for these reactions were: 93° C., 1 min.; 95° C., 1 min.; three cycles of 94° C., 45 sec.—62° C., 1 min.—72° C., 2.5 min.; 94° C., 45 sec.; 25° C., 3 min.; ramp to 72° C. in 3 min.; 72° C., 2.5 min.; fourteen cycles of 94° C., 20 sec.—68° C., 1 min.—72° C., 2.5 min.—94° C., 20 sec.; –68° C., 1 min.— 72° C., 2.5 min.—94° C., 20 sec.—44° C., 1 min.—72° C., 2.5 min.; 72° C., 5 min.; end; ~4.5 hrs. For second product PCR reactions 1 µl of a 1:50 dilution of the first PCR product reaction was mixed with 13.44 µl distilled water, 2 µl 10× Platinum PCR buffer (Life Technologies), 0.6 µl 50 mM MgCl$_2$, 0.4 µl 10 mM dNTPs, 0.4 µl 10 µM primer LB2 (or RB2 for analysis of the right border), 2 µl 20 µM primer AD2 and 0.8 U Platinum Taq (Life Technologies). Second product cycling conditions were: eleven cycles of 94° C., 20 sec.— 64° C., 1 min.—72° C., 2.5 min.—94° C., 20 sec.—64° C., 1 min.—72° C., 2.5 min.—94° C., 20 sec.—44° C., 1 min.; 72° C., 5 min.; end; ~3 hrs. Third product PCR reactions were prepared by first diluting 2 µl of the second PCR product with 98 µl of distilled water and then adding 1 µl of the dilution to 13.44 µl distilled water, 2 µl 10× Platinum PCR buffer (Life Technologies), 0.6 µl 50 mM MgCl$_2$, 0.4 µl 10 mM dNTPs, 0.4 µl 10 µM primer LB3 (or RB3 for analysis of the right border), 2 µl 20 µM primer AD2 and 0.8 U Platinum Taq (Life Technologies). Third product cycling conditions were: twenty cycles of 94° C., 38 sec.—44° C., 1 min.—72° C., 2.5 min.; 72° C., 5 min.; end; ~2 hrs. Aliquots of the first, second and third PCR products were electrophoresed on 1% TAE (40 mM Tris-acetate, 1 mM EDTA) to determine their size.

Reactions were purified prior to sequencing by conducting a final PCR reaction. Here, 0.25 µl Platinum PCR Buffer (Life Technologies), 0.1 µl 50 mM MgCl$_2$, 3.3 U SAP shrimp alkaline phosphatase, 0.33 U Exonuclease and 1.781 µl distilled water were added to a 5 µl third product and the reaction cycled at 37° C., 30 min.; 80° C., 10 min.; 4° C. indefinitely.

Di-deoxy "Big Dye" sequencing was conducted on Perkin-Elmer 3700 or 377 machines.

Knock-in Experiments

For the following examples, a two-component system was constructed in a plant to ectopically express the desired cDNA.

First, a plant was generated by inserting a sequence encoding a transcriptional activator downstream of a desired promoter, thereby creating a first component where the desired promoter facilitates expression of the activator generated a plant. The first component also is referred to as the activator line.

Next, the second component is constructed by linking a desired cDNA to a sequence that the transcriptional activator can bind to and facilitate expression of the desired cDNA. The second component can be inserted into the activator line by transformation. Alternatively, the second component can be inserted into a separate plant, also referred to as the target line. Then, the target and activator lines can be crossed to generate progeny that have both components.

Two component lines were generated by both means.

Part I—from Crosses

Target lines containing cDNA constructs are generated using the *Agrobacterium*-mediated transformation. Selected target lines are genetically crossed to activation lines (or promoter lines). Generally, the promoter lines used are as described above. Evaluation of phenotypes is done on the resulting F1 progenies.

Part II—from Type I Supertransformation

Promoter activation lines (generally Vascular/Ovule/Young Seed/Embryo line, Seed/Epidermis/Ovary/Fruit line, Roots/Shoots/Ovule line, and Vasculature/Meristem are transformed with cDNA constructs using the *Agrobacterium* mediated transformation. Selected transformants (and their progenies) are evaluated for changes in phenotypes. The table for the knock-in of the Type I supertransformation comprises the following information Clone ID, Pfam, Gemini ID Trans. Unique ID (which indicates what promoter activation line was transformed S Ratio: segregation ratio after the transformed plants are selected for the marker.

Assay

Stage: phenotype was observed

Feature: Where the phenotype was observed

Phenotype

P Ratio: phenotype ratio

Comments

Part III—from Type II Supertransformation

Target lines generated using the procedure mentioned in Part I are transformed with T-DNA construct containing constitutive promoter. Selected transformants (and their progenies) are evaluated for changes in phenotypes.

An additional deposit of an *E. coli* Library, *E. coli* LibA021800, was made at the American Type Culture Collection in Manassas, Va., USA on Feb. 22, 2000 to meet the requirements of Budapest Treaty for the international recognition of the deposit of microorganisms. This deposit was assigned ATCC accession no. PTA-1411.

Additionally, ATCC Library deposits; PTA-1161, PTA-1411 and PTA-2007 were made at the American Type Culture Collection in Manassas, Va., USA on; Jan. 7, 2000, Feb. 23, 2000 and Jun. 8, 2000 respectively, to meet the requirements of Budapest Treaty for the international recognition of the deposit of microorganisms.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

SEQUENCE LISTING (200524 sequences)

SEQ ID NO: 1 - DNA, 960 bp, Unknown
  misc_feature (1)..( 960): cDNA_ID_1691857_gDNA_ID_52_Annot_ID_144096 3000 nt of promoter + ATG
aactacttccataaatcagctccttgtaatttacaaatgtatcctgctaaattccaagatcttacccactaggtaagggtaataaagtaaaattggcttcacacgtgagtaagtaagttccagttggaagatctaaaaacatgtggaagaatgtgagagataggacagatggaggactttgcttgaaagcaaggaacccacaatcttacagttacagccttttcacattttcttactgtcagttacatttgtctgtactttataatcgttctatttctttctatatttatctctttccaaaacaatttttacattgttttcttaacgcagcttttagcttattttgggtaatggattaataaaatgcagtttcatttgttgtcacacacgcaaaagaagtcaaacgcagtttttttttttggcagcttgtcaaacgcagtttctacaattagaattctcttatgtgtcttttaaacgtcaaaatcaaaactaattaaaaacaaaaattgatatcgttcggttaaaatttatgtttggtgaatattactaaattaacacaaacacaaaattctgatttttccttagtttgttttcttttgttaaagttttccttaaattgtttgtttaatctttatgtcaagtttggtaacaatcatctttcaaatattggtactgtaccatataagctggtaccaatgttataacaaacaaccgttgtttatgaatatttttgagtatgaaatttaatttcactatagatttacagcagattaacacgtttatttgattacggagtttgtatgtacttcagactattgtggggtaataacataaaaataaaaaaataagggggcatatttgtgattctacaaactacccatcactaaaccacattaaactctctctctccctctctcttctctaaagagattcgaagaaatttacagagagacaaaaatg

SEQ ID NO: 2 - DNA, 850 bp, Unknown
  misc_feature (1)..( 850): cDNA_ID_3048054_gDNA_ID_104_Annot_ID_143898 3000 nt of promoter + ATG
ttttcccttttttttttttttggttaatatctaaaaacttgttgcaaaatgcgttaaaaacaggacgatgtagatgaaactgacctgaggaaaatggaagaagcaagattagcttatgtagcagcagtgaataccgcaaaggaacgagaagatgaagaatctctggtcatggctgctcaagctcgagcttacctgcaatcactagcctttacatattaatcatcttcaggtacttacttctttataggatatttctctccttgggttgttttaggagtatgtagatttgtaccatgaagaaattggagaagaaaagcttatgtgagaaacataacgttatggttttcccctaaaccaatgaacgcaactctgagtttttgtttcttcatttgagcatgtatgtatctatatgatcttctacattattgggaacataaaatcagattgtataatgcatctgttcaatagtttactttagatatactcttaacaaggaaatctatcaactttggaatctaaagcagccatacttgttcaacttgaaatcgtggaatgatgaatttgggcttaattagctaacaaaatatagtttgggctcacattgaattccttttaataaggtaaggtctttttagtgataatcttaatctaataatagttcacacgggtgggaaaaaatacaaaataataataatatttcacacgtgcagaattcggctgtgtcaaaaattccgcgccattagcccatcgatacgaagtcgagttcaaagcccaacaaagttttaaaactatatatacattaaaaagttctttctttgttaatggaaggaaaaagtaaaatccggtaatg

SEQ ID NO: 3 - DNA, 2024 bp, Unknown
  misc_feature (1)..( 2024): cDNA_ID_1596316_gDNA_ID_141_Annot_ID_143938 3000 nt of promoter + ATG
  misc_feature (20)..(20): n is a, c, g, or t
  misc_feature (391)..(391): n is a, c, g, or t
  misc_feature (587)..(587): n is a, c, g, or t
  misc_feature (709)..(709): n is a, c, g, or t
  misc_feature (1094)..(1094): n is a, c, g, or t
  misc_feature (1306)..(1307): n is a, c, g, or t
  misc_feature (1309)..(1309): n is a, c, g, or t
  misc_feature (1336)..(1336): n is a, c, g, or t
  misc_feature (1727)..(1727): n is a, c, g, or t
  misc_feature (1864)..(1864): n is a, c, g, or t
  misc_feature (1967)..(1967): n is a, c, g, or t
ttctatctctgttatgctgnaatacgtagttgtgagcttctcggggatcagaatggtattggcgttagatatatagaattctcagtcaaatactagattctggggagttatcttcactttgatgttcctttggatagtggctagagtatatgagtgaatgttgttttacttttgacatcttctgagcagttacatcttgaatctgataagctactctattatatgatatcatatggtactgctttttgcatcatgagaacatacattttaccagtgttatttgtaggtccaacatttaggtgtaactgattctaacttctgcagtatgatcattcggaatgctgtaaatactgaaagctcttgatataatttttcagttaagctagaattncgaattgatggggtattcgacgtggtgatgcatggaagcgtttcaggatatcttctagtaaatgctgaggttgattccatgggaggagttatcgatagtggaggtggtattggtgttaaaacatctccgcgccgaacagctattgagaaggctcaagcggagctaaggtatttcagattgagacatcttgatcttnctgcagtgtgtttaaatgctctataatttctacagctttctattatttccaatgtgtaacaaagatgcttatttcaacaggcaagagtatgatgttcgtgaggaaaggaggagagaattggnagtttctagagaaagtatgaatacctatttccctgttctataattgttttgtgtgtgtgtgtgtaagaacttatgatgacaagcctttactcttctatctgcttcagggcggtaatcccttggatttcaagtttggtattgcaacttcacatagcgtccaatctacatcactcacagatcagcaagcagagcattttgtaaacaggtacattcgtgtttggtgtagttcccacattaatttcatggaataactcatcattatttgcccataacccccacagtgaagtcaaagatagttttgccctgactgcctcaccacatggtgactcggtggagagtagcggtagacctggagttcctacaatttctgaacccaatacagcangataatcttttactgtttgattctgaaaacaagtcagttgaaggggaaagaaatttgagacatcctaataggcaaaacagaacttctgagtcagaacgatcttccaaagcacacaccaaccagaataccaaagaaacagaagattctgccatctttcgcccgtatgctcggaggaacagatcgaagataagtcgggatccagcacggtcaanncntctacggatttagttcagaatcgtggntggtcttgcaacgtctatatctattcgcagaggatcagtggaaggaaagggttgcattcccgaagcagccaatcaaaaggatatgcatacaacttctgtatcttgtccagtatttgcaaattcaaatggtaatatcgttccgaaaaatagagtttccagcaattcgctgaatactaaggtggatggtgaacctgttgtacgagagagtactgctggatccaagactagtctattgaaagatgaagccgacatttcatatagtaaaagctctgcatatttgccagttggagagtctggccttgctggggagaaggcacaactagtttcgactggtggttctcccaaagctgcaacaatagctggccagaaaaatagttctacccaactgaantggcctaagagattccacggtagaggaagaaagcttaacaaatagaggagctacagggactaatgggttagagtcagagtcttctcatgcgaacaacgtagaagtaaatgtagataatgaaagagatctttataaangtggacaaacttgactctgatgaaatctctatgcagaagactttgagagtagaggggttactagatcaaacagttggtgaaatgaccaaaactaagattgaangatgagacaggtcaatctaccaccattatcagtgagtgcattcctgaatgtgaaatg

SEQ ID NO: 4 - DNA, 9 bp, Unknown
  misc_feature (1)..( 9): cDNA_ID_3046512_gDNA_ID_147_Annot_ID_143949 3000 nt of promoter + ATG
agtttcatg

SEQ ID NO: 5 - DNA, 129 bp, Unknown
  misc_feature (1)..( 129): cDNA_ID_1010524_gDNA_ID_209_Annot_ID_144003 3000 nt of promoter + ATG
tcttctccgttcgaaatcgcatccatcgccgtcgtcgtcggtgacgaaaaccaccgcgtaaaaccgtttcctaaatcagatgttcaatcttagaagtatctcttagaagctctcttgtatgaaaaaatg

SEQ ID NO: 6 - DNA, 1032 bp, Unknown
  misc_feature (1)..( 1032): cDNA_ID_1597245_gDNA_ID_226_Annot_ID_144017 3000 nt of promoter + ATG
  misc_feature (69)..(69): n is a, c, g, or t
  misc_feature (369)..(369): n is a, c, g, or t
  misc_feature (450)..(450): n is a, c, g, or t
  misc_feature (604)..(604): n is a, c, g, or t
  misc_feature (606)..(607): n is a, c, g, or t
  misc_feature (609)..(609): n is a, c, g, or t
  misc_feature (802)..(802): n is a, c, g, or t
  misc_feature (805)..(805): n is a, c, g, or t
aatatcaggtcgagtaacaagaaagaattgcagaaacctaagcaacagatgacaagatgcagtaaccancagtagagtaaccaataaattcaataagataaagaattcccgaggatggggtaattgagtagtttcgtttcctcagtttacaggtgattgacatgctcaataaattatccctagacaacaagttctttaaccaaatctaagttccaccgcaacagagaccctcaagttaacctagtcccagactcaatcaccattgacgagagctaacctaacaaatattacgaatcaacaagttaaagccaaaacgctccctgcaaccaataccttggtacaaggccacaaatctctggaattagtggnttcatacatttcatcaaacaccttttgggcgcggaaatgtctgggctcaaattccagttgatcagaaagcaataggcattnaagaacaactaatccagaagggatctatcaatcaaactcaactacccagcatactgagaattctaaactactctaacccatcctcagatacctatgcactactcagacatcattggagaaaacataaacgttgaatggaatgaaaacatgatancnncnagagtaatagcaagatggtaacaagatgaaaaacagtaaacgaaatcaagaacaaatactcaatactgaatagataaagggaaattcggattacaaaaggtcaagcacacagtgtctgcgaaataaaacttagataaaaacttgttcacaaaaatgtaaagtacatgctagttatagcaaaatattctgaaanccntaatactcaaaacgacgcaatattgagacgaattaagaactgtactccacccaggttgtcgagtgagaggtcgagtgataagctggagtcttcttttcttccttgtgctcgagtgtctggttgagtgcgaaatgaagaagactctaaagctggcagtcgagtatgtagtcgagtgatagagatgttggtactcggcttggtggtaaagtgatcgagtgaaggtgatg

SEQ ID NO: 7 - DNA, 115 bp, Unknown
  misc_feature (1)..( 115): cDNA_ID_3046422_gDNA_ID_268_Annot_ID_144055 3000 nt of promoter + ATG
aatattcaaatctcgatattgacaggtttgccctcgtcctttgcctataaatttgacatgatctacgttcattcaaacaaaaaccaagccacaaagaaattaaatacacacaatg

SEQ ID NO: 8 - DNA, 1189 bp, Unknown
  misc_feature (1)..( 1189): cDNA_ID_2991145_gDNA_ID_371_Annot_ID_144333 3000 nt of promoter + ATG
attgatgatacatacactgtttttcatacgcaagacttttctagctagtactctaatccatgatttgcactttatttaaagatatatgaaaatatttattagctttggaaatgagttcactgatattctttgatgcatgattgggttcacgggtctatagttgatatggcagcccacacacgtatatgtttgcaaatggtactatagaaaactgaatccaaaaagtgtgaaactactttggttgtatttcattcccgttttaaatctgtcgaagctatattcattcagaagtaataaagcttaacattaatccaaaaagcagtcgcattagacattcccatcctcacggtagcgttagaaagactggaatggagcacaacaagcagatgagatgacctacacgaaggagtacgttgacccaaaacctgtaatgaatttacgttaatttttgtgttatagacgaggttttatgacgttgtaagattttgaatacaaagaggtagtggagttttgacccattaagcacaagatttttcttagaaaacaaaaaggttaccgcaagtaagtcaatacctgaagaataaaatacttgaaagaaaaacctaagaagagtgagtattcattttaagacgaaaatagaagctgattcaatgtatgtgtcatgttgtggtggaccctaaaacaatattaaccgcgcaaaatttccgaatggtagtatagctaaccgttgaaccgtatgctactatgctttcattcactaaagaattatggtttacgtcccatgcggttcaaacacggtatatacatatctggtcatattttgtgaaaccgggtttgaacaactcaccaatacaatagtactacaattcaaattaaatttttctttttgtaattaaacttcattttggtataattaaagaaaaaaaatgtttccttttgttgaccgatacaatgactgtatattcaaaaaattacttttagacatccaaattatattttcatctatcaattacaatattatgaaaattatatatttacagatgctaaatcaaaaacggtacgtttcaccttaaaccctaaccctccgaatcagctagagagacaccagcccttctattaaaagttaaaacccttccctctttacttctccgatagctttttattttcctcgtttttgcgccgaccaatg

SEQ ID NO: 9 - DNA, 201 bp, Unknown
  misc_feature (1)..( 201): cDNA_ID_3014692_gDNA_ID_524_Annot_ID_144467 3000 nt of promoter + ATG
aagtcgtttgattgtaatgacgaaggatttactttcctaaaataaacgatcatgctcacctctactatacatattcttcagatactcataatcttcttttctttcaacaatcttttattagtttattatgttttcataagttacgcttgtaatcttcgtcctcttccttgaactccaagattcaaacatattttctttatg

SEQ ID NO: 10 - DNA, 196 bp, Unknown
  misc_feature (1)..( 196): cDNA_ID_1686587_gDNA_ID_546_Annot_ID_144103 3000 nt of promoter + ATG
gttatccgagtagtagttaccatcaaacaaactataactgatttaatgagccattcgcagtttcacagtctgaattcgttcatacttacacatgcatggcttaatctttgagacaagcatatgactactggcaggatcaaccaggtagcattcatcgatcacggcaattccccgccacatcctctcaaacgcaatg

SEQ ID NO: 11 - DNA, 781 bp, Unknown
  misc_feature (1)..( 781): cDNA_ID_2141597_gDNA_ID_604_Annot_ID_144143 3000 nt of promoter + ATG
taaaaaaaaaaaaaaatatcaaagcttatatcaaacgaacgtttcgcttgatgtacaaacgataatgtttttttaatttaatttaatattagattcagaaaagaaaaaaaaaagaacgttccaatactcaaaaagaattgcattggaattatctctctgtttatcccaatactcaagctctaggttgtattctaatttaagtgttaaaggtccaccggtgtcttcagtgacgtatacgaccgtggtacatgtttgtttacttcacatgagccaatataccgcaatctcccaaaaataaacgcaagatgataaaccacaaaattttacatgaatagtaaatcaaattaaagagtactttttatttcaaggtaaacagtacttgttattcagactttagtaatatgtaaagcaatattttcataggatcaaatatataaactagtaagtcatagtaattgcctaattggtacttttaagtctttcaaacaataaattaatatagtacattccgaactataaacatattatgaaaaagtttaattaaaattaattaattaattgagggtttgcaaaaaaaaaggttcaacctccacccaatttcatcactttagacagcaaattattttaaatgaaacaataaattcatatatctgtcttctactataaattaccctctctctctctcttatcatcatcatcaatttatataaccctctcaaaacacacaattttaagattcaaataaaattccttcttcaacattcaccaccacaacatcatg

SEQ ID NO: 12 - DNA, 689 bp, Unknown
  misc_feature (1)..( 689): cDNA_ID_3014674_gDNA_ID_649_Annot_ID_144481 3000 nt of promoter + ATG
aaacacacgctaacaattctttttttttcctctcacattttatttttttaataattaaaaaaataaatgttacggcatggttatatcatatattttaatttcatggaggatattagattgttcccattttctattgatcatattagattaaataattagaaaatactatttttctgtctctattgtagtggtatgtatgattggagagttgatgaaaatgtaagcaagtaaaatcatcgtgcagatcgcgatgctatgtttattatcatatatgcttaaaggatcatttgagattaataccgcaatcagcgggtgagtaagaaacttaaaacacataactactctctttgtcaatggaagaccctcttaagcatctaacacatgattcgtctacacaaccatttaactctaattatatcccctaattgatattaattaaatcaagaggacaaaaaaaattaaatcacttataaatattaattttatagatgtatattttaaaaaagagaaaaaagaaaagaaatgggaggaagacactgggacgaaagacgacgtcatctattgttagtaagtttagcccaatcgtgttctctctgcgcttgtctcccaaattctcagatctaatcagatcgacgattcctgatttcatcagcttcgagagagatccttcttttgttcttcgttgaatg

SEQ ID NO: 13 - DNA, 50 bp, Unknown
  misc_feature (1)..( 50): cDNA_ID_3014688_gDNA_ID_654_Annot_ID_144488 3000 nt of promoter + ATG
tacactcttcttcttcttcttcttctcactgtaaaaaagaaaaaaaaatg

SEQ ID NO: 14 - DNA, 378 bp, Unknown
  misc_feature (1)..( 378): cDNA_ID_3014701_gDNA_ID_655_Annot_ID_144493 3000 nt of promoter + ATG
  misc_feature (356)..(356): n is a, c, g, or t
accaccgaaaacaaactcagcttcttcttagctaagcaggcttaaggggcggctggacttatctaataataaaaatttgagtatctaaacgaataaattggagatattcttttagtgttatcctaattatagttataaaacaattataaccttagaaagtttcttggaaatttaatggtaatttcattaccgtaaatagtttttctttcttcttcacgttttttttttttgtttttgtcaaaactttcttttctcttttctctataaaaactaaaaaggcaaactttcctcccttttttgggtacacttgcccaaatgctcctctcagggctcaaattaaaggggggaaaaacagncaataaaatattaaaaatcatg

SEQ ID NO: 15 - DNA, 989 bp, Unknown
  misc_feature (1)..( 989): cDNA_ID_1665243_gDNA_ID_703_Annot_ID_144503 3000 nt of promoter + ATG
gtttcttgatcttgatattgttgttggacacatcatttttgtaaaatctgtgcttgttcagtctcaaaatatgttcgaacatttgggttttgaaagaaattcaaatcacaaaataatttttttttcttcttttatttgatcatatgtgggaaaaatactctaatggtgttgtttaaaatataatttgtaatgttttattattgttatatgatgtaatgttttttatatataattagtgtttaatttaaataatatcatattgtatgagaattttgcaaaactataatatatatgatcaaattgtaaattatataattaaaaagtactagtatataaaatataaatataatattgttaaaaatattcttttttatagtagaaaatagaaaaatacattagaattaccctattttatagtaaaatatagagctacaagatggtctaacccaacaaaattagtgttactttagtagttctttatttatttcacatggctaattattttcttatagttcattaaagagtactttattttgttaaactttaattaaagagtactttatttttgtaattaatatatatgaactggaaaataattagccataaagatcaatctatgccattaaaatgctctgacaggttccgacttgtttctcttgtcaacgcccaaattcgactttttttttgtttcccttaacaaaccaaatttcactgtttcattcttttacgcgtcgagagtcttctccatgagaagcaaattctcagcttcttccgatgatctagcttcacttagatctcatgtaagtttgtttatctcccgatctgattttctgtctctctaacgttgttgttgattgatcatgagattttgcatttacccaattcgtttcaggaactgatttggcgagtttgatgataaagtttgtatttttctttgtgggttgatttcaaattgtgagaaagattcaagattttttgtcgtctcaatg

SEQ ID NO: 16 - DNA, 129 bp, Unknown; identical to SEQ ID NO: 5
  misc_feature (1)..( 129): cDNA_ID_1010524_gDNA_ID_727_Annot_ID_144201 3000 nt of promoter + ATG

SEQ ID NO: 17 - DNA, 3 bp, Unknown
  misc_feature (1)..( 3): cDNA_ID_1585658_gDNA_ID_782_Annot_ID_144518 3000 nt of promoter + ATG
tgg

SEQ ID NO: 18 - DNA, 12 bp, Unknown
  misc_feature (1)..( 12): cDNA_ID_1027574_gDNA_ID_798_Annot_ID_144524 3000 nt of promoter + ATG
gcttttgaaatg

SEQ ID NO: 19 - DNA, 3 bp, Unknown
  misc_feature (1)..( 3): cDNA_ID_4254807_gDNA_ID_811_Annot_ID_144527 3000 nt of promoter + ATG
aag

SEQ ID NO: 20 - DNA, 742 bp, Unknown
  misc_feature (1)..( 742): cDNA_ID_1685621_gDNA_ID_813_Annot_ID_144531 3000 nt of promoter + ATG
caggttatgtataagttataacagttgcccttcttttctctctcacattcttaaaccagaccaaacattctcatgcagtttcagagcgggctatcatcacctttggtaataaacggtgttcaagaaaaccatttaatctcatggcttcctattaacaataaccagcaaatgatcatacctgctgactcaagttttcatcctcatccgtgagtgaaaactgttaatgcacttaataattaatatgctttggacttatatgctatattcaattgaaagttttatgatcagcagaaagatgaaaccggtttttgagttctggttaaacattagttttgagtaactgtagcaatgtgcacgctagttttcttgtatatacagtgtacctgtctacgtatgtgtgaacctacatgatattcagcagatttgtatatatctttgtgtcagtgtgtgtattgtataatacaacactagtgaataaaaaagaagagttttaattgtgatgagcatcatctgatgtctccaactcaaaaggcttatttccacaatcaacggtagagatctaaagataatgagaaaatttgcacaatcttctttaatatcgatatcttcttccacgataatcttacagatccagaagaagatcacacatggtttttgtataaattagacaaagctttacttgcagaacagagcagaaacagaacatatattctctgtcttttttttgtggcaaaagtaaatg

SEQ ID NO: 21 - DNA, 646 bp, Unknown
  misc_feature (1)..( 646): cDNA_ID_1573308_gDNA_ID_818_Annot_ID_144538 3000 nt of promoter + ATG
  misc_feature (199)..(199): n is a, c, g, or t
tgttctttgagtattaatatatatgattatatgtggtatgtttagaaaaaaacaaaaaaccaaatatcaaacctaaacttattaaaagtaaagacacatttgattaaattctaaaccaaaaacgtacaaaactattcgcttatgatgatattatttatcataaccaaaactttcctaaactggtcgtcttctcacgtcnggtttactactacttcggattgaagaattttgatcgtctcgttgctaactccacgatgtctttctgacgcttaatcttctgacagaagacaaagacatagcataaaaaagtaagcacagaacataaacggatgtttattcttttctagacggtatatttatataataacgaatcacttatcaaaaagctggagtagctcagttggttagagcgtgtggctgttaaccacaaggtcagaggttcgacccctctctctagcgtttcttttccttttgtatttttaagatttaaaaacatttttccacggctacaaaagaacattctcgacacacataaaaaaattcgaaatttccagaactctcttgtgccttcttcttcatcttcctctgtttttaaaaatgcaatcaagcagattctcacgatacctaaaccaaatccaattcaatg

SEQ ID NO: 22 - DNA, 823 bp, Unknown
  misc_feature (1)..( 823): cDNA_ID_3046082_gDNA_ID_884_Annot_ID_144617 3000 nt of promoter + ATG
ttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacaactttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaacacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtgatg

SEQ ID NO: 23 - DNA, 391 bp, Unknown
  misc_feature (1)..( 391): cDNA_ID_3013768_gDNA_ID_898_Annot_ID_144628 3000 nt of promoter + ATG
caaattccatggtttgccaatagaggatccactcgaccactttgatgaattcgataggctttgcaacctaacaaagatcaatggtgtcagtgaagacggattcaagctccgtttgtttccattctccttgggagacaaagcacacatctgggagaagaatctgccccatgactcaatcaccacctgggatgattgtaagcaggcttttttgtcaaagttcttctccaatgccagaactgcaagactcagaaatgagatttctggtttctcacagaagactggtgaaagcttctttgaagcatgggagcgtttcaagggttacaccaaccaatgaactaaagcctctctgctcagcactctttacagaggagtcttaccacgcatcagaatg

SEQ ID NO: 24 - DNA, 117 bp, Unknown
  misc_feature (1)..( 117): cDNA_ID_3015042_gDNA_ID_911_Annot_ID_144641 3000 nt of promoter + ATG
  misc_feature (66)..(66): n is a, c, g, or t
tcatacttacacatgcatggcttaatctttgagacaagcatatgactactggcaggatcaaccagntagcattcatcgatcacggcaattccccgccacatcctctcaaacgcaatg

SEQ ID NO: 25 - DNA, 276 bp, Unknown
  misc_feature (1)..( 276): cDNA_ID_3014074_gDNA_ID_989_Annot_ID_144724 3000 nt of promoter + ATG
aagaaaccaaacatcaaccactacggattttttgatgcattggatatgcaaaggtagagaaaccactcctaaaaaatttagatgacatattgcgtatgttggttcacttaggaacggaaccgggatcaaaggcataccgattacttaatccacaagtaaggaagatagtcgtacgtagggacgttgtatttgatgaaacaaaacggtggaattggcaccatattaattcggaacaagaacaagatgaaggtttcagctttgcgttcggagaatatg

SEQ ID NO: 26 - DNA, 3000 bp, Unknown
  misc_feature (1)..( 3000): cDNA_ID_1585796_gDNA_ID_1007_Annot_ID_144573 3000 nt of promoter + ATG
  misc_feature (2208)..(2208): n is a, c, g, or t
catggtcctaaaagcccatttgacatccttacatgttcttcatctgttggaacccaatcatattcgagtcacccgtcatctgtcacctcttcctctagttttccctcgaggaaaatatctggtatcgtttcaacgagttgaggcagatcatcaaatggatcgtcaagaatatatgtgtgctgtattattatgtttttaaagggatcaacagaaactttggctatcctagttagagtgtcaaacccctcggcagtctccccatacacctgaaaaagggcctagtaatttgatatatacacaaaacaaagaataggtagatcattaataactagcacttacattgcgttttcgatcgacatggtctagaccatcactaagtgtaatatagaattaaaaatgaattaaacaaatgacataagactcggcttttacagattttttgagatggtcgttggtctggtttgcttcattatttttctcagttcttaggatcgattgcctacaattctagtttttgtttgatctttcattttttttaaagttccacaattcttagttgttatggtctttttgtgccatgtattgtatcaagtgcttcttgtgtatagtgatttagttttcgagaattttttgtttccgcagatattagtatttcaaaaacgtattgatatccattatttcacccctaatttatataatcaaaaattcaattaaaaaaaatatggtgtgtatcgccaacgtagaatttcaatatatataatattacagtctttttttccgcacataatattacagtttctacttaagttaatgatatgaattatttaggtatttatataaaatatttaattatatttttacacactaaaaacaaataatgttaattattaattattattatattaatctttaaatgatacatgaataaacgagacaatgagtaaataatatattttggaaaattgagacaaaaagggacaggacaaaaggaagctgtgcaccgccaactggaccgtggctgtagtcttctaccttccactgtcatagaaacagaataatactctttgttctttgcttcttccatggaaactctccacttactagaaataaataaacctacttttcgttaataacttaggccaaaacaaagattaattatatcaaaattttactagttaattaactttaaaatatactttttaattaggttaaaacgttctttagttgaaatttgcaagtgattagttatattagcttcaactaatggaaacatctcacaatttgtcaaaaactcgtttagaaaacaaattgaagtctagtagccttattttacgtggaatagactttatatatggtaataaaaattataaatattcttgcaatgaattttattttttctgttgactttctcaaatttgagtactgatttgatttgttgcacaaaaaaaaaagagtacttatttctgaattttgaaatcatcttagaatgtataattgtattattaaagtttttgagttttttttgtgaaaataaagtttttgagttaattgtgatcatacatgtatctatgtgtaatcttaaaactatctaatcatattcactactttctttttttatatttatcaaccagaaattaaattaagtaaataaccattaaattaagtacaatagaaagttatgttttcagattttcttgtgatgtttgtcggtgcttcaaattttttctcttctttgaaaaattgataattatatagttttctgactttttcttgtttgtcggtagaataagagaattcggatgagtaataatggatgactataaggttaattcgttcattttacattagcaaatgcattagtactcatgatagtagtttaagtatcatatgaaagttacacaacaactaagctgtttttataacttgaaaatatcataacactattcaatgtttaacaaacggagccggactccatttgcaatcttttaaagtaaaactagaggatcatattctcaatattaaaattaattttaatattccaacaatgactctttgtgatttgccatctcaacaatgaccgacaatttataatttattttagttaatgtcgtttatcaaaataaaatatcattctttcttgttaacattaattagcagtttcgaagtaatatagaaagacgaaattgtgaacttcacatttttgtaacnggtaccaaagtagataagacttcttttacacatctacttaagttccatatatctcttcttctaattactacactaaaatataaaaagaaaaacttaactatcaagcaactaaaagaatgaaaagtatttgtacattgtacatgaggctagatggattagagatccatgttgcaattcaataatggcattcctcaaattagctttccaaactttcatttatgttatttggaaagaacataatcgcaggttttattctcgaataactagatttctatcggcttgattatatatatcaaaaacaccattcgttactagctaaagccttaatagttacctattagatcaattgacttagaaaatcttagaatatgttataaatttggtttatttttatgttttacgggcgaattttttttgttttttataattgcttgatttttaaaaaatgttgtatttttttaatgaaaaaaacaaattactaaccgatttcttgtccaatttttcagaaaataatttttaagttgagaaatttactaaaaatataaaaactactaaatatattaatttaagactaattttaaagacaataataattataaaattgattaatgacgtacgcgtttgtgtaaatttaccaaaccatacccttcaaaaacccaaccacaaaatttgacaaactcatcgtttaacaaacatttcactttcctcttctcccaccattttcagagctcagagaaaaagaaagaaagaaaaaaagcttcgtgctccttcaccttcccaaatcggaaaaca

SEQ ID NO: 27 - DNA, 45 bp, Unknown
  misc_feature (1)..( 45): cDNA_ID_1663391_gDNA_ID_1067_Annot_ID_144765 3000 nt of promoter + ATG
catgtatatatatctgtgtatttgttccagagcttagctaagatg

SEQ ID NO: 28 - DNA, 209 bp, Unknown
  misc_feature (1)..( 209): cDNA_ID_3013115_gDNA_ID_1087_Annot_ID_144787 3000 nt of promoter + ATG
tttcaagtccggacataggaaatagtcgtggttcgtcacctgattctcatttgatgggaaacaaattgcagaacgagagaaacagttcacattactttctttctgagatcaagaggaaactaaaacatgcaatcaaaaaggagcaaccggccgggggatttggggaagggtttccgaaaactaaagatcatttctttctcgagcggatg

SEQ ID NO: 29 - DNA, 389 bp, Unknown
  misc_feature (1)..( 389): cDNA_ID_1596343_gDNA_ID_1174_Annot_ID_144854 3000 nt of promoter + ATG
gcttactgttattttgcatgataatttaaacaggctctgaatatatatcagatggaatatatctctctctaccctcttactttgtcatacggtaaatagtgataaaattgtttttgtctagatgcctctaatctgcacatactttttctgtatatgataagaactgtattggagattagtaaacgggaaaggtctaggataaaagttacggcgtcaatgattttcattttcaatgtcaatgttttagactaaaactatgaaagagagaataagaggtacctcctttaggtttgttttcctatttatccaggttttgttgtcctgaaaattggttttcccgtctctttcatgttccttagggtctctttcatgttccttaggaagcaatg

SEQ ID NO: 30 - DNA, 50 bp, Unknown
  misc_feature (1)..( 50): cDNA_ID_3077584_gDNA_ID_1200_Annot_ID_144876 3000 nt of promoter + ATG
  misc_feature (24)..(24): n is a, c, g, or t
ggagactgtgaaagcggattcatnatgcttttggagaaacgaatttgatg

SEQ ID NO: 31 - DNA, 133 bp, Unknown
  misc_feature (1)..( 133): cDNA_ID_1387605_gDNA_ID_1201_Annot_ID_144877 3000 nt of promoter + ATG
  misc_feature (16)..(16): n is a, c, g, or t
  misc_feature (26)..(26): n is a, c, g, or t
  misc_feature (41)..(41): n is a, c, g, or t
  misc_feature (60)..(60): n is a, c, g, or t
  misc_feature (67)..(67): n is a, c, g, or t
  misc_feature (74)..(74): n is a, c, g, or t
  misc_feature (86)..(86): n is a, c, g, or t
  misc_feature (111)..(111): n is a, c, g, or t
aacacatcactttggncctacttagnacttacctgcccctntcgacaaaatttcttctgnactttcncatttcnctgtaataaacncggtaggtttgcgaaaacctcgccnccgggaaaaaaaaaaatcaatg

SEQ ID NO: 32 - DNA, 209 bp, Unknown
  misc_feature (1)..( 209): cDNA_ID_2994649_gDNA_ID_1291_Annot_ID_144955 3000 nt of promoter + ATG
ctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatg

SEQ ID NO: 33 - DNA, 3 bp, Unknown
  misc_feature (1)..( 3): cDNA_ID_2994649_gDNA_ID_1292_Annot_ID_144956 3000 nt of promoter + ATG
gct

SEQ ID NO: 34 - DNA, 868 bp, Unknown
  misc_feature (1)..( 868): cDNA_ID_1586207_gDNA_ID_1303_Annot_ID_144969 3000 nt of promoter + ATG
acaattactctgacacatcaaatcagctaaaacctaactaaatataccaaactagcaacacatatttttgttattaaaagcatttataatgataaatcatgatcagaatcatagtaagcagattcgaacactagtctctcaaatttcggtagtaaagttttcaaccattagaagacaaatacgattttaacatcattagtattgttttttcttttttaatttaagcgttggctttccaaaatgaaatagtaacaagcattaacgagttaagttgtcaatgggggaagttaaaactctttacaaccaaaaaattgaccacacaacacatatagtgcccactagttctctcaaacgaatatggaatactttaaaacccacctctattctcaagaattaaagcccagaatttcaacgttctaaaaatagttttgaaagatttgtttttcacgggtttttcgtaaaataattatgaacaaaacaaataaattcaaactaatttttacacgtacaaatctgactcctagcctcctagatgaaattcaaaattttgtaccagcagctcaaagctactaggtaaaaaatgtcacgagagaaaaccggagaatattggtggttcatcaatacgaatcaaaccgaaccaagtcataaaccggttcatagaaagataagaagacagacaatcaatagtcatcactttggtctcgttgagcctttcgtccatatctcacctgaaggaaagacgttcagctttctctttccaaaatcaaaagctctccgatcagtttctccggcttaggaaattagttgaaggaaggtgatgagaggtactactgagaatacggatctgttcgatcccaaaacccaaatg

SEQ ID NO: 35 - DNA, 58 bp, Unknown
  misc_feature (1)..( 58): cDNA_ID_1596332_gDNA_ID_1330_Annot_ID_144987 3000 nt of promoter + ATG
cagtgttgttatatagaggagaatctggaatcacaagtagttttattcgatctgaatg

SEQ ID NO: 36 - DNA, 5 bp, Unknown
  misc_feature (1)..( 5): cDNA_ID_1586187_gDNA_ID_1336_Annot_ID_144994 3000 nt of promoter + ATG
ttatg

SEQ ID NO: 37 - DNA, 7 bp, Unknown
  misc_feature (1)..( 7): cDNA_ID_1016386_gDNA_ID_1421_Annot_ID_145056 3000 nt of promoter + ATG
tggcatg

SEQ ID NO: 38 - DNA, 214 bp, Unknown
  misc_feature (1)..( 214): cDNA_ID_3013870_gDNA_ID_1466_Annot_ID_145090 3000 nt of promoter + ATG
aaacacttatctttaattttggcttcaacttttcaaaggcacataatgatcacactgtactgtatcatcttatctcataaatgagaaactcgaccataagaactgtctatagtgtcagaaaagttatcaatagttcaatactaagaaaccggcctatatatatatttgtggtcactaatttctccaaaaaccagttgccttccgtaaaaagatg

SEQ ID NO: 39 - DNA, 344 bp, Unknown
  misc_feature (1)..( 344): cDNA_ID_1033925_gDNA_ID_1507_Annot_ID_145123 3000 nt of promoter + ATG
  misc_feature (154)..(154): n is a, c, g, or t
  misc_feature (223)..(223): n is a, c, g, or t
aatatatcatgctattttaaacaaatacatataaactttataactaaagctaatgctattttctgacacaagatcattctctcaattcttttccatttcatagttagtttgtaatattaccctaaaaggaaaaagaaaaagaaaagggcaaaanccctaaaaattcaataaaacggtaatagcaatcaactccttaatctcttaatgatttataaaacgtacngaaacaaaacttaattattataactagcccctatagttattttaaataaatatctgtctaataaatttgaccaaacccttaagatctaattttctctgtttgatttgtcctctcaacaatg

SEQ ID NO: 40 - DNA, 276 bp, Unknown
  misc_feature (1)..( 276): cDNA_ID_4254289_gDNA_ID_1522_Annot_ID_145137 3000 nt of promoter + ATG
  misc_feature (149)..(149): n is a, c, g, or t
catcaatatatgctaaaccgaaccgagactgccccacataaaattgaattgaaccaaaggtttttaatttttacttcaacatagcgaataagaaaaagagggtatatattcattattcaattattcaatgttaatgagaaggcgtctgngtttggttcgacacctcaaaacttgttttgcctttagcatctccgagtaaggaatccaggtccaaagcctcttctcttcctcctcctcgcttccttctcacgcaaccttggatccaccgcagctatg

SEQ ID NO: 41 - DNA, 292 bp, Unknown
  misc_feature (1)..( 292): cDNA_ID_4371048_gDNA_ID_1526_Annot_ID_145143 3000 nt of promoter + ATG
aaaaaaaaaaaaacttagtgcatgacttaattggcataaccattaatattagtcccaaaaaaaaaaattattagtccaccgtcgaaggaaaaaacaaaaagcagtagacaattcttgaagtaaaattaaagggatagacagataacgtttacgagaggaatcatgacacgtgaacatggagtatcggtcaaacctggcaactgggacatttctttaaatacccacaaaatatcacttttgaagaagtaggaaaaaacaaaaccaaagaagatctaaagagataaagagaatg

SEQ ID NO: 42 - DNA, 11 bp, Unknown
  misc_feature (1)..( 11): cDNA_ID_3019355_gDNA_ID_1532_Annot_ID_145153 3000 nt of promoter + ATG
catataatatg

SEQ ID NO: 43 - DNA, 187 bp, Unknown
  misc_feature (1)..( 187): cDNA_ID_3013591_gDNA_ID_1535_Annot_ID_145155 3000 nt of promoter + ATG
aaagaatgttttctaatccttcgccggccggaaaaaaatctacaaactccggcgataccctctactccgattctcacttccccgagaaaccaaatcaaacttgatctgagaatcttcaacaacactttcagatccatgaaaacggatttgaaaatccccaatcagtgaaatcgaagatctagttatg

SEQ ID NO: 44 - DNA, 67 bp, Unknown
  misc_feature (1)..( 67): cDNA_ID_1596062_gDNA_ID_1579_Annot_ID_145191 3000 nt of promoter + ATG
cactgacaaagtccttagctctaagcgatggaatttatatcgacagctaaccctagccagaaaaatg

SEQ ID NO: 45 - DNA, 62 bp, Unknown
  misc_feature (1)..( 62): cDNA_ID_1691191_gDNA_ID_1665_Annot_ID_145267 3000 nt of promoter + ATG
tggttcttgaacatcattgcatgttgattaatcacacagcacaaataagagttagaaaaatg

SEQ ID NO: 46 - DNA, 31 bp, Unknown
  misc_feature (1)..( 31): cDNA_ID_3013609_gDNA_ID_1706_Annot_ID_145304 3000 nt of promoter + ATG
gaaagcaatggcgtacggtggtccgtccatg

SEQ ID NO: 47 - DNA, 2984 bp, Unknown
  misc_feature (1)..( 2984): cDNA_ID_1587391_gDNA_ID_1731_Annot_ID_145324 3000 nt of promoter + ATG
cgatcatgaagaatgataaaagctcaagctgaaaaaccaaaccttatgatcatgttttgattctttatatatcacataagacagaagattatcatcaaagttacacaaacctttttgtcagattgtgcagctttgagaaaccgtctcatgaacacatatggagttggcagacagaaattgaattgcaaggtattcgccattaacttctcctgcaagacacaataatgatcatccacatataaagcagagcatccatggttataatcaggacaagatttagtgaaggattttaccatatcaagaatctctgtcctagtataagccttgtcagagatcaggattagatcatcaacaactggaactgaaacttcttcatatttgcaagcaagtaacatagctgttacacccacaagctgaagctttttcctcgcgatatgttgatgaaccgcaagaaatctgtcaatgagattgattgtcaggtaaagcgtctcctccatcagctcaaacttgtaatgtacctgcaacaaagattcacagtaagctttacagtgagacaactaccaacaacagagcaattttatgttcatgtttttgtgtgtgtatatatatatacctcaatcaaccaatcaataaggattcctctcatcctctcgttaatgtcatgttgattctccatgtagttaggcgggacacagctacgacactgcaaaataattgaaaaagtttcaatcttgaagctagaatgatcataatgatacagaaacagaacactaaaagttacctcatttttcttgtagaagcaatatatgtcattaatgtattcaactacagataaaggattgttcttgtcacagctgtctatatccatcacagactcttctacttcagcatcaatatcatttgaatcttgcatttcaatcccttcctgcagaattaagacaacaggtttcttcatccgagtaaccaacaaaaaatagtggcttaaataaaacatgttattattattaccattttgtcaatctcttcaagcattgcttcagtatgttgaacaaacattggttcattaaagtctccttcttccacatctgttatgattctatctaatgcttcgtttgaaatcaagtctggtttcttggtttcctaaccacaaaaaaaccacttggaattagacaacctaaaccatgtcatgttttcaaatactaaattcagatagaattaatataaaggtacctccttgtggatttggagattgttctcagctaattgagcagcaaatttcctgaaattaaataaagaattaaacaaactcatactacaattttgaaatcgaagcagaaatcaaatgaaatcactcacctagtaactggtcgatgcactggaacaggtggaatcttcttgttacaaatcccatttttcctgagaaaacaattggttactaagataagtctatgcaacgtttttattaaaggatcattgaaagaagaaagtaataaaaatataattactcagtgaatggtctcttgacagcacaaggatagaccggagctccgatgatgttcttgtttatattactcagtgcccttcttgtctgtccattcgtcggaattacctttcctccacgtaaaccccctaacattggcaaaatcatctttttagttaatcaaacaaaagattgatttttgattaaatgggtcttcttgtttttaattctgatctaccttgttgtcgattcatcggtccaatgactccgtgtctgttctcatccgatccacccattattatcttccgtatctgagaatcgcagaaacactcgcatattaacaatccgaattaaaaattgggtcttgaatccgatttgagaatctaaaagactcgacgatcaagaacaagatgtactctcttaaacccatatgaaatctacactaaagtatttaccttgacgctttcaacgaaactattaacctctctctatctctatctctctgtcagaactcagaagcaaaatcccataacagcaaacacaaatcaacctctggctctcttcaaagatcttcaagagtctctctctttatcttctttctctcacaacgaaaacaaaattgaagaaaaagtggtaaaagagactgtagagagagtaatcaaagatttcgaagacgtgaagagcggatatatgtctgcaacacaccaaaaaaaaatatgttgttttacgaatcgttatctttttttcccctttttagaatcaacggctagttaatcttaaccgttggatacaacctcagaaaaaaaacctaatggaaaaagagaataggagcccaacggctatatttgtaaccatgtgcgtttttcaaatttggcttattttcttcgttattacttattactaccacgctcaagtctcaaaggtccaatggtccatgttttatttcaatgtcaccgaccaccaaccgcttcctcattattaagccaatctaaatattaataccagtcgatttgaccccaaaacaaaaaacaaaacttagaccacattattattaacccaatctgataaattttaattttacccgattctgatttttaatactcaagctagtagatgatttaaatctttaaaccttagactaacggctcttcgcctttttgctttttcctctttacatctttttctccagtagctttgttagtcaacacattttccaaaaaggttgaaaataagtcaaagtacaaactgaattacccaatacggcccaatatcctgattagagagttaggcccaatatatcatcagatttgcaatcgcaagtctctttcaacttctcgtcgaatgttatactctcctcagagtttctccggatctttcaaaaacaattccggtgaagatgaatcagttctgtgattcgtgatttatgttactcaatagatttctcatgttatagtcaccgatctgtatcgaaattttggtgtggattcatcaagcttctcaaatg

SEQ ID NO: 48 - DNA, 1166 bp, Unknown
  misc_feature (1)..( 1166): cDNA_ID_1595874_gDNA_ID_1738_Annot_ID_145335 3000 nt of promoter + ATG
  misc_feature (33)..(33): n is a, c, g, or t
atataacggatgaataacgaaaaaatgaaaaantatcattaatgatataatatgcatatgggacaaagcaatcttatccgttacggactatataacatatcatttcttaatcatatattatatacgtatatatataatcgtatatcatcagtaatatatttgttgtaagaaaaacacatactgtatatacatgaccaaaaacatttcgctttatgcattgatgtaaaaaaattaaaactatacataaacacatcaaaaattacagacacttaacagatgtaccatgtttttttaagaatcaatagttacaaaatttgagaaaaaggtgatattttgtcatttcgttggatatgaaggaaccaatgataaaacatcgttagttactaattcaaacaacaaaaaaaagaaccccgaatttaaatgctcaccatcgacaaaccttggctatttattttataaatataagacaagtactaaatcctatcaacactaaacaataaaatcgaacatgttcacccaattataatctgacagctgaagaagataaggaaatactaaatatagagaggttcgatgacagagagaaaaaggtagactgaatcaccatcaaaaccacgcccaagaaccctaattggggaaagtggccaaatgaattctcgccacgtgtggatctgatggtgtcagagtcggtaaagtttaaaaaaggtaatgtgtgatgtctcgataagggcttttaaactggtcgttttgtctgggacacttgtacagttttggaaaggaggacccatgactagggcattctttagttaattttaaacttgataaatcagtatttcgtttctatatatttgtttatgaaattctgtatcattagagaaatcagatgatgtggcaatcattatctgttctctttaatcgaccaaaggttcgaacaaaatatcattgttggttatctgatatagagaaaactaatttagaaacctcgttttgaaaaattccaactacaatatgagatttgattctacaggagtttggaatatgggaaagggaatttacaaaagtgattgttgaaacattaccgattgttaaatggtaatagacagctgaagctgcacaatgacatatggtaaggagctgggagcaaaagactaaggaccgaaacgatg

SEQ ID NO: 49 - DNA, 3 bp, Unknown
  misc_feature (1)..( 3): cDNA_ID_3013497_gDNA_ID_1759_Annot_ID_145348 3000 nt of promoter + ATG
cta

SEQ ID NO: 50 - DNA, 229 bp, Unknown
  misc_feature (1)..( 229): cDNA_ID_1596387_gDNA_ID_1773_Annot_ID_145352 3000 nt of promoter + ATG
tttttttttttttggacaaaatcatactgtgaaagctaagtccaatttatctttctctaaaatgtgaactgggtcgttctatttaattaccaatgacccgaccaatatcaccttttaaaagccacgtggtgtgagccgggtcggatcttggataaaagtcttaagtgtagttatatgggtcgacggttccgggttgatctccggcaacgactgcgtcacttcatcaatg

SEQ ID NO: 51 - DNA, 1100 bp, Unknown
  misc_feature (1)..( 1100): cDNA_ID_1587274_gDNA_ID_1775_Annot_ID_145354 3000 nt of promoter + ATG
  misc_feature (624)..(624): n is a, c, g, or t
  misc_feature (647)..(647): n is a, c, g, or t
tcactcattgaatcattgttctaatcgagatgagtaactttgaggtggagggtccctttcacgtggcacataaatatggtaaaactttgtaccaatttcaagccatgatacgattcatcgcacccgtagattttcttcatcgaatcatcatgagaacaaaataaccaaagtcccttttcttaaaagatgagagactgatagaaatcaaagaaaatgccagcactgaactttttctctaatttttttaatcctcctaagcttagacttgagagtaatgcaccattaagtgggatctttaaaagcaaagatgcaaatttgattatatataaaaactgaaaagttgatttttaaaatttcccacttttttaatttagggaattgggattgtctaaatagggacactttaactctttgtgggtgggtgggttggtgtgggctagacactcttttattttctcaaaggttatatgaaaaatggtaggtatatcacatatctcaatgataaatcataaatgtcacaaattggtcttcgaagagtccaattacttggagtgtctaaaatagtgagattttgatggattggtttattattattttgcgtgtacccttgtttttttttggaanactcaaacgtaaacggaatgaancaatcgtgggttatatgacagagactatagaaaacaaaaaatatcgaagagaaatagatggactatggagatgaactattagtgatctcacttctcacgttggatattgcttcaaattgtgagagtatatatattggtaacatttttatgcttatacatttcttggattggacagttttacacgtatcgaaactttgatcaacttctctacttttaaatgatcacagtgcggaaaatttaaagttcctttacatgaatatcccacataaaataaacagggaaaaaaagaagagcccaacaagtgacattaatttaagatcttaaagaaaattacataaactttattattatagcaaaaaaataaaactcaaaacacccttaaaagctccaagttgtccacatttttagggaactgagattgtctcactacacttgcaaaaaagacacacaatg

SEQ ID NO: 52 - DNA, 666 bp, Unknown
  misc_feature (1)..( 666): cDNA_ID_1587153_gDNA_ID_1787_Annot_ID_145367 3000 nt of promoter + ATG
  misc_feature (45)..(45): n is a, c, g, or t
  misc_feature (650)..(650): n is a, c, g, or t
gtttcattctcgctctatcttttgctttcctccttctctcattgngtcttttattctgtttatatattaatatataatattagctcaaatatatatacatatatattataaataaatatacgataacacgtaatcttttataaaaggctaacccatttaaccccaaattttctcctaaataagtttaaataagtcaatttctcctatacatacctatttattaaataggggttctatgtccacattaacatcactcatacataatttatgaatattataattaacctgaggaacgtggattggaatccagactcaagctttaaaggtattcgttcacttccactcctagtaaaagaaataacacagaaaatcaacgagtgctttatcaaataggtcccaagtcccatatcgaaataagagaataatttttaatttttaattttggacaacttgttttcattcattcaaatcaaaacaattacatagagtgatttagagatcacaaagtttaaaacataggtaaaggaggcattccccaatgcccaaacatgatagataaggtgagacaacaaatattccatgagagctttcagacaaaagcaattcagcgttttggtacatgtgaggtcacggtttgtcgaatgatcttncacgagcgagtcgatg

SEQ ID NO: 53 - DNA, 64 bp, Unknown
  misc_feature (1)..( 64): cDNA_ID_1691224_gDNA_ID_1822_Annot_ID_145379 3000 nt of promoter + ATG
ataacccccacgaattgtttctacccaaaacgtttaacattcgaaaaagaaaagaaacggaatg

SEQ ID NO: 54 - DNA, 2273 bp, Unknown
  misc_feature (1)..( 2273): cDNA_ID_1396304_gDNA_ID_1848_Annot_ID_145387 3000 nt of promoter + ATG
ccagtcaattaatcttctgaagtttaaaagttaacaaaagttggagtttcattttaacagaactgcatagatataaaaactatttgtatatgacattcatggtacggaagatagttaccatttccaagttctttgtaagtccaacgcctgtatggaacatcttggcgagttgataaaaagcctttggttgaccagcattggcagcaacaaagaaatatttggttgcatgcctcacatccttcttgactccaatgcctttaagatacaacactccaaggttataatgcccgctaggatcttcattattagcagccatctcaaagtattctctcgcctgcacttgaagggaaatatcaacgggatatctttaggtcataagatatattgaaggaaaagtcaaaacaaaaactgcatctacgatggtttcagagtgccactaagcgactctttatatgtcctgatcaccactaaagatgagatgtgcttcagtttggtactttaattgttaagactaatttagaatgttttacatacagtcaaaaatctatcccatgtctcaattccatcatcattgtttctaagtaaaactaaattcttcaagtcagataaagaagcaagcctagtaagtatgaagcaaaagttaccttagtgtagtttctcttatctactccatagcctttgacatacaagtaaccaaggccattaaacgccgaatagagaccttgttttaccgcaagtgtaagacattcacgtgccttatcataatctctctcaacaccagctcctctagcataaatctcccctaaaagttccattgacataggctctcctttctctcccgccttcgaaaaccaatacaacgccttagcgtgatcacgccttaaccctctcaaaccaaagtaataaaacagtccaattttgtgcattgctacagaattccctttctctgcctggtattccaatatctgaaaatcctcatcttcctcccctcgtgacttccttagtgcatctttattctcctctgttccaatgtggattctaactggctcagccattggagaatccttggatatcaaaaagctattcactgctgtctctgctagttcagcatataactcaacagctttatcatacatctgtgaaaaggatcacaagaaaccaaaaaacttgaaaattagataagttccaattgaaatgttcagtgttgcttgcttacattttgtcttagatatctaaaagcaagtgccattttagactgcatatttcctcccgcagccgcgaaatgatgatgcaaaatcgatttgcttcggctcgtctcacgcatcatcccaatcccgtatacgaaccccatcactgattgtgcgtgtggatctcctgacgaggcagacgaatctatctctgaaaccgcttcctccatcaatgtagtgtttccttcactcgcagccgagagaattttgtggagtccggagtaatactgcggcgacgcagaggcgtggacggtggaatcatttgtctcgaagattcgacgccatgaaccgggatcaagctcctcttcggatttgggttcggattcaccaaactcatcgaaatcggaggattcgtaggcgccgtttatcatcaaacccgccgttgagatcttcgttggagagaacgagaacgaagggacgggcttgaacacgatggatgtagagtgagagtgtgaatagagatacggctatgatactctgacctgagactctcattctttcttttctccagtttctcagtgtttctcagggaagaagacgaaacaatggatgagggtaatgacgtaattttatcacactcccttatattgccacgttgattattatccctcatacaataatcatccgccacgtaaacatgtagattagcccctaaacttatcattatgttgttaatttttcttacaagtgttgcactggctaaggtttgaaatgggctctcttggagtaatccttattttcatcagcatttaatgagattttatggatttttttttttgaaaaatttccatagaaatgaaatgtaaataaagattttatcatgcaataatccaaaatttagttttgaatcttacatggatgcacatatatcaaaacaaatcagacaaaaaaaggtaaatataatccatgaaattcataacaaatctcaccttcataattaacaaacaaaattatttctatgcctcatcgatctccacctatttatatgaacattgtaaacaaagaaaaacaaataacaaaaaaatg

SEQ ID NO: 55 - DNA, 1363 bp, Unknown
  misc_feature (1)..( 1363): cDNA_ID_19407_gDNA_ID_1848_Annot_ID_145388 3000 nt of promoter + ATG
tataattataaattaaaaaatgacataatcagaagaagatcattgccacaaaagcagacagaaagctaaatcgattgaagctgatagttgaagctgaagaagttcctgttcattaagaaggccgtgtcaattactttgataaaatattattagagtttgtgtattttaagtttttttcaacaaaatgtaacaacaaatttgaaaataaacaggaattagtgcataccattggttgatcccggcgacgcaataggcgaaggagcttcatttacaagagagaaaaaacattaaaataacgtcgtttatacttatcaaagatatttgattaagttatatatctatgggatcttataaatagaagaataatcatcactcactggctattttggagcagagtgaaacgtcaggattaactccacatgcattgggaagtaggagagcgttctctttggtgaggtttagggctttgagcacctccggattgttaaaagcggtgcataaacacggtgcgtctttctctacgatctctttcattggcccgcaacacgatggcggaggaggcggattcaatgagtgtatgtacggctgacacggcagcagtttgtgcagacaagccgtcaactgagggcttcctccttgtgccgtcgcttcgacggagtagaggaccacgacgactacgactacggccagaaatttgttaatctccatttttttgttatttgtttttctttgtttacaatgttcatataaataggtggagatcgatgaggcatagaaataattttgtttgttaattatgaaggtgagatttgttatgaatttcatggattatatttacctttttttgtctgatttgttttgatatatgtgcatccatgtaagattcaaaactaaattttggattattgcatgataaaatctttatttacatttcatttctatggaaatttttcaaaaaaaaaaatccataaaatctcattaaatgctgatgaaaataaggattactccaagagagcccatttcaaaccttagccagtgcaacacttgtaagaaaaattaacaacataatgataagtttaggggctaatctacatgtttacgtggcggatgattattgtatgagggataataatcaacgtggcaatataagggagtgtgataaaattacgtcattaccctcatccattgtttcgtcttcttccctgagaaacactgagaaactggagaaaagaaagaatgagagtctcaggtcagagtatcatagccgtatctctattcacactctcactctacatccatcgtgttcaagcccgtcccttcgttctcgttctctccaacgaagatctcaacggcgggtttgatg

SEQ ID NO: 56 - DNA, 70 bp, Unknown
  misc_feature (1)..( 70): cDNA_ID_3598401_gDNA_ID_1860_Annot_ID_145390 3000 nt of promoter + ATG
cagacatttggcccgaaaaccccgttactgtgatgatggagacaacttagctctgatctatgaatatatg

SEQ ID NO: 57 - DNA, 1750 bp, Unknown
  misc_feature (1)..( 1750): cDNA_ID_1691250_gDNA_ID_1860_Annot_ID_145391 3000 nt of promoter + ATG
cagacatttggcccgaaaaccccgttactgtgatgatggagacaacttagctctgatctatgaatatatggaaaaaggagacctgagggaaaatatgtcaggtaagcactttaatttagttgaatccatctccttagacagtttgaaacattcaaagcctggtacaggaaaacacagtgtcaatgtcctaagctgggaaacaagaatgcaaatagctgtagaggcagcacaaggtgaactaaattatgacttatatacttttcattcacaacaatttgtgtggtagtctgaaagcaagattgacataaacaataactatttgtaacaggattggagtatttgcataacggatgtaggcctcctatggtacatagagatgtgaaaccaaccaacattttattaaatgagcggtctcaagcaaaactagccgactttgggctatcgagatcttttcctgttgatggtgaatctcatgtcatgacagtcgttgcaggaacacctggttacttagatcctgagtgagtgaatcaatctgtttcttgtactgaaataagttatgaagaattgggaactgtaacctctctttatgatactcttcttttcaggtattacagaacaaactggctaagcgagaagagtgatgtgtacagctttggtgtagtgcttttagagatagtcacaaaccagcctgtgatgaataaaaaccgagagagacctcatatcaatgaatgggttatgttcatgcttaccaatggggatatcaagagtattgtcgacccgaaactgaatgaagactatgacacaaacggtgtgtggaaggttgtagagttggctttagcttgtgtaaacccgtcttcaagccgtagaccgacaatgccacacgtggtgatggagctaaacgaatgtcttgctttggaaatagaaaggaaacaaggtagtcaagcgacgtacataaaggaatctgttgagtttagtccatcttctgcttctgatttttcccctttagctaggtaaaagtctttgtgttatcaagctttgttgtttattataatcgattgttcatattgaaatgtttaagatagttctgtgaattttcttcaaaatgtattagcctttattatgtgtaacattcttggattccaagaaatttatatctttaatattagtttatgtatgagtcatcaacgcatggtcttggatgctcttttttgattactctgttctcatgattttgaagtaaaagtttgcaagaaattcggactcatacaaattcaaagtgaacgcatgaaagcgttgttggagtcaaatgtgacatggtccgtgtataattcactagagttcatatcacatacaaaaataaacgtgcctccataaaatttaaaatttactatctgatttaaattgactgattcatttaaaatctgctaaagttttttaacctataaataatgtaacaattgatttcacatctttttttagaagtctacctaataatatacatttgaaaattctccaacgcctgaaagcggaaagaatgtcgtagacacgtaatgtgttactataataatcacctgaataaaataaaagaatctaatgttgaagacttagcacacagcttacacaagctatgaatgccaaatcaattgaccaatataatgttatctcaatacttgccagtcaagaacaatgatcaatgaataatcataacctccctgaatcagagcactcactgcaaaaaaagaagaagatg

SEQ ID NO: 58 - DNA, 296 bp, Unknown
  misc_feature (1)..( 296): cDNA_ID_1691313_gDNA_ID_1900_Annot_ID_145412 3000 nt of promoter + ATG
ctatatgtctatatgatggttctgaatttaaccacattaatattgcaatctcttgctgttgttaataaccacattaatattgcaatctcttggagatgtttttgacggaaatattggagttgatttggatgataaagacatcaagggtattctttcactatacgaagcttcatatctctcgaccagaatcgatactaaattgaaagagaccatatactatacaacaaaacgacttagaaaatttgtggaggtaaataattaagaatgagaccaaatcttacactcttcgaaggatg

SEQ ID NO: 59 - DNA, 3000 bp, Unknown
  misc_feature (1)..( 3000): cDNA_ID_3014593_gDNA_ID_1917_Annot_ID_145424 3000 nt of promoter + ATG
attgtccacatgtacccttctcttgcctcaagagtctttattaacgctagggagattggtttaatgaaaccaggatatgtctggatccttaccaatagtgtgaccgatgacttaacttggatgaatgagacagaggttgaggctatggagggcgtacttggtgttaaaacttatgttcagaaatccaaagagctggacaagtttaggtctcgatggaggaagatttcccgcagatagagctcagtgtctatggattgtgggcttatgatgcaaccacatcactagtgatggccgtcgaagaagctggaatagatatattgactttcagtaatgtggatcttggaaggaatgtttctgaacttgaagttcttggtttatctcaatacggtccaaagcttctccaaacactctcaacaattgagttcaaaggacttgctggagattttcgttttgtcaacaggcaactacaaccatcggtgtttgagattgttaatgtgatcgggacaagagaaaggtcaattggcttctggacagaagaaaatggtcttgtaaagaaacttgaccaagaacaacgaaacatatgtactttatccacttggcaagatcatcttaagcagataatatggcctggagaggctaattctgttcccaaaggatgggagatcccaatgaacgggatgaggttgcgcattagagttccaaagagaaaaggttacaccgatcttgtgaaagtcacaagggatactatcaccaattcaccagtagttacaggtttctgcatagatttctttgaggttgtgattcgagcaatgccttataacatctcctacgatttcattccttttgaaaatcccgatggtaaaccagctgggaattacaacgctctagtataccaagtctacgtcggggtgagtaacacactataccattaagaagatcatcttagagagtattaattaaatatggttttctttgtctctaccgcggttgtgggagatacgacaatactggcaaacaggtcctcttatgtggactttacatttccattcattaaatcaggtgtgggattgatagtccatgtagaagaccaagtgaaaagagacagtatcagtttcttgaagcctttaacatggaaactatggatcacttcatttttcttcttcttcctcattggatttactgtttgggttgttgaacatagggttaacccagactaccgcggaccacctgagttccaagctagcacaatcttctggtatgctttctctaccatggtttttgctccaagtaaatttcaatctcccatcctacatatctcaacatatagtgattgttatatatttagtttccttaatgcttactctctcgagttgcggattgtaggagaaagagtgtttagctttggagctaggctattggttataacatggtacttcatcgtgctcttgttgactcaaagttacacggccagcttggcatcccttttgacttcacgactacttgatccaaccataaccagcatgagaagtttgcttgaaaaaggagaaaatgtggggtatccaaggacatcattcatctttggaaaacttaaagaatcgggtttcactcgatccagcctgataccatttgatagcgcagaagactgcgacaagcttctaagaaaaggacctgaaaaagggggcatcgctgcgactttcttggaagtaccctacatgagactctttcttggacaatattgcaacgcttatcaaatggttgaagaaccctttagcgttgatggattcggcttcgtgagttttcataacaaaaaccatttttacagtttctaaactaaatgctaagatcataacatcagtcccattccacaggtgtttcctattggatcacctctggttgctgatgtatcaagggctatcctaaaagtggcagaatcacccaaagggaaggagcttgagctcgcatggttcagaaagaaagacgaaacatgtccgaatccagtcacaaccgcagatccaaatccatctatttcatcgaggcagctcggtgtagacagtttctcggttttgtttctcattgcttttctaatgtgtgttttcacccttggaaaattcactttcttctttgttaaggctaatcaggataatagtttgtggcaagagtttcataaaccagatgaaatttcatacatcaactacgtggagaaatgtccgtgtttgttgaacgaagaagcgcctgttgaagatgttgtaaacccacccgctgatgatattcatcaagacccaagggaacaactataatgtttgaatgtctcaagactctttaatttaactaacaaaaaggcgtgtgtttttatcaaacaaaactactgtagttttttttgtttcatttgttcaaaaactaatgtagtttatttagttatttttaaaatcaattttcctaagacgatgaaagcaacaattttcatgtaaggactatccacattcttatatatcaggaggttgatgatgttacttgttccccaagacagttaacctagggctaggatttctcgcattttcaaaagatttatagtaagcatattgacttatcttggatatagagtacaaaaaatattaacctcaataaaatatgcggtgcgtttttatacaacgaccaaattcttaaataatttccataaatttccaaggtttagccggaatcaacattgatcaaaacaatgttagtcaacatgttcgtttatgttgagtaggatgacacgtgtggaatttccattgagtcggatgccacatgtcttgaatataagagaattgaaataaatacttaagttagggatctatatgtaaattagactagttagctttaccctaattctttattatgtttgatgtataaatagatgtaaacctctttcattcttaagaagattatctttacacttatatggtatcagagcttacgctcctaaaacctaaaattctcctttttttttaagccgtcact

SEQ ID NO: 60 - DNA, 3000 bp, Unknown
  misc_feature (1)..( 3000): cDNA_ID_2106619_gDNA_ID_1933_Annot_ID_145435 3000 nt of promoter + ATG
  misc_feature (2002)..(2002): n is a, c, g, or t
  misc_feature (2016)..(2016): n is a, c, g, or t
gatccaacattttttccttcagttagaaatagacttattcattgtaaatacatgagcttttttctctttcttcttgaaagagttgttctaaaagtgtagaaagtgaaatacaaaattaatgttatatacaaacttcatgtcaatacatttttgatcgctcattgaaaaagaaagacgacaccaaattcatcaatcaaaaaactactctaattatagtttcatgttgattaaaaacaattaagtggaacatctaacatccggatccgtggcgcaatggtagcgcgtctgactccagatcagaaggttgcgtgttcgattcacgtcgggttcaattccccgaactttactccggatattctttttaaaaaaatccagactttgcccttcgctttcattcgataaactaaacacaactgtttagggtttgaagaaagtaaaagtgtgtttgcgatccgccatggattcaaagaaagagaaaacgggagggatcataggaatcttcttaacccaaaatgctgcttccttggcacgaagcttctacgccatgttgtgtattttgatctgaagagaaacagtataagagaaactaagtttaaaggaattgtaggaaactcaagggatttggatttggtccactcaatgatttagatgttttcccaaatcacattgagagtctcttgtccttgtaagaacattcaccgctcgatgctagttcttcatcattcatttattagattttgagattgtttgatgatgtctttaggttttcttgtaatgatttgtaattattccttaatctcaagatatttatcccagcatgttatataacaatgtggatagtgcaaactattgttgtagtctgtataaacagagactgctctgtttctagcatttttcatgcgagccacgtttgcttattcatattcaaaaacggacaaaatcaagcagagaatcacaatcaagaacagaacttgccagccatttgcttattacttctctggctttttatcatgagatccaatgagaaatgttttggagaagctcaaggttgtgaagatgatggtgtaggtggccttgttccatggccgttggtgttgaaatatgtctctttatgtctttgaattttcctctgtctgacaaagaatgggcgtgtttaattttgaagggtgttactgatgctggtgagtttgtttatacgccaatgagtgtgtatgaatccttccatgtggtgtattttgatccaaagagaaagagtattagagtaaccaaaattaaaggaattgcaaatgacctatatagacgacttaaagggctcagactcgattctctcaatgatctcgatgttttcccaaataacattgagagactcttgttgttgtaagatcattaatggctcaatgctattaatcacttatgcgatattaagcttctttgatttccttaggcttttcttgtcatgatttgtgatcattcctatggttttactatcataacatgttatagaacaattaatgtggatactggatactgcatgcagactattgcataagatccgtaaaacccgagactggtctgttcctagcatttgtcaagtgagccacgtctccttcttcaaatattaagatcaggacgtacgacaaaagcaaccagagaaatcacaaccaagaaccacaagcaaatgtagcgaactcaaaccctcatgaagtctagtttagcttatcgttgctcgtcttttgtatccacattcatttatcacgttagcatctggacgacaaaaccatctaaactctcttcttatgtgtccactcttacatccacaagtttcagaagatttccgagaggcttttaaattcgctcagggagtgctaaaaagggtttcttgtagtatacgaaactctcaaaacatcaattctaagatgtgagaaagtgaaaaaaaattggttattaagtgagtgtctttactatgcaggatcatattgatatacatttttggttatattcnaaatatagattttncataaaataatagttttacataaaataggtgttgaaactgtccttttgcttgtagcctctacagaaaagccgataatcttctttgaactcaagaggcctctgaacaaagccatttcttgagtctggaaaatctaaatttgaagcttctgagaaaaagttagatgctcaaaattttgaggtctggattgcttcactacttggtgaagagttggttctgtctctggatgtataaatagattgataaaagacttcaaatcaccctgaaaccattcaaagtaggggtgagacatacacaaagatagtttcacatggttctgttttttaggtatgatagatgacaagttgacaacggaagctaatgagcattatcatcacttcacaagggtctgtcttctccatgtctgtataataaatgaagagaagaagtgaggtattcagtctcttttagttttcatgtgtggatataatcaaagaacaactagagagtgacattgaattgttgttctgttgttgaataacattcaggtccccactttaacttcttaataaatccatttcgactgcagagattagagtactataggacaaagaaccaaccacctaatcatcacagaacctgctgtctttgttcttgcaaatatagggcacgtcttatctcagaaacattgagaaagcaagcccttgtgaaatttcacatggagattatttaagtagataaatttcattaatgcatcttttccagatggtaaagacagaaccatgtgaactcttgctctagtctgtcccacgcttcaagaccacagtttcaatgactttttcagagaagtttcaaatcgttcattgatatttctatatatacacccataaccccattatttctatcatcaaccaacaacaagcattccaataacttgaatcttttcatacatcttcaagagcttcataataattcaaacttcttttatttaaaataaaataaaaatg

SEQ ID NO: 61 - DNA, 340 bp, Unknown
  misc_feature (1)..( 340): cDNA_ID_3014774_gDNA_ID_1938_Annot_ID_145440 3000 nt of promoter + ATG
aaaaaaaaaaaaaaaaaattaacgagtctattatgcaaatggtgcataaaagttttttaacaaaaccatttattaacagatgaacagaaatcagaccggttcgatccggtttactcatggtttgtgtttgtactttctccacttgccgttttcatgtttgagaaacaaaatacgcagcgtctaaaatagaagcaaaaaacgggacgttgtttactaacaacgacaaaacaatggcacacttacccaagttcttcgtcatctcttcctgattgactctatttaaaaacccgatcggaaaattcgaaatccgttcaattgtaatcggaatcgtcgaaaaatg

SEQ ID NO: 62 - DNA, 315 bp, Unknown
  misc_feature (1)..( 315): cDNA_ID_1691379_gDNA_ID_1940_Annot_ID_145443 3000 nt of promoter + ATG
gaatcacacattcaccataagcagacctgaaaaacctgtttatcaatttggcgccattgccaattcattgttgcattgttacattcaagatatcagaaacttttaagatcaagttcttttacatttattaagttactaactcatattttcgtcttcttgtttttgtggtataggtactaatctttgtgcatgcaaactcgatccaaaggttctgcacacctactaccattcaaagacagaattgacagaatagctcgcgagttacaagaaaccaaagcaaaggcagcctgtgatcagccaagaccagctactatg

SEQ ID NO: 63 - DNA, 1836 bp, Unknown
  misc_feature (1)..( 1836): cDNA_ID_19619_gDNA_ID_1946_Annot_ID_145447 3000 nt of promoter + ATG
gtaatacacacaagttattcaagattctttgattctcctccgtacattacattctttaggctttacttttgtggggcttcacgtgggttatttgatcaatgggcttttaagatgccccattttacctagatgaagaaaaaggcccgttatattgctggccaaccatgcctagtctcacgcttctccaccaaccatgcctagtcagttagtagtcactaactattttttttacaaaagtaaacatgtagatgatgtatgagtagactattggatttctaaaataattgatttattactagtagtatcaagaaccgaaaaaaagaaagactagtattgttgttatatgaactcaccaaccagttcaatccaaaaataacctaccaaatcaatagatgatttttggcattttattcatttgagtcatgaccttccttagttagtgctaattattgcaataaaatacattttatactcaatttaaatactgcccgcttcctcaaattatgtttctctacaacattaattattatgaaaacaatgaaacgggaatatgtggttgttgaatgcattaaactatctgcacatgagtctaagttttgaccaatgtttgatacaaatggcatttacaaaaatattggaatcaatttcgagaacagaatttagacatgaatcatactccatattaatcacatcgtgtagaccatttctaactcatcttcatttcatctccaaaataaaatttggagtaaaatttcttccaactcatttttattttcaatttcaaaataaaaatctccatatacggatatttttcatttttaatttacagtaaaatttagaaaatctctatttttgactctaaaatagagtagaattagagaaaacctcaactccaaattaaaattactatattttgaagaaaaaaatagaaaaataagttggaaatgctcctaataataattagcttttaacctttatctttctagttttaaatgtttttccaaattatttttggttgggttgagatttttcatccaaacagtaaaaacaattatctttgctagatgtctttttcactttgatttctaagatcatctctagctatttcaacaaccaaatattcccgatgagctaatgtacttgcatgcactatttggaaatacaacatacaatttcacaaacaacatcacgtggaattgtatcacattcctgttgctgtggaagagaagtgcaaattctcttcaatctctctgtggaattgtatcacattcataacaaccattgatttttcaaagatcaggattccacagggaaattgcacttcgctttaagaggactaaaactcgtcccaatcccattaatttgcataagtcgcctccaaaaaatcaaactttgatcaaatcaagagtaaaatcattaaaaaaaacaattggtcaaccaataagattcaactgattaaggttacgtatatgtgtaatcaatttttctcgtctatgctaagtataataacaacatgtacaattttttatgtatctaaaatatcttagtaataaccatatgatagttgactatactaaaaccaaataatttgttgaaagccaatattaattaatacaaattgatatttttaaattgaggaataaacgcgggaagaagaaaaaaacagtataagcatggtgagagccatagtggttgttcggtcatcagctgattgcattctcctcttttaaatactgtttcctctctgtaacaaatcttcacaacacaatcaaaatccctaaagtctcaatctttaagcaaataaacaaaaaagctcctatcttttttattccaatg

SEQ ID NO: 64 - DNA, 3 bp, Unknown
  misc_feature (1)..( 3): cDNA_ID_1691512_gDNA_ID_2017_Annot_ID_145491 3000 nt of promoter + ATG
cac

SEQ ID NO: 65 - DNA, 2181 bp, Unknown
  misc_feature (1)..( 2181): cDNA_ID_1691539_gDNA_ID_2060_Annot_ID_145502 3000 nt of promoter + ATG
catatatgtacaattaccaacttcagggaccttttccatatgctcaaatccgataagctcatgtctgattatttttgttatgtgttaagtcgactaaaaactttgtgtgaaattcttaattttcatggtataatactccatgtgagagaggatccacctattatgttacaaccttatactctttttttacgaaccttggttttagcttcatataatttgttgtggtatgactttctttgcttgaaagactttggtctaatgctgttgaaccttcatgcgagagtttttatggtggcttgggaagcttgtcaaaggaccacccctcatcatgctcgcttaacgtcttcaagtcatacacctcacttcatgttgctattgtttgcctaatctcaactttcattccgcatcaattctagcaaataaatccaagcaccagagcaccatcaccactacccaaacctttgtcaaagctctacttcatgtagctctcctcgtgccggcaagaatcatgtctttgaccccttcattaacgccacttcgtcttttgacagagacaatttgtttttcctttgaatcgctcttgaaagagtcgtcgataaactttgatctcacaagtaccataatgtaacgcccgcaatcctcaataggatcgttggctacgacttggtccgagagaagaaggtggagtctcgaacaagtgagaaggagctgccataagctcggacaaaggggaaatcatgcaggctaagctaggatcataaagaaatcagttgggtcagctcgcccaaacctcaagctcagctggaaggagtgacggttactcaggtcgagtgacagtccagctcgggcagctggatgagtgacagttgagctcgaggtagctggacgagtgacggacgagctcgaggtagctggacgagtgacggatgagctcgaggtaactggacgagtgacggactagctgggcggttatgggcgaagagatacaactcttcgaaaatgtgcaactcttcggaagggcgcaactcttcggaaaggtgcaaagaacggatgtgttgattcgggaagcatccattcgccccctatataagggagggcgcccaggaccattccactcaccacaacacaccgaaaacacaagaaactcaccattaaaactctctccctcttgggagaataaatagtcttaggattcggtagccgggctgtggccggcaataaagaagaagggtcggatcgacctaacctcgagaaggaaggtaagggatcctagattttgagtctaagggttctaagatgtgagttagtagtcggatccttgaaaggatcgactagagggctggatagtatccgggtcatgtgcatcctacacaagactcggtccgggtagggatcggctgaggcggagacgcggctcggcggaggaccggtgggtcttaactgacctgccgagaatcggccggactgatgcgcgatcttcccctctctgaattctctccacgtatccgagtagtgtatggcatatagagcattgcatggacttgcatatgattaagtaaatgagattacttatggctctatgactttcaggaacgaatggtgatcgtgggaaggacttggcttaggcgcgagagactcaaggccgggatgatggatggtgatagttcggatagtgtagggatcgattatatgacttgtaatagcttatatgcaaactcgtaggttgtatcaaatcctttgcttaatcaataaattatccgattgtttgtttactctattcgtctcatatattgaatcacggaatcatatggaacggattagactaggaaagaacctcataaacggttagggccgagtgacttagtggcttgggtcgagagaattcgtccggactttaggcagtccggatcggggcctttcaagttggtatcagagcatgcttggttctaggactaggtgttgggttaaggggtatcaccactcgtcggcttgagaatctcgcggtagttactctttactcttttgcaattttactaggagttatgtggattaactttggaggtttcgcagatgggtaagagcagcaaaacgggaaagagcaagaaggacaagggcattgtcgtggagactttggttgaggaggaaacgatgatcaacgagtaaaccagagttaggacgatg

SEQ ID NO: 66 - DNA, 399 bp, Unknown
  misc_feature (1)..( 399): cDNA_ID_1691556_gDNA_ID_2079_Annot_ID_145510 3000 nt of promoter + ATG
aaaaaaaaacaaacataatgtacttattttcatgaggtccacccaacaacagtcgtcacactagtcgcgttggacttgcatgcgcatattatactctatagtcaaacccacactaacctacgccgatattcttatccaccaccacctcttattagctcaaaaaaatttcactaacccatagtcattattgcttatactccgtattaaaaaatgttaaaccttttgatctgacgtttaaaagcaggtttctttctatttccagataaaaaactttactcatcgagactcgtttagtgattcgaaatttcccttctcggctcaaatcttcgatctgggctttcgtgtctttttgcgttttgattggtaataaaaagaagctttttaaaaactttttccatg

SEQ ID NO: 67 - DNA, 14 bp, Unknown
  misc_feature (1)..( 14): cDNA_ID_1688600_gDNA_ID_2096_Annot_ID_145533 3000 nt of promoter + ATG
  misc_feature (6)..(7): n is a, c, g, or t
taagtnngagcatg

SEQ ID NO: 68 - DNA, 2195 bp, Unknown
  misc_feature (1)..( 2195): cDNA_ID_1688608_gDNA_ID_2099_Annot_ID_145538 3000 nt of promoter + ATG
tatgataaaaatcaggatagttagcatataaacgcattatcgagataatattgttagcgaaatatagatagagtttgatggatggatgaaatgacattgagtacaaaccaacttaatatgttaataatatatttgacgatataaaaaaattctcagttattgaaccaatgtttagatttcaaagactgatatatatgcgaagcgataacattattatttaaaggtaacaaaatatttagcatgaaaagcaaaaaagttgacttgcgactgaataatcatgtagaaaaaatacatgcatcagaatagttaacatataacgtattatcaggataatattgttagcgaaatatggatacttggataaagttttgatgtatggatgaaaagacttaggatacaaacctacttaacatgttaataatacagttgacgatataattaaattatcagctattgaaccaacgatttgatttcaaagattgtataattatgggaagatgataacattattattaaaaggtaacaaaatatttaacgtcaaaagcaaatatgatataagagtataaaggtattttcatgatggaaagagaaaactcaacagtaattttttcttggacttaattttgtaatattctgtgtatatagagtgataatacccttgaaatccacatatcaccaataaaatgtatatatatagcccctactagactactaatcttgtgtaacatatatgatttgtctattacaactttagaagtatttgaaaatataattttgctaaatatgatttatatgatttatcgcttttttagtggaatcgaactccaacaataaaaaaggcagaatcaaatagatttaatcactcgactaaatacacatctccacgtaatttatcgtttacatatagcaaacgaacattatatctgacgaccaaacctaaaataaatacagatggacatattcagaaacataatataccaaagcaaatagtatcctaatcgtacagtattaagatgactctaatacacattgacttctttaaataataatataattttatattaatattctaaatcatatgtaatgtataatattaagatggtcttatatcttattatataaagtatggttttcaaagttactaatttataggatcgtgccacgtgtcaagtcaaacgatcggatgtttacatgtgtcattaaaaatttaacttatgattacacccgcctaaataatttatttttgtatcttatactcgcctatttaggcgggcattatctagtctctaatatacattgactaactagtaactagtgggtgagagtcataaataatttgaaaagtgccaattgagacacatgcatcaaaggggagtcatgtaaaatacttcgaagattcatctcaacataaaataaaataaaatcaattgattcgtcttcttatcctccaaaacattttatttttcttcgtcaattaattttgtggaaacaatttcctattctaatattttcacatttaaccgagactaaactctttttctctctctcttcctcaaataaactacttctaatttttgtcttcaacttaagaattataacaattatgaaagacctagtcagtttaccggcgaagctcgggtcgtatattatattttagcaaagaccttaattcttacattttttaaagacccaaaacaaatatttttaaccaaaaaaagtctctctccatattcgtatacaaataaatacctttcatccatcagcttatagagaccaacatacaacaatactctctgttcttcatcttctctatcctgcaacaccaaaggttagagctctctctcctccctctctctatacagatttgctttaacttttatcaatgttttgagcactatattcttatataaactattgtaaacgtaaagagcatagtctggaaaactatagagttctattgtcttctaagttctaattagataattgtttttttgggtaaacaatagataatagtggtaacggcttctttattcacccatgaaatttgatcgtttaaatggccttcttgcttcactctagatcttgtttgatcatcggtttgaaaatggttttatcttttaataattcccaacgtaatgaaacacatattgcttttgatgcgaattactgactaagtaacacaatatgtctttatg

SEQ ID NO: 69 - DNA, 1046 bp, Unknown
  misc_feature (1)..( 1046): cDNA_ID_3013459_gDNA_ID_2115_Annot_ID_145553 3000 nt of promoter + ATG
  misc_feature (20)..(20): n is a, c, g, or t
tttttttttttttttaaacnctttaatttttttttttaaacactttaaaatttggttgagggcattctaaaaattttacactaagaaggttactttgccaagttttctaatttgcggacaaaattgaaacttaaaatttaacattgattttgtatggaaaatacgaggatagggaaaaaaaatgcaataaaagaacttgtttcccaaaaaagagataccaaacagagcttgggtttttagggattttctctctcaaaacaaaaaaaatttagggttttaattttccggccaaatttcaaaactttccatagtccagaatcagattctcggtttcaggcgatcagagttctcgatattagggacaatgtcccacatcggaagttgagtaggatcttaagtggtatatataagatatgggtctctccacttattgccaattggttttaggttggaagcccacagtctaatatcgatatcacctcttgagaactatagaggtgatcttaaaatcttaaaatctctgttcatttgtctagatcgatatcacctcttgagaactatagcttcggtgttttcctaatgactttaacaacaaacactcgaatttggaatgctttgcacaacgaagctgacatatcgactctaaccaagagtgtgcttcaggctaatactgagggtacagaacaatgtttttgttctgaaaatgatgggagatctgaccttgttttggatataatccgttcaacgaaattgaactcttcccaagaggatgcaatcttgggctgccttgagacaagaaactgtacccataagaacagtgtgaaactgatatggggacctcctggaacaggcaaaacaaagacggtcgcgactcttctctttgcccttctcaaactaaggtgcaagacagttgtgtgtgctcctacaaacacaactattgtacaagttgcatcaaggctcttatccttatttaaggaaaactcgacagcggaaaatgctacttacaggctagggaatatcattttatccggaaaccggacagaatg

SEQ ID NO: 70 - DNA, 327 bp, Unknown
  misc_feature (1)..( 327): cDNA_ID_1688704_gDNA_ID_2141_Annot_ID_145564 3000 nt of promoter + ATG
tatcagggttggtgaattttaaatattcccagactgctgctaaaaccttaatgcatccaattggtgttgacgagatggctatcctgctcagtttttaattgctgcttggtcgatcttggaaatgattttataatagcagtgcagtccttcttgatctttggatgcatgcccaaaagtgttaaatcaactattctgactcttgttcccaaaacagatggtgcacaaaatatgaaggagttcatactgatagcgtgatgcaatcttctatattaagtgatatataagataatagcaaaccggcttaaagttactttacaagaggcgatg

SEQ ID NO: 71 - DNA, 1844 bp, Unknown
  misc_feature (1)..( 1844): cDNA_ID_1688718_gDNA_ID_2156_Annot_ID_145569 3000 nt of promoter + ATG
acctttgttttatttttactcttgtctctcttttcctccgagtaatgcttttactctcgttggctattgactctgaaatagttgtacttgctaaatctccaactaagctacacttgtgatagatccaaacatcaagcgtatgctgcgtatcatcatccacaataaccactccaccctcatcagccaagcccaaaaccaaatcaggcgtcttttgtgagaagtttgaaatctatttcttgtagcaaaaacctcacgtcttgtgactctaactcttccttgactctgaagaatccatagtgaacttccttgagtaatttcagaacattggccaatccaccattgtttttactctcgtctctcttctccaccgtgtaagaccttgactcttctgggccattgactctaaaatagtggtactcgttaatctctactaggttactcttgtgatgcgtccaaacatcactcgtatcatccacaataaccactccacgctcctcagccaaaaccaaatcaagcgtcttcacgtaaggagactcgtctcttgttatcactctatcaccaaagtagattctcttgggatcaatcagcttcaacaaggattcgacgtacactctagtacccattgtataaacatacattgtgaacaactcgttggcttccttcaaaaactcgtgaacaaaaggccgtagctttgtcaagtaatcgctgtccaacttccacagatcttcccttgtagttgaacacgcttcttcgattagacacttctctgtttcggaaagaagtgaaaccctaatagagtggagaagcgtgtggtccaagtcgagtacaaggtttagcttcttctcgttgagacaatagaattgcgtagtaaagcgcttcgtaaacgctgctgcttcgtggcttagctgcaaaccttgaacgagataatcgaatgctctgccatggcgtttgtttaccgtcgatttacaagcgatgcagactccgtaacgaacataccagtgaccgcagctactacgagatgacgaaagtgacgaagacgattcgttgatcgccggttcgaattccatagaaatgttttcaactgcaaacatgatttctctgattgagataatcctttctctgtttgatttgaaaatcacttagcactgatcagattgtttttgagaacagaaaaccacagtaatcgagcaaaacaaaaccctaatttgacaagaaactgacagtagaaagtattttaagggtgtttcagattagatttaaaaccacaaaaaattgtaaaccgggtgatccaaattagttaccttttttaatctaattaataatgttttattccataactaataaattaacaacaagaaaatcataacttttaatctaaaaattctacacaagttgagataaaattattagatttctgatttatcaatctacacaatgatatctcaccatctgtaagattaatcagattatgacacgttttaacaaatttaaattttaatgtaaggtataataaactaacaagataatttattagctaggcaaactaaccatcaaataaaaaggaaaatttacaatagtctgaattaagaaaagaaggaaaaaaagaaagtaaaagagggatatacagtatatgtagaatttcactttcttaaaatttaaagcataattatttttttgaacaaaaaaggaataattattattgctctgtaattttctggtattagtaaaaatcttagttgtcatgttttcaaagatttttacttatgttttacgaatttacctatgaaatcaattaaaaccctaactaagattttcgttaccgtcgctttctcctaagtaagatg

SEQ ID NO: 72 - DNA, 2502 bp, Unknown
  misc_feature (1)..( 2502): cDNA_ID_3013454_gDNA_ID_2166_Annot_ID_145578 3000 nt of promoter + ATG
  misc_feature (689)..(689): n is a, c, g, or t
  misc_feature (758)..(758): n is a, c, g, or t
  misc_feature (925)..(925): n is a, c, g, or t
  misc_feature (930)..(930): n is a, c, g, or t
acttgagggacaaaacattggattgggttgtgacaagtctttagactgagacttgagggacaaaacattggcttgagttatgttggtgcaatgaaaatggtacccacggcttcaaactttagtctttagactgagacttgagactgaacgttgatcattcttggtacccacggctttaaaatcacaaagacatatggatcatgtttagtttcttgtttcggtctttagacaatagttacccacggctttaaatgttacaagtctttagacagagacttgagggacaagacattggattgagttattacaagtctttagacagagacttgagggacaaaacattggattgggttatgacaagtctttagactgagacttgagggacaaaacattggattgggttatgttggtgcaatgaaaatggtacccacggcttcaaactttagtctttagattgagacttgagagtgagactgaacgttgatccttcttggtacccacggcttttaaatcacttagacatatggatcatgtttggtttcttgtttcggtcttagacaatagttacccacggctttaaaaattacaagtctttagacgagacttgagagacaaaacattggattgggttatgacaagtctatagacagagacttgagggacaaaacattggaatgggttatgacaangtctttacactgagacttgagactgaacgttgatccgtcttggtagccacggctttaaaatcacacagnacatatggatcatgtttggtttcttgtttcttagacaatagttacccacggccttaaaaattacaagtctttagacgagacttgagagacaaaacattggattgggttatgacaagtttatagacagagacttgagggacaaaacattggaatgggttatgacaagntcttnacactgagacttgagactgaacgttgatccgtcttggtagccacgactttaaaatcacacagacatatggatcatgtttagtttcttgtttcagtctttagacaacagttacccacgggtttaaaaatgacaagtctttagacagagacttgagggacaaaacattggattgggttatgacaagtctttagacagagacttgagggacaaaacattggcttggtttatgtttgaagcaatgaaaatggtacccacggcttcaaactttagtctttagactgagacttgagactgaacattgatccttcttagtacccacggctttaaaatcacttagacatatggatcatgtttggtttcttgtgttggtctttagacaatagttacccaggggtttaaaaatgacaagtctttaaacagagacttgagggacaaaacattggattgggttatgaaaagtctttagatagagacttgaaagacaaaacattggcttgggttatgtttggtacgaagaaaatggtacccacggcttcaaactttagtctttagagtgagatttgagactgaacattgattcttcttagtatctacggctttaaaaccacttagacattagacatatggatcatattcagtttttaatttcggtctttagacaacagttatccattaaaaatgacaagtctttagacagagacatgagggacaaaatattggattgagttttgaaaagtcttcagaaagacacttgagggacaaaacattggcttgggttatgtttggtgcaatgaaaatggtacccatggcttcaaactttagtctttagactgagacttgagactgaacattgatcattcttagtacccacggctataaaaccacttagacagacatatggattatgtttggtttcttgtttcggtcttgagacaacagttacccacaactttaaaaatgacaagcaagattatgattgattgaagtctgtaagtcttgtttatgttcaaagattggataattgaatctgattgtctatataatgctgtctgggcagcataacttcaagtctctgcatagaattgccttcattaaggcttttctaatgatgtcgtaagaacgagaaattcaatgatatgcttataagacttgtctaatgatgtctgaatggggaattctcttgcaaggatggaggaataagcaagcaagctgtgattaacactgtaacacttgtcacagttctatatattgctagctgggcagcataacttcaagtttctgcatggatttgcctttattttaaggcttttctaaaactcaatgatctgcaaattgatggagagtaaattccatgttctactatagaactcaatgatctgcttattgatggagaataaatgttcttttatagaactcaatgatctgcttattaatagagataaagtatcttttataagacttgtctaatgataactgattggaaaatgcattaaaacatgtagttaatcctctttgcatagctcttgaaactcttcctgttagcgaaggcacatcattgtgcaacgcttgatg

SEQ ID NO: 73 - DNA, 340 bp, Unknown
  misc_feature (1)..( 340): cDNA_ID_1688809_gDNA_ID_2234_Annot_ID_145590 3000 nt of promoter + ATG
ggacgattgtataaatattagacctcattcacacaactctcactctcttacatttaatgtgcaagaaaataaaaaaaactatatactatagacgtgtatctatatatggttatgatattaaagccatccattaaatgtaattagttgtttgttgattgttgctctcaagtctcacctaaagaaaaccttaggcctacaaagattaatcactatctttataattccctctccaaccaatataataaaaataacctagacgaagaacaaacaaaactctctctttctctctctctctaataagtaaggttttgatctttttcaagatcaaacaaaaacaatg

SEQ ID NO: 74 - DNA, 206 bp, Unknown
  misc_feature (1)..( 206): cDNA_ID_1688835_gDNA_ID_2253_Annot_ID_145599 3000 nt of promoter + ATG
caatcccaatgcatgcttgtgtccgaagcatgatgtcatcatttgttagttcccctgtctcgttcgatcaaaaaacacgttttgacagaagagattcaaagtgacaatcagtttcaagatttaattctcttacccactctctcaccctggctttcataactttctccgggaataagaatcgccggaaaagaagaaaaccgccaatg

SEQ ID NO: 75 - DNA, 239 bp, Unknown
  misc_feature (1)..( 239): cDNA_ID_1688839_gDNA_ID_2263_Annot_ID_145602 3000 nt of promoter + ATG
gtatctgacatgtgtccaatcgctgcgtcagtacgcgcgcgtgaagctcaggaaccgaagcgtctcgtaggtttaatgatgacctcgtaggtttgccgcccattcgcctctatttatattagattaaaccctcgggaaatcattttccgccgcttgcaagaagaatcaaaggtagctctcgctctctcctctgcgaattattttgtactctcgattctttatcgatttttccggcaatg

SEQ ID NO: 76 - DNA, 1781 bp, Unknown
  misc_feature (1)..( 1781): cDNA_ID_1688863_gDNA_ID_2273_Annot_ID_145608 3000 nt of promoter + ATG
gataaaaagcccctgtggacgcaggaaaatgctaccatacttctggcaggcttccccaaccgttggagtgtagataacgggtagcaactcctcgacgtgatcaatgagaagtttgtaaaacagcctctcgttggtctcctgaaatacaaaagcattgtgaaagaagttgggtaacaaaggaaggcacttggtgtagttgagatagcgagacttcctaatgagttagtttacctggagatccatcatagccatatacttctgcaagggaacttgatactgacgaagagtgtgcataatttttttaacctgtagacaaagcgtgcagtaaaaggatcaaaagtccaaatctccagttgcatatatatatagaaagggtaagtgaaacctgacaagacgggaaacctgaagatcttgtgagataacagtgggggggaggaggccgcgtagatagtgagcgtcacgctctctgtggctaaaggcaaggcctttgttgtgatgtggatcacgcaacaacgtatacccactggcgacagagagagaccaaggagtgataggcatgtcctcggtggcggcatcctcgccgtagacatcctgaactccaccagatacggtggatttgggaacaatgtcggcggcggaggtctcgagagaggaggatgaagtggcagtggtctcaatcaaaacgctgccggtgggatcctggttagatccgagagaggaaaagactctcaaggaagcaggaggagtaattatagttctaggctggcgcagagagaggcgtgtggaacatccaggaacaaccgtcttgttctgagaaaccaaagcaatgagactttttcgtatataaaaaaagatgagacatggacgatggatggagaaggaatgatgtaaataataccagaaacaacgagggagtgagagagatcatggcgtctggggatgccttgtctcttagacggaggaggagaagggaggagacggagagagtcttcttcttcagagcggccgtggtcgtggatttcagcgcggccgtgatcgtctctcgctcactttctctcttcctatctccctcacacgctctaaatctgctgggagagagtcttcttcttcagaacctccattgttgacgtgtcttcttccttttctatctcttcccaaattgcgtctccactccttggcttctccctttatttaccaatttgccattgctcaccggtccctgtattggtacgcttttgtcaattttagcccacaaaatctaaattataacttttcgttgactctgacctctctctcttatttcttttcaattgaaaattgtgactcaaactagcaaaaggacagacaatttcaagcgaaaatgcaactaccatcaatgtactggtactaagtagatttagttggtttggaattggtatgagagagattcaccacttgccctctctacttgacatttatttttttatttatgtgacagaaaaggactcttccaacttggacttgtgtcacactcgatgcccatcctgtgaggatccacgtcaattgggtaaacaaaaggccgcttaaggcccaacttgggtccatccataatatgatgaatagtgtcatcctctctggtttttggaaaaggaaaagttgcaatgaataaaagcaaacaagagaattgcatctcatcattatgctcttgctttatttaacaaaaactttttctttggccaatgatcgatccttgctctacatatatacaagtattattacgagtaagaccccaaacaaacatg

SEQ ID NO: 77 - DNA, 298 bp, Unknown
  misc_feature (1)..( 298): cDNA_ID_1688872_gDNA_ID_2279_Annot_ID_145611 3000 nt of promoter + ATG
  misc_feature (191)..(191): n is a, c, g, or t
gtcaacaagaaaaaaaattaaacttgaaaatgcccaataagttttctacttggaaatatatactaactctattattaattctaattctaggatttaagatcgagacatggctagcaactattttttaatattcaaatattttttgcccaaaaaaaaaattcgtatattttgtgaaacaacttaatgtttanaacaacaaaaccctaacttacatgtttacttttcaagtgcaaaataaaaagaaaattttcctatatatagtatacataatccaactcaatcaaatcacaaagcaatg

SEQ ID NO: 78 - DNA, 305 bp, Unknown
  misc_feature (1)..( 305): cDNA_ID_1688917_gDNA_ID_2301_Annot_ID_145626 3000 nt of promoter + ATG
cataattgaacattgtttttggaaaataaaaaacaaatccctaattcaacgaatctacttctcttatccaacacgaaatcaagagttttaaaaatatgaaaaatctaaagaaattattcaggtttcaataatatctaaattagtgcctctaagtatatttttatataattaaaaaagcatattttgttttgggccgcatgaagtcaggcccaaatatttaaaggcttatttgattaatgatatttgaagacatgtccttgaatcggagttttcgaaaattttgaagggagcttttctgacagatg

SEQ ID NO: 79 - DNA, 1591 bp, Unknown
  misc_feature (1)..( 1591): cDNA_ID_1017185_gDNA_ID_2304_Annot_ID_145627 3000 nt of promoter + ATG
acatatatgtaggtgtttattgtgcagagagagcctctattcattagcatttcccatagcttatctgccttttatgtcatgtggttggtcgtaaatgcttgtgatatctttcttttgtagtcagttttaaacgacattagttttcttatataatattgcagtgccttgagggatcgcaggttcccacctatacaggccaaagaattgccatctctgcagtgtacggtgtctgtcttgactgattatgaagatgcagaagattaccttgattgggaggtatattctcttcactcttttcttacaatatgtcaatctcacgaattaagaatatagttgccaagaaggaatgcatactattcaatgtacacagccaataaactttccgttgtcctttccctcatatcattttcccgcttagttaactgctctgccttgctcatgacattgtagtttgtcgaattcttcttgtttgtagtttgtcttatacattgtcccgttggtgatattttgttttgtgatttcactctaaaggttggtaagcatggtataatcattgagtttactgaacctgagactaatacaaagcgaagcgccacatatttgcctgaggtgccagctcatgaaggtaccatttcaatacaataattcaagtacgtgttgttgctattggtattgttgatacaacgattactttttttatccccaggctggacaaagatagaggcaatcgattcgctggtgcgtaaagcaggatacaatggtgtaataacagaagcagtgcgtaggcgaatcaatctaacgcgttaccagagtacattattcagcatgcattatagcgaatacctttcatatgtgaaggcgaccaggggcgttgttggcccggttattaatgggatcaacaagcacgcctttgcctgatttgcacctgcaaatggatgccattgattatgtttggctacctcctaatttatcctctgtcttgttgtctggctctcataaaagaaacgagacttcgaacttggctgtttcactattgtaacattaattaaatcactttcatcccttctctctttgttcctcacttcctcttaattagactcgatgttaaaatcgtatcaggtaaacttgaacttagtgttgacaatgtccaaattgaccaaccgtttatcaacctcatactacagtaacaccaagtcaactgtttttgttaaaagtcaactcaaagttggaggttacttatggttaatttaagagtacacgcttatttcgtaagaatattttaaaagttggaggttatttatggttaatttaagagtacacgcttatttcgtaagaatatttaaaagttgggggtgtttattttgattttttcgcatattaaaaaattaagaatcatgaatcgcttacgcatgtgcagtttggacgcaactgaatcgtaccaatgagatcatcctccttattttaatctcccacctgatttgagctgtttctttctctttcgaactctccgtcacttccatttcatttctatttgaatcttctcaaagctacacagatctctggaatcgaaaaagcttgagctgtgttaatg

SEQ ID NO: 80 - DNA, 499 bp, Unknown
  misc_feature (1)..( 499): cDNA_ID_3013649_gDNA_ID_2306_Annot_ID_145631 3000 nt of promoter + ATG
cgagatagggtgaagaagagagagaaaatcccgacagaggagagagagataaagaccgatctaaagtctgtaggttcttcttctgaagctgaagctgggttcgaagttcagcttcgttgatgcagtgttgtcgttttgacgcaaaattgctacttgccttcctatggatatgggcctaactataaaggcccactaaacatataagagtcggtattttcctgacaaaaaagccctaacaagttgtcggatttacaatcgtacaccctatttttaagccgcgcttatctcgaacctatacctgtagagaggaaataagcatttgggggaaatcaatcgaaaaccctaggagagataaaaacaaaaatctagacggagatttatggcgacagcgaatcctggccgtggaggtggtagaagaggcggtggagctatggatgacgataagttggtcttcgagactaccgatggaattgagcccatcacgagcttcaatgatatg

SEQ ID NO: 81 - DNA, 447 bp, Unknown
  misc_feature (1)..( 447): cDNA_ID_3014503_gDNA_ID_2330_Annot_ID_145648 3000 nt of promoter + ATG
taacctaaataattctttctttttgtctccaacctaaacaattcagtacctattacactattatataattttggtgtacctaatgcactattatagtgtttactataattttatgacagtagcaccaaaaatcatgctatttttattttctttctaccgtgccaacgagaaacacaacgttgtaataatcattcatattattggaaagttggttagaatttaatatcgagggaagtagccaagcttttagaaaaaaataacataagttgagaagaaacgtgattagagaaagtaggtcatctgactgattaaattcaaatgtaacaacagacaacccgtaacatcatcagttcatcaccttcccctatttaatattcatatcgcaacttctccctccgatcaatagatccgtactcgaagcaggaacgagtgaaactgaaaaccatg

SEQ ID NO: 82 - DNA, 1633 bp, Unknown
  misc_feature (1)..( 1633): cDNA_ID_3014485_gDNA_ID_2334_Annot_ID_145651 3000 nt of promoter + ATG
gagggagaatgatgagcagttgcagatggggtgttttctaaaccaactttatggataggccatgatacaaaagccaacaaacagtcttcaaggtatgtagtatccattgtaggcctccatataaatgtatctggctgatgtattgaatccataaagatttttactgcttttggtccaagaggaagtccattaactaatgcactttcatcttgtgtcagccaaggaccctcagcaataatcacctaacaatcattttggttaagtgttggcggattaagtaattttagattcccacttatgatctttcattcatagcttttatcatgggcttttataaattaccaaaataaaaacttatctttcataacagttacagaaaatgagctatcctcgtgtgctatcaatgtggatatttgttgtagtgtaagtaataaacaaatagattctaaccgagtaaccagagcaaacgtttcttcaaagttcacatgtaacattcccaatctcaagaaatgggctatacattattgaaatcaaaatttgtagcccactaggcctatatgaagcaaactcccaaaaacaagggtaattaatctttaatatgtagctgtataagcattttcatctaagtttagcaaagtaaccttagccactaagagaaacaaacgaaagagagacaaagagagggagagagaaaagagaattatggtgaggcaaaggctttggtcaccatttgagcttcactgatagtcaccgtcaaacacttcacccactagaaccaagatctaatagactagtttgtttgggtaaggaaactcttacataattatgtcttctcctctttcaagtcttttgttttggtcattttggaacttagcttaaaatactaattttaggtcaaaaattagaggtaaacttaggtgaaaaattagaggttgcccactagtctccggaagttgtgccgtctaatgtggcttaggcagaagcaccactagtgaatgtcctgaggctaatgagaagtctatgtttagaaattttgtaggttccaagaatacatgcggagagagcgaggtatgagaggagcatcagaagtgaatattctacagcatggcattaccgaatgaggcatccccacctccaccacatcttgtgcatgcttatagacaagatacatcgtatgtggatgctatcagatatttgaagctcgtgtgtatggagttattttgtggcaatctaaccctattgttcctaataaccaaagaacaaaattaaaaagaatcttgataatgttagatgtctacaaaagtactgtaaggagttagtggttcagtacttaaaggaagaaactcaactataatgggataaggttgtagcctagatgtagggacgatatgagttgacttggaaggatttcaacacatacttcttaatgaagcattttctggggaggcaatgtaccagatggagaataaatatttagaacttcaccagggaagcatgcttttagagagtatgaggaatagcttgacttattgagttggtttgcatgtcatttcatagatgatgatgagcttatgcttaggtttttgaggggacatagaattgagctcaagaatcgttttgagatgtatatatg

SEQ ID NO: 83 - DNA, 569 bp, Unknown
  misc_feature (1)..( 569): cDNA_ID_3029968_gDNA_ID_2349_Annot_ID_145662 3000 nt of promoter + ATG
gggagagaatgatgactgatcatctcttttaacaccgagccaccatcgtctcgacgctaacgagggaaaagaagagaacaaagcgtgagagagatagagataaatccggttctagaatcccggtttaaccgccataccggtggaagattacctttactacgctctccgcttcttcttctcctcgattcgattctcctcatgggtttatcatgaatttttaggtgagaatttcgatttttgtaatttgatagtcttctctaggttggagcataattggcgttaggtttggtgattggtggattcagtttccattggtttttgataatttgtgctggcttttggccattgattctgctttttcagttttcttaatttgtgtgtggattatttgctatctgacagtattatcctctgctctcgcaatttggacttgaggaattttacattgatgaatttgattttcttaggttttgagtaattcagaaactcgagtgatgatcccgaatgatgatgatgatgcaaattctatgaagaattatccgttaaatgatgatgatgcaaactctatg

SEQ ID NO: 84 - DNA, 288 bp, Unknown
  misc_feature (1)..( 288): cDNA_ID_1714593_gDNA_ID_2353_Annot_ID_145664 3000 nt of promoter + ATG
atcattttggtagtttctgatgagaattttctcggatttacagaacagaaaattcaaattggggatgatagttggaatagttagggtttctgattttggttggttgtgaaaatcgtcatgtgtgtaagtacatttagcattttgggtatagtagaaaatggaaaacttggcaggtgaaagttaggtttaggtttgattttgaatgagaaattgattgattcaaatctctggatacgcatgatgagttcataggtccagcaaaaagctactgtttgtgatttttgtatg

SEQ ID NO: 85 - DNA, 504 bp, Unknown
  misc_feature (1)..( 504): cDNA_ID_3013567_gDNA_ID_2362_Annot_ID_145667 3000 nt of promoter + ATG
ccggtggttcttctcccaccgccgtatgttcttccagcgctccggaccgccgtctggtctgactttaatttgagatctattccgatccctaacagctacttctggtatactatcgttctctctctctaacacctctgcgtatttggatcgtattgactagagtcttcccattatacttgcatcgttctctcttccatggtttcgaacttgtttaagcttatagtcttcaataccttctaactatctaaaaggtttcgtgtttcaatttgcttctggtgcgatttgctcagtgttttctttctctaccggaatcagctctagacaaattgtttgctatgttattgtattcactgggattttggatagtcccagtgaaaatctttcaatcttgttcgtgttacattttctgatttatgagaggaataaaagtctaccactttaggtaataacttatctcttttgattcttgtatcacagcaagtttcaacttggaaagaaacaatg

SEQ ID NO: 86 - DNA, 1569 bp, Unknown
  misc_feature (1)..( 1569): cDNA_ID_1689086_gDNA_ID_2364_Annot_ID_145671 3000 nt of promoter + ATG
ttaactatatgaactaacttataatttgaatttactacataaacaatcaaaatatggctgaaaccaacaaatcaatagatgccgttagttaaaccgttaatgtagctgactaggatgccacatggatagactttacaaaaacgaatctaaacaacttaaaagacgtcgtatctgtgacatctactgtctcttgaactattgtgttcaagggacagtagatgtcacaggttcgatatgtttatattcgtttacattcagtttacttctaagaaaaatataatatttttttttaaaaacatatatttcatcaagcaaacctgaaatagccaaaaagatttttttttaaaaagccaaaataaaaaataaaataaaaaaggaggaaaaagggttccataacaagaaaagagaagaaaattaaaaggctaatgactaaagatacattttcataataaaagaataaaagaatttaaaaaatgtatatgagcaaatcataagcaaaatataagtattaaacaatatcaaataggtttaaattaaatttattacacagaataaaataattagtaatcatcaataatactaaaaacatatagtagtacaaataaaaacatagtagtacaaactcacggaggaaacgggtgtctaacgtaattaatttttcgattcaaaccaatgattcatcgcctaagatttttgtgccggtctagcgacacaacccacatatttttttcaaagttgatttataaagttctatgagttgtaaaacattattaccttagcaaagagagacctgcggaagaatctggatgttgtacaaatattcaaatttcctatattaccacctcgtttacaatttattaatggttatgatatatatgtttgtgactcagttgcttgttaagtatgaaccgtcaataattaaaaagtcattttagtagaaaaacaaaaaaaatgtataattgtataacaagttaacaacccacgtatgttacagagttgatttataaaaaaagattggggacagagttaccattagaagtttggatcgaaacaattgtttttttttgtttttgataaaatattgatcgacacaattgtttgacattcatttaatgttcttaacacaaaaccaaaatccatatgactatatttatattaattatgttgttagttttgttgaaataagttatccaaaaacaaatttcaagaataatttgaaagattttgggtctttctactttctaggaattgcaaggtcaaggcggttggtcttgtgtcatgattttcttcgttttaactattcaaagaaaacaaatattgataataaaataaccttgttgtgattatctagaaaaagggctgtagaagaaacaagaagcatctctgttttatgttcccaaatgaaccagaaactcttagaaacttctaacacctcttagaaaccaaccttttagcataaaccctaatcccatctttataaaccaaacacttcttgcctttttcttgcaaactcacaaaaaagaagacaagaagacaaaaattaagaaatttaccgatttgaaaacaatg

SEQ ID NO: 87 - DNA, 314 bp, Unknown
  misc_feature (1)..( 314): cDNA_ID_1689090_gDNA_ID_2367_Annot_ID_145673 3000 nt of promoter + ATG
acatgattggtgttttaggattattgactaaaagcctattatcaatttggcgccgttgacaattgggtgtttgtttgctatatttgagatttcagaattgttaagatcaagttcgtttttggtataagagatactaacattgtgtcttttcagactttgtatttcaggtacttagcaaccaaactttattcgtctgttgtagtcaggttgctacatgtcatacacggtcacaagggaatcagaacttcgtattcaacgataacatcgaccgtattgctcgccaactgaaagaacagacagcaacagacacaatg

SEQ ID NO: 88 - DNA, 593 bp, Unknown
  misc_feature (1)..( 593): cDNA_ID_3013435_gDNA_ID_2391_Annot_ID_145692 3000 nt of promoter + ATG
cacaacacgtactttgcttaacatccctgacttcacatttccagctcgccagatcaccagctcaccacgttaatcctgtatcacattcccataggcttcacgtcttcacctcgtcaccgatgtgcagatcggctcctggttccttttagatcgccgggaaatcgatctgacctacgctcacgtcttcacctcgtcaagagtagacttttttatttaacactacacttggaagactttcttacctactctcactatcgacccgattcttcagaaccgggttttggattcaatttcggataacccctaaattggtacgccaattctcagtcactcagaataaaaaaaaggctcacctttgtccacgaatcgcaagtgagtcatagaaaaatcgaagcttttgactgatctcagtcactttagtctccctgctcacgacccttctcgtctacttagggttatctccatttgcccctcttcctgtcaactttcaggtattacttgtcaataagatgtgaaattgagtatgtgcatcagatgtttcctctagattgaactgattccacctttgatatgcgcagacacgaaaactgatg

SEQ ID NO: 89 - DNA, 233 bp, Unknown
  misc_feature (1)..( 233): cDNA_ID_1689176_gDNA_ID_2399_Annot_ID_145697 3000 nt of promoter + ATG
aagatccattaaaaaaagaagtcgtctctctcaaattgcaaaatcacccccacaccaaaagacaaaattaccctgcgatttaattattatgaatttatgacggtacctccacgtcaatggctgatgccacgtcatcacgcatgttgagatttggtggagagatccggggttcttagaggtatccaactatccatccatcatcggtcagtccccaaagtcggcggaagaagatg

SEQ ID NO: 90 - DNA, 1814 bp, Unknown
  misc_feature (1)..( 1814): cDNA_ID_2026252_gDNA_ID_2404_Annot_ID_145701 3000 nt of promoter + ATG
ggcaggtttgtacactcattcttgcttctgtatatgtatattcagcgagcatcgaaattgttgtgtacctttgttaacaaacaacctgcatctgtcacagctgtatttggacatgaagtttgtcatatgctttgcatcccaaggtcgctacctatcgaggaatttgcacaggggaactaatgagataatatctaaagccttagcagctttcactgcaacagggatagatccatataggtacatcggttttgagggtgttttgcaatgttttagcctttatggtaagtataaatgattaaaatgtggttgtgaatgatgtgcagtgagctgccagaagacgattggttcaatgacatatgtgtggatgcgatggaaagattgagtggcaagacaaagggcaacaacggggatgtccacagtccgactgcttcagtgtcagctcagtctgtttcatcagcgagatctcatggcagctattgaaaccaaacccatcttacatttgttaagaaggtgaatggtcaataacttttgatcttctcttttcagctctgcttttccaaaagctttctattttgtagagtctccagttgttgatgagatgattttgggggcgtgtaaatgttgttgagttgacatgtttgttttcttgtattggtcctctctctctctctcaatggatgcattctttgggttaaaatattgaatcagatgtagcaaacttgaatgagatattttacgattcactttttgtatttcctactcgaatcatgtagttcatagcgtaaattagttttaagtaaatcgtgttgtgtaaactcctagtctaattcttggtacggtgggtcggatcttgggatgtacaaaagtttgaataatgggtaaggacggttacctaccacatggacccttaaaggcttggtaatttggccacgcatgcccgataaggcaataatcattcgcgaatgaggcttagagatgctagagtcatccctcgccattgatgcaaacacctcctttgcttcttttctacatgtttgagattcatgttttgacagatgacaaacaaaagtaggtggtgatactcaggctgtgaatggtaaccaaaaccgtaccgcaacagtgctgtaacgtatcaaaatctttacatatacatatgtatctatgtatttttgttcctatttgaaccgcaccgcacttctcctgcaccgcaaaacgcagtcaccattcggagcctcagaatgtataaaacatggcaaggaagatgtgatgttgatagctctatggtagatttcaggtaatgacttttccaatgataattccaagtgatagtagtctatagtcacgtgggaggaggcacaatcagactacattactgaacattttgatttcagcttacttaccattcacatgttatgagctgaatctgatatttaattaacaaaatttgcctcgttacaaaaatcgaattatcagggtgcaaaacacaacaatttattcaatagattatttctattatgtagcttaaaatattttatttttttggtgagaaagtaacttaaagtattttaaatgtctagtttgatcagaatttttattttattttgtgagatatacactgtgggactaaaaagaataaaagaagagataaatataataataaaatattggaggtgaatttgtttgtaaaacaacaagtggaacaactggtttcgcttcttcttctacagagcttccctcgtttcctccgccggagagacactccattaaaatcccttcttcatcgatccttcattagatttacaacaacaacaatg

SEQ ID NO: 91 - DNA, 461 bp, Unknown
  misc_feature (1)..( 461): cDNA_ID_1689202_gDNA_ID_2411_Annot_ID_145707 3000 nt of promoter + ATG
agaaaagaggacattacaccgaggagtgtcgcgccgttaaaaagtttatcgcagctggggttaaaactaaaaaaggttcaaaccccaaagttgaaacccctcctcccgacgaacaggagaaggagcaaactccaaagcaaaagaaacgggaacgaacaccggagggaagtgactctcccccacccgctaggagagaacgcatagacctagtctttgcagaactcgatctaagtggcaggacaggaaggtcagtcaccacaccttcccccgcctcgcataagaaaaacataaggtttccattacgcctctcaaaattctgtagaagcgcaactgagcacctctccccgaaacgcatcgatttcatcatgggagggtctcagctctgcaacgattcaatcaattcgatcaaaactcattagaggaaggcagattcttacacaaaagacaagagcccgatgatg

SEQ ID NO: 92 - DNA, 791 bp, Unknown
  misc_feature (1)..( 791): cDNA_ID_3013557_gDNA_ID_2413_Annot_ID_145709 3000 nt of promoter + ATG
tctctgtaatcttcgacggaccatcgtcgtaataaacgtttttgagatgcatgatcttgagacaaggtaaagaaacaacaagctcttgatgcttcattatcccaacatttgcaagctttaaagaaaccaatgtcttgctcttataaatcttcttaggcatgaattctttaataatgacaggattcttgttctcagcatctagatgttgaactccgcgatcaaccgcagtggcgatccactccaagaatctgttggtacatacatgttggacatgggcttcgccccaccaacatgtttaagagcccaacacattgaaatcagcaacaaggaaggaaggaagaaaagatcggcccattaaagataaaagagcccagcatcagacgaagcccgcctcgaggaagctgttgatcaagagaaagtcccacatcgagaagaaaactgtactatagactgtccttgcagtactataaatactgacaaaggaatgtcagaagcggggaccgaaaaatgggcagagaaaagtaatagaaacttctaattcagattcaaaagcataagtctagttttgacttgcaaagtttgtatttacgtaagtttaggctcggctgtggaaacaccttgtaaacagccgaacttcaaggatatcaataaagatcttccttaaggctcgtcatttcattctccggtttggaggttcggttttatactccaacaattggcgcgccaggtaggggtctaccacaagaaaaggagaagagaaagccgaggaagatctacgagaaggaaggatg

SEQ ID NO: 93 - DNA, 638 bp, Unknown
  misc_feature (1)..( 638): cDNA_ID_20646_gDNA_ID_2415_Annot_ID_145712 3000 nt of promoter + ATG
gtcagcacgtaagaaaaggaagatcaaatgacatcatgtcgacaagaatttaatcaacatgtcgatgtcttttaccaaaaagaaaacaaaaagtctttaacgtttaacgggactacggtacaaaatcgtggataaggtacaaaacacttttcattctaaaatgtcttttcctttcttttaacaaattatttcgtcagcacgtaagaaaaggaagatcaatgacatcatgtcgacaaagatttaatcaacatgtcgatgtcttttaacaaacaaaaggaaacaaaaaagtctttaacgttagtacaaaatcatgtataaaaggtatgtgattattatatggtgttcaagtataagtccgtcgtgtgttctttatggacttgtgaaatatcaataattatatctctgcggagatttgatgggaccaagtcggcgggcttctttggtttcaaaagaatcctctcaccgcaagtcgcaagaccgaaaaattgtggtttccactttaattccacataataaagttaaaaacgtaagaccgaaaatcaaatgtcgacaagaatatttgtcttataaagacataacgagactgaaggaaaaattaatgctcaaaccaaatacttcaaactcaaacacaagaaatg

SEQ ID NO: 94 - DNA, 914 bp, Unknown
  misc_feature (1)..( 914): cDNA_ID_1689239_gDNA_ID_2421_Annot_ID_145716 3000 nt of promoter + ATG
acaaagaaccggaactgataaatttagcaagaaattgttttgaaaaaccctttataaaaacatagtaatagttagtctaacctacttgagaaagaaaactaagattatgaagtttggattttcataaatggaagtagatttagttgcattaaggatttttccggcaatgtggtcacaaagacgagcaccaatctcattttgtaacagtgtgtgtgaattccgaaatattcatatattcttttcagaataattaaaagttttcgtcggcaaaggatgacagaaaatatcgtttcttttgcaacaggttgtctttgttgttgacacttcatatgcaagagttgtcgttcttttctttgatgtaatcattttgggccttggcctttaactttaagcttgtttgaatcaataataaagataacattctcgtgaaaaaaaataaaaaatcacttattcttcacaagcaagaactatgagaaaggtggagaaaatgttcctaattaaccagtaaacaccacttgtccattagtggctattactgactgtcgatgcaattgtgaccgaaatcgacctctgcatcgtctcctcgatcaggctttagctgatgtatacaacaatcacaatctcaggacttaggagatactggctctgtacattgcaaaaccccttacatttcggtaaaaaaatatcgagcacagaaaccggtacatttcggtttactaactggtgacaagctggtttattaacacagttaaaccaaataattatttcgacttatatgagttagagttatgactgactcatcactttatatctctctttctcaaaaaaagtcaatggtgaatacgccttttccacagatttttgtctatgtgaacttcaacttttctcgctagtcgctactctagtctctcatg

SEQ ID NO: 95 - DNA, 1565 bp, Unknown
  misc_feature (1)..( 1565): cDNA_ID_1689243_gDNA_ID_2423_Annot_ID_145717 3000 nt of promoter + ATG
tgagcttcttcttcatggttgctttttttgaatttcttctcatgaaccgatagagaactctgtagctcatcgatcgtcattctccctgtgtctttggactcctcgatagacacaacaacatatgtgaatctttctgtcagagttcgaagtaccttctcaacgatcttcgaatctggcatgtcttccccgttacttctcatcttgttggaaacaatcatcacccttttgaagtagtcatcaatgttctcattattcttcatggcgagaacctcaaaatctctccttaaggtttggagaagagaacgcttcactttctcgtttcctccaaactttctcttcatggattcccatatgatcttggatgtcacgacccgatcgattgcttggaacaagtaatacttgacttgatgatccttcttcttcaactcctcaagactcttctgctgcgctacagtagtctcgattcccgccgccggctcgggaacgccatcttctactagattccacaacccctttgctcgtaagaggttctccattaactcgctccaatgatcataatgaccatcgaaatgaggaatcgcaagtgttttctcttcactcatctttctttcacggttctctcttttcttactttgatcacttttaaagttgtgttttgctctgataccaaatgtgattgtaatttcagagaagacacaatattgcactgaaatgatctaactttattcatcacgtctcaatgcattttatagttttacaacaactgaagcaaataacagaagcaaactaaaacaaggacacaactccactagctcaaccactaagctagattaatacaaaacagaattgactgaaacaaactaaagagagcacgtctctattattcctaaacttgcggaaacaaagacacgacacaacaaacccaacacgacgaccataccctcgatacagtagctgctccgctcatcaacgtccatttcgccgcctttagccgtcaacgttctctggttctgttgccgtacaaaattcttaaaggtcgcgtttttatgtaagcgtagggtttagttgtcgtcacgctctttttaattagactttgttaatttaattaggttaattagataagacctaaaacggcgacgtgtaagctgtcgtcttcttgacctttttggtgaactcctccttcttctctatagctcgctgcgtctctgtgtcttgttgcttggagcaagctctccagcgtgagttaatctaatctctgtaatgattaattaccttcttttacggtttctggaattgcatctgtgtgtgagcacttggtttgaaatatgatttaactagtgaattcgataatgctgttcaataagaatgcttagaaaagccttaactgagttttactcaccactcttcttattgaatctagaaattgaaagtgtgaatttttgcgagttctcttattcaaactccactgagaaaggtggagttttttgtctctgttttctccctaattcttatagtttgagctaatggtgttaatcaggctcaagtatagataaaataaaataatg

SEQ ID NO: 96 - DNA, 1792 bp, Unknown
  misc_feature (1)..( 1792): cDNA_ID_2686209_gDNA_ID_2423_Annot_ID_145718 3000 nt of promoter + ATG
caagacatggagcttactaggttggtggatgaaatgaagtaggccatatcttattttgttcttcccactcttctttggataccgcaacatatttgcatacctatcatagttatagtagaaatatgagattgcactgaaaatataaatgaatgagcagaaagaaatctctaccttggaagctaaatgaatcaaaaagccttgaagcaaatagtggtgagaaaagagaaaaataaacctacttcggtaataaaaggactcaactcatagggatcaacgagtctctgcacatcaggaggcatgtcacttaaatgatcgttgtgctcaggtgctagacataagatgacagtcaactgagtttcacctgtccaataagcttacaataaaaatctcataatcttatgattggtgtatcagcgcgccaagaaaactaacaatgggataccgcaatctggaagaatcttcttcttcacccttttaacatgacgaagatcttttagaggagcaatcttacataaatgcctatcatagcaaagtcaaaaaattcactcatgagattacagcactgaaatcaacgagtcaagagtcgaaacaagaatgacaaacctcactattgtattggcaaatctgggtttgattaggctagcatataccttcactgtgaacaacaagaacaacactcacacacacacagaagaagaagtttagataaagaacctttgatagactaaaaaaccaaacttagagattgaatcatactagtgggctgatggtcaggtgacaatgaaggcttttcaggtatatggataatttcccatgcatctgaatccattattttattttatctatacttgagcctgattaacaccattagctcaaactataagaattagggagaaaacagagacaaaaaactccacctttctcagtggagtttgaataagagaactcgcaaaaattcacactttcaatttctagattcaataagaagagtggtgagtaaaactcagttaaggcttttctaagcattcttattgaacagcattatcgaattcactagttaaatcatatttcaaaccaagtgctcacacacagatgcaattccagaaaccgtaaaagaaggtaattaatcattacagagattagattaactcacgctggagagcttgctccaagcaacaagacacagagacgcagcgagctatagagaagaaggaggagttcaccaaaaaggtcaagaagacgacagcttacacgtcgccgttttaggtcttatctaattaacctaattaaattaacaaagtctaattaaaaagagcgtgacgacaactaaaccctacgcttacataaaaacgcgacctttaagaattttgtacggcaacagaaccagagaacgttgacggctaaaggcggcgaaatggacgttgatgagcggagcagctactgtatcgagggtatggtcgtcgtgttgggtttgttgtgtcgtgtctttgtttccgcaagtttaggaataatagagacgtgctctctttagtttgtttcagtcaattctgttttgtattaatctagcttagtggttgagctagtggagttgtgtccttgttttagtttgcttctgttatttgcttcagttgttgtaaaactataaaatgcattgagacgtgatgaataaagttagatcatttcagtgcaatattgtgtcttctctgaaattacaatcacatttggtatcagagcaaaacacaactttaaaagtgatcaaagtaagaaaagagagaaccgtgaaagaaagatg

SEQ ID NO: 97 - DNA, 987 bp, Unknown
  misc_feature (1)..( 987): cDNA_ID_3014460_gDNA_ID_2431_Annot_ID_145728 3000 nt of promoter + ATG
ctacgaaatctctacaaccaattggaaggtttaatgttttacccttgtctcctccaatcatgtcgtttcaaaatcctctaatttctcagtcctagtgctaaagctcttgctgggttcaagttgatttctcagtcatcgattgaaattttctcgggaaaaagttctcatcgtctaccatcgacaacgaggttagtcgttaattggattttgatccgtctctctaccacaaattgtttcctttcgtctcctgtttatgtgtttttaccattatccgattcgcatcaaatccgtagcaacatttaaaactaagaatctgcaattaagaactgtttcgtagctgggattatgttcattgaagcgttaacttgattcaattgaacagttattgaaaggtggtggtgcttttgcttctttgtttcacagaaaccagaaaatgcaaagtcttagtcaacttggaccttcagagattttccttgtcgccagaagagaaaaacccagtacgaggttagttatgagcgactcgagctcgattcatgacttcttgagatattgcacttcttgactttggtgcttgattctacgaatttgcagagcacagctttggtttacgggaagactctcttttagacaagaaacaaatggtgagtgaatcaaaatgatacattggagaatctttgaaccaatttggtttagtaacgatgttgttttgttaggggttcgtttaaagaatagagtagagtttagtccaagacctgtacctccaaatctgattgcagcagagaaagaagaagctaaagcagttcttactctattcttcaagaagcaaggtcttagcaacagtctctcttctcggttaatcaacaaatccgatcaattcattgaccatttagtgtccaggctccattctgttcacaaagctcgatacctcgtaggttcgatctttcttcttttaaacctttactatgtaatgagaagagctcggcgatg

SEQ ID NO: 98 - DNA, 448 bp, Unknown
  misc_feature (1)..( 448): cDNA_ID_3014452_gDNA_ID_2436_Annot_ID_145730 3000 nt of promoter + ATG
tttgttcttgcttttgttggttttttctggtgaatctcctctgttcttgtctgaaattcgcatctttttttgaggatcacgatttccttttttatgttttgtttgagtaaaatgttggtgtttcagaaaaaatatgaatcgatagaagattcatatttcaattacaatggaagtttctgcgattttagtacctacattgtaaccaaacatcggttcttttgtttcaagtacattgtgtagattatataatatataatgtgcttgttacgctcattgagatattgagaagaacttcttgtttctttttaaaaaatcttcatttacaccttcctcctgagtttctggtaaagtgtcaattgatacttgttaataatctttgcaggtttggtttgtttcttgaaatttaagaagcttggggagagtttaaagatttgcaaaaaccagaatg

SEQ ID NO: 99 - DNA, 2552 bp, Unknown
  misc_feature (1)..( 2552): cDNA_ID_1024912_gDNA_ID_2569_Annot_ID_145788 3000 nt of promoter + ATG
  misc_feature (1)..(1): n is a, c, g, or t
nctatggaatagttcttcttgagatgttaacgggtcggaaaaatatggacgggtcttacccgaaagaagagaggaacttagtgaaatggagcagagcttttctagcagatgattgcaggctctcgcttataatggatcctcagcttaaaggtcggtttccggcaaaagcggcgaggagcatagcagatatagcacagaaatgtctgcaggtggagccatcagagcgtccaaccatgagaaacatcgtggatcaactcaagatcatacaggacatgaagtactcgtgtaggttcccgttaagagaacccgcaccagtcgcggcaaggaaacatatgggaagatcaagcagtctcaacacgattatttggaccccggcatcagtgccaccaaggtcgagtttttcaccgtcacctccaccacgacgaccgtctgtttcacccacaaggggacggacgctcgtgtttcccccagtgtttccgccgcgagcgtgttcatctttggaggaaatggctcgggaagaggttcgaagatcgtcttcagccagtggtaggagaactagcctcgaagggttttgatttgttcatatctctcttctttcttctttttcctatttgtttttaatttttggcgttgatttgttttttggattccaaatataaaaaattgtttttttctttttcttttgttgtttatgaatccggacgtcgatagagagggtttgtgatgttttgtacataataatcaacatttcttctttcacattaaaaagagatccaagtattgtgtacttaacagagaaacagaaaaaggaaaaagaaacctaccttattcaagaatctatctctctgattcgattcaaatcttttcagtgatcgttcatggcttcctcaaagtgtttgttgttgccgtcgctaccatttgagttgatagaagaaatactttacaagattcccgccgaatccttgatccgattcaaatcgacgtgcaagaaatggtacaatctcatcaccgagaagagattcatgtacaatcacttggatcactactcaccggaacgattcataagaacctatgaccaacagatcattaatccggtgaccggaatcctctcagacgcactaatccctgacgagtttcgcgatttgtatccgatttattccatggttcactgtgatggactaatgctgtgtacgtgtcgaaaatgggacaacagtctcgcagtttggaatccggttttgagggaaattaaatggatcaaaccgtcggtttgttacttgcacactgattacgttgggattggatacgacgacaatgtatctcgtgataactacaaaatcttgaagcttcttggtcgtttgcctaaggatgatgattcagatccaaactgtgagatctatgaattcaagtctgattcatggaaaactcttgttgctaagtttgattgggatatagatattaggtgcaacaacggtgtgtctgtgaagggtaagatgtactggattgctaagaaaaaggaagactttactattataaggtttgatttctccactgaaacattcaaggagatatgcgtctgtccttatactttggtgactcgattaggctgtttcgatggagatagactctctttgttactacaaggtgaagaatcacaggggattgaggtttggatgacaaacaagttgagtgataaggttgtttcgtttagccaatatttcaatgtcactactcctgatcttccagcgttacatatccactattgtatggcttgtccgggatactccattggtaagcgcagaaatataagggtgtggtgtgagggaagtgtagacgtggatgataagtcgtatgttatcatcacgttttacaaaattgatgaaagtgggatcataaaacaaattgagacagcaagctatggacagtttgagtacgatgacccgtttatttgttgctatgtttatgttccgagtctgattccgattcagtgattcccgccgtccagaagaaaaatagttagcgatatgagtgttgtttcgtgttcttaaagctagggttttgtttggctttgtgtttggtgatcgtctaccatgtacatattgaaacgaactaggttattgaaattgacttctggttttggtttttgtatttatgagcttgagaagttttaggtttggtacagagttgtatcatcttccatatattgctaaaactaagcatcattatccgaagacctaaacatttacaatgaacaaatctaacatttcaattgatttgttcatgtgcatacatataaaaaataaaatgtaactatttgaggaaaaaaacatctaatggcatttgattggaattggtactctaaaaaatcagataaaagcgtatgtaaaccggataattgaattgaaccgaattacggttcggttttgttgttggtgtgataaaggttcgattgagccgtaaaaccttccgtcctcctcgagtcctttccatcaggaccttatccacagtccacacacagcgagactctatttactcgccggcggaagaacaaaatg

SEQ ID NO: 100 - DNA, 122 bp, Unknown
  misc_feature (1)..( 122): cDNA_ID_1684034_gDNA_ID_2570_Annot_ID_145791 3000 nt of promoter + ATG
tgaggctactcacactaatccagcagacgaggtttgaaaaattatttcacacatatgcttttccaaaagtggtgcaatctgttacttgaaatgggatgatgatacgaggtttgcctacaatg

SEQ ID NO: 101 - DNA, 3000 bp, Unknown
  misc_feature (1)..( 3000): cDNA_ID_1020019_gDNA_ID_2570_Annot_ID_145792 3000 nt of promoter + ATG
  misc_feature (749)..(749): n is a, c, g, or t
  misc_feature (979)..(979): n is a, c, g, or t
gagtatagttctctgaacttccgtgatgagaataactctttctttttgagacttgtctattgcattttttcaataactctaccccttctgagttatatctcggagattattgaattcctgactttttcctaacgttagagtactctacattctatcgataggaggattttgtaaccgagaagaaggaagagttgtcaaaggaagagttggggcgtcttgttgcctctcgttggacaggagagaaatctgataagccaactgaggcagacgatatccccaaagctgatgatcaggaaaaccatgagcacacgcccatcactgcacatgaagcagatgaagatgatggatttgtttcagatggtgatgaggataccagcgatgatgggaaatacagcgaccatgaacctgaagatgattcctatgaagaggagtatcgccatgattctagttcttcatacaaatctgatgcagatgatgatgtcgatttttcaggtctgcactatttccacagatgtttatattcttgaacgatgttaatcatctatcatatttagttgacttgattgaatttcattactgatagagacaacctcaaatcctacttggttggagaagatacaaaagactgtcaagaacattttgctggctgtgaatttattccaaaccaccccagtggacaaatcaggtaaaaaaatagtttagcattttcatagtgatactcgtattctttagtgattcatctatattgntgtggaatgtgcagaggctgatcgggtacgcaaagaatacgacgagtcaagctccaaactgaataaaatacagtcaaggatatcgagcttagaaaagaagctaaaacaagactttggtctgtatgataagacatcctaagccttcacttacgtttacctttctttgagttagtccttatatattgtttataacaggaccagagaaagagttctattcattccatggtcgntgttttgagagcaaacagggcaagtaagaataatcttagcaatttaatgtcacatccattctttattaacattactatcagctattagaattatatatctgatgcatttactgttattacctaaataatgctgtaggtatacttacaaagtctgcgcatataaagaagcaacacaagaggagggctattcgaaaactcggttagggtaagtgtcatgccactttatcttttctgtgcatgctgatctctttcatgatacagataactaataacaaggaattggttcgcagatgataattaaatatgagtgattattttatctgtgcttattttgtcgcttccttattttgtttaatggaatttgctaaaatagggagtgggacaaatttgagaactcttaccaattcatgtcatataccaacggagaaaaatgctggaatggtcccgatagaagcctgaaggtagtgtctgattacattaaatccaaactaattgttcaattaatattttctccaattatatttatataaaaaaaattatctgagaagatttttgcgcttgcaaagatcacagagatatacaaagcttgactgtctcactaaatgcaggtgaaactaagatgtgggttgaaaaatgaacttatggatgtcgatgaaccaagccgttgcgagtaagttcttatcgtaacctacatctcacgggtcatcatctccttttatctccagtttttctttttatatccttaaatttttactctcttgttgcagatatgcggccatcttatctactccagctcggtgtttggaagacaaacttaaagtaagtttttgtgtcatctcaaatctcaaaacagacctacactagttaacacttccttaacctggtgtttgtctttgtataggaactacaacagaagctcgagaagttgatgaaccaagacaaacctcagaatcacgacgaactctgatcattttcacctgaaataattcttaccatatgcgcactgcgcttagatttatgtcagtttagactagtaatcttgctcagtcgcaaacgtcaagagaggacttaaaaaaagaacagagaagttttgggccggaagagaatgaatgatagagtcaagtttacctcatttgggttcaatggagattttctatatcaaaagtatttagacaatgttcaaactttggttaagcacaaagaacaattcttctatataaaaacatgaagaagagctaaaaccttttaacttttttggagtcttaaaaatttattcgagattgttggagctcgtcaatattaaggtacatatgtcagttatcaaacatctccaagttcacttttaggtcagaaaatggttttaatgtctaaacaagtggtaggtttggtttggttcagttttaatgctttcttttacagattccattaccaatagagacaaactagaacacaatatttccggaaataaattactgcagttcaacacttaacaccatgaaagaagacaaagaacaaagatcaacttcagaaattagtttaaacactattgccaaaatggcaaaatacaattaataccattttttaatcaacataaacacttaaaatatcattataagatattttatatttggaaaaaaacgtggcccgacaatagatcgagaagacataaaaaggtaaacgaaaacgaatattaataaacaatgtgcgtcactccttaattattgaaagaaaattaaaccggtgtgaaccaatcagtaaacatatggtcttttgttgaccaaatctaaaccaataaccttcaatttcatttctcattttttacctcaaaagtcaaaaaaaactctagaagaagactcttaactcataaatctctcattctttctcagattctctctctctgttttccttgttctccaagccagatctctctccataaatctctcttcatctctctctttccaccaaaacatccgcgatcctcgattctcaattccgtgtctgttttttttcttcacttagcg

SEQ ID NO: 102 - DNA, 2342 bp, Unknown
  misc_feature (1)..( 2342): cDNA_ID_1684091_gDNA_ID_2597_Annot_ID_145807 3000 nt of promoter + ATG
  misc_feature (581)..(581): n is a, c, g, or t
  misc_feature (596)..(596): n is a, c, g, or t
  misc_feature (700)..(700): n is a, c, g, or t
  misc_feature (1851)..(1851): n is a, c, g, or t
cctacaccgaactgagtctcaaaaaacgggttggaagacagcatgtcgacgtgtaattcatttggatggaacatttctaaagggacgcatgaaaggacaattgttgacagctgtgggaagggatcctaatgatgcaatgtatatcatcgcatgggctattgtaccagtggagaacaaggtctattggcagtggtttatggagttattaggagaagacttacgtttggagcttggtaatggtcttgcattatcttcggatcagcaaaagggactgatatatgcaataaaaaacgtcctaccttacgcagagcatagaatgtgtgctagacacatttttgcgaacttgcagaaaagatacaagcagatgggacctttgcataaggttttttggaagtgtgcacgcgcatataatgaaacagtcttttggaaacagcttgagaagatgaagaccataaaatttgaagcttatgatgaagtgaagcgaagtgtcggttctaactggtctaggtgtgaaaaaattccgtctcttatttgtctatggttttggttggtttgactcttgttttgttctctacaattgncactctggttttggntgatctaatggatttattattttctccttttgcagagcattttttagtgatatcacaaagtcggctgcggtagaaaataatatcagtgaatcatacaatgctgnttttgaaagatgctcgagaaaaaccagtggttgcattgctagaggatataagacgacatattatggctagtaacctagttaagatcaaagagatgcagaatgttacaggcctgatcatacccaaggcgattgctattatggagaaacgaaaaaagagtttgaagtggtgttatccattttcaaatggaagaggcatttatgaagtggatcatggaaaaaataagtatgtggttcatgttcgtgataagacttcttgcacttgtagagagtatgatgtgagtgggattccttgttgtcatattatgtctgcgatgtgggctgaatataaagagacaaagctgccggagactgcaattttagattggtattcagtggagaaatggaagctatgttacaactctcttttgtttcctgtgaatggcatggaactatgggaaacacatagtgatgttgttgttatgcctcctccagacaggataatgccaggaagaccaaaaaaaaatgaccgaatcaaagatccaagtgaagaagcttcttcggagaattctcaaaaagctttagtggtaagctagtcgtggtaatacgtctctctttcttatatatttgtaatcttgggttaatattttatttacttttgtagacatgtagcaactgcggacaaacaggacataataaacgcacatgccaaatagagctagtgcctaagccacctaatccatctctagaattttcttcttatcatgcgaaagttattgtggtaaaattctaattttctatagtagtgtatgccaaatattgtttggaaataatcttgttatttatgcatttgtttttgcagacatgtagtaattgtcaacaaactggacacaataaacgaaaatgtaagctcgatccagtgcctaagccacccaatctgcctcctggaagaccttcaaagaaacaaaagaccacccaatgaacaagcttgaagtatgaagtcttgctttttttagatttcgatgttgaaacatgtttgagctagtaatgttggctttagaatttttttttgttctattagatttaatacacatggatctctaaaagaatttttggatcggttgaaaatttaattttttttaacagcaaaaataaagcaatcaatatcatacatnaacaatatccaatgcaatggctgtaccagagtctcctcaatgatagatcgttgatcagaagtggcagcgtttaatttaataaagcaaaggaattttaataaaatgttttattgcagcaaaaaaaatacatgtcgtttttcttcaatgtaaaatacagcgtttaatttaactggatatttaacagtacagtagacggaatgaggttttcactaacaattttagagttcatgtgttttttcattaaatatatcattgaggggttttttcacaatccatatttagttggggggttttattactaaaaacccttttttaaataaaggaaataaatctgaaccgacgcttaatgagccgggtttgggcaaacgggtggggattcgagtgttgggctacgtataaatagtgttcgggtcggataaaatcctatttccctctcttctcttccgtctttctcgttctgtttctgattgttcgtgtaaaaccctagaatg

SEQ ID NO: 103 - DNA, 3000 bp, Unknown
  misc_feature (1)..( 3000): cDNA_ID_2990982_gDNA_ID_2598_Annot_ID_145809 3000 nt of promoter + ATG
  misc_feature (38)..(38): n is a, c, g, or t
tctctcgccacgttctcatcaatctattcaccaaaagnaaaaccagaaaaaaaggattgaaaatcacataatcaacctttgatcttataagacaatgaaccagtactatgctcacaaaagtaagaattccagataaacaaagcagaagaacactccaacttgcaaaattacacacataaaaggaagtaatttgagagttagaagaagaaccttagggccacgctcgatgtacttcatagcaacaagttccttggagtttttgactctcatgagcctcgccactccaaaattcccagcaccgatgtctttaacaagctcgtacttgtccattttctcgtagcgaaatcaaacaacaagcctaatttccactacacaaagtcacaaacccagaaaatcaagggatgcgattcagaggtttttcgcgatggctaaaaaaggcacaaagtgatagaatgagattttgaaagcaaaagcgaaattgtcgatatccttttttcttatccgtgaagaaattccaaaagaagatatgattacgaattacaatgatgatgatgatgatgatgatgccgtaataatctccatcgttccttgctggcttcttctctcgaagtcacgatggctcttatttttttattatttaagtaatagtttacttattgaattatttttggttaatttaagaggtatattaataaatgcgggacctacaaattccaattctatcggttctttagtgactgagacgtcgctatatgtgaaaaggatattttagttgtcacagaattgcgtctatttcttattttttcatctttttgcaatttaccgattctacgagaacatcatttgtttattggatatgctttttttaaagaatcaagagaatacgaaaacaacttgtactcaagaatgtttactataattctctagtggatctttataagagctggagattagtttggattttatcttaaagtatccagttatcaaaaaatgagattgttaggactttttttacccgagagtatttagttacaaaaaagaaagttagtttaatattagataaactataattgcaactaacggtcagtagaaagctatataagttatataacgaatctgaatatgacttagttatcttgttggattgtctagatatgtttttgccttttacggaaagattcgatttggaacaacttctgaattaacctgaaaaacgtaattaaacattgacttgttggttgtttgtagaatggttggtttatactttccgaatgtggctatgtgaaatcacattttgattatatgtataaagttgagatataattttaaaatttgcaaaaaattattagttttgttaaaataataggagatgcaaactaaataaattctcttcttaactaaaaaagcaatagatttgttaacattgaatgatggatagatttgtgagttgtgactttgcttaagctaccccaacagataacggatatatcatatagatgttgagtaagaaagaaaaaaaaaacatttacgattgcattctcgtaatgggctttatgattttaaggcccaatagatgaagtaaggctaatgcacaactttaagaaacgtaattctaggaagtgtttatcgactgcgttgtaggtttcttgtgttcgtggcactatggattaggttttaatatggtttctaatttcgttgatttcagtggcataagtccagttgttgcttgtggcaaactgtttcatgtacaaaaacacttacatcattactaaattatgtcatgggtttggtttcgttaacaataagtcaatctccttgatgagttttatctatatgattatctatttgtctatttgcaacatgtagtagattgaactggggctgcaaaatatgctcttgcaattcctagttagatctagcttttgataatacgattatctaatttgtcatttcgatatgatagatagattgtttttaaaagagatctcaaccacttttctttaactaaaataaaaaatttagtcactttttattaaaaataactaaaaagttttaaacctatcaggacacttccatcaacagtatttaaaagagatatttattattaaaataatacaaagtggtgaaaagaagagagaagtgagaatcgtctctgttttcagaaactctgaaaaacgtttatggccacgtgtttttccagaaatgattgattttattctttttattaaaatttaatactttatctaaattcaattaaaataagcaatatttttttcatgagaaactcttttttgagaatcaaccgatgtagatggtctcatactctactctgttgattgtgtttaagtttctgaggatttttctactttccgacgttatgccaagaggctggtcttcactagaaaactacttccacccaattcaagcaagtatgacctcttctccccacaatttattcatgtactgaaaggccattagaagttgactgaattgtgaaggtggagattatgtattcacttgttgatttggtatacattctatgtaaggttcaattatttacgttatataattataatggagtaatttacagtaattgggttaaaatggtttgattcggtcaggttgatacggtttggaagttaaacccggcctagatatgatgttacaaccagtccacatcttttatgattttagtggaacaaacgaagagttatttagacgatacaaacaaggtccgaataagtgtgagctgtcccaagtaagaccacgtaatactcacctcaacaagatagtgttcttaaagtgtgtcaaacacaatcacacacacacaaatcataaaacacaaagacgataatccatcgatccacagaatagacgccacgtggtagataggattctcactaaaaagttctcaccttttaatctttctccacgccatttccacaagccataatcctcaaaaatctcaactttatctcccaaaacacaaaacaaaaaaaa

SEQ ID NO: 104 - DNA, 2892 bp, Unknown
  misc_feature (1)..( 2892): cDNA_ID_2781998_gDNA_ID_2618_Annot_ID_145819 3000 nt of promoter + ATG
  misc_feature (2704)..(2704): n is a, c, g, or t
  misc_feature (2727)..(2727): n is a, c, g, or t
  misc_feature (2791)..(2791): n is a, c, g, or t
  misc_feature (2807)..(2807): n is a, c, g, or t
acgtcctctaaaataaatttgttgatatatcatttttattatttttatgttgaatcatgaattacggggatatattaagttatattaaccagtataaattaagaaatatatttctaattttatcaaaatctcatataatggaatcttatttcaaattttcaaaatttaatttttcatgtccataatggttgttgttatggttatgctataatttggtcaattggacatatgtgaagtgaaagagtcaagcttttggttcaggtcaataaaaattgatatctatcaattaacagttataatatcaaagatgttttctaatggaataattaagttctagttgcctcaaaggtttgagtcatcatctcgtgtgaataaatacattatacatacaaaacaaaaagctctttgtgatagtagtagtaatacatgtcgcaaacctatatgatgaaatgaaatacgtggtaagccgtatagaaacccctatggtaccaaatattgaaagcttttttgtagtattttcaatcttgataaataaaaaggtaaaagaaatttgttattcacgaaaaaaagttgttcttttatagcttgccaagtggccagatagacgctatatgctaattgttactaaactactaatccaagtggacgaatgaaataataacacaataggtacacataatttatagacaaaactattaaaagaaaaacaaaattatccaaaaaaagaaaaagatctggtgacgtaatcgtttggaatagactaaggttccttccttcaacgtaaacaacgctcattgatacacgcagctgacgtggacggatcattctgccgacgatggcctctggtggctcacacttggccttacctttttgtttctcgtgtctctctgaattttctttccacctgagtttacagtttttttggttgttattttgtgcatttcgttttccttatcaaacataaatctgatgttgacacaaataatatcaaatttgaatctgatagaagatctttccccaatttaccggtcgttgagctttaagcactagaggcgtatgtacataatcgtgaaacttgatatccattgagccttaatttattactgttatgtttttcaagaaattttttgttgattgatgatactataagtttagcaagaattatccataaagaccataacatacatgcttctcgtgagttcacatataagaagtttcttttagtatcagtcaaccccgcagccctatggtttattatttgtactcgtttaaaatgggatgctaaaattctctaaatggtcatacaatattctcaattattcaaatcgtacctaagatataattttggtgtattcagttattattgcacttataatacaaaaaacatatgttgcatgaagctagttatattatttttttgtcaatgacatgtattattttgatttaaatccagatgattacagagtaacaaaacaagtacaaacactagactatatttctgattagctaatctaattttcataattagtaatttgaaaatgaatatagatctcggatgcgaaatcatttgacaattcgctaagtgttctatgtaggttaggttttttcccccactttcgtaataagacgcataacatcagcatatgctttaacatgttctgtaacagagtccaaaaaaaaaagttatgtaactatttacgaaaacgtaacggttattattttaattcaaacttatatagatggttaacatgttctgaattcatcgatggtaaatttgctaattatcttttaaaaaaactaatacaatacaattggcggtatgcgagtgctcacatggttaaaatcggtcggttcctctatatccgcctttaatttgtactgtttaccaagcatatctcatttttatagaaaaaatgtctggaaataacactatttgattagtccgatttctgacgaaaaataaataaataaatattagtccgattgctttctccaaactactgttgcctttattttttgttcaaactaaatacagatgttctttgaacatagttctcaatttgattaatacatatacaagtagactgaatggaatttagagagagtaatgtgcatcacacttgacaaaaattaaataaagacaagagagtactgtgtttgacgcaatttaggtaacaccgttattctagggagactagagctgaacatggattgttgattaagctctcacatatgagataaagtttaattgctgtcctgtatacaaaatttgatttaggagtccatgtagcaaatatttaatggttgcaaagggcaaaactcttgtagacaaatatggataatttgcaatcataatcattcataaatgttttgctcacagtagtacagataaaaataaaaagtctattacggacttattgcaaaccgataaaccaaatgttgaaaaaatttccggtaaaccaagaaaagttcagaaaatcatgagactaaacaaaaggaaaatacagaatgtattaaaacttttgaaactcttgtggattatttcctataaggctatataatgcaccaaaaatcaaactgatcatatattatgttctagaataattattccttggaaaagacgtccaaaacaacatcatctcaaatgttaaaattcaacaagaaaaaaaaaagagtcattatcaatgatagatattatttattngttaaaaaattacacatcagctntatcgtcagcatcgtcaaatttttgttttcgacgacccttttaaaaccctcaaaaataagtctntaccaaaaaacctctntctccagaaaccaaatcacacttacatcataaatcctctgtacataacccaaaaaaaaccctagaaacgaagaaagatcaagatg

SEQ ID NO: 105 - DNA, 1612 bp, Unknown
  misc_feature (1)..( 1612): cDNA_ID_1684224_gDNA_ID_2637_Annot_ID_145834 3000 nt of promoter + ATG
tagtgtactttagatatttgtttaacttttgctttaatttttgaggaatgatgttttcgtttaatcattatcctctagcataatcattgacatagaattattctttgaatggaagctcaaagctgcatttgttaccaaacaggcaatcacagctgttaacctaaacacaactgacggattataaaattctagcactgaaatacttattcaaaactttcactcatttttacgcaagaagtttttttttaataaaaaatcaggtagatatttcgggtaaaataaatactcccatttgtatcaaaataaatgatgtttaactttttcacacaaagattaaaagttattatattttttccgaaataaaaacgtaatttatttatttatacatggttcaataaatgataaaataaaatataaatagtcataaggaaaaaatataaaaattttgcatagaaaaaaaagaacaccggtcaatttcaaaccaccaattattttgatatcacagatgtcaatacgcgtcagagtgtgatatatgttagttatatgcgattttagtaacatttttggaagtttcagtgttgaatatcacatgtatatcgttgatcaaattattttagtaaacatgttttcaccagttttttgaatttgtagtcatttcaccaattgattctagaatatatttaaaattcttaaatgatgtaaaggtagttgaaattagataacctaacattttttatgttaaccaaactttttaattaaaaatagtatttttataggcacagcctattgtaaaaattttaatttacatagttttaagtaaactagataaaagaatcagctggtgatcctcaaatcggataaagtgttatgagtgtataggagattttgatacaaattgaattctttttggagtcatatattttgtctatgctcaccacagcatcggaagatcttccatcacaaaacagttcacatttgtggtggacacgagagatgaagaatctgtctccaggtttaatcactgtggtattatatagtaaaaattttatgatgatattaaatcatgattttggctatggtaaaatttgaggtttttggttctaaggattttttttgctagatttatgttaatatctaaagtttaagaaatttgataataattatagttacgtgacataattcaaatttatgatgaactacatttactatatatagccctcgagataataatgttatacatttatttagtagatatattattagataattcaaaacttaaattacattattttgtttatatatttcatattatgttaaagtttaattgctaaatgatatttttacgaaaaatttgtataatactaaagagttaaactaaaagataaattttaaagacatcaatttcgttttatgttattaatagtacataaagaaaaataaataaattaaattaaatttgtgactattttggtatatgatcaatgctcgtctttttaagtagtaatcgtgtctgttacaggtgaatgaacccaacaaaaatcttcgacgagaatcttctgctttcttcatctctgaatgatcaatttctagaatcagatcggatatttcgatg

SEQ ID NO: 106 - DNA, 123 bp, Unknown
  misc_feature (1)..( 123): cDNA_ID_1009520_gDNA_ID_2689_Annot_ID_145859 3000 nt of promoter + ATG
catttttagtttctatcatataaatagcttcttgtgtttttcacgcccttcttctttgtatttccgcctcccccgagaaaacgaaaaccctagtttcagaggcatctccagacaccgaaaatg

SEQ ID NO: 107 - DNA, 63 bp, Unknown
  misc_feature (1)..( 63): cDNA_ID_1684386_gDNA_ID_2693_Annot_ID_145865 3000 nt of promoter + ATG
atcatcttcttcatcttcatcagtttccagattcagattctccgaagcttaacgaaaacaatg

SEQ ID NO: 108 - DNA, 1359 bp, Unknown
  misc_feature (1)..( 1359): cDNA_ID_3013398_gDNA_ID_2695_Annot_ID_145867 3000 nt of promoter + ATG
ttccattgtatcagtgccagaaggtcgaaactcttgggagagttacacaattcacatgtgctgtagagattggaggcataaagtacacaggagctgcaacaagaactaaaaaagatgctgagattagcgctgggagaactgctcttttagcgatccagtcagacactaaaaacaaccttgccaactacaacactcagcttactgtacttccttgtgagaagaagacaatacaggcagctatcccacttaaagaaaccgtcaagactcttaaagccaggaaggctcagttcaagaagaaagctcagaaaggaaaacgcacagtagctaaaaatcctgaagatattatcatccctcctcaacctactgatcattgtcaaaacgatcagtcagagaaaattgagacaacgccaaatctggaaccttcttcatgcatgaacgggttaaaggaggcagcatttgggagtgtggagacagagaaaattgagacaacgccaaatctggaacctccttcatgcatgaacgggttaaaggaggcagcatttgggagtgtggagacagagaaaattgagacaacgccaaatctggaaccttcttcatgcatgaacgggttaaaggaggcagcatttgggagtgtggagacagagaaaattgagccaacgccaaatttccaaccttcttcatgcataaacgggttaaaggaggcagcatttgggagtgtggagacagagaaaattgagacaacgccaaatctggaatcttcttcatgcatgagcgggttaaaggaggcagcatttgggagtgtggagacagaagcaagccacgcataacagtgtcaagatggagtcttgtgagtttgtcatagttactatatggttacgtagccattttgtgattcctatctagtctagtagtaattcacagattgaagagaagtaatatttgagcggaaaatcaaaactaatatgattggtacaatttggtggtcgattgagtcattcgaataaagtaatgtggggttgcaaaacagaagcttcatatctacatataaatgaaaattactctcaaacttcattatttgtgggccggttataaaaacacaaacccaacagaaggtccattaccctcactcttcattatttgtgggctggttctaaaaaacaaaagtccaatagaaggttcattaccctcactcttgattatttgtgggctggttctaaaaaacagaagcccaacttgctgacccaacaggtccgtttacgaaaccctaatctcaaaacagagatataaatacactctgccttcctcatttcatttcttcggcgatctagggttttagttgtcgcacgaggaggaaaaatg

SEQ ID NO: 109 - DNA, 2630 bp, Unknown
  misc_feature (1)..( 2630): cDNA_ID_21148_gDNA_ID_2698_Annot_ID_145871 3000 nt of promoter + ATG
  misc_feature (2289)..(2289): n is a, c, g, or t
gataatcatcacctggtacaatcattctgtcaccgaactgcctttcgttgggatcagtgtcatcagttccatcgctcatatcatttgtcccattaaaatctaacccataacccataggcttttggccaaatgcccttctcttatattcacaatatcttccatcttctagacgattacggtgcatttttctcttccgtgcagatcttcttggaagagtccggaagtttctttttcccttgtgctgccagttggaaaccgtactagcctcattatcaggattttgggaataaaggtaggaagagtcgccagaaatagatgactcataatgatcttcctcactgcttgtactttcatcttctcctgacgtatgtctactaaaagtattgcgtcgctcggaatgacgcccagctcctgaaaggagaaatttcaaactctagttagggaataactaatacctatgcgacacatagaaaattgtggtctacgtaatcaaaaacattaattggttttagtgcagaggcatgatacaaattccagtcaaagaagaatcagatatgaatatagtgttgacacaactgaaaaccaattttcgcaaaagtagaaaacatttagatgataagaaaaactagcttttagctgtccagaaatactttacctgacagcaagggaatgtcatcatcagtatcctcctccatatcagaagaatcagtttcagattcagaataatctgattccatatcttccaaaaaattaggagggtcataatctgaataacgagtatcaccaccggcaaaggaggaatgcattgcgtccctgtggcttagcaaattctcatgtaggtctgaaacatcattagattcacttggtgtaaacatatatttagtccttttagcctccgccctactcttagttttctcctttcctgaaacagagccaaaaatgcatatgaatttcatgtcaaaaagagccagaagccttaagtatccaaccatctaggaacaaaaacttggaagtttaaaagtacatcttaccgagggtataaatgggcctctccatgctatgatccccactggaagaagctgaagaattgcttctggcaagatacttaaaggaagtatcaggaccattggaacatgaaatctttcgctttgaagaggcggttctaagtccaaagtcctgcaagcctctcattcgaggcacagcctcatcctcacaacttggttgatcttcctctttatctctcagcaaatgcataacatcaccaacatggttggtccttagataatctgtggattcccgtgtcccattagaggtatcctgaaccctaactatagccattctctcattggttgcatcaagagagtcatctctagccttttcagggactagtttcccttctcttttcagcatttccttttcaagttcaagggcatggagaatggcatcttctctccgagcatacttctctctcttttttattatcatcgcttgcgaagattctaccctctcaatgcattcatcaaaatcgccacaccgaaatggcttgacccgcttggatttctctaaattgtaccaatccctaagcacattaaaataagaatgctttcagtaatcaatccaaaagaaaagagagaagttcacacagataaagaagagacttacacacttgcatcttctctcccgaggagcttcaccggagttccagatcgtggcgacgtgatatgcgtagagtcaagatcttcttgtccaagtatcctccccggccaccacgagccattcctcctcctcacccacacaatcgatcccacagtccaatcaaccgcacctgatcctggacttgccatccttgtctctccctctctacactcaagatcacactttctctacgggtttcttctacgtcactaaccacacacaagcctcaaaagtccaccattctccaagaaaaatctttctacggttgtgtattgatctacctgaaaatcagctccgccgccggtagtacagacgaatcccggcggatccaaaaccacaactgaaacagacggaagagaaggaagtgaatccggcgagaactaagctttccattcagatttggaaaactcccataaccctacgctctttaacgccggttaggttaaaacctttcctctctactttttccaccgtccctctataagctagctacgtaagcgagttctcgtcgtcctcgtctctctcgttctctctgaaacctccgcgtcctcgtctctctctcgttctctctgaaacctccgtgactctttcgcnttctctctctctctctcctccggatgatggtgattgcgagcttcgcagttcaattaatttacacgcgctcctcaagagcgcgtgctttctacgttaccgaatcataggcccatcttacgatccaaaatatgggcttttatattttaggcccatttaattcaaaatttacgctgcaacggtcacttgtgcgcaagggagttagggtttatgttcgcctaatggtataaatatccttcatcttcggatctttagagacatagcagaaacgtcttgtttttcaactgtcattttctcaaccagattaaactttttgttttcattttctctaattcgtcgccatg

SEQ ID NO: 110 - DNA, 633 bp, Unknown
  misc_feature (1)..( 633): cDNA_ID_3033331_gDNA_ID_2720_Annot_ID_145895 3000 nt of promoter + ATG
tgatctaattacgtttgttgttgcctcgttggatgttcaaataaaaagcacattttatattgcgttgttcctaaacaaatattttgttgtcttttgtactaaagtttattggcgagttaagaaaagctttgtggtgtgtgggaattattattattatttattatttattgttctttagtttgctatgcaattcgagcccactaaagaggcttcctatgggcccaaaaaacgcagcccactattgtagtgcaaaacgtgctgagttttctacattgcatgcccaacaatggccaccagtgtagttaaagactcaagaacttgctgacctctatttgtttgactttcttttttgtgtgaacaaaatcacatattgttgatgtcatttgttctgctataattcttaacttcagattacagataacgaattttctcttgatgatttaaacaaacatatataattatcaatatcagaaaatgaaaaggagatataaataatttttttttgcgcctaatcgaaacttcacctaccattttttagcgtataaaaacgttaaaaataccaaaatttagaaatccaataaaagttgtgaaaaaaagccgcaaagggtcgttgttgtttgtcgcctctcaatg

SEQ ID NO: 111 - DNA, 257 bp, Unknown
  misc_feature (1)..( 257): cDNA_ID_1020543_gDNA_ID_2745_Annot_ID_145914 3000 nt of promoter + ATG
tatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttcatg

SEQ ID NO: 112 - DNA, 94 bp, Unknown
  misc_feature (1)..( 94): cDNA_ID_21263_gDNA_ID_2750_Annot_ID_145922 3000 nt of promoter + ATG
tttttttttaataaaaaaaaaaaaataaataaatatggaatacacaaatgtgtccattttattaggcatgttggtgatctttgtttcaccaatg

SEQ ID NO: 113 - DNA, 188 bp, Unknown
  misc_feature (1)..( 188): cDNA_ID_3014198_gDNA_ID_2756_Annot_ID_145927 3000 nt of promoter + ATG
ggctcgtttagtctggctcacggtttagtacatgcacacaaagcaaaaacgctggtttgtctttttttttaaaaagaacttcgtttctcttcaattccgttaccgtcactgtcaccgttcacctccgtttatctcatcctcaccgttcatcttcttcgatctaactcgccgtcgttcaccttataatg

SEQ ID NO: 114 - DNA, 2989 bp, Unknown
  misc_feature (1)..( 2989): cDNA_ID_2730377_gDNA_ID_2790_Annot_ID_145930 3000 nt of promoter + ATG
  misc_feature (2398)..(2398): n is a, c, g, or t
cacggttcctcgttcgtcctctcccgtcgtctctccggtgagtccttaattttccggcggtctttttccctttctcgtctgtttggtgctttctttatgtctgaggcgaatacagcaaaacgtatctgttttggttgttgagttcgaggctggtcctgaaaattcggtgacaaaaagagtcaataactctcgtgatcgagttggatgcgttgttttgagggttgattcagtttatgactatgtattttggtacttgcaagattttctgattttatgaagattcgtgtttgacttttatagcgtataatctacggggcaaacagattcgagcaacttgtttttttctagcgcttgttttgtgtttactctgtcatgtgtttgtattttttgagcttccactagtgattaatcatctcagctcaatttgaacataggagatgtagtttttatctgtcggtggatttctagggattttgcaaaatgttttgggctttcctgaattagtatgtgatttggtcgtaaagtattttagggatttatgtgttccttggggtgaatctgacattgacattatcttggtgtctgcagcactaaattgatgggcacatcatctgggtccaatcttcctcaccagatgctacctccacgtcagcaactacaaacatctctttcgcttgtatcttcagatccccacttgtcacggtctaattctggcattgtgcgtgaatcaccagctgaaagtgctagctctcaagaaacttggccaacctcaaaatctattatgggaaggaagacagatagcggaaagacagggcctgactctcatgatcaacatgtgatccgccatgtttccattgctgataaggtatcgctacgggacatagctagagagagacttgacatagtcgctgagagaatgcatcgattaccagaagaatatctcgaggagttaaagaatggtcttaaggctatccttgaaggaaatggtgcgcagcctatagatgagtttatgtttctgcagaagtttgtccagacgagatctgatttaacttcaaagacacttgtcagggctcaccgagtgcagcttgaagttcttgtggttataaacactggtatccaagcattcttgcacccaaacatcaatctctctcagtcatcactcatcgagatctttgtgtacaagagatgcagaaacatagcttgccaaaacgaactcccggctgatggttgtccctgtgagatatgcgctaataggaaaggcttctgcaacctgtgcatgtgtgtgatatgtaacaagtttgactttgcagtcaacacatgccgctggattggctgcgacgtgtgttctcattggactcatacggattgtgctattagggatggggagatttcgatgggagtttctcccaagagcgtatctgggatgggagaaatgctgttcaagtgtcgagcgtgcaaccatacttctgaattgctggggtgggtgaaagatgtgtttcagcactgtgcaccaaactgggatagggaatctttaatgaaggaacttgacttcgttagtaggattttccgtggaagcgaagatacaagaggccggaaactcttctggaagtgtgaggagcttatggagaagattaaaggtggactggctgaagcaacagcggccaagttgatactcatgtttttccaaggtaagcccactcgctattgttatatgataagggtttactctttatagacctaaccatgttttgtgtatgaagaaattgaattggactctccaaagagccttgaaagcggagaaggtgggggtacgatagcacctcaagatgcatgcaaccgaattgctgaagttgtaaaggaaacactgaggaaaatggagatagtgggtgaggaaaagacgaggatgtacaagaaagcgcgaatggggcttgaggaatgcgagagagaggtagaagagaaagcaaagcaagtggcggaactgcagatggagaggcagaagaagaaacaacagatagaagaggtggagaggatagtgaggctgaagcaagcagaggcagagatgtttcagttaaaagcaaacgaggcaaaagtggaagcagagagattggaaaggattgtgaaagcgaaaaaggagaaaacagaagaggaatacgcaagtaactatttgaaactgaggctgagcgaggcggaggcagagaaagagtatctgtttgaaaagataaaagagcaggaaagtggtgggaatggtggtgaagcgtcacaagcagtgatgtactcaaagatcagagaaatgctgcatggatacaatgcatcgtcgccaagggtagatccaagatcaaaccagcgaaatcctttcagatccaatccttagatgtttggattgtctctctttgtttgnattaaaaaaaaaaatccgaatcaattaaggttggatttgtgtgtgaagtattgtggtctttgtattcaaattttgcacatgatcgtctatgttgggccataatgttatgcaagctttgacacagagtgttgccaaaatctcgatacttattcactcggatttagagaattgtggatttcgctaatggagggagatccatgttaccttaaatagtttatatttgagccaacatgagagccaaagaacatcgccaccgactttaaaaagaaaatattttgcccaaatggatattacagagtagttatttgcaataacgtcctcatgtttgggttataataacgatttgatttcttacggggtataaagcaaaaggaatcaaaacgtttggggaaataatgtaatattctggaaacaaaacgcgtataatcggattgataaggaatattatatcatcgccgatgcaatcatcgaccatcgttttgttttcctgtctacccaaaaacaaaccctagtgtccgaattctcgacaaaattcatcggctccaaattccattcgtgctttttgaattcgcgttcttctgattcaagatg

SEQ ID NO: 115 - DNA, 3000 bp, Unknown
  misc_feature (1)..( 3000): cDNA_ID_3014384_gDNA_ID_2804_Annot_ID_145941 3000 nt of promoter + ATG
gagataactaaaccaacgaattgttatcggcaaaacaacaaattaataaaatcgaacgaagtgttagaacgaaatgttgtgatcataactccgacacctacaaatggaccgccatactttttatactttcactttaaaacctaccaaaacccctaaattaaatttatacgtgtctatatatacgatctctcgtcgagacaccaattaattttgaataaagattacaattctcacaaaacatgaaaactcccatgagttcttctatcacgtttgcactcgtcttctttctcctttctctcaacccaacttcatcattaccgtccaaacgcgaaagctacgttcaaaacgcgtgtagtgttacacgctaccaagacctctgcgctaaaacgctattgccgtttgcatcagtcgccaagaacagtcccagcaaatgggcacgtgccggcgtttccgttgccataaccgacaacaaagacgtccttagacaccttctcaaaacgaggctttcaacgattgggaaacgagaccgaatcgctttgtcggattgtcgcgaacttctccaagactctcttgatagtctccacaagtccttggccgtcctccggacactcagagccagcgagtttcagcagcagatgagtgatcttgctacgtggcttagctcttccctcactgacaaggacacgtgtcttgatgggtttgaaaagacatcgacgaggtcatcatcaacggtcaggatgattcggaagagagtcacgacgtctatgtacttgtccagcaattctctcgcactcctcaacaagctagcggctaatggtttgtaatctcttaaatcataaacttttacaaaagctttaattttccatgaaagtgtaagatcatattattaataaggtggttcatggctgatcactacgataactgtatctctctcattataatggaattatttacaggcgaaataataatgggcctaatgtcctatattgggccaatgttattagtcaagtattgtcatttttattcgaccgtcacaagcccatgccacctaacgagtaacgaacctctctctcatcaagtcaaaacgtgagaagaagtcggtgataaaaacctaataaaaatcactcgaaagatatttttttcttggttaaacactcaaaaagattttgtctaactactataactcgttttagtcctttccataaaccattttaattccttttacgataataacttgaaattttcttactcttaacgccacaacattgctaaacgaatttcatacaaatatagcgcaattattactttgatagcatattattgttgcttcaaatcatatgtttaggtagttgcaacttttgttttgtctacatgtatatatcaccgtgttaattatatattttgtttcatattgtcaagatcagtatataactttttaaaacaagatgctttgattttgtcacttacatatacatagtttcatataagagatccttcctaacattgtagttagctagtcttattccattagttttaaatgggtataaaattcaattgttatttataagaaaacaaagaagttgattagagaaagaaaaaaacaattatttataagaaattcaattattagccatcgcgaatctaaaaagttaggcaagaaagtgaaggagatgtggggtgacataactagctaaccgccaggttagcatcacaagtcaacgtaaacataaaacaccaatgctcttccatttttcaaaaaaattgtattcacatccgagtctgaagttttttgtgatttgtttagatcacaagttaggaattttgtagttttgcgcagggagggagacgccgagggaggtgtttagggagggagggaggtagacgccgtcgctacttagtgtaaattatcttttcagatcgtaaagctagtaaaatattgatagtataattcatatgtagctattaaaggtagatccaaaccatcatggtttaaccatgtgttattgtgtcgtaataagcaaaggctttatcttatataatcagaaacacttaaggacgtaactcaaaatatacaagtttcattaactataatcaaataattgtgtttgagcaaatgtttcaaatatatggttagtttcaatcaaaacgggttttcttttattctagaccattccatttttttctaaactacttagacaatcgtaatcactcggtaaaaaacactgttacaaaatggggtcgtagagatctaccactaattaaattggatttaccttttactctttggctcctttttgaaaaaatttgaagttaacaaaataaccaaataaaataagaataagtcgtcacatttaatctcataggcaatttttgaatctaatagaaatcacgtttttccaaccctgatggtcaaaagcgttatgaatgtgctttgtaaaaaactgtttagtttgttaagacatgcttttatattattactaattataaattatcatgtttatgctataattgaaaaatacgaacgtcgaaatcactcaaagctcacaccaatctggctttgagtgctaagttagggtttggcattgactttgtttacgtgagattaccatacctaacgaacctatcatttcattaattacaatttgagtattaaaaaaacccatataatatgtgttttcgtgttgttgcaaataatggactaagtaacaatattcattggtccgattttgaaggaaagttcaatgaaataaataaaagggtaatctcgtaataagagtgaaaaacaagccttaacctgtaaacgcttacgctagttaaatacacaacaaagaccgattcgcttttcactctctcgttcaaggtccgactcagttcccggcgagttcgactcggtgattgatttttttctagaaaataaaaattcttcttaacgattgatcgattttggttttctatctttcgattctagatctagaactcaatttgtgaggtttggagatg

SEQ ID NO: 116 - DNA, 746 bp, Unknown
  misc_feature (1)..( 746): cDNA_ID_1026618_gDNA_ID_2804_Annot_ID_145943 3000 nt of promoter + ATG
ctggaaagtctgtccacagaatgtaacattacatctaaatctaggagcatgaggaggcccttctctctcattcgcatacactggtagctccagattatgttgcagggcatacgcttgcagttgacctttgtatacatgatccatctctatctaaactggcaggaattaaccaaacataaagagatcaacgtgtatcagaatttctcaaacataaatggcaaacgaagagacgaatttcagatttcagaattggtcaaccaaacataaagagatcaacatgacaacatgtatcagaatttctcaaacataaatggcaaacgaagagacgaatttcagaattggtcagactcaatgatctagggtttcgtacagatcgataacatcaaaacagcgaaaggaatctacgattataaacacaaaatcgtacctctttgaaatggtgaagacacttcgagggaggaagtgaacaatcagacaaagcattcgctgattgaaactcatcgagaaaccataataagtatacacatgtaaattgtctcaaggatacgaaagattcgggttaacccagcttgaacgggtatgatccgaaataatccattaatgggccaaaattgggcttattcatgaaagttgtaaaggcccaatgaaactcgaagttgatcagaaggttgtcggcgaccaaatttctaaatccaattttgggagggagacgacggcggaggttgaaaggggaaagagcagaaatg

SEQ ID NO: 117 - DNA, 208 bp, Unknown
  misc_feature (1)..( 208): cDNA_ID_3014187_gDNA_ID_2810_Annot_ID_145949 3000 nt of promoter + ATG
  misc_feature (16)..(16): n is a, c, g, or t
  misc_feature (57)..(57): n is a, c, g, or t
acaaaaaaaaaatccnattcccttagagagagagagagagagcctttttaaaaaagnacaaaaaaaaaatgaaaaactagagagagaaacaagtggctagctagctcgccaaacttcttcaacaatggcggtttcctagggtttgatgtttatatgatcgggaaactctctcatctagatcgcgataactctcttttccatggaaatg

SEQ ID NO: 118 - DNA, 536 bp, Unknown
  misc_feature (1)..( 536): cDNA_ID_1688282_gDNA_ID_2815_Annot_ID_145957 3000 nt of promoter + ATG
agatagatatgactgaatttggttgctttcaagattggcatttgttggtttgctgtctgaaatttgcgagagtgagacaggtattgcttatgttattgtctgacacaattggttgggctaagaagttctaaatcatacacatgacacttgatatactgattatgtaattttcttttgcaagttttgctgcttgaaataatggaaatttggagctgatcttagtctcttatcccacgacaagtttgtaccttcttctcctcagtcttgtacattactgtgggttttgtctgcttggtgttatttatttttgtttgatttgttagaattatggtgattgtgtttggcggagttcattgatctattcgcagatcaatttatatatgttgtttgagttcatatatgagtttgttttatatatttgctaataggtattaatataaatggcttttttgatgtctaaagagtattttattaaatctcaaatagtttttatggtactatataaaggttttaaaacacagttacaatgtataatg

SEQ ID NO: 119 - DNA, 1008 bp, Unknown
  misc_feature (1)..( 1008): cDNA_ID_1665314_gDNA_ID_2825_Annot_ID_145966 3000 nt of promoter + ATG
cctcaattccttaatcttgttgtatccagtatccatactttgttttcttactgcggaagttacttggtagtgtagtctggatttcggattgcagactttgcagtccacgatttttcatatgttggtgacaacgaacaagtgttaagttgacggaagtgttcgtaacaaacgacgtcgtgacggtgatcttcatcaactttgattggaaatcaagttttgagggacaattaacccaaaaaaataatcataatgataagaaagagatttggcgtgttgctaataatgtaggacaagtgagcatgtgagagtctgtgaccgatgaacctgctcagaccaacctgcacatgattgtatcacaaacaaaaaactctcatttgtctttctttcgtcttactttattcattttaagcaaaaattaaatatccaccgcgttgcacaacaaatcatttacccatatgattattctcttagttttgaatttttgatgaccatgctgatttaaaatttgcaatcttacaataactttaacttatgtataaaaaaaaatgctgcatcaaccaataaaacaaaactttaggattacaaatgtttggctatgagtaaatcaagatataatctgcttcaagtctctttttctcatataataacagaggaaagtgtttatatatagttcaaagcaatattagtgtaaccaaaggtaaattttgtatgaacttttttgggggaaagaaatccatctgcagcattattacaaacagagtatgcagatctactgtctttttttggacttatactgttactaacaaaaatacacatgtaagagatttgcccaaataaataaattaaagatacacacaggctagataaagataagaccacatgtaaggtttttgttgctatactacattagtttacactcacttcccacctttatttaaacaactctcacctccttcactcgatcatcatcatcatcatctctttcttcttccaaaagtcataatcatg

SEQ ID NO: 120 - DNA, 555 bp, Unknown
  misc_feature (1)..( 555): cDNA_ID_3013183_gDNA_ID_2838_Annot_ID_145981 3000 nt of promoter + ATG
ttagtggtgaggtggtggaggatccgggtctcaaggcgtaaatttatcgagaatctgtcctaaatgttgtagaaaatcttggtttcagagcgtaaaaaagagagtaaattagataaagagaatatagtgtgatgcagcgcatcttaaagtctccttttacttctctcttttgaattgggctttgttttaatttcttttacttgggctttatgtttcagttttgtttagataatccttagtcggttaggattagggtctttgtttcttgtataaataggacatctcctccatcaaggagctgacgttttattgaataataattagaagctttagctttcttcattctcttgactatcggctattcgtttcgaatcaacgatcttcaagctcagtctttgttcggctatttcgaggaatcaacgaacaagtgacgcccccttctctcggctattccacggaatcaacgagcttaggattctctattggttacgctgcgccagttttggtatcagagccaaagacgatctctttcacgttgttgaatattcaatcatg

SEQ ID NO: 121 - DNA, 463 bp, Unknown
  misc_feature (1)..( 463): cDNA_ID_3014342_gDNA_ID_2850_Annot_ID_145983 3000 nt of promoter + ATG
  misc_feature (38)..(39): n is a, c, g, or t
  misc_feature (80)..(80): n is a, c, g, or t
taagcgagtctgtctagtttagcgaatctaggataatnnccggaagacacttttgaatcatcactgattttgatctctgnttctttctctaattgtgttgttgtattactgttgatgtagaagaagaagaagaagaatgtctcacaggaagtttgagcacccaagacatggttctcttggtttccttccaaggaagagagctaaccgtcacagaggaaagggtgagtctttttatcaaatgtagattccttgttagtgaaatgattactagggtttttataaagcttctctctttttgctcactcaccaatattgaattgagaatcagtgaatgaaatggttgattagattcaaaaggttattcatttattgtttgttttgcttacacgttattgttggtttatcagtgaaggctttccctaaggatgaccaaaccaagccttgcaagttcacagctttcatg

SEQ ID NO: 122 - DNA, 480 bp, Unknown
  misc_feature (1)..( 480): cDNA_ID_3017335_gDNA_ID_2862_Annot_ID_145993 3000 nt of promoter + ATG
cacatgattgttttgtatgtagactctcaaataaaataaaaattaatttaaaaatatttcgagttacgccaggtatattttttaaattttatcaatttaaatataatttaataaatataaaatttatggtttaacataaaacttatttgaaataattaatatgaacttgaattagggttttattttttgagtgacgttaattattaaagaaagaaacaggaatatcataaaaatagtttctagtaacctttaaaaaacgttgtaattcagaaaaacgtgaaaccaaacgggctacaaaatatattaaaacacagagtacaacaggcttttggtttgagcccaaacaagcccatttaaatctatttagtctgtaacataagtcacgtgcacctatcacgtgatcatcttctttcttccttttttcttgtcatctgttacacatcggttagggttttagtttctcttaccgagattcaaatg

SEQ ID NO: 123 - DNA, 2086 bp, Unknown
  misc_feature (1)..( 2086): cDNA_ID_3014360_gDNA_ID_2866_Annot_ID_146003 3000 nt of promoter + ATG
  misc_feature (127)..(127): n is a, c, g, or t
tagtttttttttgtaccaagcaatttataacaattgtggtttaagaacattggttgaggtttggtttggtgtacaatcatcaccggtaaaccgaaattgtcttcttctttttccatttttcttttanaaaattcatagtattaaagtacaatattcctcttgcatttactatttggcacacatatatacaaaatccagtatcccactcttgtgagccagccatcaaaagaagaaagagagagagaaaaaatgaatatgaaaacatcaaagatgaagttcacaaaagagatgatagagtctatcaaagacaagctcccgaggctcagcttcctccgacaatgctacggtggttgcggcgaccggacgcatttactcccttgctccatcgccaccacttccacccgcttttggaacctctccgaccgtcccgtggagctccagattcgggtcggttcaattctaaaacgggtccacactctcaaacctggccgttccaagaagcttagacacagaagcattcacagagcttacgttgatgaccaggaaggacgtagatggctgtactacgacgacacttgtctaccgtacgtatgggttcacgagactggtacggacttgtcgaagatggtgaagcaacagtacgtgagtctcgaggatctgagggattactcggagattagggttttaaaggatttacagagaggttgtgtcgcagttgagaaaagagacagagcttctgctttgtgttgattctccttttctcatgcttcgaatgtcttgattttctcttttgaaacttatcgttattggttagttcatctaaattatttccaagttatattatgtgatacatgatgcatgtataactccgtctgactcttcttgaatttggatttattgggattaaacaacgtgatcacaagttgatctctttccaaaaggggtaactagatctctgaattccaaactaatcacaaaattttatttatcttcgtcggttgatatttgtggtagttgaggattatatgtagtggaaaaagcaaatattatatttactaatttagattcagtcagaagatgacattattaagttaacacaacttggttagtggtgttgttacttatagtataagtgatctttgctatgatgatctgcgaatgatttatatccaaaaattagtggttttctattattgtttcccaaaatggtgatgcaatatttaaataaagtttcttataattaagactatccatcctgaagtaaattttgatctcttatttggtcgagaaacaaatactatttagagagatcttatctttacacatttatcgatgatcaataatgtgtatttattttgatttttttcgttggagaaaggcaacaaaatccagtgaggtgccttgatggcaggcaaaataatgacctttcttctgatcctctcccactttgatagtccattaatcaattcattcaattgtgtcatatatccaatatccaatattcaacatttgatgcaaataatatacttactggttcaaactcaactaattagtgcaactttaatggctgacatgatatatagtaatagcattagatacgaagtttttagaaatcgatttcccgcatgagaggtaaggtatattgtagactcatagaaaaacatgtctctaatctctatagtctatagttgtagagttgacttttgagtagcataatttaattattacacacggtaagttgtgattaggtggtaaaaactatacaaagtcaaagttacgaagaaaactgaacaactaaccaattattttatgtaaacattaacatattaattaattttctacaacaaaagtctaaaaccacatattaaaccgaactcaataccaaaaccaaaccggaaaagagaagttttgttactcggtttaaaaagtaaaaaagagaaaagtcaaaaaagcattaacgaatcttgaacaagacatcttctagttcttcttctaccaaatcttgtttttcttcagtctctctgcttctcactgttgtgctttctgtcttgtctctgtctttcccattgtcattctctcaccaatg

SEQ ID NO: 124 - DNA, 2557 bp, Unknown
  misc_feature (1)..( 2557): cDNA_ID_1688573_gDNA_ID_2871_Annot_ID_146016 3000 nt of promoter + ATG
  misc_feature (1874)..(1874): n is a, c, g, or t
gctagtagatctacttgagttttaagagatgtgtcttctttaataccattgtggttccttttttaatttcatggcttaagtgaatgttttttggcttctttggttgctatagcttatctctgatttgattaagtagaatcctttgtactgaagtgactttttttgtatggatctaatgtagaatatagtcattggagatggctccggttggtcctcgatccggtgatgcgatcttctctagcattgatcgtgtggtaagttcagatttcaaagttttcgccttttttatctgttcctctttgactctgatttatagaatttggtatttgatatgctacattaccgatttgcttatctatttcttaggatatgcctttttctatgtatgctttattgcggttggatgtgtttttgtaatttgtaaaggatttgagaagtcaaacttgaagccagttccgagtctttgatagaattttgttatggagatactgtttgatcttgtggaaattgatgatttgtagaatgcggagttgttcacgttgacgtatggtgctattgtgcgtcaattgcttactgacctggaagaagtagaggaagttaacaaacagcttgatcaaatgtattcttcttctacgatttatgtagactctcttccatggttttagttttgtatttttgtcatcttgcatttgtatatttcattcttgtgtttgaattttgtttgcattatgtttctggttcttttgttcatatatctttctaataatatgtcatggatgggatgaataaagcattgtactctcaggttcatactgatgagtgttcgattgtttagacctttatcactaattttctgtttattttgcaggggatacaacattggaatccgacttatcgatgagtttctagccaaatctggtgtttccagatgcgttgactttaaggaaactgctgaaatgattgccaaggtttgccatttccagtgacttgtttagtatcacgacgttacagtttgaagtgtctccgggagtaaaaacaacgaggaattaaactgcaagatatatgaatgtttattccacttgacactatagataaaaccttatatatcaaactagagcataagcttcttaatgtctagtagatatcactcctttggtttcatggtattgagaaagcagtaacagggctttgccttattgcacaggtgggtttcaagatgttcttaggagtcactgcatcagtgacaagctgggactcggacgggacttgctgcagtataatcttagaggacaatcccctagttgatttcgtcgagcttcccgatacttgccaaggtctttactactgcaatgtcttaagtggagtcattagaggagctttggaaatggtcagtctccttctccattatcaagtgcagaacttgtttgtgctcagtgttttatgttcttattttttgtctgcacaatgatcaggtctcaatgaagacagaagtgacatggacgcgtgatgttcttcgaggagatgatgcttatgagttgcaagtaaagctactgaaacaagtcgctgaggaatatccttacaaggatgatgaataaatatcaatctcttatcttccctcttcctcaaagagaaactaattactgttttgtagtctctttctctgcattcttagctttgttttttttatccgcaaacacaaaactataagctatgaaactaaatactgtttaaatccatttcttagtgttctgatgtgacaagagttaatcgtatcatgatgtctcaaatcgtgtaataaatagatcaattcagtgagatcagagtgtttttttctttcgatatctctaataattttgcctcacgaagaaataagncaaagaacaaaaataacattgaggtgtcgtcatatgattggttcagataaatccgacgtggacatcattggttattaaaaatgattataaatctctttgtcttattattttctcaccgtcgagagaacaaaacacaagttgcagactttatccaaatttagggttttctttttcttcttactcagattatcatcagatcttcgaaaccccaaatttacaaatcaggtaataactttctccgtatgtctttctttgatcaccgattgtctcttgcttcgtttgcttttaccgatctgtgattgaattttctagttcgttgattaatttttattacacttcaatttggttttcgattttgattcatagagattgaattgcgaattatgtttcagatccttcgtgtttgtatatgattcaaacaaagagaagatcttggcttttagttttttttcttcttcttgtaataaactcctacaaggcaacgatgattttgatttggtccatcgatgcttttaaccttataggattgtaattgaactggatcagctttacttgaattgtttggatctcgattattcataaaacatcttgttaattaaattgaaacatatttgtgtctgtgttcttgatgatcatgtgaatttggtagcataattttgcttgttgagattattaatgagatg

SEQ ID NO: 125 - DNA, 200 bp, Unknown
  misc_feature (1)..( 200): cDNA_ID_1376494_gDNA_ID_2871_Annot_ID_146017 3000 nt of promoter + ATG
gctagtagatctacttgagttttaagagatgtgtcttctttaataccattgtggttccttttttaatttcatggcttaagtgaatgttttttggcttctttggttgctatagcttatctctgatttgattaagtagaatcctttgtactgaagtgactttttttgtatggatctaatgtagaatatagtcattggagatg

SEQ ID NO: 126 - DNA, 306 bp, Unknown
  misc_feature (1)..( 306): cDNA_ID_1688584_gDNA_ID_2876_Annot_ID_146022 3000 nt of promoter + ATG
  misc_feature (152)..(152): n is a, c, g, or t
aaaaaatattccttctttgattggtgttaaatcagtatctcttaacccacaagagattagggtatatttaaccaacttgtaagaatcaaccttaaaaagaaaagttagggcttttcactaatcttgattctcagtttcttttctattacaanatttttgctttgatttgattctcttcctgaaatgtgtggttctttttctgttctgttctgctctgttctgtttcatcttaatttgtttggggtttggtgaaaaatggatactttgttttttcagatgtggcttcattgatttgagtgagctatg

SEQ ID NO: 127 - DNA, 440 bp, Unknown
  misc_feature (1)..( 440): cDNA_ID_2685721_gDNA_ID_2891_Annot_ID_146029 3000 nt of promoter + ATG
taattattttgtaaatggttctaaaaagataataattataaataaaagaaaacttttttagaaaaaatcttttaaaaattacaaaattagtttaaactctctataaattaatagtacttttctaaattaataaaattttattgtctcgatattattaatttatagaggtttgactgtatgatgaatagttaaatacctttataaattttgttacaaatgttggatacatatatacaaattacaatctatactaaaccaaattaaccgaaaaacaatcctaaccagcattaaaccggagctatacatatgtagtagatcagtttaatttggtctcactcaatcccaagaaaaaggccgttctttgcattttctatcgtttcatgtctgtctgagtgacagaggaaaccccaaaaacctccgtaaaacctcacaaaagaatg

SEQ ID NO: 128 - DNA, 807 bp, Unknown
  misc_feature (1)..( 807): cDNA_ID_1690384_gDNA_ID_2912_Annot_ID_146038 3000 nt of promoter + ATG
gatccacgtcacggacgttacctcacagcctctgctattttcagaggacagatgagcacaaaagaagtcgacgagcaaatcctaaacatacagaacaagaactcgtcttacttcgttgagtggatcccaaacaacgtgaaatccagcgtttgtgatatcccaccaaaggggctcaaaatggcggcgacgtttgtgggtaactcgacgtcgattcaagaaatgttcaggagagtgagtgagcagttcacggctatgtttaggcgtaaagcgtttctgcattggtacacaggagaaggaatggacgaaatggagtttacggaagctgagagcaatatgaatgatttggtcgctgaataccaacagtaccaagatgctactgctgatgaggaaggtgagtatgatgttgaagaagaagaggagggagattatgagacttgatccaccaaatcaaacattttacttaaaagacaaggaaacgactcttggaaatctctctatttaaatttgattgaaaaacattgaaaaaatgggaaatttgtttaaatgtgttttttgtttgagtaatttgttcaaagaaagtttgaagtttccatttattttgggtgtcttgtattttccatttgagataatacgtccttgcttctcaagctactgtgtcgtatataaattttatacttctctcaattgtcccacatcgagtaaattagtataaaggaagctaaacttttgcctctataaataaagatacttcatttcccaccgacttttacatttgggcttcttaaaaaataggcttgacaataaatg

SEQ ID NO: 129 - DNA, 2881 bp, Unknown
  misc_feature (1)..( 2881): cDNA_ID_3014315_gDNA_ID_2921_Annot_ID_146041 3000 nt of promoter + ATG
tatggtagatgaatcacgaaaagctgaaaaagctcagatcgctagtaaatagtaataatagattgagtctagttgatcagaagaaacttgcacaagttatcaagttggtggtcgaaatggaggatgaactcgaggagaaggttcaaaaagtcgagaagataaacagaaaggtagatgagaagatgaagaagaaggcaaagaagagacatttttcgtttttggtttgttgaatgttgattcgtcttcagctatcatatcatgtcggtgttagacttaaaataagtgtttaccaataacttatacaagagaggttctacaccgtttaccaagagaatcaaagaatgcaaagtttgtaacttttgtttgtggtttaaaagaacaccacaatcattgttgaatgcataacatatttcaaccagataaggagttaaagaacttttatatggatctaatacttaaccactaatactaaaaatttgatcttgaagcaacataggagatttgagtagttagaacatatctagcaaattctgatctattgtgaaaagaataactagagacggatgacttaatttctatatagcatttggagggtcataatgacttgtttttatttacgtgttttacgttattttgtttttgtcaaaaggctttcctaaattagtaatactctataaataaataaacacaataaaatactctttcttatcgatttaggtatggccaatgtaaaaaactaaaaattaacaaaattttgaaacttctatacatttttatggttctagtaatattataaatttatacatatatagctaagataatattctaaatatgactataatattgtttgtaatttgaattattgttagcgttattctctaatgttacttattattcaaaaactcttcggtgttttcgatttgtatccaaattttatgataaactagatgatcacccgcgctacgccgcggtttttttggatttttttgtattatttaatttaaatttaattttatttatctaatcattcactcatgcaataagcaattacttagtattaaaaatatttttttctaacaacattctcaacaatgcatcatacatataattcataaacaacatttgtcttaaattaatttaagagagggtagtgttggattctagaaacctaagaatttgatgataaagctccttacgtattcttcagcctcagtaatttattctataaatatcataaaagaatataaatatcaatttaagagaataacttactcaaatcattaagtaatccacgactattatacattcatactttgagtttggattacaaaaaaaaatcttcgagtatgagaaaactattaaaatagttttattaaaaaatcatataaaataaaaataaatttagtaatagtataattaaatatgtaaaataaaattaaataagaaatatatcattaacctataaattagaagttgaagagcttacattaattatttaatagacacatgtcaaatgctaaagtgatgatgtgtcaatcatatggagagagttggccaactttcatatatatgattctaaacacgataattaatttacaaaaataaagtacttatttgagtacccttaaatttatgtttacttgacttcccagttcccagccagtataaatctttttcttatatttaaattaattaattaactttggatatagaattgaattattaggaaaatatatacatatcaatcaaaaatataatatttataagcttaatacaaacatagaaatatctatatctatatatatctagcttaattaattggatagtaaaagcttatctttgcatttttattattttaattaattacttgtatatatatattattttaaatacttattagcatattgacatttaagatacaaggtttaaatttcttttgttattttgaacagaagttttgttaatcagtaaaataaaattattgtaaataaaagaaaagattttgtgcaaaacaaactccaaagtcgtttatttttgtaactttatctttcacgtttaaaaatacaaaacaaaattatgaagtaaaaataatacgtaatgtagtcgattttacaactttacatatattgtaaacgttttcacgatcacatatatttgtttttaaaaattttaaagatatagttgaactcctcatctcaaaggctttgatttgataaattatctatctaaattttaaaattatttatcagaattttaaaatttgacaatagcaaaaaatttgacatatgtataatttttgacttagtattattattctgcattgttaagatgtaaaatgtaaagttgtaaaaagtaataattccgaggattttgtgtaaaaaaccttaaaatgttttagagtttcttgcacaaggataacttttactttttttccaaaccccaaagtctgatttacctgtgagttaacaacaattactactctctttgagtaaaaatcgcatgccaaaaagattatagaaaatataataccgaagaaaattccaaatatacaagcagtaaattaagttgattttgggaatagtctacaatcccatgtacacatctccactacattccatacaccttttttaatctaacggctcacaaacaataaaactctccgaataagtaatcaccacgtgatttatcttgacacaccaaagtttgtatagacgtgcatgtatgtaattaattaaccttttatgtactatgaattaactgtgttgatatataaagggtgactcaataccccaaaagcggtctctctctatactttgcttctctctctaaacttctctctttctttttttctcaaagcttttttccttctccctaaacgatg

SEQ ID NO: 130 - DNA, 376 bp, Unknown
  misc_feature (1)..( 376): cDNA_ID_1690403_gDNA_ID_2922_Annot_ID_146043 3000 nt of promoter + ATG
gcacgaggagtgaggcgactcacgagtttcctcgtagtcgacaagaaagctcctttcaacgcaatactgggaagaccatggctacacgccacgaaagccgtcccatcaacctaccaccaatgcattaaattcccctcgatgaggtcgattggttgctcaagatcggatcgataagagaagtaaaataccctgactagctcgccaacccggtcgtcgttaaaaagaaaaacgggaagtggagagtatgcattgactttacggacatgaataaggcatgtcctaaagatagtttcccactcccacatatcgaggcacctattgttataaagtaatgccctttggtttagaaaacgctggagctacttaacaaagaatg

SEQ ID NO: 131 - DNA, 357 bp, Unknown
  misc_feature (1)..( 357): cDNA_ID_1690518_gDNA_ID_2963_Annot_ID_146062 3000 nt of promoter + ATG
tgaaacttgattctatatattatttctcttgataacagtagctactgcatagctatttagtttgttacttgaagtaccatataaatacactgctgaagtttccttctgattagctttcatttagagcctactgaagctgatgctttattttcttgatcatgcagtgaagtaggccgttggttaatacttctatctttgtgatactctttatcgcaggaaaagtcatcaactggatcacgcactgatgatatatatcgccatgatgaacagcggtctgcagcaagagggtcgtcttttgtccaaagggactccagaatgcgttatgagagcccagacacatatagcaaatcaaaaatg

SEQ ID NO: 132 - DNA, 357 bp, Unknown
  misc_feature (1)..( 357): cDNA_ID_2686240_gDNA_ID_2986_Annot_ID_146081 3000 nt of promoter + ATG
  misc_feature (25)..(25): n is a, c, g, or t
tgagtgagtatgcatgagtaaaacnaatagttccacttaaaccttttccaaaaaaccaaaaaaaaaatccaattaattgaccttaaattatagggagaggtttatatagtattgcctaacgtgagctacgtaaaattaaagacgctaaattcgtaaatgcaaaatcatttctatttggttgataaaccggaaaaattacacttaaccgagtaaaaggtacgtcactgtatcttccccatatttacccacctgacaatatatgatacaagtaaaatcttaaaatcccaaaaaagtgaaaacaatctctcttctttctcaaggataatgagtgagccaaatcgggtacccaaatccatg

SEQ ID NO: 133 - DNA, 929 bp, Unknown
  misc_feature (1)..( 929): cDNA_ID_1690682_gDNA_ID_3004_Annot_ID_146092 3000 nt of promoter + ATG
  misc_feature (115)..(115): n is a, c, g, or t
aatttttcatcaagtatcatgacaaataatcttttttgatgaaagcttggtagttttggagttaaatattttaatttaactattttatagttaaaccgaataaatttaattaaancatcgacatcacaaatgaaattttaacaatatattaatcaaagatacttataatttgtttttggatatttagacaaaattccggttattcagataaaattcggatatttgggtaaaagttttgggtattttgatgaattttcgactattcgcataaattttttgagtgtttgagtaaattacgggaattcgagtatatctgaatttaaaggatacctgatttttaaaagtatttcgtggttttgaatttttatacccggactgatcagaacccgatgagatccgaaccgaaacctaaccaatattttatttttaccttcttagctcttaacttctctagtacccgatcggattttaaccgaacccgacccacaataccgttccaataatcttttcttttgacatacctttaaagctttcaccttctgttgctctttcaaaaccaaagcctattgggatgaccaatttgtcccaaacatgaacacaattccacttataagtcactgcacacccaaatttgaatgcttttatatttttctacactcccaaatttactctgggaaggtccaactaaatcgagaaagctatgtcatttactccacacggaggatgcccacaaggtgttcgacacaattccacaaagaccctgtcacgtggctcgtacgtgacatcttcttcaataccttactcgttgattttttcccgcttctcctctgttttctctcgccaagaacaaaacctctctcgataccaagaaaaagcaaagatcagatcactgagaagcgttactggcttctactctcttccccaacatg

SEQ ID NO: 134 - DNA, 2534 bp, Unknown
  misc_feature (1)..( 2534): cDNA_ID_1690969_gDNA_ID_3113_Annot_ID_146096 3000 nt of promoter + ATG
tttgtcttatacttgcatcgatgcatgcgatgtaaactttgtagaagcaattccaaccatggatatcgcagatactgaagtaactccataatcaatcatttacatatctatcatatacattaatattgaaagtgttttgatattggtatttctctatatgaaaaaacaagacaacccgagacattttaacttcagattatagtgtgatatcgaataccaaattgacctttctatcgaagataaaccttaatattgataaagacatatagttactaaagaagtaagttaatgaatgttgaataaaaacaccaatggtaagctaaatattaaacaatacaaaagagaaaacaaagctaataagtaagaagtaagaagctaaagagatagactgacatccatgctccctcaaccaaaagacaaaacacagtgcatcaatggcccagctgtcaccacaactcttttttttgttgatataggaacttgttttgttttctattctataatatttatttattcttctttcttgttatctttttaaatcaaaacgatcgagactgaagttgttcaatttttttcgtaataaggataagaaattaattaaggatagagagcacatgaaaatacactgtatgtactgtaatggtgcattcagggacccttcaatacgttccaaggccacatgtgattctcacaaaatggttcaatatttatgaaagttatttgtgaatatatgttaagataaaatgtacctggaccattctttctatttgtattagactatcttacacgtgattttcttactcttttgatttgacttcaattagatctatatattgcatcaaactttttaccaaattatgcgtcaagtcacaccaattgatgaggttggccttatcgaagtagtggaaccgtcatatgctaaaccaaatataagaaatgaatgaaagacctttcaacaaaattaataagcaagtagaagtaaatccaatatcaatataacaattggttaaacctaaattatatgcatccaatacgaaaattctttttttggtatcttttaatccgtttattatatttgtggagcctaagttgcggatccacttgtattccttatttgaatcattgttatcatttctcattgtttgtgactcgtgagctagaagaaacaaaaacaaaaggataacgtaattttgatatttaaagtaaaccactataaatcattgtgtgtgtgttttttcttgttttaaaagatcgaattagggagcctaacatgtttttgtctcaagagattattatcattaaaaaaaacaagtggaagtggaagttgtgtaacccacttgttgaattcttaacttcgaagcacaacaaaaagatagacgaaaaacgaaaactcaatctaacttcgacatatgcattagataacatatagaaatttaaacaatctcgttgatgaaattggtctatcaacacacgacagtggttctctctacagtagcatcaaatcggtggatccttatgaacagaaaaaacgaggagggacagaggaaggccaatgaggggtcatgcaaaatggaacttagcaaaagtaccaaaaagatccatcctctttgaaaattcatttcagccccataattatccatgacatgaatttcgatctgaatctcacaacaagtaagagatcagcttttgataacattaaagaaaaaagtaaaaaaaagaaagacgagagactgagaaaagggcaaagacttgtaggggttaagacagctaagagtgttcctcagtcgccccacaaatgtcttctctcctctctcttcagtctttctcagctctcaaatctttaaatggttccaagttcaatgctcccaaaacccacgcccacacatgcatcctatgacctttccttttctatccattttcttcccacaaattaccactttgcaaacacacaaaagccaaaaactcatttacaagatgagttaataaagacactaacacacaaccaatgtgaaaacagacgtttacatgagatatcgttacctctaagaagtcattaatcatataatgagaacattcttgcttcctaagtttttacaagattattaacctctaagaaaggagagacacttttaacgcaataataactacatgatgttataaatataggagagagtagaaaagaatatgacagccctactaagacagagaatcatcatcgaacagtaaagaggagaatctctgaatatccactttaaactactgccctcttgtcttaactctcagaaccatttaatttttcagttattttgacccataccctttttggcctctttccctgctttccaacaccttcacacttactctagggcttccacggctatatatatatggtcccttccttaaacttgtatctcataattcacaaccagcactgctactactagtttatcattattccatcaatttattctatatagagttcttctctgtttatattacgatattgctcgaagattacatacctgagaaagatg

SEQ ID NO: 135 - DNA, 367 bp, Unknown
  misc_feature (1)..( 367): cDNA_ID_1690975_gDNA_ID_3114_Annot_ID_146099 3000 nt of promoter + ATG
ccgatccggactgcctaagtccggacgagttctctcgacccaagccactaagtgactcagccctaaccgtttatgaggttctttcctagtctaatccgttccatatgattccgtgattcaatatatgagacgaatagagtaaacaaacaattggatactttattgattaagcaaaggattcgatacaacctatgagtttgcatataagctattacaagtcatataatcgatccctagactatccgaactatcaccacccatcatcccggtcttgagtctctcgcgcctaagccaagtccttcccacgatcaccattcgttcctgaaagtcatagagccataagtaatctcatttacttagtcatatg

SEQ ID NO: 136 - DNA, 906 bp, Unknown
  misc_feature (1)..( 906): cDNA_ID_3013323_gDNA_ID_3123_Annot_ID_146105 3000 nt of promoter + ATG
  misc_feature (14)..(15): n is a, c, g, or t
aatacaatatgttnnattattttgatgtgttcattaatgtttcattctttacgacttttctctaactataagtgtgagagtcgaaactcgcacaagagaaattgtactaagagtttcttcaaagaatggatctttgtgagtttctcaaagaacaacagaatttttgattaccgcggacggtattcttgattatattattgaaataatgaggattcgatcgtacaagtgtttagaaatatgaaaataagtgttttgtcttcaaaatcagagcgttttagatagcctgaagttgagagcgtttttgtgcctttgctttgtttgtcctcagaggtgctttttatagggcttcagcagatcgcttctcgcgatattcccggaagatttctctttatctttgagttggcgaaggagattgtccttatcttccgatgattctgggaatttctatattaggtgatatcttcggagattctccaatatctcttccggtttttttggaaatggtatgtttgatcctatattagttaagtcctttctcaaaggttttcagacccgatccgaagttcttctgagccgggttgagctgaccctcgggtcgtgattgagcggctcgggccgtgacattcgaaatatgcgctcccgaggcgtcttgaaacccgcctcagattgatttccgggttgacgtccaaggcaatttgagaccgggtcggggaaccatttcggggcgttattgataacgcctcgggatggatcctcgatgtgatctccgaggtgttttgtggcccggctcgggatgattctttgacatgttctccgaggcattaaacatggttgactcgtttacctgggtggaatccaaccccaacagtttgcccctcagctcattgacttagaggaaagacgatg

SEQ ID NO: 137 - DNA, 279 bp, Unknown
  misc_feature (1)..( 279): cDNA_ID_3014307_gDNA_ID_3133_Annot_ID_146110 3000 nt of promoter + ATG
aaaaaaaaaagtattttcttgaaatcgaaatctgatctccattgagagtcttgctacttgatttggattccgatttaaggttttctcgagaattcttttgctgcagttattagattttgacgagccgttgatctggacggagttccagatctccgggtcgtggtaccaaggaattagggttttagcacaaagttctcgtttttctgtgtattcgagggatgaaggagttttcgggtcgatgttcgctgctctaacatttggagtatgaagatgaacatg

SEQ ID NO: 138 - DNA, 74 bp, Unknown
  misc_feature (1)..( 74): cDNA_ID_1685057_gDNA_ID_3142_Annot_ID_146121 3000 nt of promoter + ATG
caataaagaaatgaatatttccaccacagaattatgaattgagtaaaccagaaaatcgaagaagaacggcaatg

SEQ ID NO: 139 - DNA, 762 bp, Unknown
  misc_feature (1)..( 762): cDNA_ID_1017618_gDNA_ID_3159_Annot_ID_146132 3000 nt of promoter + ATG
caaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcgcttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattccacattaattcgtcttgtgcaaaaaaagacacttcttaagcttcaacaagaaagaaatagtattcgcatagtatcagaagatg

SEQ ID NO: 140 - DNA, 225 bp, Unknown
  misc_feature (1)..( 225): cDNA_ID_1687366_gDNA_ID_3196_Annot_ID_146151 3000 nt of promoter + ATG
tttttaataagtccactgataaagacgagagcccaaaacgtaattgtattattatcttcttaatttgcttttaaattttaaattgacattaagacaagactaacttttgcttgtcaaatccatgtgttgtccagcgggtaatcaacccaaagttccggatccggacccaacagtaagcaacattttacgattcgttgtttttgaatcccaatgaaaaaaaagatg

SEQ ID NO: 141 - DNA, 1118 bp, Unknown
  misc_feature (1)..( 1118): cDNA_ID_2999487_gDNA_ID_3219_Annot_ID_146163 3000 nt of promoter + ATG
  misc_feature (336)..(336): n is a, c, g, or t
tcggtaacataacgatcgttcaagatgtgatcaaaccgggtgattacttcgatcaaatcgagtcattgtcgatcatacaatgtcatcgagacgaagtacttgagcctccagagtcggctagagtcataggattctcagacaaatgcgacgttgagatattctcagtggaagatcacttgctttgctttcaaggtcatcccgagtataacaaagagattctccttgagatcattgatcgtgtccacaagatcaaatttgttgaggttcgttttaaacgtctatctttggttttattaatcctattatgtatagattggtcggtcttctaatgtcccnccccctgggagattattccgctacgtacccaatttaaattccgttgttcaggatatatatatatatatatatatatgtagccagggtgaggaatctctaaaacgattttttaaactaaaaaatatgtaggaggaaattttggagaaagcaaaggattcgatcaagaagtttgaaccagacacgcagcgtttgcacatgctttgcaagaattttctgaaaggacgaagaacccactaattggtttagtttccacgttcatggtctaaataaattctactacgtttgtgtaatttcataactattatatggtcatggtcatcacataatgtaacatatcttcgcttttaactaaattaccgactgctataagaaataataataataaattaccgataaacaaaaagaagaagactggtatttgtaattttaatttagtcatttataagtgggtataggttacgtgtataaatagattatttgatcttcaaaaaatacacgtaaaatcgagctacggtaaacaaataaatgtgattctaaacttagataaattattaggtggagttgtcatcttatagacagctaatctcgatgtgtgattctttttttttcaactaatttttgactattttttttctgttttctttatttaacaaaaatctcacttggcgtgtctgatcttgttccccgtcgtcgtctctaacttacacatttccattctccgaatctctatctctccttttgcttcatcggtgtgatctctgagacgaaagaagaagaagatg

SEQ ID NO: 142 - DNA, 1407 bp, Unknown
  misc_feature (1)..( 1407): cDNA_ID_1687439_gDNA_ID_3242_Annot_ID_146175 3000 nt of promoter + ATG
ttttttttctaatgttatagaattgtatgattgagaattggatgttttttcctgaatttagaattggtcggacgaagagtgttgatattttcttcaactttgtactgctgaggaaaaagggaatagaagaaagacgagattaaatataactggaaaagagtccatcatgagatagtttgaagaaaaatttgggaagagatattcatgggataaacaattcaagaacaagtatgatgtgcgtagaagaacatacacaaaggttaaaaacttgcttcataacagaactgaaattacatatgattctgtgtaaagaataaatataatttttcttttcattacgtttacctaagtatttaagaaagcaagtaaacatacttttaataactaaaggtcgctgaaaattctaaagattgtaacgtgaattctcaaaactgtaaaaactgattctttttattgtaccctatatgttaacgttaattctcataactctaaattcttatttttccatcaaaatcatgacgtcaatcaaactgttaaaaggcgaaatacaaatataaatattgtactaatattgttaatctgaaatatctactattcaaacatatttgtttgaagtatatcatattacatgatacattttttggtgatgaatcaaattgatgaataaacatttcaatatgaaatttacttgtttttgaataattatgtaatacttttttttattagttatattttgtaaaaaaatataatattttattataaatttcatcaattgacacatattcattcatgacaatttttttatcaagcttgagatcctcaaaatggttttatcattagttatatttaaaattttaacattaaatcataataatataaaaatttggtgtttttcagttttctaaaattataaattatattattttggtattttgtatttaccgttatcgcacatgctggttaatcaactataaaacttcaacaaacgtaaaatttaaccgctaaatcaaacatttaaaatatatgataactcttaaaaccgcaactctccgtttccataaatttcagcagtcccaacagcatccgctgcatttgaaccattcaagcctcgtagtttggtcaagaaccgattacgcgaccaaatcttatatccgacgctaagtcgctaaccatgtggaaaccattatttatcaatagaaatcaaaacgacaaaacccgacctaaaccgaaatctcaaattcgaacccaaatccaacttacaaacccgaccttaaccggaaatcagaatccgaaaacattttcccttatagcaaggtttaaagaaagcaataacaaaaccctatctctcgtctcttctcccccaaactctcgccgccgtgataacccaaagttctcgacgaagccatg

SEQ ID NO: 143 - DNA, 2891 bp, Unknown
  misc_feature (1)..( 2891): cDNA_ID_3014900_gDNA_ID_3254_Annot_ID_146185 3000 nt of promoter + ATG
  misc_feature (1888)..(1888): n is a, c, g, or t
gctcaccatctcgcaaagcctcaagggactggacaaaacaggatatgcataatatggcaatgtaagtaaaatgaaatcatgttaatctcattggcgaaatcatatatgtaagagagaaactaatgcaagcttgcctgtaatagtggctggaaaagatcaaaaatggctttgtggatcttctcagattttgtatggaaacactgacccaacaatgtgttacgcatcacacttggggacaaggtagccctaagccagagcttacaacctttcatcatatgaatgtgtcaactaacagaatatatatcttcaagataaactggctagtttataaaacgacaatagttaccataccaagtgttttaaatagctcttttaggcaattaacagccagcgaaaattcaggtgaatcaccacttatgtgattcaacactgtatcgacaaaaatgggataaggctctaatatcccctcttcaaaagcagggccttctaagaactcaagcctttaagaagcaagaaatattaaggaatcagcaactcaagaaaaatattgaaaaacagtaaaaggaagaaaaactataaggggagaattagtcactaactcttacagtgatgtcatcccaagccatatagatgagcggtctaaatatatccttggtctcggttcctgagacgcagaaggcagtccctccatctccagaattccaatgaatttcttgagcaatggctggaggcgctctaactgggttgctgacctgccatgatagcagataatatcatacatggtttcatacgcactacagatagtcttgataacagagttagctattaatttacttagttgctgtatgaaaaaggaaaatacctcaactttcccatggcccttgccaagcgataaccaattacacgcacccttctattgagaaaaaggagtgcatacacaccctaaacagaatgaaatatgagaaaacaccaagtcagatagattcagtttagtaggaaacacaagaagctctcctctggtattaacataccggaaattcttgattctcagcaaacgcaagctcgtgtatgttgtcgattgactcaataaatttctcaaactcagtgcataaggacatatcatcaaagaagaatggaaacatcaaaacctgacaccaaaataaaggctcataagttactatttactagatgccaatcccatgatgcaaagaaatgacatgacatgaggattcaaaatgaatagaaaaatacagatcatcagagtcagtcggtaacgcaaatgattcatcagtgaaaagaacaatccagtaattattttaagtgaaatgaaaaagcacatatactacaatacctcgtacataacactaacaacttcagcatgatgatgatctggatcatatgttcctttttcaattttcaaattgatctcttgcaagtgcctcgtcaccctttcctcatcaagtttccgcaacacaacaagtaatggaccaacagaagagcactcatactctttttcatacatctcttgagtctgatggtgctgacaaatgcattgcgcacaaagccgcatctcttcagagattctcttccacaagaccttgagaggtgaatcaactctatcatctttgaagtaattgtagaaagtctctataagaggtcccattatatccccgtgcccacaccaaatatgagtatctttcggcaacgatatcaataaagtgaatgcatccgtaaacctaaaagaagatgtaaaacaaaaacagtcagctagagctgaaatccgagcaatgtaataactaaattttgtctgatgattttctgatttcaatcgatttaacagtgaactattcagagcaaagagagatatagaaggaaccattgttcttgncgctgattaagacgccgaactgctgaaggatcagaatcgtcattctcctcttcgtcttcctcgattctcctccaccggttcaagagctctccacttggggagactttactcaacattttactctcaattcaacaacgggggaataaaaaaatctaacagaaggcgtagtcaagagttccggcgacgggaattagggtttccgaagtagagaggaaggaaacgaggagaaccaatttgaaatgccttaattcgaattcctgggtctcgctcgttacacaaattcttcgattttgagaggaaaaccaattttcaaagcccttactgtttgttagtggggagaaaaaagcgagcgcagtataaaaggacacgatgtcgttttatactaggggaaaaaaccatattgggccctattgggctttcctagatggaaaaattcaaaatagtcctattactttctctttaaaattgtaaaaaaaaatatcctctctcttgttctttctcgcgttctgctctttcgatttcaggtgattgatttgattagggttcgagttttagctcaattcattgcttctgcgtcaattattaggcttctagatttctgttttttttctctatatggtaatcatgaagtgtatgctttgcaactatcgattttcggttgattattagggtatacatacactatagatctactacgcctcgtttactaattatgtgggttatgtgatggctctttacttttttgattgataagcttgattcgtgttcaagtcctagttctaggatctcttgtcatacacaaaggaaagaaagaaagagttagagattttggaacctttcaatgaatttggattatatgtatactgatgatatgtgctctccgtttgctaagtcggttggtagttttgcttatcagtgtttcgagaaatcaccaattctcaagctttctaacttgaatgtatgttttgtgtggtactttgttctgactagcagccaagagatg

SEQ ID NO: 144 - DNA, 2302 bp, Unknown
  misc_feature (1)..( 2302): cDNA_ID_3594261_gDNA_ID_3265_Annot_ID_146194 3000 nt of promoter + ATG
  misc_feature (1290)..(1290): n is a, c, g, or t
tagacattacaagtctctacaatgttggtttatcattaacaaggactaaacaatatactataatcatacaataaattaagagtcgtaaattaatggtaaactcaactaatgcatgaatagttgtaaaagtatatatatttggacacgttactcaacttgcatcgcggatctgtattccttcccaaccactacgtacacgcatttcccacgagtttgacgatctttctcgtttaatctaatcatatctacttttataggctccatagcccacatttcatatcttatagtacgttccaacttctaaccaataaactcaaaactagttgagttttttaattagtgaaatatatcttgaattttatatatctaatcttgcaccaataaagtttctgtcaattatgtaaaagaaagactcgttgtatcagtatgggacgactttttcttctgaattgtgtcgatcgagtccatattataatactttgtcacgtactttgtttactgattaatttaatataattgtgtcgcattatccaagtctaattaaacattaatgtgtatattatacaccaagttacaattacagatctatctcttagtcgttttattatgtatagcctacaatgaaacatgacatcaacgtataggtgaagctgaagcctatacataaaagtaaggttttggagtttgtttcatgttttaaggttttagatattttgtgatcgatttgcatgtatagggttccaaatatctgagctttggcttggtctactttgagaaagcagctgtagagatcaactttagccgtttaggtgataaaatcacattagaactctataggtcgcgtagcagcgtataagagccctggatactgaaatacaagaatctctccacgcgtagaaaaacgaaccaaccatgataaaacacgtgtcatatcgaataggtacagacaacgtgcacttgccaaccttctttccttgtagtttccttcttctttgcttctttttttcgttaaatattgatattgttcaaaaaacgcataacaacaaaaacgtggtcgacggaacatgtgggtggtggagttgtcttctttaggggaccactcactaacgccgtttactttcccgcttggacgataacacccttgatatatggattagtctctcttttgcttttggatatcttaatatatttaatatgtccatttttatattgacgaccatttaattaggtctcagtttgtattattgatttttaggtgccaagcattactttcgttacgtgtaatctttngattattcaatcaaattatcatatggttcatggcattttatcaattgtgacggtcgacatgtgggttgactttgatgtatgacttttagcttgtgcctcatttttattccaactcgacaactagcagactttatattttaatttatttctttctagatattagacaattcttagcttgtctctctgcatgaatcacgcgttaatatacttataatagtaagttttaaaatgtttcgagtataatatcatattagatttcaattataattgtaagattatttagtctcaatgaagagcatttaaaaatgtgaaagagtttaggctttgactgttgactggttctaacgcgttttgcttcttatttatacaaaaagattttattttattttaattagaaatattaagtactttttagacgtgtttaggttgattaatttcttgttaacatatccgataaaaaaaaacagcaccaaaatcacgacgagaattatgcgtacgttacgttgataataaagattagagataaaatgtaacctctcttctctttacatcattacatgcatcttgtgttttatttgactttattcttaccaacaaacaaccaatggataaattaggctcgtgaaggagggcaaactcgtaatttcaaagaaacggaaagcgtgagaacgtggagaacagtgaaccgagacacattcccgatttttctaaagaaacaaaataaaacacgtgttttttataccataagtaaagtagtagtatttattaaactattaatatatagctttgttatattggaggtaggaagaagaactctgcaaccaaaccaaccaaccccaaagccaaacaaagttttatagagaccttccatttctccctctcgtgacaaacgcaatttgcagagaagcaacaacaacaacaagaagaagaagaaaaagatttgagattactttgtatcgatttagctattcgagaaactcttgccgtttgaaagttttaattgttaaagatg

SEQ ID NO: 145 - DNA, 3000 bp, Unknown
  misc_feature (1)..( 3000): cDNA_ID_3600293_gDNA_ID_3265_Annot_ID_146195 3000 nt of promoter + ATG
  misc_feature (427)..(427): n is a, c, g, or t
  misc_feature (2338)..(2338): n is a, c, g, or t
ggatactgaaatacaagaatctctccacgcgtagaaaaacgaaccaaccatgataaaacacgtgtcatatcgaataggtacagacaacgtgcacttgccaaccttctttccttgtagtttccttcttctttgcttctttttttcgttaaatattgatattgttcaaaaaacgcataacaacaaaaacgtggtcgacggaacatgtgggtggtggagttgtcttctttaggggaccactcactaacgccgtttactttcccgcttggacgataacacccttgatatatggattagtctctcttttgcttttggatatcttaatatatttaatatgtccatttttatattgacgaccatttaattaggtctcagtttgtattattgatttttaggtgccaagcattactttcgttacgtgtaatctttngattattcaatcaaattatcatatggttcatggcattttatcaattgtgacggtcgacatgtgggttgactttgatgtatgacttttagcttgtgcctcatttttattccaactcgacaactagcagactttatattttaatttatttctttctagatattagacaattcttagcttgtctctctgcatgaatcacgcgttaatatacttataatagtaagttttaaaatgtttcgagtataatatcatattagatttcaattataattgtaagattatttagtctcaatgaagagcatttaaaaatgtgaaagagtttaggctttgactgttgactggttctaacgcgttttgcttcttatttatacaaaaagattttattttattttaattagaaatattaagtactttttagacgtgtttaggttgattaatttcttgttaacatatccgataaaaaaaaacagcaccaaaatcacgacgagaattatgcgtacgttacgttgataataaagattagagataaaatgtaacctctcttctctttacatcattacatgcatcttgtgttttatttgactttattcttaccaacaaacaaccaatggataaattaggctcgtgaaggagggcaaactcgtaatttcaaagaaacggaaagcgtgagaacgtggagaacagtgaaccgagacacattcccgatttttctaaagaaacaaaataaaacacgtgttttttataccataagtaaagtagtagtatttattaaactattaatatatagctttgttatattggaggtaggaagaagaactctgcaaccaaaccaaccaaccccaaagccaaacaaagttttatagagaccttccatttctccctctcgtgacaaacgcaatttgcagagaagcaacaacaacaacaagaagaagaagaaaaagatttgagattactttgtatcgatttagctattcgagaaactcttgccgtttgaaagttttaattgttaaagatgtcgagttctatggaatgttctgagttcgtcggtagccggagatttactgggaagaagcctagcttctcacagacgtgtagtcgattgagtcagtatctaaaagagaacggtagctttggagatctgagcttaggaatggcatgcaagcctgatgtcaatggtaagaaaccttctctttctcctagatccacttcttttttcgttttctctgttttttatttcttgaatcttgatcttgaaaacttttcaagaaaattttgaatcgatttcaaagaaattagggagagttagtttgctaaattttgacatagaaaatgattggagagagttctaacttttggatcatatatatttgcaggaactttaggcaactcacgtcagccgacaacaaccatgagtttattcccttgtgaagcttctaacatggattccatggttcaagatgttaaaccgacgaatctgtttcctaggcaaccaagcttttcttcctcatcttcctctcttccaaaggaagatgttttgaaaatgacacagactaccagatctgtgaaaccagagtctcaaactgcaccattgactatattctacgccgggcaagtgattgtattcaatgacttttctgctgagaaagccaaagaagtgatcaacttggcgagcaaaggcaccgctaatagcttagccaagaatcaaaccgatatcagaagcaacatcgctactatcgcaaaccaagttcctcatccaagaaaaaccacaacacaagagccaatccaatcctccccaacaccattgacagaacttcctattgctagaagagcttcacttcaccggttcttggagaagagaaaggacagagttacgtcaaaggcaccataccaattatgcgatccagccaaagcgtnttcaaaccctcaaaccacaggcaacatgtcgtggctcggtttagcagctgaaatatgaatgctaaccaccctcaagccgtaccaagaaattcttttgacgacgttgcttcaagacaagatataaaagctcctatcttcatgctttttgatttaagatacaaactactcaatgattaggaaacttcatatatttgtatgtattgattagtgatcaattattgttagtattcgttatagtctgtttttctactagttattgtcgcctgtctaaatccccttgctatgggttatctcaaaattagtttcgtatgtaactaattttgtaagaacaataatttttgttgacgaaccatactatcaaatactctaaattatatcttgataaatctacctatcaggtaagtaggtgtgttttgttttcatttgtttacttgttacctactaatctcatattttatgattcaaattcaaacccgtgaattatgagttagtaggtaggtttaacaacatgtcaacaactaaagaacaacgtgacatctaaaccaaaccaaaactatagagagttcagagtagtcgtagtctcgtagagatcattcatataaataaatcgcataaacaccaaaatcaactcttaattctttcctaatcatcattaatctcta

SEQ ID NO: 146 - DNA, 3 bp, Unknown
  misc_feature (1)..( 3): cDNA_ID_3440483_gDNA_ID_3274_Annot_ID_146204 3000 nt of promoter + ATG
tat

SEQ ID NO: 147 - DNA, 2667 bp, Unknown
  misc_feature (1)..( 2667): cDNA_ID_1687540_gDNA_ID_3290_Annot_ID_146216 3000 nt of promoter + ATG
  misc_feature (301)..(301): n is a, c, g, or t
tggatgaggtgtcatttaattctctgcgataaagttactctcttttggatacatataattagatttacgtgcattgtaattgggttattctgttggttggaaatcttctctttgttttcttattttatacttgatttcttgcctagagaaattggaactcaaatatagtaagcaaaggtctgtccggaagtagaaattgatttcttttgttatttctacattttttatgtagattctggatgtggctgtttccttagccaaagttgcggatatagacaggactctacaaaatgaagttgcngcgacagatgggttcaaggaaggcatgagactgctggaatctttgaaactggactctgaagattctgctctcgagcaacgggtaagattcttgcacgactccctttttatttgtatcttatccaaagctgctgaatgtcagtaaaactttatctgacaaatgtaattttaacatgcatgcagcggctctctgtactggagttccttaagaagcaagtagaaaccgatgctgaaactgcactctaaaccgatgcaggcttaagtacgtatatagaaattatacctaagttctcgtctgtggcattttgctgaataaagaaagcaaaaatcaaaaatgttgtatttgcgctcaagggacaaagaaacagagttgtctgtatgttgtgaattgtgatggttttcaactttcaatgcactaatcttgcaatgttaaattgttaagcatgattgtactctatgcacttgtgaaatttaaaaattaagatatcttaagcggctacagctgtgaactgctttctatttcttttcagtgcaaaatgagaaagaacccaacagagattgagagatgatatggaaggaaaatgcaagtatttgcaaactcaatcagctacaaagagtataaattgcgacaacaaaaatttgtctttgttgttttgttgcatgaagtttttcttgtaactactcttacaaaaataaaaacataaacatagtcaatccctaaagccgatgatactatgcaaacgacaaagatatactaactccaacgcacgaatcaacaaaattaggtcacttttacgaaaataaatctacataatcaacaaaattaggtcaacttcgttctatttgtaaagcttttttcagtatttttttctttaatatgttcacgtcttttaactgttcatataattacgtaactaaatctttaacttcgtatgtaaaactatgtttttacgtattagatatagagaaattgttaagaatgtttttccaaaaatatttttttttagtactatcctcccatgtaatcatttttattgatattatcttttaattattaatgactattttgcttctatttgaaaatacttaaatcaacaaaatgagaaaatgattttttccgccaaaaaatgtacttcacatcaactgctatgaaacaatgtactgattttatcaattcacaaaaattcttacctctaatcaatcgtgattcaagcaatcatgcaaaatcttgagtaaccaagcctaaaaaacctaaaaacctaatcaattcttgagagatacggaaattaaagtcaaagattactatcaactctcgcctcttatccatcttaattagttcttcaaagatttcacacgagtaacctaaaatccattgaaattaagtcaactatatacctctcttcgcggtttatagttgaaatctggaggcatcgccaagtagccgccagcttcgccgattttacgttgaagatcagcgttttcttccaatatgaaatttctggcgtaaagcgataagtgcacttttccggcatagattgagttgaactgaacaagaataatacgacgacagatcagatttttatggataaagaaaccattatcgagaatttgagaaaaagatgaaagtcgagaaatgattattgattatctaaggatttataaaaatatataaaaaatatttaaagttcaaattttattaatcctactaatattagtttagaagtacatttaaaaaatatgaactaatatctatcatctaaaagagtataaattacaacaacaaacgaaatgtgttgaaagaggctgtttttccgggaaataagcatttgaagtttagtttcagaaaaaggagttaaaagaagagcaaagtaaaaaaatcacatatatccaaaacggtgtcgttccattctcaaacgtgctttatcttcttctttacacactctcgcctccggacgacggagacagtcagatataaattagggtttcagattttttagattttatctcttcaattcgagccagtgaattgccgcctcctcctcctcctcttcttccctcaagttagttactttcgtcttgagttttctaaattctctatctataaattgtgatatcaacttgtgagaatttcgaaaaaattgtatgtgcgtcttctttggagcttgagaatttaacgagagtattgattttttacctacagtacataaccaaagcaatgaaattctacttgtatcctgtaatggctgactaaatcaactgcgaatcgtggttcgtcactttcttaattaactatttttttttcgatctttgtctaatttcaataatttatccaaatcctgatacttgttgttccagttttgtgacatg

SEQ ID NO: 148 - DNA, 3 bp, Unknown
  misc_feature (1)..( 3): cDNA_ID_1687628_gDNA_ID_3315_Annot_ID_146231 3000 nt of promoter + ATG
aaa

SEQ ID NO: 149 - DNA, 1687 bp, Unknown
  misc_feature (1)..( 1687): cDNA_ID_1687639_gDNA_ID_3320_Annot_ID_146239 3000 nt of promoter + ATG
  misc_feature (466)..(466): n is a, c, g, or t
aattagatatgagtttttaggtaagcgatctctttcttccccatagatctggttaattttccaaaaccgatggtgtaaatccgttggaaaatttggcacaagactaactgcacatcaaaaatgagaagtgaggcccatattttcaatgttagaataaccacttacctctatgcatttgatgacaactttgatatcatccatgatgcatatattcatgaaggatgggtgttagtgagaatgactgtcagatcccttactatttcgggtgttgcctttgccaatacgatctaacggagttttaggtcacaatataataatatatacacacaacatatttactgctcagttcacaagtattctctcttgtttccttacaaattaagtaatagtcatgtttcatgtggttcatacaactacaacgaatgagatttgcatagtctaataattatcgtagctgttacagaangaaattctgttacagagagaatcgaaggagaaagagtcgagagaaagtttgttatcttcattaataaatgtagactcaattacagacattataaagactccggttcataccagtttacagactcaattatggttaacacttaaccatatactctaatagtagctttgtttcttatatttttagagttcaaaattgaacaatagtttaactcaagctacatagaaaacaatttcagtacaataaaatgagcatatgaagttgtggtacaaatataattaatagaggtttttcatatgcatttgcatatatctaaaggttgaatatgacgatgtggagaactttttaatggtgaaattgtttatagaacttctagaagatgaactaaacgaaatcatattcttggtgagtgcttctaaccttatgagaaaatcttttaaatcttgtcttctaatgatatgcaaacttgttatgttatctttgttgagaaaatgaatcaagccttgtaaattcattatcacttagtgattatacaaagtggagttgaaatttcatggctattgagatacttagttcccatatataaaaattttggggaaaacatatgttttcttccaaagattaaatgctttaagatatgactatattgtcaaagtttttaaaaaactaaattcagaccacacgttcatagacgtatttgtttggtataacattcattaatccgaaccaggggcggagacaatgctttattaggagggtcaactgaccctataatttttttaaactcctatgttattagtaataattgaaatgaccccaacctaaaacaatttttgaccccaatacgaaaattaatgttagaacatgaaacaaaaaaaagttcaaatacttgaaatttagtttcctagcatgtattaatctgaaacaaaaggaataataaattattaacatgattaaggtgttcttagttttgcacgtgggggttgtcaaagttgaccaaagcgttctgactgtttctttaatgagaaacaaatcaaataacacggcaacgtcagagtaaaactcgtgtcgtttcgattatacaacgatgaacgttgcgctgttttttgtttctcagacacggtgagaaacacaaaaaccatagacgacgaacgattcctcaaacgcagaagtcttctccttctctcgacggattaagcttttacacagaagaggagagatatg

SEQ ID NO: 150 - DNA, 1709 bp, Unknown
  misc_feature (1)..( 1709): cDNA_ID_2686252_gDNA_ID_3324_Annot_ID_146243 3000 nt of promoter + ATG
gctcacgtgtagagtcttattcttgattctcaaagctttgatagtgaagccgaattcttatgagtttttggttttgaacagtttaacaaggaagcaatactttacttttcgggatctggttgaggttctagttttatattcaatcatacacataacatctagtcatatttaactctgaaacgctaacctagattctttttgcttcttaaagtattaaatatatttgctcctaaacactaaacataaaccctacaccctaaatcccaaaccctaaaatctaatccctaaaccctaaaccctaaaccctaacgctaaaccttaaaccctaaaccctaactctaaaccctaaaccgtacaccctaaaccttaaaacctaaaccctaaacgcaaaaccttaaccttaaaccttaaaccctgaatcctactttaacttccaggttcttattgcgtttatagtttttgtactgaatgataaacaaaacatcaagtcaatttgtactacaaaaacacaaacccagcttcttcatgattctcaaagatttgatggtgaacccaaagttcttaacagtttttggttttgaattgtataacaaggaagcactactactacaagaaaacacggattttacgaccacatctggcgagtgtacaagtagtcgtaatatttagcgactattaaatgactatgtagcgacaaatctacgactaaaataaaagggacgttccgtagtcgctaaatgacgactgtttttaatagtcgttcaagtagtcgttagataacgactaagttgcgactataagtaagtcggagaattaagagtcgctaataagtcgttaaaattgtaacaataatcaaagaatttttatagtgttatagttttgtgtatactaagtaaaattagatatgctaaaattagactattagttttgtaattgttaagatataagttagaattataacatatttcagttcaaagctttattttaaaaatgcattctttaaacaattgtacaaagtatatatatatatagtgattgaacattattttgatatgaagggttaatcaccaaaataacctataattttgtataaaacctatgattttgtttaaaaatgcactatctttaattaaaaaattgtacaaagtatatatatcactctaattaataaattaaaaagggatatatattaatggatatatagtgattgaacattgtttttggtatgaagggttaatcacataaataactttgttttggatatagaccaaagttataaaaacctatgattatttaaaaaattaataaacactgcgactgaataacgactaataagcgactacaatcaaaacattgggctgaattaaaacccaagaaaactatcgcgggccaaaattaacgaggcccaaacaaagcccaaacattgtgtcgattagcgagggatgaagaacgagaatgaggaaccctaattcatttctcttctacctctctcactctctctcttgtttcttcgattcaccctgaatcttcatctctctctttcgtttcttcaatccttcctctaaatcttcatcaattgttctccttctgctatctttttcttcgaatctctcggatctctctcactttcagaagaagtgtctcctctagggtttgcaaacaaggtcgattcgatgcctctagctaagcgaggaaggaagagaaaaatg

SEQ ID NO: 151 - DNA, 34 bp, Unknown
  misc_feature (1)..( 34): cDNA_ID_3014874_gDNA_ID_3328_Annot_ID_146249 3000 nt of promoter + ATG
tactctgtattagtaggtcacagaacaggacatg

SEQ ID NO: 152 - DNA, 559 bp, Unknown
  misc_feature (1)..( 559): cDNA_ID_3014282_gDNA_ID_3334_Annot_ID_146253 3000 nt of promoter + ATG
  misc_feature (10)..(10): n is a, c, g, or t
  misc_feature (47)..(47): n is a, c, g, or t
  misc_feature (75)..(75): n is a, c, g, or t
  misc_feature (168)..(168): n is a, c, g, or t
  misc_feature (183)..(183): n is a, c, g, or t
tagtcactanctattttactaaaatcacaatttctacttttagctancatactattcataatcgtaacaactaanacacttacatgaccaaaaatagatttttgtaccatttaatcttaactattaatttgtaaacgatctcactactattgtaacgtttagtccgtncttactagtgtgctncacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatg

SEQ ID NO: 153 - DNA, 36 bp, Unknown
  misc_feature (1)..( 36): cDNA_ID_1687697_gDNA_ID_3347_Annot_ID_146256 3000 nt of promoter + ATG
taaaaatctctgaaccgctgagaaacgacaaagatg

SEQ ID NO: 154 - DNA, 552 bp, Unknown
  misc_feature (1)..( 552): cDNA_ID_1687739_gDNA_ID_3397_Annot_ID_146273 3000 nt of promoter + ATG
caataagggcatactttggaggaaaaagacaaaatattactaagtaaaacttagaagatcttacattcgaagggaaaggaataacaaatcgtttataagtctaaaggcaccctctcccccacaagctagctttttggggtgagttctacctctggacttagtgtttgttaggtccaaacctaacaggcacacacaagaacattattactcactagtttataagaagaacaagaagaactagggggattggtttcgttcaaatttatatcacctagcttcttagggccttaccttacacattagccatcaaacaaacaatcttttgagatacgtttgagatgtttcttctcttttctcttctttcctcttattttacgtggtactctgtcatctcagttgatgataagctcatggtgctagctttgcttagctatttttaacttcacttcttggtgcaatattttaatatacactgttccttcatttctcctttgctcgtcccaagtattgatatctatatatgctgttttatactttatgttaggtataatg

SEQ ID NO: 155 - DNA, 185 bp, Unknown
  misc_feature (1)..( 185): cDNA_ID_1836205_gDNA_ID_3404_Annot_ID_146278 3000 nt of promoter + ATG
ctcaacccagccctgagtatctgttgttagtaagaaattgccgtctggaatgttttggaaagtccccaaaggatcgcatggcacgtcgaagattttcgaaagtgatagatatctctgtggatcccatcttcatggattcattccccagactgaaacagtggtaccggcagcatcaggaatgtatg

SEQ ID NO: 156 - DNA, 159 bp, Unknown
  misc_feature (1)..( 159): cDNA_ID_22476_gDNA_ID_3406_Annot_ID_146280 3000 nt of promoter + ATG
aaaaaaaaaaatgaccactgattaatatccgcagcagacaaaggcactcatagagttgaaatataacttttgtggcttataaaatgcatacatccacattcatgtcggtatttacaatttcatatcaatagttacgtataaacatataatcagaaaatg

SEQ ID NO: 157 - DNA, 1991 bp, Unknown
  misc_feature (1)..( 1991): cDNA_ID_3014266_gDNA_ID_3413_Annot_ID_146281 3000 nt of promoter + ATG
  misc_feature (523)..(523): n is a, c, g, or t
  misc_feature (1597)..(1597): n is a, c, g, or t
cacaagtgaaattatcaccgcttcacattgataaaagactaacctggatttcagtctaaaaatatcatctaagaaaaccatatagaattaaataaaatattgaaaaagtcatacttattttttaatcatgcatgcaattgggaatattatatggtctccgttagcttccttgtaagaaagagtctcacagagagaatatgaatagagatgcaagaaaaggaaaaatcaaggaaactacatctcatctcaagtaaaccaaaatgtaatttttatgacaatataataatagataagttaacgtcaactccagcatctcaactctcaagctgagtccgtgtaaaattgaaccgatcgtccactatgactcacggaatctacaactagagatcattaaaacaaatgggtaaaacacattagattatcggactcgtctcaccatgttgattcttcgaaataacaacacaagtactccattctttcacataaacataataatgttagtatttatttagttgtatactgngttgtgtctttatgaattgttttatctttgtttggtgtatcaaaagtgacgtgtgtaagtaaacctttaaggggctaaatgaagaaaaaaaagcctaaagcgttagatcatgtggatcctaccagtgcgatctccgtgatggctcgcgcctcccagcctcacaccacgtacgagtgcaaattgtgcaaaatcaattatacgctttttataagaaaacataaaaggggtctctttttgttaattaataattatatatggtgacttgtaaactgaataatggtgatactactagtaagcaccgataagaaatacgaacatctttaataatgtggtcatttccaaataaaatgattcgaatatgccacccttgcatttgttgatctcatcatcactattgattttctgatcttctcgatctacgttgattttgtacatatgaataataccatgaatgaatacctaaaagttgattatgtgtctgatttcaagcatacgaaatattagtgttgttagtttatccagaataaataaataaatatatatgccttgcatggcaatctttggtaaaaaacccaacatatataacaaagaaaataagcaatattattcttctaagaacatttcatttataaatatgcatggaaaagggaaataatgtataaaaatgtggtcatatgtatttccaatgggtcatggacctcatggtgaccatatataatgtagatgaataattgtgaggtgaagaagaataatgatggtgactttgtaatcttctcctcccacttaaattattgagcgacaacgtggctttttgttggcccatattcattcgtatctcccatctctccactccttatccaccacgtgtccccacctgcaagaccaactgtgtatatctttgtcacatccaagtcgttacaatgacagtgtttcacattcataaaggttaattatcatctacagtttatgacagttctatgattatatctgttataacatcatatcatcatatacatgcagtcccctgtgactatagatgactataacataattttctctgaacaattgtactgntcatttaattgtttctgattttttccctaacatgttaacttctactattaaataaaactttaaaataaaatttgagtttaaaattaagttttgttaaaagattagtatttggtgcctttgatggatcacattaccaattttagtcatctacttaatttcaagatacatatttactttttgacaattataccctaattgtcggggctcactaattttaaaacgacattagtcacgcgagaagatgccaacccatcacatcatcatcatcatacatcgcggcttttataagtaaacaaatcgactcttatgtatttctcccgacacaacacaaagttcatataataagaaaaacagagagaaacacacagagagctagaggagagtgagtgtcatg

SEQ ID NO: 158 - DNA, 1015 bp, Unknown
  misc_feature (1)..( 1015): cDNA_ID_3014269_gDNA_ID_3416_Annot_ID_146286 3000 nt of promoter + ATG
atatttgttaatatgttaatttgggaagagtttgttctttgcagctactgaaagctagtttccaggttagtagatgtcttatctccattgaagaagatgacttctttaacctgtcttgatatcttcgctaacggcgttatttcatggtgaggaatgcattgcaaataggattcattagtcacaaaataaaacttttatctcaatgcaagttgtctaatttacttgcaaaatcctgctgtttaccgttgaatggaagctcctaaccatctgtttcgacttgcatgtgcttacttgatcttcacatctgccatttctacagtctgcacgagatatttgtgaggacatcacacatttgcgaattctcatggttctggctaactttcccctctacagatgcagattaatctccctgaacacatactgttactctcaataccctgacttgagatcgttcattctattccaaggttttgtaacaatccatttcttgtacagatagtaattatttcttactcagtaaagctttttgtaacaagaggcacattacaatctttaggtaaatgaaaaaagcagaattctcttatttctccagactcaaatgagccttaatctactgtttcacttactgatcaggttctttatacacgatggttccactaatatccatatcatcatgctaccaaacatttgatatcagaatgtgattagagatttaacagaggatgatgttgttgagtcagaaatatgaggtgcattgtttttttcagtctgacacaacatgtgaaggaagaagtccttaccactcctttaagtcctctgtagtctagctttattcccacctttttttggttatctgtgcatgtgaccattattggtcgtatcccttgacccattccctcacacgcacatacacaaacgcacgtgtatacatgtttttgtgtcactgtgtctgtgtatatattactcagctctggagtatgatgcttctgtagttcagtttacttgtgtccaaatg

SEQ ID NO: 159 - DNA, 662 bp, Unknown
  misc_feature (1)..( 662): cDNA_ID_1687807_gDNA_ID_3425_Annot_ID_146295 3000 nt of promoter + ATG
  misc_feature (41)..(41): n is a, c, g, or t
ctggtccgtttgatcgagtgctaagagtgaagtactttccnccgtccgatcgagtgaagaaaccaaagagactaccttgcggactccgacggctcgtgacccgcctccattgaaatccatgatgtctctttgtcttcttgtcccctcataatcactttggtccccccccatcgcaattcccgaactcaacaacctcatatctccacctcccataccaaagcattctcaaattcttataactctctctctttccttcacttccccttcttatcaaaaacattgcaaaattcatttgttatctccatcattcgatttcctaacctactgaattttggttttgagtctctcccattcttgttctcaatgacaaacaagtgcacgctcttgtcaaggatccggaacagagctctctcaccatcgaagagatatccaacaccttcttcgcatgcagcagctcgaggactctctgaaccatcatccatgtggtcgagcaggagagaacaagcaagtttcgagatcgatcacaacgaatcaagccaagaggaggaagcgatgcaagaagaagaaactttcaactctcttgccaaaaacactcgatcccgaggaaagaagcccgtgggagaaggttgtaacttgtagatgaagactctgaggaagaaatg

SEQ ID NO: 160 - DNA, 593 bp, Unknown
  misc_feature (1)..( 593): cDNA_ID_3013944_gDNA_ID_3448_Annot_ID_146306 3000 nt of promoter + ATG
gttaatggaaagaataaaagacccaaacatgtggcctatatacccatgggacttatacatgattaagattggcatatacatcaatgtttttcttggtaaaacatatatatcaatgttataccatcaacactaatttatttttaatatttgaaatagaatttttaaaaatatatgatattaatttcttccaagctaagtgaaaaaaatcaaagcagccgtacagttacagaatcaaacaagaacttgacagcgtaagaagacataactcatcatactttcttctttttttcaaacaaaaactacattcacatatttacgtaatttttcatcactattataaattttgtctaggctcataaggattttaataaaagagaaatctgcaaagaagaaaactagtgtattaatttatgtatatgtttgcatttgaatgataagaaaatatctcgcatgactacaaatctttggatatcattatcttactatttatacactaacttctatatatcattttatcgttttatagccaaaatcagaaatattgcaaatcttattttttaatatggtttttaatatttgagaggcgggaaatg

SEQ ID NO: 161 - DNA, 3 bp, Unknown
  misc_feature (1)..( 3): cDNA_ID_1687846_gDNA_ID_3451_Annot_ID_146312 3000 nt of promoter + ATG
atc

SEQ ID NO: 162 - DNA, 85 bp, Unknown
  misc_feature (1)..( 85): cDNA_ID_1687850_gDNA_ID_3452_Annot_ID_146313 3000 nt of promoter + ATG
taactttttaggttgtgttaaataatatttgcttttgtaataaaggaacaaaattaaatagagagatcggagaggatcaaagatg

SEQ ID NO: 163 - DNA, 44 bp, Unknown
  misc_feature (1)..( 44): cDNA_ID_1687889_gDNA_ID_3471_Annot_ID_146325 3000 nt of promoter + ATG
tatcctagccccccccccctccaccctcattagaaaccagaatg

SEQ ID NO: 164 - DNA, 517 bp, Unknown
  misc_feature (1)..( 517): cDNA_ID_1378446_gDNA_ID_3474_Annot_ID_146327 3000 nt of promoter + ATG
  misc_feature (162)..(162): n is a, c, g, or t
agtcaacgaaactggctgctattgactttgttttccaatcagaaatcaaaactttctttaggggtcgttatagaaatagactaaagtaatggattatctgggaaaatatagaaacatgaagggggtacggctgtgaagacacgtgtatataggagaaggaangaaaaaatctgaggacagataaaatgacgatggtgaccataagaagaagaacccagaggatctagggcttcacaatcgattccttctctctatctcgacggatttagcttgcagatgtttcgtctcctctctggattcattaattcatcatcttctcttcttaaattctctatcttttcctgacaaagttagggtttttcgataactcgggatgagaataattggttcaatctaaagagctggctttgataaattattgagatttaaaagggtaattggaccttcctgaatcaattttcctggaaaaagaattgatttttagattgaaaaagaagtgagagtttctgtaactatg

SEQ ID NO: 165 - DNA, 16 bp, Unknown
  misc_feature (1)..( 16): cDNA_ID_3013635_gDNA_ID_3560_Annot_ID_146348 3000 nt of promoter + ATG
aaagctgcaacaaatg

SEQ ID NO: 166 - DNA, 606 bp, Unknown
  misc_feature (1)..( 606): cDNA_ID_3014242_gDNA_ID_3572_Annot_ID_146353 3000 nt of promoter + ATG
tttcttatagtatgtaacaacaacaaagggtttgatgatttaaacataaaaacacaggtgagagatgcaggacacatggttccaatggaccagcctaaagctgcattgaaaatgctgaagcgatggatggagaattcacttatcgaagatgctactgtgactgttgctgctcagggaggagaggaactggttgctcagatgtgatcacatcttcttttgcgttgcatgaaaacaaaaggcagcaaacataaaacaatgtgtgagcaattgacgttttcttctgtaatttgatctcataagtcataagaaagatacagtatatgtaggggttgcccaatttcgttataaaatcaaactctgctgacaccaaaaacataataattactacgaaatgtgttatctatgtttgtttccgaaataacgaaatgtataaaacaaaacttaaaacgttgtttatacaaaataaagccgaggtaggcttgcaagagtaatgaacaggttttgatgcggtttatgtacatgacacatggcaaaacatgattggctacatgaacgattttatctaacaagcaagatagagatgagattaggagacaaggagcaatg

SEQ ID NO: 167 - DNA, 2353 bp, Unknown
  misc_feature (1)..( 2353): cDNA_ID_3014240_gDNA_ID_3572_Annot_ID_146354 3000 nt of promoter + ATG
accgaggagatgggtttgtttaactggcatcttgctaacttggagtatgcaaatgcgggcctagtatcaaagctttctcttgcattctgggatcaagatgacccatatgatatgggtggagatcactgctttctgcctggaggaaatggaaggctggttcaggctttggctgaaaatgtaccaatattatatgagaagaccgtccaaacaatcagatatggttcaaatggtgtcaaggtaactgctggaaatcaagtgtatgagggtgatatggtgctgtgtacagttccccttggtgtccttaagaacggatccatcaaatttgttcccgaattacctcagagaaagcttgattgtataaagagattaggttttgggttactgaataaagttgcaatgctctttccgtatgtattttggagcacagatctcgatacctttgggcatcttactgaggatccgaactatcgaggtgaattctttctgttctatagctacgcaccggttgctggtggtgctctcttgatcgcgttggttgcgggagaagctgctcataagtttgagacaatgccacccactgacgcagtgactcgtgttcttcatattcttaggggtaatagatttcactatctattgattgtcatttaattgaatttcaatttttacctgtcaatatcaatcttcaagaattattagttgaggatttgtattccagatttgttaaagttgatgctagcgtctgacgcaagttccattttaatgaatatcaggtatttatgaacctcaaggaataaatgtccctgatccacttcaaacggtctgcaccagatggggtggggatccattcagtttaggatcttactctaatgttgcagtgggagcttcaggcgatgattacgatatattagcagaaagtgtgggagatggaaggcttttctttgccggagaagccacaacaaggcgataccctgcaaccatgcatggagcttttgttactggtctgcgagaagctgcaaacatggctcaatctgcaaaggcccgaggcataaggaaaagaatcgataggaacccatcaaggaatgctcattcctgtgccattcttcttgcagatttatttagggaccctgatctggaatttgggagtttttgcataatctttagtaggaggaatccagacccaaaatctcctgctattttgagggtaactctaagcgagcctcgtaagagaaacgaggacccaaaagcagatcagcactcaaacaagatactgtttcagcagcttcagtctcatttcaaccagcagcaacagattcaggtgtatacattattaactagacaacaggctcttgacctgagagaagtcagaggtggtgatgaaaagagactatactatctctgtgagacacttggagtgaaactggtggggagaaaaggtcttggtgttggagctgattcagtcattgcttctattaaagccgagcgaactggtcgcaagctaccatcatcatctacctcaggcacaaaatctggttaggctccgtaatttcctgatttgattactccttacttaccggatagaaccagtagcaacatctctaacttcttctatattgagtaggtatattaaaatcaaaatccggtgcattgaagcggaagatgatcaggtttgctacgaaatcatatgtgcaataatttctctcacttatcaaaaacaacattacagagaacctttctgttgcacagaaggattaaaggaccgttgccgctgaagcaaagtaataacaatggcgtctcagagagtataaaatcagagtctttaggtaatggcaaatccttagagcaacaacaacaacctagaatagtagagtcgataggaggaggtagcagcatgcaaggggaaagcaagtctttgagcacaggagttgcatctagttctggtattcatttttcgtaacttctttgttccttttgaaattctgatcatttacatcgataataactcacacgtaggtggttccttacatgttggtggtgagacgatgaaaaagattgaacaatgacttttggagaatccctgtttgatacaacatctgtagttcacaaaatttgtacttcataatccatttttattgtaacaactgacaaatttaagttataaattttttcctaatgataatttgtctggtatgtttccagactttttatttgcaaatgtaaaaagaaaatatttgattttttcttgcttcattacatcgaattttttttgtttgttctttaccaatataaatacaaataccctttgaaagctcagctttcaaaactggaacacaaaaattgaaattaagtggaaatg

SEQ ID NO: 168 - DNA, 337 bp, Unknown
  misc_feature (1)..( 337): cDNA_ID_1686449_gDNA_ID_3581_Annot_ID_146362 3000 nt of promoter + ATG
aatcttatttgggacatccagaaattaaacttttgaaacatagaaacaaaacattgtgatgagaagagtaaaagaaaacataaaaagataccaacctacacttaggttccaacccacaaagagaaacatatactttccctctaagctttgaagctttagtttcaccaaactgacgaagcacaagaacccaacatttgcatctttataaggcaatgatcatgaatcattttcgaatcacaaaaccaagagagaaagttgagaaatcatcagtagaagatcaaaagaggaaaagtcatagtatacatttaaagacacatcaaaagcttcaagggaaatg

SEQ ID NO: 169 - DNA, 640 bp, Unknown
  misc_feature (1)..( 640): cDNA_ID_1686532_gDNA_ID_3616_Annot_ID_146397 3000 nt of promoter + ATG
ttagtggttggatttgaatcttttaatggttatgacttcaactaaaaaaacactgtcgagagatgttgtttcttgtcttggtcagtgaaaattttctctggtcttagggtcttctctcagtcaccatcctctctttctatctctctctctctttactctctaatctttatccattctctctcttcttctctatgccaacgaagcaatagctatgaaaagctaaaccctttccttcttcttcttcttcttcttcttcttcttcttcttcttcttcttcgattgtttagattacttgggtttgacccaagtttgcttctttctatgattcatcaatctagatcttgctatctgggtccagaaacgattcacgcgcttcattcatgatataaagttactaccttttttttattttaccttctgggtcatggttttgtctgcttttcgtcttttgcttttgtctggatgattcataatctctcgagatctattatgttcacaagagttgttcttatgcgtggtgagatgatcttaggagtgtttcactatctttcttcaattcgggtttttagtttctgagatctgtttttgaagaatctgatctgagtttgaggaagtttgactaaatagatcgaagaagatg

SEQ ID NO: 170 - DNA, 1798 bp, Unknown
  misc_feature (1)..( 1798): cDNA_ID_23543_gDNA_ID_23471_Annot_ID_146398 3000 nt of promoter + ATG
atcctgagacctttttcatatcctgtgtcgaggaacctcatgggcttccatataaatggagggatcatgaatctaaacagtgtagactctgttgcttcttcaaaagctttagcaaatggaacttggggaagatcaacagctagagtttccgggtcagcacctagacccgcaaggcagatgatgtcaaacgtcaagcgcaggaacacgtcttggagatcgaaagcttcttgtgactttgcgaaactctccatcaccttcaacagcttcttccttaccaaatgttgtgttgtctgaaaggaatgctctacaaacccggttgaatgcatttcggttatgatgatccgtcgttgctccttccaagaatcatcatcagcattaaagataccttcctcgagcagatcattgaaccggcttttaaagaaggtaccttttgggaagttcttgaagttagtcttgagcatgtactcgacatttgcaggaacacaagtcacagctccataagacccatcaagccaaactccccgataaagaaaggtacctcgacattttttcaaactccttgtgacccatccatagacatcatttatatgaaagaaaaactctaaagtaattccgaaaactggccatagcattggtccacgcttgttggttaacttctcacgcaaacagcagaaaacaaagagccccaacaaggaaagaagtagatcgaagagagaaagatgattataaagtcgctctgttaaagacattgtagtctcttctcagtaaactctctgcagttttgtttgtggtgatgtcattgtttcaagagtatttgaagaaagatttgcgatgcatttcatattttggttttggaattacatttgttgtcttcgtgtagaattggtctatatgaagaagatgagggtttcttgttggcgacgaaacgtaattaggctattacaaattgtgtgtttattgagaaaaacccgtgaaagaaaaattccagaaaaaatgcaaatttgcctgtcatgtcttatgtgaatctatctgacataagctgatgacaaactgaaactcttagaatcaattaacaaacaaaagaaagagcaatcgttgttactagcaagtagattacaaggaataaatctgaaaaaatattatagagttttgactttagggggaagaggtccaaaacacagaggacgagatattttagttttagatatgttcagcctagttaagtattaatcaaagaatcctaatctatgatgcttcaatggcgatcccactgattcacactttcacagtctaaagactcgagaacaatcgaaagactcaagtaacaaacatcaagattgtaaaaaaactatcttgtagtgagtagtggtgacaaattcatgatttttgaggtttgatacgttatataatataaccaaaacttgtagcactctgcaaacacaattattattgatttacataaccccctttgtttcaagagtctttcactactgtgagtctctacttctctcctacatgaagcctaaaaacaaagctgttaataaattcgctgttgcattgagacagtaagtatgcaccaagtaaataaactcttcagtattcaacaatcaacacccatctttaagaaaaacataaattacttggtcttaataaccggacagaaccaaagactaatcaaatcctgaaccggtctggttcaatagatctaaacctaaagtataaatcaaacgtctcaattgttttttcctagggtttcaatctctctcccaaaaaccaaaacgcaaaacctccgataatg

SEQ ID NO: 171 - DNA, 2207 bp, Unknown
  misc_feature (1)..( 2207): cDNA_ID_1689063_gDNA_ID_23509_Annot_ID_146409 3000 nt of promoter
cccatgtcattgagcatatttaggaatatgagaagccatatcaaggcaaaagagattttcatctttcgttgatatggtgctagacaagaatgtttgtttatgcactagaattcggtggatgatgaaaagtttaaagtttttctaagctacaagagttgcgcatcaaaagagttaccatcgttagaaagcaagtgtcgataatttaaagacgataagctagaagttttaatgaaaggtcgtctgcttgtatcccgtaaatgcggtggtggtgttcgctaaagttacaagtaagtggtgtatatggaaataaatcaccgccaaaattttgaggacgaatttcatttaagtgggagagattgtaacaccccactcccacatagttgggccaatttgtcttgacattatgatataggctcaataaagcccaatagcttcctaaacaacaaaaagggttttgtgatttctcaatgaacgcgtctttatgtatatgcacatgtatagccgcctacataaaactgcaaaagagtgagagagaaggtgagaaaaatctcgtgagtatcaacctctagctaccgccgtcgtctccgttagggtatcgatctacaatctatgttgtgtttctctccggcaccatgttacgttgatttggagatgaagagcaagtagaaatatcagatcagagagagtaggtggatatgatcgtgagccatggaggaaaaaagaagaagaaagagaaagacgagaagagaaggggtattacggagatgaaggtggagaggtgacgtaagagagatcatcaccaccacgaaggagaagcagtgggaagtgatttctggttcttaaccttgaggagaagtattgagtgaagtagactgatccagatcgaagctaggcaaagcaaagaaagaagaagaaggaaaataagaaggaagaagaatagtttcaagatggggtttttgggagactcattcccgttgaatcagagagaatcaagtgacgtgtaaggtttctttggaaatataatgatgtcaagaatccatagccgccgacatagatagaatcgagattatattcaagaagttatgagtgtttttttctgggcaagtaactgtaaagtctgtcaaatccaggaaatcctaaatgacagtttaagatggcttgttgacgacaacgtttggagcttgtaatgaagtccgctcgggatgaaatttcgtggagttaatcaggatacttatatctaaatattcaacggttggatcatgtttctaacggttagttcctgactttgtagtatgtttacaagacaattttatttgaagtaaatggtgatgactttatgttgttggttgggaaacgagttcggcttgagctgaagctttgcaggagctttcatgactcatgaattcaggtcctggttgaaggagaactaagttagagcttatgaggatatggttccagtaaagatcgtctaataagtgaaaagaaaggagtcttcatcttcactaggctaaggtgagggttgtatttgcgaagcatggtatcattttctttttttatacttcttgacgcatgatatgtaggcttagatctgattgtataggataagattacatgatgatatgactttatgaatgttgagtatgatgtttgataatgtgatgttatgtatgatattataagtatgtgtatgttaagtatgattatgattatgagtatgtatgtatgatgaatgtaagactggggagaatcgagctattggtcgcggtctccctatttatgtggacagtgatggacctacgggttaatagctggtcaagaacagctgacgagcccggaatgggagtgtatgagccacgagggacaacctccactcattaggttctagttatcacgaggatgactggacctaacgatacacatttatatgctattatggataagatgcttgttatgaatgtgctattagaaattaaagcatgttaggttgattgtttgtgtctaagtttatatgttatgatgatgattgtataactttagaaagtgttctatgtttcattgggcagatttgattcccctcactaagtattctttactcacccttttttccctttttcctcaggttagtaagcgtgaggagttatgtgcaatattttgttcgtgtgtgaagtttaaagaaaacattttggcaagatcagatgaataacatg

SEQ ID NO: 172 - DNA, 520 bp, Unknown
  misc_feature (1)..( 520): cDNA_ID_3013051_gDNA_ID_23898_Annot_ID_146422 3000 nt of promoter
catttagctacttttttgtttgaaatagaaaagacattcaaaatagtaaacatataaaaccattgtaagaaaagaaatcaaattttttatttcttaacaaaaacgtgaaacgtttgtttccaaattagtcgcaagtcacggaccgtgtgacgcaaaaaaagtccattcacatcattattacataatttttgtcataaggaaaattaatttgatttttccaaatttttttggttcttcctcttcagaatatctgacgtggcataaatatcgcctttttcacatcgcctgtcttctcttctctctccattttgggaactttcatccataaacttctatttttctcatcgcaaacttgaaccgtcgtaaccctaaatcgccatcttcatcatcggcaaatcgaatctccgattatatatcaaatagcttaccaaatccgacatgacccaggccctcgttttcggaggactataatgatcggactcttcgtgtcccgtctcgattgcatggggtttgagctatg

SEQ ID NO: 173 - DNA, 937 bp, Unknown
  misc_feature (1)..( 937): cDNA_ID_1025443_gDNA_ID_24186_Annot_ID_146430 3000 nt of promoter
  misc_feature (747)..(747): n is a, c, g, or t
gtctctaagcttagtacattgttaatcgaagctaacaatagacaaaattagttttaaattgttgggatttttccccaaattcgtgacctaaagaaactcaaattaaacaacaatcctacggcgaaaactatggaactgacctgtaaaggaggtcgaaggacacggcggcacgagcgtggccaatgtggctataatcgtaagcggtgataccgcatacatagattccgattttgccgggattcatcggcttataaacttccttcagttgagtcattgtgttgtacaatgtcaaatccggtttctccacctccatctccgacatctctccgtcgcttggaagaatttctcaaaaactctgatgatttttcacttctcccgggtaaagctttcacgagctcaatttttaccggcggcasgtcgaattttgtttaggaaaattgaaattgcttaaatagccctagatttttctaagatttccatttttctatataggaaaattatatatgattttctgacccccaaaaaaatatatttgacaaataaaggaaattgctaaataaccttgattttagaaagatttccatttttctatttaggaaataatctatgattttttgtctaccaaaaaatacaaatttatatggctgcgaatattattgactttagttgatctctgagatgtacaaagaaaatctcgtattagcaaatacacactagtaattaagtaacaaaattggacacctcatntatcatcagatcactaaactcccacgtaaacacattaatagtcacagactcacagcaatattcttcatttgtggcccccgttacatttcaatccccaccacacaaccacatgtatgttttgccaaatttataaaaatgtagcacaatttggaatctctttacttggaatttgagtgaaaaccataagatg

SEQ ID NO: 174 - DNA, 2568 bp, Unknown
  misc_feature (1)..( 2568): cDNA_ID_1683704_gDNA_ID_24396_Annot_ID_146434 3000 nt of promoter
ggaatatgtttaatagcttataaagtttagtgtatttttgttttcaaggatatgaagtttaacgttagcacttagctagcctgtattgtttacattaaataaacttcttgaagaaattaaacttagaaacatatctagtaccataatttaagattgtgaacatgcttattagttatctgtatttgacaaaagcttaccacgagtcttatttaacgatagtgatgattcatttattcgcaatagatatatccatatatataaatagaggtttgtgtactcagttacactcacaatttatggttttataataatcacacaaatcaccacaaaacaacttagtacacatatatgccaaccttctagatcgcatctgtgaccccttcttgaagcatggtagatatagaagacatcaagattcgatcaactatatatcttcctgtatctagtcatgtcctaagctagaagacgacgctccaacaatcccatccttacaatcatccatctgcaaaggttgagatattgggataatattaccaaaaggatcaccaacatcgttgatgagcgaattaagaaacgatgagaacttgtcgtcgtagcagaaaccaaagtcttcgtagccgtgttcaccaccaaagacattgatactgttcttgctatctccatccccgccattaacagtggtatcatcagtatgagaactagaaataggctctagagggtacttttgtccaccggaaacttcttcttctggtttatggatgttgtttgcatcaagaggcttgtgggtttgaggatcaattccttgccttaaaagtttcttacgaagatgagtgttccaatagttcttaatttcattatcagtccttcccggtatccttcccgcgatcaatgaccacctgcatcacacattagaatttccatgaagaacaagagcggttaattactaatatggttacaaaacaagcttgcatttttatcctagtaatcataaacaatttgaaaaaagaatgaatgatctctagaactattaatttgctctagaaccagaatcaacttaattaaaattatactctaaagaaactagagaagggattaaccttttgttctatataaatatcgaatcaagaatcaaagtataattgttttatatagctataagaaaaaatgggatcaagctaaaatcagaaccttcatgtttatgtggaagaaataaaaccctagctagcttaaacaaaaaaataactctagtgtatgggtagagagagacacacacatacgtatgcatataaactaaacgatcttgtatagttgaatacttgacgagatttttttttaatatctatatatatacctgttgccgaggaggcggtgaagacggaggatgagatcttcctcgtccgacgtaattcctccacgtttaaccgagggtcggagatagttcatccaccgtagacgacagctctttccacatctgagtaaaccagctctcttaggaagcgatcgccaccgtccttcaccttctttcttaatgaagctcacaagaatctcgtcttcctccaccgtccatggtcctctcttcatccccatcttcgtgcaacacggcgttgttttcttagacactggcttcttcccaccacatgacatcatctccgccgtcttcaacaaagctttctctctttccactagggtttcgtgatctctatgagttcttcgattggttgtttttttcttttctcaaagtttctctctctccattagtctgctgatgttaccaatgaacctaccgaccttttctctcacgcgctagcttcggcgtttggtaataatcttcatttggtttttatttcacctgcgtggtttttttttcctttcattttaaagattttgcagtaacaatcatattgaaatccaaatggctaatgttattacaatgcataggttagttgcttctagttatttatattaaagatttgatactactatgaattataatttgattggctataaacatccgattataccagctcctacaattgagaaagttataacaaaatggttgataatacattaatgaatactaaccaccttaattaaaattgacaccagtgaaaaagcattaaatatttggaccaccttttaaatagatgattaatcagtaattggacaaaatgctagtatttttacaaatcgggaaataaaggggtgaaatcgtaaataaataaaaagtatgggccacataataaagaagaatacaggcgcatgagaaattaacataattacctctcctttattacagttagtcaatttctaacccaaaacttttgttttgttctttcctttttcttaattttgattttattaaaatttggtcatgtattttcactactgtaatagagctggcatctctgatctttcaactccaccaatctcgaaatcttttctttcaattttctcaaaaaattaaaaccctaattcttattggattctgtttccttgaggagcaattgtgttctgttcgctgcattttttttgttctgctgacggaggaagaagaaacgagaagagatg

SEQ ID NO: 175 - DNA, 3000 bp, Unknown
  misc_feature (1)..( 3000): cDNA_ID_30436_gDNA_ID_24396_Annot_ID_146435 3000 nt of promoter + ATG
ttaagatgggatatataatacattttgtaatattcttccaaaaaataaagttaaatacataggttctcacttgatggtgccactatgccgaagtgatgactgcaaagctcgtctagagtttcgtatccaagggtgagagagcastgtctttgcatcaggcctctgcctggaatcctgtaaaacacaagatacaaatcagatgtacatactggatattaaataaatcattgtctaggttctggtacagaggtaggtgaataaaccctatagcagaaaattataccttcttgaagcactgtcgtagaaagtccgtaatatctggagaaagactatcaggaataggagggttgtcatcctgaaacgaaaccataagaaatagtttgtcacttctggctaacagcttttgcatttttcaggagagaagtgtttacgacatggagaaggggacggaagagacacctaaatttgattgacttaaatgcaaactcataaaatgttgtcaaatacctgaacaatacgaaagagggctggcatgggttgcagatcatagtaaggaggtacacatgtcagaagttcgataacagtgcatccaacgctccaaatgtcagaagcagcacaaactcctgacatttcaataacctgaaacagaagttgggcttctgtcaatacgtacataatcaggtaaaagttctctaaaggagcaaacaaaagcatctttcaaacaacaacaaatattttttcaaaactgcgtacgaaagctatacagaatatggagatggaaaatatataatcaaaggtgtacctcaggagccatccagtaaggagttccaaccaccgagtgagtattaacatcagcctcgttaagtttagtggcaactccaaagtcagcaagcttcacaagaccctgaagtgtgatgtagtcaagtatctttctaaggaaaaagcctagaagaatcttatccagcagatctcaaaacaaaaacacactgaagacatgtctgagaatagataatatagaaaacacacctcctttgtcgtcaaaatatttgcacccttaatatcacggtgtataacaccctgctcatgcagatataccaaaccttccaagacctgtattcactagttagtacacaatgcataacgaaacttaactcaacttgaaagatgtatacagacctgagcaatgtaaacagccaccaaagattctgggaaaggtccaaatttatttggtttaataatgtttgcaagagagccattctcaacgtacctgcaaacacataattgaacttgagtttcccgtccatagtccagagtggaccaaaataaacaaaaaaagctacttactccaaaataatgtgaaggtgagtctttgtcttcgacgacccaagatacttcacaatgtttttatggttcaagttctgcaatgaaatattatctcagaatacatagagaagaactgcatcttaaccagcatcataaccattcatgagaagaagccaaaattcagaaggtgattgatttgacataaacttagtatcaggatcccaactctgtaaacagtacaaaattcagaaaactaccttcaaaagatcaatttcttgctggagaaattcatcccaacagcacaagaatcatccacatgtaaaaaccaggattagtcagcatagcagtggtaaggaacaaataaggaagatagatataaggaaaataacaaaccataatggtgttaagatcctcttgaacaatattttccaaagagacttgtttaatggccacaaagtcaccattctccaagtctaatcctttataaactcgaccataagctcctttaccaatttcatctcccagcatctaccctcaacatatcaaggatcaaccattgaaattaatcaaaattgaagagaaaacagcaaaaagcaccakacttaagcttaaaatcaataaaattactaaagctaaaatcttaaggagacccattagaaaacccaaatcccagaaattacggagaagaagaaagctcacatatttgttgtcgagagtctttgatttgtggaactgagatgacgtcatttgccgcgccatctcttctcgtttcttcttcctccgtcagcagaacaaaaaaaatgcagcgaacagaacacaattgctcctcaaggaaacagaatccaataagaattagggttttaattttttgagaaaattgaaagaaaagatttcgagattggtggagttgaaagatcagagatgccagctctattacagtagtgaaaatacatgaccaaattttaataaaatcaaaattaagaaaaaggaaagaacaaaacaaaagttttgggttagaaattgactaactgtaataaaggagaggtaattatgttaatttctcatgcgcctgtattcttctttattatgtggcccatactttttatttatttacgatttcacccctttatttcccgatttgtaaaaatactagcattttgtccaattactgattaatcatctatttaaaaggtggtccaaatatttaatgctttttcactggtgtcaattttaattaaggtggttagtattcattaatgtattatcaaccattttgttataactttctcaattgtaggagctggtataatcggatgtttatagccaatcaaattataattcatagtagtatcaaatctttaatataaataactagaagcaactaacctatgcattgtaataacattagccatttggatttcaatatgattgttactgcaaaatctttaaaatgaaaggaaaaaaaaaccacgcaggtgaaataaaaaccaaatgaagattattaccaaacgccgaagctagcgcgtgagagaaaaggtcggtaggttcattggtaacatcagcagactaatggagagagagaaactttgagaaaagaaaaaaacaaccaatcgaagaactcatagagatcacgaaaccctagtggaaagagagaaagctttgttgaagacggcggag

SEQ ID NO: 176 - DNA, 270 bp, Unknown
  misc_feature (1)..( 270): cDNA_ID_3013948_gDNA_ID_24413_Annot_ID_146442 3000 nt of promoter
tacaattggcccaatatgagtaagcagatgttagttagctgagagtgtggctttaattagagcatatggtttagtgttaacactgctaatctatgcaaaaatttatcttctccgtccgcaaaaattctttaaagcattggatcgagttttaaaaaggtatccgcgccagagcttaatttaatcattttcatttcttcatcattcatcatcttcctcacagtctcgaaaccctagtttttacccaataacaactttctgggttgagaaatg

SEQ ID NO: 177 - DNA, 82 bp, Unknown
  misc_feature (1)..( 82): cDNA_ID_1683740_gDNA_ID_24421_Annot_ID_146444 3000 nt of promoter
tacttgactttttcattcttcttgatgttaccacctcgcagtcgttttggtaaatttgttgaaatccaatttgacaagaatg

SEQ ID NO: 178 - DNA, 1663 bp, Unknown
  misc_feature (1)..( 1663): cDNA_ID_3013897_gDNA_ID_24677_Annot_ID_146450 3000 nt of promoter
acagtcctgaaggaatagaggaactatgctccaatttggaagtgtcacatactgatatcagaatcttgatgcttgcttggtaattatccatcaacacttttattaatgtttttcttccttctttaccggagtcacatatccttaggaatttttaattgttgcaattgcaggaagatgaaagctgagaaacaaggttactttacacatgtaaggaaaaatttgaagaatccataagagctagtgatccttttttctttgatacttgaattaagtttgtgatttgtgttttgatcttaactcactgtccatctgtaggaggagtggagaagaggcctcaaggctttaagagctgatacgatcaataagttgaagaaagcccttccggagcttgagaaagaggttcaaactcttatcctttatattttcattttgattgacatcttctgagtatcagtttagactgaatcattcttatttctgtctcttgaaggtcaggaggccatcaaattttgcagatttctatgcttatgccttctgttattgtttaacaggtaatattaaaatttctgcttctgcatgaggatatatatattgctgttgtttctcttttctacctttcatgtgtatgtgamctatgttttattgttcaatgcagaggaaaaacagaagagcatagacatagagactatatgtcaactcctagagatcgtcatgggatctacatttcgagcccaagttgactactttgttgagtatttaaaggtttggatcactcaaaagtctcacattgtataatttccagaatgttttcacgcaatgttgtcatctcacattggttatatttgtttggcacagatccaaaacgactacaaagtgataaacatggaccaatggatgggactttaccggttctgtaacgaggtatgtttcctaattcttatagttccccagcttggcagtttcatcaactaactctgattgtttgtaatatttacagataagtttcccggacatggggaactacaatccagagcttgcatggccattgattcttgacaattttgttgagtggattcaagaaaaacaagcctgaaatcatttctgagtcccctcaagtcgaagcttcaaatctctgcaggatgatcagtgggctctctcatcaaaacagattcagcacatttttacttcagttttcatctttcaaacattaaaaaaagacacattatatgattcttgttacatgtgattaacttcaatagagggaacacataatgtttgatttattacatcaagttctgttagtagtaaccaatgatttcgaatttgcttgtaaacacgttgttaccaaatttataaccatcagattcattctgaattggacggtgtagatcagcttacaccattactaaacaatcctaaaactcaaaaacgaattctccatctcttaaaccctaagaaaaggctcatctttgcgactgctcccgtgttcttcgtctctctgtcaatggctcgcctcctcagatgtctgagaaaaagtttcatatttagttcatcgacttcgattgcgtacagaaaccctagaatatgtgttcagtcaaatcaaagctatattttcttaagcagccgcaagtttctcagctcgggaagttacgtttcagaaatg

SEQ ID NO: 179 - DNA, 129 bp, Unknown
  misc_feature (1)..( 129): cDNA_ID_1683806_gDNA_ID_24689_Annot_ID_146454 3000 nt of promoter
  misc_feature (1)..(2): n is a, c, g, or t
nnggttttgaagaaaaggttttagtcgccgtcgttcttcgtttcttccttctccgtcttcgtcttctttctcagttctgttgtcaaattagggttttggtttcaggggaaaaagagagagagagagatg

SEQ ID NO: 180 - DNA, 187 bp, Unknown
  misc_feature (1)..( 187): cDNA_ID_2785779_gDNA_ID_24689_Annot_ID_146455 3000 nt of promoter
caaaaaaaaaaaaggcttcaaagagaataaatcccaaaaaatttcaatctttacgcaaaaggaataaacatttctgtgacggtttcaaggtttcatcggaaccctagatctaatactttttcccgatttgaatttgcgatttcagatctgagagaattagtcaaattctgaaatttcaaaattgatg

SEQ ID NO: 181 - DNA, 642 bp, Unknown
  misc_feature (1)..( 642): cDNA_ID_3013039_gDNA_ID_24708_Annot_ID_146459 3000 nt of promoter
cgaagtaagcatctcgttttgcataattatagtcattattattcatatatgaatggaccaaattgttaaagttgcgagcacttcactcacaagccacgtgcactaagccatcacacttacgctagcgtttaggataaaatcataaaaatgttttaccaaaaatcaaaataatttttaaaaacactttaataaatatcttcgtgtctttggttctgatttgaaaagacaataaagagagagattttgaataacagaagaaatttaatatcgttacctttaattttatattttctgtttccattttaatttgaagatccttccctttctttctttctctctctctctcgctcgccgggaaaaatcgctgtccaaatctccggttatttctccgaggatctcttctatcaatccaacggttttgttttcatcttctcagatctcacagaacaatagtcaaagactgatgcagaagaagcgttagtacaaggtttttgttggaaagcaattgaatctgaattcatctttcattttcacgctttgatccaatttgagttctctcttccactgaatccctcatacgtaaaacctagggtttctaaattagggttctcctgaggtctgtttatagtgcgtaaagccatg

SEQ ID NO: 182 - DNA, 836 bp, Unknown
  misc_feature (1)..( 836): cDNA_ID_2026537_gDNA_ID_24979_Annot_ID_146470 3000 nt of promoter
caaatagtttttttgcagcagataataactcgtccccactggcgagtgacgaccgagactctgtgaccctatttttcgagacgataaaagggcaaacaatcgctcttttcaaagctcgcctcttcaccacagagaaaacttcgtctctcttctctgcttcgccctctcatttcctgtgagataaaggcggagtctctctccagttattttgctcatccatcgattcttaggtatgactcgtttctctcagatctgtgattctttataatctcgtcgttcttcaaatcattgttatattcgtttcttcgatctgtgttttttagatctgtaaggtaaatgagacgtttcgatctgtagatctgattgttatattgatagattatgttatctgctttgcttaaagtccgatcggaatgttttgtgctcattgtcgaatatctgatgtatcggtttcatagatctgcttctttttgtgcgtttcgttgatctgataatcttctagtgatcaaaatcgtttggatctgttgactttagtttaaaatgtatccgatctgatgtcgaggcttcattattggaagttgttattgttgtaatcctgatttaagttgctgttcttaaatttatatgatctttgcgttataatatgacatggtagatcttggttcatggttcactgttttccaataaacttggtttgtttggttggatagcgttctgtgatacgaccatgtcttgtgttggataagaattctctgaatttccttggctggtttgtagtatgttattcacgtctggtttctcatcaatgattatgtgattttgcagagttcaaaatg

SEQ ID NO: 183 - DNA, 74 bp, Unknown
  misc_feature (1)..( 74): cDNA_ID_3046401_gDNA_ID_25024_Annot_ID_146486 3000 nt of promoter
ttccggatctgaattgtgttggaacaattggttctgatttcagatttcgaatttttttaatttgaatccaaatg

SEQ ID NO: 184 - DNA, 8 bp, Unknown
  misc_feature (1)..( 8): cDNA_ID_25828_gDNA_ID_25704_Annot_ID_146507 3000 nt of promoter + ATG
agctcatg

SEQ ID NO: 185 - DNA, 412 bp, Unknown
  misc_feature (1)..( 412): cDNA_ID_1019158_gDNA_ID_25709_Annot_ID_146520 3000 nt of promoter
aacaagagccagcgacttaatcgagtgtggcttattagttgacgtagagagacgacaaagagacgatatagtttataccatgagtacatgtgtgatgtgtggatcagtcgctctcgtgcgaggacattctttaaacagctgtaataataagctcaattacttagattttcatatatagatttgtttgttaaaatgttaaataaactttttatagaattagatgtcgaaacacttaacatgcactttgccacgtttgaacaaaactcaaatcaataacatcgcttaaacaagatttaaccggaattaaccggaccggtagaaactgtgtttgaaatttaaaagcacactctctctatcgccacacccacaccttctctgcaaaaacaaaagatttccacttttcttaaaaatg

SEQ ID NO: 186 - DNA, 1626 bp, Unknown
  misc_feature (1)..( 1626): cDNA_ID_3013044_gDNA_ID_26036_Annot_ID_146529 3000 nt of promoter
  misc_feature (1)..(1): n is a, c, g, or t
ncaaaattttcatttctagtttatttttgcagttttggtttctgtgtattcttttacattgccgtggcgatttgcggctacagtatgtttggtgaggccattcaatcgcagtttacgctaaacatgccacaacagtacatatcatctaaaatcgcagtttggacagcggtgagttataactttaaaattctatacaaacatgttttttgggtaaatattatgtttgtctctatatattactaaaattcgattacttctttttctgtcactgaattaggtgataacaccgatgaccaaatacgcgttatgtctcacaccgatcgtgctaagcttagaagaagttatgccgtcatcagggaagatcagatcctacggagtatctatgcttcttaggacgattttggttctctcaactttggttgttgcacttacattcccattcttcggtaaaaataccctaactagcttctttttgcatgaaattaatacaaataaaaccccatttttatcatcatttgttcttaatctttgcagcgatcatgggggctttggtgggatcattcctcgcaatgcttgttgtaagtcaacgttaacaaaattccagctattatcaattattaggcatatcacatatgtaaaaaaggattcatatatattttgtttatcgkgcaggcttttatctttccttgtctttgttatctgagtatcttgaagggtagattgagtaagacgcaagtaagagatatattaatttattttattttatgccataaagtaaagtggttattgttcgattcagtatttgattttcccataatttcatttataattttttgtaaactatttgatattttggcagattggaatatgcgttttcatcataatctctggcattgtaagcggttgctgcgggacgtactccgccattggaagattagtaggaaaactggattgatggtagaatagtgaacaatgaaacaacatagaattgtgaaacaataagagattttctttaataaaagttctatcaaatacgtaatcaagttttgtgaaactttaaacactaattttagtacagttttacagtttattaacttgcaatcttcttttttttattaaatgaatttatatatgagcaactaaaaatgctcattaagagatatcatcatgaaagtctttgcaagccatgattctagttccaattacaaacctgaacgttacatagctaaattattggagacgaagcgaattatcgaaaatgctctgacatttttaaatggaggtaaataatttcggttatacggataatcagaaactgcattttaggaattaagaaatgtgtcagcaaaattttgaaaacaataatagaggaccttaataataaaattaaaacaaaaggggcaaatacgaaataatataataaagaaggggtcatttcaattaggtggggagcttcgagttcaagagatctccaaaatcgtcgacaacttcagacgtactccaacaacaaagtacaacaacaacatcaatcgagagaaagcgaataaataaaacaaataatttaaattaaaaatccactcgccggagacgccgtcgtttcgacgccggtgctccaaaaaaaatatg

SEQ ID NO: 187 - DNA, 1261 bp, Unknown
  misc_feature (1)..( 1261): cDNA_ID_1684123_gDNA_ID_26042_Annot_ID_146532 3000 nt of promoter
caaaggcaattgaattcataattacgaaagaacctatcaacgttattttcgtcgctaattatagtaacctgaattttttgatgacgttattatgatcacgtggagctcggaggaactcaataaataatgtacaataactgatttatacttgtctcagtatacggatagttttccaaaacaatgaaagtacacgttgccttgccagttgcctgcatatatataaatatatatacatcgtctagtagataccattacagtatattgttgttgaggttttataaattgtgtaatgattttgtataaattaaagaaacatatctccaggcatctcataattacgaaatcacgtttaaccttcttaaaatatttataataccacaagatttgaaagtatttttaacaaatcataatttgaatcatatatgaaattttgctgccaagagcattcatatttgatccaccagaatgtcataattgatcaaatttcatatttgatccgccaagaccctgagcattcatttgatccaccaaattaaaaagtcctagtggattataacttagaattatttacttttattaaatcaactaatctatgaaccactcaaccacatactacattataagaaaacgtaagtagccaaactaatactctatacatttattatatacgacgaaacaagatatatccattctcgaccacgacattggattagcttaaagttaattttagtatcctataaacaccgttcacgtttatgaaaatatataaacggagcaatctttcaaatcatttgcttcaagttcaaaaacctatctagggttctcgggaggagatgtgctaactgattttctaacttgagtttagtccatagtaatttttgttttttttacgtattttaagatttgaactgaaggatttagaaaataaatgattccaatcttgagtatagagagagaccttcatacggagtatattacaatgaattatagtctagattgtagtggagtgatcaatattttgctttttagcggggagttatcattttcgaaggctttaaatgtttttttttgcttgggaaatgtgaggagtgtcatgaatatcgaaattaaatgcattcaccaaccctaacgatccaacacttcctttgagttaatgtcacacattaaaatcatatccacttgtttataaccacattttctctcagaatccataaaaagagagagagataaataaagagaaaactgaagaagctagaagatg

SEQ ID NO: 188 - DNA, 734 bp, Unknown
  misc_feature (1)..( 734): cDNA_ID_3013704_gDNA_ID_26049_Annot_ID_146539 3000 nt of promoter
aaatttatatccactaaacactttttaatatcaatgataaaatatattaaactttcaaaaatttccaaaaataatggcgtataaggctatatattggagagatgctcgaaaagattatcgattgttgtgcagaatctaacacctccgacaatatcgacctgaatcaaactttatttcaagaacataaaaagatcaaatctttttcttttgtgcaaatgggaggcaaaaggaacttactttccatcaagatagggaggagggttgaggcaagtaggcacgtatagcacgttcaatgaacattgacaaagctgtagtatctaaaattgtttatattttcacagagttataccctacgtacaaatcagtggttccaattgaaaaattatgttgtaccaatttcacaatttaattgcatcaaagtaacaattctgatgtaccaattaaactactcgtattaaataaactaattgtgtatttacaaacgaacaattgtcacatttaaactagctgtttaaatgtttttatagtttcatattactttgcttttttttccatttgtttttaattcatcgaagccattgattcgaatttagttgggtataatcttgatcagtaatttaaaccgttgcagactagggtgttgttgaaccggatttttcctttgctgggggaatcaactatacaaacaaaaaacccattttcctaaaaccctcgtcgtccctacaaagcctatg

SEQ ID NO: 189 - DNA, 623 bp, Unknown
  misc_feature (1)..( 623): cDNA_ID_3446743_gDNA_ID_26053_Annot_ID_146542 3000 nt of promoter
tggtgttggtattatgggctacattggtaacaaggtcttgatttctcttactagttgctttaaatagttatttgtagcctagcttataacttacggtttcttgcggtcttacaggggtctgtatctgtgagcatgtcaatctatcaaacaccattttgtttcttgtgcacgcatctgtcatctggagaaaaggatacagatcaagagaaaagaaacgatgatgtacgtgaaatccacagaagaacgcagtttcttcctcattctttaaatgccaatgagcttccaagaagcatctgtaatcatgagtacgttttatttctcagttgatccattcaactacatctcttaatttttttaacataacaagataaccttgtgtagaagaataatctggctgggagatctgaactatcggattaacttgtcgtatgagaagacacatgaacttattgcaagaaaggaatggcaaaggttggtagagtacgaccaggtacctttactgcagcattgttttggtttaatactaaattgtgaagttctaatgtttatgttttttaagttacatatgaatctatcaagattgaaattagatgtttattctctgatagctttcaagagaaatg

SEQ ID NO: 190 - DNA, 1504 bp, Unknown
  misc_feature (1)..( 1504): cDNA_ID_3012105_gDNA_ID_26053_Annot_ID_146543 3000 nt of promoter
tggtgttggtattatgggctacattggtaacaaggtcttgatttctcttactagttgctttaaatagttatttgtagcctagcttataacttacggtttcttgcggtcttacaggggtctgtatctgtgagcatgtcaatctatcaaacaccattttgtttcttgtgcacgcatctgtcatctggagaaaaggatacagatcaagagaaaagaaacgatgatgtacgtgaaatccacagaagaacgcagtttcttcctcattctttaaatgccaatgagcttccaagaagcatctgtaatcatgagtacgttttatttctcagttgatccattcaactacatctcttaatttttttaacataacaagataaccttgtgtagaagaataatctggctgggagatctgaactatcggattaacttgtcgtatgagaagacacatgaacttattgcaagaaaggaatggcaaaggttggtagagtacgaccaggtacctttactgcagcattgttttggtttaatactaaattgtgaagttctaatgtttatgttttttaagttacatatgaatctatcaagattgaaattagatgtttattctctgatagctttcaagagaaatgacaaaagggaacctattcgagggatggtcagagggaactttagattttgcaccaacatataaatacgaaatcgattcagaaaattacatcggagatgacccggaatccgggaaacgtagaccggcctggtattgtcttcatacactgtgatacaacatttttacttgatatgataaaaaggcaaaaacgatgagtttggagtgactatgattgatcaggtgtgaccgcatcatttggaacggaaagggaatgaagctcttcaattacagaagaaacgagattaaactatcggatcaccggcctgtcacagccacgttcttggccgaggttgaggttttgtctccacggaaacttcaacatgcgcttacacttacatatgctgagattcaaggccttgacgcctaaacaaccacttccgtcagatcccatttgtgtatagtaatttaacgatttgtatgcccttcatgtataatagtgttcacgtacacagaaatattgtagatagaaatactgactgaaaacaaagaccgtatctttgatgatataaacattggcaattgagttgagatgtaaactatagtgttagtgtatgcacaaatataagaattagctcagacttacataaaagttaattaatgggctttgttatactccaataatgggctcaataaagcccaaacaacctgccactcacttcacttcccagttcccactgactttgatcactgatttttttttcctgtctcattttccattttcccccaaaataaaaaaatatcacaaatcccatgaaaaatcacagagcttaraactctccacactctcaaactccgacgacttgactttaaratcatccctgaggagatcggtacttagcaatg

SEQ ID NO: 191 - DNA, 3 bp, Unknown
  misc_feature (1)..( 3): cDNA_ID_1684200_gDNA_ID_26300_Annot_ID_146545 3000 nt of promoter
acg

SEQ ID NO: 192 - DNA, 145 bp, Unknown
  misc_feature (1)..( 145): cDNA_ID_30530_gDNA_ID_26503_Annot_ID_146560 3000 nt of promoter + ATG
gtatgacgagttatatttgtgtaactgggcattttatcgatgaaggttggcatttacacagttatattctagatttttgtgagttgaagtctccgcacactggtgaacatattgctaataggattcttgattgtttaaaggaatg

SEQ ID NO: 193 - DNA, 373 bp, Unknown
  misc_feature (1)..( 373): cDNA_ID_3013024_gDNA_ID_26737_Annot_ID_146564 3000 nt of promoter
  misc_feature (238)..(238): n is a, c, g, or t
acaaattttctccattaaaagtgtcttcttttttagctgtattaaatttataggtctmtctatctgtactggtatagggttcatgattgagtctacaaaaacataatgaatgacctaaaagctattaactttcgtttctagatctgcttgcttctctttaatatcttcacctcattgctctaatagacattaatctccatttgaagttagtattcttttaccagttttactgattttnctttttcattcaggtaactgtgattgttgcaggatcttgtgtagaaacagatcacaagaagatgaatgataactcggtggtgcggctttgattatcttcagagattttagattctgtatccactctgttgcgatg

SEQ ID NO: 194 - DNA, 765 bp, Unknown
  misc_feature (1)..( 765): cDNA_ID_1684405_gDNA_ID_26964_Annot_ID_146572 3000 nt of promoter
gacttcgtcattaaagttccaacggccatattttcatttattgttgcgatttctttacttttttagagcatatgaatgttgtatgagcctctatataagctcaccttagttttcatttgtattcaagccttttacgaaataaacaagtatttttttcaaagtgtgtctttgagttttatgcattagaagttagtgtggattcaataaagtcttgtgtgtttgcggatcaattatcttgtggcttcaagttaatttgttcgtggtttgattgtggattcaatcaagcacgttgagtgtggattcattcaataaaacctccatctttcatctctaccatcattcatcgaatcattcaagatttaggtcgagaaatagagaagcgtaaaccctaggtagattccgaggtttgcatcattggtatcagagctaaaagctcctatcccacaaggtgaactcgttcccttttatccctttcaatttctgtttttgttattttcagatttaaatcgaaaaaccaaaataaaacttgtttcttgcaatttgttttgttttgattccgcaaccttaatagaaaaacaaaataaaatttttccttgtttagtttgttatttgtttcatttttgctattttcgttaaaaaaaataaatcaaatgttgttatttttgacttatttgttgacttacttcctgagttaagttctgattcattgtcttctttgttttactctcttttacgaggtaccacaaataaaatctgagaacgatg

SEQ ID NO: 195 - DNA, 3000 bp, Unknown
  misc_feature (1)..( 3000): cDNA_ID_1989477_gDNA_ID_26992_Annot_ID_146586 3000 nt of promoter
aaaaatgggaaacaatgcgctattctcttctgacgccgccatctttggagcctttaaactgagagattctattctgctgaaaggaaaagctctgttataatctcacaacatccaaaaagcttcaaggatacaaaattatcaataacatgaaaagctggatctgaggccactgaaattaattagggattctacatgacggagatcaacactaatagatctcggctaatctagtctaaaggtatatgaatccctggactcactttgagatcgacacaaaaccttagaaaacaaacaaacgaaactacgggaaggaagcaaaaccaataattggtgaaagaagatgaaatcgaacttgaaaggatattgtagaagaggaaatcgaagaagaagctcacctaggatgatagctctctataatcagagagatcgcgctgctgcagatcggcaacaaacggcgttgcagtttttttttctttatgcttctcttctcttctaatttctgatttctgattggtgagttctttcttctttacttgcttattcacttttctttaccttctcaattaaaatatttcgcaattcatttctctctttacatttttacgagttatttattttccattaaattagagtaattattaatagcaaagtttttatggtgaacgaaaacgaatttcccaaaaaaaatcacattttttataaattagaaaggaaaaagagaaaaggatatggatcaaagagggattatatgctctagagatttaatgtgatccagatattgtaatagggattgcaacaaatctcttatatgttctagagatttaatgtgatctagagattgtaaatagttacaacaaaatagagatttaaacaaaacaaatatttaatgattttaagaaaactgttttgttgtaactatttatatttcgaccagaaataaattgttctacttgcaaaatacatcaatcttcgttattattatcgatttaatcataaactgtctaattcaattaaatttataagagcatggttaccaatacttttttatctactgtaacgaaagctaataatgattttgaatgagtttggtatgatttggttattcgattcactaaaatagtcgttttaaatctagccaaatatcgtataattttacttgttttgattatattaaataatcagttatttgaaaactttgttgacatgttaatattatatataactaaaacaaaatatagatattaaaaacaaagaaaatgttattatatagctattatcgtttttcataccatttaaattttattactggctttcatattatgatattgttgtacatagacaccactgctaaaatgcttattaacttgagattttgcttgtgagatttggaggctaatttttttctcggttaagcatttctcgcatcatatgccttccacatagtttgagcttttgttcaccaaatgttcttaccactctcaagaaactggcagcacacgaatatgctttccacatggtttgagcttttctcttggacaaaaactcgttcaccaaatgttcctaccactctcaagaaactggcagcacacgcatatgccttccacatagtttgagcttctctcttggacaaaaactcgttcaccaaatgttccttccactctcaaaaaaatggcagcacacggtggagtttaccacatttgaaaacaagtaaataatgtcttacataattcacagtcactgctttcttcgatcattttcaagaattttgaccgtgaaatttgcaataccatatcttcaagaagacatctaaaaggttttcgcaatctggtgattaggttaatgctcttttgtaatacatttctttcattttatatatgatattaacatttataacaaaagaaaacaatcatagcatattgcatgtcattgcaagtttgctatatacagtagttttaaaccgagtaaacttaagatcaggtaggaaagatgcaaataaagaagcaagtgataccaaaaatatatgtaaacatttaatatagttcttcaatctaattgacgattagaaagtactgtactagatgattacgatccaagatttttgtccacactaagaatatttcacaaaataaggtttgcaacagtaggattgaaatgccagtaaacagtgacattatctcgaaaaaatccaactcagaaatcatttactagctaataatatttttcaaatagtttagaattattattgttgtttatcattaacgcatacaaagttagttgtataatctttcaacttataaataatttggttttggacggaagagctttacgcaaatgtattaatttggttttgataatttttatttgtagactcgatttgtttacgtaaattatgaaagagaggckaaaataaatatcataagatatagmattagaagaaaaggycataaaagtagtaattaaaaaaaaaaaggaaaagaaagtgtgaaaagaaaaaaggaaaagtagagaggaacgcaaccctgggggcttcttaataaacccctctcgctctcttgtctcttccttacgacaacctctcctgctcttcgttttctctctacgacgataaaacccagatttgggttcaagcttccataactttaaacccctctcgcgatccaggtatgtttcccaatctttattcccagatcttccagatctgaagctcctcttctattttttcgtagatttgatttttaggtttgatctatttgtatgaatggctcgcgtgttctcccgtattggtgattgtaatctaaaatgttgatttgatttaggttcagtaataagactagttatctgacctgtgttaacaccaattagtcttctcctagtctgctttcattgatattccatccttgttcatctgatacttattttttttgcttttattgatctgagaaggttgctatcaaatacttgggagcccccagtattattgaataacacagcctgacaatg

SEQ ID NO: 196 - DNA, 3000 bp, Unknown
  misc_feature (1)..( 3000): cDNA_ID_1989476_gDNA_ID_26992_Annot_ID_146587 3000 nt of promoter
aacaaggcaattctcgtttccaaaatcaaacccgactacactcattgtcaggctgtgttattcaataatactgggggctcccaagtatttgatagcaaccttctcagatcaataaaagcaaaaaaaataagtatcagatgaacaaggatggaatatcaatgaaagcagactaggagaagactaattggtgttaacacaggtcagataactagtcttattactgaacctaaatcaaatcaacattttagattacaatcaccaatacgggagaacacgcgagccattcatacaaatagatcaaacctaaaaatcaaatctacgaaaaaatagaagaggagcttcagatctggaagatctgggaataaagattgggaaacatacctggatcgcgagaggggtttaaagttatggaagcttgaacccaaatctgggttttatcgtcgtagagagaaaacgaagagcaggagaggttgtcgtaaggaagagacaagagagcgagaggggtttattaagaagcccccagggttgcgttcctctctacttttccttttttcttttcacactttcttttcctttttttttttaattactacttttatgyccttttcttctaatmctatatcttatgatatttattttkgcctctctttcataatttacgtaaacaaatcgagtctacaaataaaaattatcaaaaccaaattaatacatttgcgtaaagctcttccgtccaaaaccaaattatttataagttgaaagattatacaactaactttgtatgcgttaatgataaacaacaataataattctaaactatttgaaaaatattattagctagtaaatgatttctgagttggattttttcgagataatgtcactgtttactggcatttcaatcctactgttgcaaaccttattttgtgaaatattcttagtgtggacaaaaatcttggatcgtaatcatctagtacagtactttctaatcgtcaattagattgaagaactatattaaatgtttacatatatttttggtatcacttgcttctttatttgcatctttcctacctgatcttaagtttactcggtttaaaactactgtatatagcaaacttgcaatgacatgcaatatgctatgattgttttcttttgttataaatgttaatatcatatataaaatgaaagaaatgtattacaaaagagcattaacctaatcaccagattgcgaaaaccttttagatgtcttcttgaagatatggtattgcaaatttcacggtcaaaattcttgaaaatgatcgaagaaagcagtgactgtgaattatgtaagacattatttacttgttttcaaatgtggtaaactccaccgtgtgctgccatttttttgagagtggaaggaacatttggtgaacgagtttttgtccaagagagaagctcaaactatgtggaaggcatatgcgtgtgctgccagtttcttgagagtggtaggaacatttggtgaacgagtttttgtccaagagaaaagctcaaaccatgtggaaagcatattcgtgtgctgccagtttcttgagagtggtaagaacatttggtgaacaaaagctcaaactatgtggaaggcatatgatgcgagaaatgcttaaccgagaaaaaaattagcctccaaatctcacaagcaaaatctcaagttaataagcattttagcagtggtgtctatgtacaacaatatcataatatgaaagccagtaataaaatttaaatggtatgaaaaacgataatagctatataataacattttctttgtttttaatatctatattttgttttagttatatataatattaacatgtcaacaaagttttcaaataactgattatttaatataatcaaaacaagtaaaattatacgatatttggctagatttaaaacgactattttagtgaatcgaataaccaaatcataccaaactcattcaaaatcattattagctttcgttacagtagataaaaaagtattggtaaccatgctcttataaatttaattgaattagacagtttatgattaaatcgataataataacgaagattgatgtattttgcaagtagaacaatttatttctggtcgaaatataaatagttacaacaaaacagttttcttaaaatcattaaatatttgttttgtttaaatctctattttgttgtaactatttacaatctctagatcacattaaatctctagaacatataagagatttgttgcaatccctattacaatatctggatcacattaaatctctagagcatataatccctctttgatccatatccttttctctttttcctttctaatttataaaaaatgtgattttttttgggaaattcgttttcgttcaccataaaaactttgctattaataattactctaatttaatggaaaataaataactcgtaaaaatgtaaagagagaaatgaattgcgaaatattttaattgagaaggtaaagaaaagtgaataagcaagtaaagaagaaagaactcaccaatcagaaatcagaaattagaagagaagagaagcataaagaaaaaaaaactgcaacgccgtttgttgccgatctgcagcagcgcgatctctctgattatagagagctatcatcctaggtgagcttcttcttcgatttcctcttctacaatatcctttcaagttcgatttcatcttctttcaccaattattggttttgcttccttcccgtagtttcgtttgtttgttttctaaggttttgtgtcgatctcaaagtgagtccagggattcatatacctttagactagattagccgagatctattagtgttgatctccgtcatgtagaatccctaattaatttcagtggcctcagatccagcttttcatgttattgataattttgtatccttgaagctttttggatgttgtgagattataacagagcttttcctttcagcagaatagaatctctcagtttaaaggctccaaag

SEQ ID NO: 197 - DNA, 643 bp, Unknown
  misc_feature (1)..( 643): cDNA_ID_3012997_gDNA_ID_27003_Annot_ID_146592 3000 nt of promoter
agcgtatttgaaaccctccacacaaaaagcccaatataccaaacacatgcttgcaactatttttgttttkgacagctagtttagctacttgtttatgttatgaaacacaatgaaaaattattcaaatttcatagatatagcttcaacaagctgtagatagtagtaataaactagttttcaattttattatttacctagttggtaggagctaatccaactttacacatcgctaaatgaaaaattattattcatcttaaatactcaacaaaattattaattctgtcttaccaaaatgttattaattctaagaaatgataacaactactaagaacagtctacttgatcaatttcttataactttgaaaccacaacggacatacgtagggttatatttcgtattagataaaataataggtaaagattaaaatgattttaaaggacagggaccttaaattaataccagcgtcaatctcaaggagtaaaaaaaaactttaataattacgttcagacaaagaagaaaaatcctcactgaaattcgagcaaaaaacactcacttcgctctttcttcgctagcttcgttaaattcagcaaatctatctctcacgatcgaacagaactgagagagagtgtgagcttagccatg

SEQ ID NO: 198 - DNA, 1407 bp, Unknown
  misc_feature (1)..( 1407): cDNA_ID_1534193_gDNA_ID_27606_Annot_ID_146624 3000 nt of promoter
  misc_feature (22)..(22): n is a, c, g, or t
  misc_feature (732)..(732): n is a, c, g, or t
acatgtcacacacttaccatanatamataattaagsatactcgcataaacctatatatacagtctaagatttctagctggtccatatgcatgtgatctaatcaaaagccaaactctccttgtctttgctatattaacaatcatttaatccacaccaccagagatttcaatcttccttttgctactctcttttagatcgttcttgtgaaaatcgcttgcaaataacaagcccttcgtccaatctttattagctcgtaagmttcaccccattgctccttttagggttttttttttgttttgtttctctactcacttcatgcatgaaccagatgatgatgcatcggcgtttgtgttttgcattttaattattcaaagatacatacatattacatgtagtatcgtttcatatcttgaatagtatacatgtgtgtggtcctgttgagattgacccacaaatattagagtaaactgsggaattgaaatcaatcatggtggggatttcgsaatctatgtgtgtttctaagatattattgtttcttggaaattaattgttgttgcaccataatataatttatattatatagatagtctaggaaaataactcaagacaaagagtgtgtaacacactccaacctcagtgacttccacccgtcaagcttttcggctacatagcctttatatacgattattttacatatagttacagatatatacagtactgcttgtatatttntggtcttataatactaccttatgtcattatatatagtacatattatacaaagtttcaatcttttcatttataagcatcgttcggtatgtagaaggcgaaacaaacccttaaacctaatatttttttctggtccaaaaactttctctatcaagcttttgcattttttcttttaaaatagtaacagctcctccattgttgggtggtcccataaaaatacatcataaccatcatcagcaacatataatagcgatagccttaagcttaaagatccaagcttttggatataatatctagttacatgtatatatatatgtgtttgtatatttataggtatatagtatattatcgtgtgcgtccgtgtgtaacatcactatcattacccaacatacagcttttggaatttcattggacccaagagccattcgatccctdtcttataattaaatataacgaagcttgtaataggctttggttttggtcccaaatacaaaactttaaggttgtgccttgtttgtctaaggttttcgcaatagcttccaaaaagacacgcttatgtttatatacatttcattttccttcatatcattctcttctctgccacttctccatcttgtttcttactcatttctctaacaattttccaaattaaatacgtttataggatcattgtggatg

SEQ ID NO: 199 - DNA, 1414 bp, Unknown
  misc_feature (1)..( 1414): cDNA_ID_3012945_gDNA_ID_27814_Annot_ID_146632 3000 nt of promoter
aaactacctggaccagcaaaaattggagaaggaaaacccgaaaatcagaatcatgctctcatttttacaagaggagaagctctccaggctattgacatgaatcaggtaaaatactttcccccaaccgaaagtttccacaacaaaaacatagtggacttttatttattggaagagttttacttaccaatagtatttaatttataggaccattacttggaagaagcacttaaaatgaggaatctgctggaagagttcaatgaagaccatggtgttcgtgcacccactattcttggtttcagagagcatatttttactggcaggtatttgggaaatatggttattattttcttgttgtgtaaagaacttccttcattttgctagctgattgatatgtgtttcacttcggcatcttattctcagtgtttcttctttagcctggtttatgtcaaatcaggaaacaagttttgtgaccattggtcagcgagtcctggcaagtcctttgaagtatgtcatgttcttctttctttcaatctacacacattgatgcccattttaactaaaagtttagtagctgttaaaaatgtaattccttctcgatatcatttaactcacacaggcaccttcgatttgtgatttcagggtaaggtttcactatggacaccctgatgtcttcgatagaatcttccacatcactcggggtggcatcagcaaagcttcacggggcataaatcttagcgaggatatctttgctggttagattgtgaagtacttcttcaaggaaaatagtgatgttggttccttcatcatttacttatgattgattcatatgtatataggtttcaactcaactctgaggcgtggtaatgtcacccatcatgagtacatccaagtagggaaaggaagagatgttggtttgaaccagatatccctctttgaagccaaggttgcttgtggaaacggagagcaaacattgagtagggatctctaccgacttgggcatcgttttgactttttccgcatgatgtcttgttatttcacaacagtaggcttctacatcagctcgatggtagcttctgatcttccaatgtcaaactaagtttatcgttaactcataatttgcttaaaacattaactcataatttgcttaaaacaaaacataacggactaattatgtgtactacagattgttgtcctcacagtttatgcattcttgtatggaagactttacttgtcattgagtggagtggaagaggcgatagtaaagtttgcagcagcgaaaggagatagttctcttaaggcagcgatggcgtcacagtccgtagtgcaattgggtttgctgatgacactaccaatggtgatggagattgggctagagagaggattcagaacggcgttgtccgatctaatcataatg

SEQ ID NO: 200 - DNA, 2696 bp, Unknown
  misc_feature (1)..( 2696): cDNA_ID_28020_gDNA_ID_27978_Annot_ID_146638 3000 nt of promoter + ATG
gatgaatgggtaaacaattttcctcaatttgttttgcaatttgcagaatatttcgttttccagtgtatccctcacccctaaaatgttgttttcacagggcacccaaatagaagcaacaatcggtcctcgtttctctgccttctactttgacaggatcaaagagaatcaatggaaaacaataactacgtttctcgttcgacctaactgcgaagcaataaaaacaactcctcatcagtttcacattctattcatggatcacaccattgtcacttcttccacaccaagagaaacaggtttactgaacaagttcactccattcgactacattgtggatgatgttgttggcaacgataccttgattggtaagtaaattcttctttataaactkttatagatgttatcggggcactcgttaatgttgggattctgactaataccgcaagtaacgagaatgatatggccggattcaaattgccgttcacgatcatggataaaaagtacatttcttaaaacctcaatttacagtttttttcaaacatatcatgtttatacattattatagtaagtatataaccacatatttttacatattttcagcaaggatacattggtatgtgaggcttatggagaaattgcagtggacttggagaaaagatttcgagcatttcgcaagaacaatgttgttattgctcttgcttggtggaagattattagattttatccaggttgtaactggtttaagattgttagccatgcacctatatcaaccatgtatccagaacctgatgttgaggaagttgaagaaatcaaaatggttgtcgactaatagaaagatgattagaactatctcatcttcttttattttttttcaaagttgtaatatttttataaatgataagatatattaataaaaaaagttatttctttgttcaaaatttctcatttgtaataattttaacaaatattttattaagtagtacaataggaatacggtgtataaattaagtgcaccttactaaggaatggttatatcaagattacaatctttttatcagaaattagcaaattgcttgagttttaaaaggaataaaattggtgatctgaaaatattgtttcccaacatatctaatttctcaacatatatttgtttacatgactgatagggtggattgttgaaacttttagttgaaatccataagaaattactatcgtggattgttgtttatggataggttaataaattactttcctgtcttttataccctaattataaacgatgtattctcttacttttttccgcatctgattttagttccctcctcaacattgagaaactgatttatagcgggacaatttaccacctattataaattgtttaatataaccgcagaaaaactttaaactactctttccttaataatctatataaacacccaacattcattaatgttttttccattacccatttcttcagttaaaaccaaaaaacagagaaattatgcagaagtttacgaagataagcaacaataaaacatcatctgcctcggatgtgaaaatggttgttcgtccaaacccaaagtacttagtattctacagttttaactactactttaataaaaatactaacaatctctttccttttttttccaacaggttgctgctatcccagaagtttacttgccggccccgctgcttgctaaaattgttagctacgttgcagaatctggtgttgattctttgaaatcctttgttaaggctggtccgttatttaaagcggctgtctattccaaggaaacactaagttgtgtccgccttgacagatcttggtattttatgtggtggtcaatgcctcattccatctattatcatttctttacaaaatgtcttgacgccaacaatccacatgctttaactgctgtattatacaaaggaatagcatacgagaatttggttgctgaatgctatagatctagtttatggatggaaccttatggagaggacggaggatgggtacaaatagatggagcttactgggctcaaccccgagttcgagagagtattccacgttgctcccgttgcaaatctcgggcacacaaaagatctaattgtccaaaatattgaaagacaatgttttaatactgtgttatccatcattatctgtctatctacatgtttctatttttctaaaacttgtttttctgtttttaagcttctgctagtctgtctttttaatgttatattctcgtttgctattcaatcttcgtttatatatttgctaaggcttatccatcttattttgtggttggtgtttcatgattacagtctatgtatttattacctgattgtttatggagaacttgttcccccataaatgagtccctgttcgattgcatgttaaaagacatccacgtctatattttatataccataaagttgtgtctatttggacaacaaaatttggacacacaatgatttattttggacatgagaaaacttactcacatgtctaatttttaaaaaattttgtaggacccacgacgtcgccactaacccatctcaccaccacaccccaccctcttcaatgtgacaaagtattagggttcccattctatcacgatctcaaagttacaaaaattttcattaatagatcgctatttgtacaccttcagtactatccgaatcgataatccaaaatg

SEQ ID NO: 201 - DNA, 129 bp, Unknown
  misc_feature (1)..( 129): cDNA_ID_1710974_gDNA_ID_28160_Annot_ID_146657 3000 nt of promoter
attgcggtaagtattttccaatctaacaagtacttgaagagattcaaaatctttaattctgtttttctatagcacaaactataaatatgaatgcaagcctccttttgattcaactcttatttattaatg

SEQ ID NO: 202 - DNA, 244 bp, Unknown
  misc_feature (1)..( 244): cDNA_ID_1688325_gDNA_ID_28291_Annot_ID_146664 3000 nt of promoter
ttggctctttattagttcttcttttgatggttggtaagtgttaatgactaactgagaaacagagtgacgagagaattaaagagacacttgccagaagaacaaatctctcaagtgggacgggacccaccgcatgtccctttcttcattctccttcgtcttcgtcttcgtcttcacttccgccatgagaaaaacctgcacacacgcctgaaaaaccaaatcatcctcatcatcttctgatctaatg

SEQ ID NO: 203 - DNA, 3 bp, Unknown
  misc_feature (1)..( 3): cDNA_ID_1688361_gDNA_ID_28303_Annot_ID_146672 3000 nt of promoter
ctc

SEQ ID NO: 204 - DNA, 996 bp, Unknown
  misc_feature (1)..( 996): cDNA_ID_3012892_gDNA_ID_28580_Annot_ID_146691 3000 nt of promoter
catgttaatggtgtttgatgataatgaggatggttgtagtgttgtgttattgtgtgtatgtaagaattgtagactgtatatttgacggtttgggtttacaagtctaattctagggtatagcgtttaccattgacgtcgttcgttatccctcgccgtcaaagccgtgaaccaccaccaaatctttgtgctaccgtcaaagcttcacgtctaccgtcgaagctgcaaatccactatctaagccatatatctctgaatgtcaaaagaaacttaaaattgaatcagagatggggatgcattttttagaagataaacgcattcttttcacctcattctcaactccagctcatagtttaagggcaaaaatgtccgtaacaatgaaaattggagttattatatgcttttactgttgttgttttttacggcaaaataaggtcatccatttaagctaaaaacgggtcggttttcttcgagagaaaactagttcggagtagaagaacttacatgggaaaaaatagaacctcgtgctcttgccttcttatcaagacaatcagcacggacattgtttagagtgtctgttttgaaagaaatgttttcaaaatgcttgtttagaatataagctctatatagtatacctacacatgttatcgtgggtccaaatagaagagaaaaactatatttaaaaaatdaaaattatatgagatatttattttcaatgaaaaggagaaaaataaaaaataaagaaggaaaaaatataaagtttcctttccctctcgttcgttggctttgccttcccgagagagaaagataagatttggttttgcattcctcttctctctcgccgctctcaatatgcttcgatttctattctcctcttcctcttgattttgtcttcttctctttgctgcggagagattaaggaacccaagggttttaagcaagagacgcggcgaggaagctatccagaactctctgaaacatccattcctttttctcatg

SEQ ID NO: 205 - DNA, 7 bp, Unknown
  misc_feature (1)..( 7): cDNA_ID_28712_gDNA_ID_28590_Annot_ID_146701 3000 nt of promoter + ATG
atatatg

SEQ ID NO: 206 - DNA, 71 bp, Unknown
  misc_feature (1)..( 71): cDNA_ID_2026504_gDNA_ID_28591_Annot_ID_146703 3000 nt of promoter
caaacacacaactaacaaacaaacaaaacacaaatcttggttcattttaaatctctccaagaaacaaaatg

SEQ ID NO: 207 - DNA, 86 bp, Unknown
  misc_feature (1)..( 86): cDNA_ID_2996582_gDNA_ID_28593_Annot_ID_146709 3000 nt of promoter
acctgcctttcttctcccatccatcatcatatctctctctaatttctctccgtataacacaaactactctttaataagtatttatg

SEQ ID NO: 208 - DNA, 1752 bp, Unknown
  misc_feature (1)..( 1752): cDNA_ID_1690464_gDNA_ID_29526_Annot_ID_146727 3000 nt of promoter
aaaaaaaaaaaaagtcatggtgatctgatcagatctctaataatgaggtttaggcttaagtttatatttttgttataattgattttgcgtagaatataagcacctctttagaaaacgcgtagaccatcaacaagtcgaatattttactctttttcttgtttttatgttctaaaaaggcttcatttattttctacctgtactgttctttaattgatttttgaatccccacaatttcacaaaacatttataagtatataaaaacatatgtgcggagaaataaaaagtcagcaaatacaattagtccaaatgttcacacaaacgaacatgtggagcgactcacatgtggctctcctgtcaacgagacaaacagaagtggtgttgtcctcttgcttaaccaatgtgtaaaaattcctttgttatttgaatcatttgattatatactttgacaacgaaggtccatactttagttatatgattctgaatccaaaaaaatgaataataaagtatgcacactttactgctaagtcacagaacaatcactaatattttaataataaaaccagttagttgctgaaccaaaactagatacaataaatataaaaaccagatagttcttgttttataatctcaaatcatattatttacagttctcaaatatttcttatatgctttagttgtcctagtttaaacatttttacatagattaagaaaatatttcaatgtataaatatcatcttatatcattaattaaatgcaaatgaaaataaacttagattttattaaatttaataacctatgtattaactgtaaaataaaattattagataacttaggttccgaactttccataaaacgttggtaagtttttgtgtcattttgttaaataatacaaacactacctttaattacctgtgctactataaattcaacatccaaaaattttagcatatttttaaaaaacataatttatttcagatatttagtaaattctgctatttttaactacttttatagttttatttatggttattaatatctgtttatcacagaaattaaactttaactatttatctttacatataaagttattaaaagaaccaaaaacataataaaggagaatttgagtggatacaagttgtaaacttttttaagatcataaacaccatatatccctataaagataaagaatacgacaaacttagatctttttcctccaacgtgatatctagtagtaatgaaaaaacacatgatagttaataaatagatcttgaccctataaaataagtaaagacttttttaaagatagcaaaagtaaactctgtaagaagtctccaatggagaacaatctaactcttccaatgtggcataggcctaatttggggatccttcttatatttcgggtaaaatcacacactcatgtaaaaataccgacatcactatcattattacaaacagtacttttctttcattattatagtttagaaaaaaaaataactcgtttatttatataatatctttattaggaaaaaagttgtttcccgaccagcaaaatttctctcttcttctttataatcatcagatcgttccttcacttgattttcagggctcgaaatctctctcaaaaccctctcaaaaattccaaaacataatctcatttctcaagtttaacattttcgagcccctttagaacagtggagaaagatccacacagataaaaaaacgggtgagttttatatcaaatagacgaaaatg

SEQ ID NO: 209 - DNA, 882 bp, Unknown
  misc_feature (1)..( 882): cDNA_ID_3012824_gDNA_ID_29585_Annot_ID_146745 3000 nt of promoter
gaagaagctcctggacttactgtgagcaaaaaaagtgagcttctacttgttccagtgaagtatttagaccattgattcacgtgaattagttcttcatcgattgtactatgaataagaacgaaatgataatgagaattttcaatgtaataatttktttctgttttgtttttgcctttcatacttttgttttgtttaataatgtaacttacatgaagcctcctccattagcagcatacagaattagtttacgtgcatcatttgttaggttaccattgccaccgttagaaaactagaaagcaatgataaactaggactacattatttgatttatgtctttggccaaagaattatcttccactcaaaaattttcggtagatttttttcagaatattccgcaaattgagaagatgatttatcgaaggttgctgaatctttttgtccttttctactgtgtgatcacgttctatctaatacatgattcaaatcatattacttcgtactaagaaaaaatactttctttatttgttttttctttctattttgttaaatacatttctttagttttgtacatattcacaggtgtttggtatttctcatatatttttcaacgataattttcctatctacgacttttcaaatttgccacgtattttcttgtaagaaaaatctaggtaaatattttcctatacatgtatattacaaatatacacatcgccatctgttaataaattgcatatatctttgattctaagcatcactatctgagtctttatctcgagcttatcctcactgacggcaataaacggcaataagttcttttgtcttaatgtttctctatatcaaaaaaaaagcagagcacaaaccagaggaacgagaataatg

SEQ ID NO: 210 - DNA, 850 bp, Unknown
  misc_feature (1)..( 850): cDNA_ID_2991917_gDNA_ID_29590_Annot_ID_146748 3000 nt of promoter
ggtctttgataaccaccaagatttccactagtctcggttagatatgctttgaaaatgacgagacgatgtcatcttgaactgaatgctactattggcgatgttgtggatgttcgaaaatcaagacgttcacgtaacaaaaaaaataaactcacgttccttagctatgacagttaaataaaaataatatcaaaattaaaatatttcgcactataaaaaaaggtttataaactaattttttttgtcattaacataatttcatttgaagttattgtcattttgcaaaaaggtttctaaataaatcgatcaacacatgctggtgacatttatgatgagtttcaaatgtatgagttttgaagaagtttcaaactcttataagggtttataatgtgggaattaagttttgttaattcgtacgttcaaatgtaattggaaatgttgtggtaatataaatatttttccagtattcgtacgttcaaatataattggaaatgttgtggtaatataaatatgtttccagtaggggaaaaaaactacaaaagtttcagaaattttcataatgttttgtgactcccacaaattttaacgtgttcgtcatgtagaaaatctttggtaaaagagtgactagggcagtgtcccaagcaacgatgggtcggcacttggtcactccaatggacatgtgttatacagttgttacctatctgagctctaagtactgagtactaaaaaagctgtcatatgttagccacattttacacaacacaaaatccatttttcttctttcataactatcagaaacaaacacaaattaaatcaaagtttcattagttttaaccccccacaaaaaaacatg

SEQ ID NO: 211 - DNA, 319 bp, Unknown
  misc_feature (1)..( 319): cDNA_ID_3017946_gDNA_ID_29597_Annot_ID_146751 3000 nt of promoter
caatccctttcaatgtcaaaaccctaagttccatctctttctcttcgaaacatccgcagccttcttcttcgatttctctcttcctcttcgatttcctctgcgaaaccctagcaaatttctctcttcctcttcgattttcctcttaatctctctaccaaacatctgcagtcttcttcttcttcaatctctctcttcgatttcctctttgaaaccctaccaaatcaatctttcctcttcgtttttctcttaaatctcttcttcttcttcgatttcatcgatttgaacctctgtctcatctagatctctccttaatatcatg

SEQ ID NO: 212 - DNA, 1082 bp, Unknown
  misc_feature (1)..( 1082): cDNA_ID_1387935_gDNA_ID_29778_Annot_ID_146765 3000 nt of promoter
  misc_feature (1)..(2): n is a, c, g, or t
nntttctattactgaataatttgattgagtcaggtaaatttgtctgaattatcttacgcagctttgtcttgtaatgtcagttcgagtttggttggctctaccatggtttcatgttatggtacattatcatcatgtgcatcagtgcatgttgcattatatagaatacaacatagcattttatgagtgttagccttgctcactctctacaaatattattgaaagttgaaactgaggatatgtcggtttggtttagtatggtatcattaattgcgtttttattgggttatggttctgaattccgattgtgtcagatatattatctgtttcttttatagttaaccaaggaatcacgttttacctagataggtataaagaaataaatatgtaaccgactcaaattttactattcagtatttgaacaaattattatatgatcggtctaaccgaaaacctagtgatccaaaaaaatgatttgaatttaggaacgaagacttcatgaaagaggaagaattaaggaccttgtcaaagaaggcaatcaatggttcttcttcgaatggggtccccaaaggaccacttcttcttttgtcacttcattgcgttagataagctctaattcattttcgtcacccacatcttcttcaaatcaatacattactttttataccacacggcacacgcgttatcaaagcatattgtgttgcttcgtttaagaaacgaaattagggtctcaatcttatttctctcaattattattattaatccaaacattctcagaactagtttgaatcttttattaaaggatcttgagaccccttcacatgggagagagaaagaaagagagatagcgagagatgttactccatgagaataccaaacccacttcgctctaataattcaaaagatttcactttctcaaacaaaaaaacttctctctttcttttctaatttctaaaaccctaattgaagttccaacaagatcgatcaaagagaagatggatctcgaggattgggaattagtactccccaagaacagcttcaaggatcttgatcttgatcatgacgaggatcatcatggagccatg

SEQ ID NO: 213 - DNA, 1449 bp, Unknown
  misc_feature (1)..( 1449): cDNA_ID_3012846_gDNA_ID_29783_Annot_ID_146771 3000 nt of promoter
acacctaaaatgatgatattccacaaaaatgcaagtgaaaagtgaaaaggtgtctcataattgtttagttatttaacaatcacgctaccatactcagtcgtggtcagcttatataaactttataagtaacgcatagatctatggattctagatatgccaccaaaaaatcaactgtgtatattcttttgtaattgtaaacgatcaatcggtgacgaacgaacaaaactgtagttaaaagcagtacaaaataaataaataacgaatagagagcgcaataccaaaacaaataataagaatattgctctttgcatcgtttttgctatcaattttgtgagtggtacaagattatactaatcagtaatcacgtccaatatttgtttgattttacaaccgaatttggtttggttcggtacttcggttaaatgttgtcaaatacactattcatgttgatcattgaccaatagaagagaaaataaatgagagaaagcgtaaatacaagtaaagaggaagaagagtccaaatgtaccaatcagctcgtgactactttcagcttacctttttcttctccaagtcccatcttcgtctccgtcatcttcacggcacatcctccaaaaacgcttagcttctctctctgttacgtttactcaagtcttttttagtctcctccttaactctcaagccttttccaagtttcaagcggctccaacggttcaatttcgcactttccgatttgtggcttcactttccggtaacgtactgatctcaatccttgtagctctaaaacgactctcctagtttcgcttattttttttcttgaaatttctactgtagaatgaattaagcatgtcgacgaggttattttagttgactatcgattagaatttttcgtgagcgttactttctccgtacattatcctcagttctgcatctaaatcttgcacttagttcttcatttcttgagatttgttatcattattctctactctacttagttataacgattatgacatcgtcacagtcttctatatgtggggtttctggtactcaattgcgcaaatccttgtaatgattgatgtcacgggtctgaaaattttgacaccgtcactagatttcataacttttaagcggtgttggtgttgcgttaaatattattattaaaattgaagtttctagtagtaaaaaagttcacagagagatcttttctttttgtctgtatctacctacttacttcagaattcagataataatcctttatacatagagaaagagatcatctactatatgattattatatggtttttatatggataatattcaagattactgaaaaatctgttgttttgttttgtttcagatctgttctagagaacttcaatatatatccatatatggtttcattggtctgtgagccatatcctaagaactaaactagctagctctcttactatg

SEQ ID NO: 214 - DNA, 3 bp, Unknown
  misc_feature (1)..( 3): cDNA_ID_3012788_gDNA_ID_30094_Annot_ID_146800 3000 nt of promoter
ttt

SEQ ID NO: 215 - DNA, 975 bp, Unknown
  misc_feature (1)..( 975): cDNA_ID_1690727_gDNA_ID_30110_Annot_ID_146813 3000 nt of promoter
tgaaagtttaagcatatttttataacttaawactggagttccataagtttattgatgaatgtgataagtttgtctcaatgtagaagctatgtcctayagattcactcaatgtaacagctcgagatcckctcaatgtagcagctatgttctccayattcattcgtatttgtaaaaaaatgaaaactayaggtggcttgattgttggaactcgacgagtattgttccaggaagcagccgtcttacttcttttcaataacatatgttaaataaatcgacattgtttgttcaatcatagagagaacttattattattattattttttttttattgtagtagtaatcatgttcattcaaattgagcaattatttgctttctatctacgcccaaaaaccaacttctcaaatgcatcgacatgtaagaaaaattgcttttatgttttaaagttgtgtaacatttctcttggaactattgattgtctcaacgttgcaaataaagtaataaaatccracaagatactaataatatccaaactgggcttataatcctaaaaatgacttccataattaaaacgaatttagtttattaattagtgtaatggaatattttgtcaataaaataaataatcwcgaaggattatataaaggaagaaaaaaaaaggaaggtgggaattttaaaagggaaagacacctgtctctctgacccacccacccattcatttctgtggctactctatcgtcgtcgtctccacaccgtcggtgccctcacggatcaatttctagagagagagagagcgagagagacgattcgtttttctagattctcgtcaaattttttttccctccttcgatctctcctttttccttattcagcatttccccattttttcacgcaagatccgtgattttccagggattgatctgattgggggatcgtgaaattcgtttgtgttttctgctcgattaaccggagaaatg

SEQ ID NO: 216 - DNA, 23 bp, Unknown
  misc_feature (1)..( 23): cDNA_ID_27713_gDNA_ID_30657_Annot_ID_146820 3000 nt of promoter + ATG
cccaaaagactgattggatcatg

SEQ ID NO: 217 - DNA, 520 bp, Unknown
  misc_feature (1)..( 520): cDNA_ID_2686284_gDNA_ID_30662_Annot_ID_146827 3000 nt of promoter
tctgccatgtatctgtggatttttttgtgtgacgaaacatcttgtctttgcaaaaactgcttgctgttcaggatttgtatagctcaactgcttgccattgtttgtgtaatgtattctactatattatcgtcaaatatgctcttattattttcaaaacaaatttgatttgctcttattatacttgatgttggttaactggtttgattaagatgaatcaaatgagagtcttgagacttttataatcaaaatgtgaaatacataaaatgtacttattatatgattaggaaaatatctgaattggtaaatttttattgactcctgtatttatctgtgattataattaaacagttaaatgacttataaattcatttttttagtgacattatagggctttccttataaggccttaaaggcccattgagaagctaattccgataaacattgacattctgaaacacttgagctgcaacaacactttttccttcaccagtctcttcctcgttttggtgagaaaacgatg

SEQ ID NO: 218 - DNA, 418 bp, Unknown
  misc_feature (1)..( 418): cDNA_ID_1690767_gDNA_ID_30663_Annot_ID_146830 3000 nt of promoter
taaaagaaagacagcgttgattcaccacttgaagtggacttttatagcaaaaagagttgagtaacgtcaaaagagtcaaacccaacttttcaaaggttgtgtaaggctttccatgactccacatcttcttcttttccctttttatccttttctcttctctctcttttattttttcttttgaagtaaattaatttcacgaaacaaatcagagaaccttttatatcttcctttttcgtcgttactatcgtcctttacctttttcatttactgttctctctctctctctctctctctatctctatctctatcttctattcatggacatgcaccgaagcgacaaagcttagggcttttctctcatccatggcggatttcttctatcttcattaaatatttccctctttattaaaatctcatg

SEQ ID NO: 219 - DNA, 22 bp, Unknown
  misc_feature (1)..( 22): cDNA_ID_1690771_gDNA_ID_30665_Annot_ID_146831 3000 nt of promoter
tgctctgaatctgtatgtaatg

SEQ ID NO: 220 - DNA, 417 bp, Unknown
  misc_feature (1)..( 417): cDNA_ID_1690779_gDNA_ID_30666_Annot_ID_146833 3000 nt of promoter
ggtccattaaacccaattaactcttatgtatgagaaggaacttaaaaccccattcagtttttgatggacttgtgaacgctgctactaaaccaaggtcacttctcagttctcacaacacatatgttatgtttgcaaattaaatgcagttttataatttttagtattaactgactatcccaaattattttcaaaatatctttgaaatttaaaaagtgattcaattatgaaacctccactcacacttttgtaccatcctttgcttttgcactaatcaaatttatttgtttgttcagttaaattgttcaaaaaaggagaaagttatgtccaacaaaaaagagagaaaaaaatgcaattagccttttaataaaaaaaggagtagtaattacaaaaaaaaatgaagtactgtagattatgatg

SEQ ID NO: 221 - DNA, 3000 bp, Unknown
  misc_feature (1)..( 3000): cDNA_ID_3434222_gDNA_ID_30942_Annot_ID_146843 3000 nt of promoter
tgacgaacaagtcattttgtcctagcaaggagggcggcagtggtgtggatcttgttttgagttgtgtcgataactatgaagcaaggatggctgtcaaccaggtagctgttacttctttctcgaaaaaggcctttttgttacacattccacagttcttacttcaccatcgagcattttttatcttacattctacataattcaattagttgggaatggaaaatatataaaaagttctagattggctctgatttgagtttattcttatgaaatataggcttgcaatgagttacgtcaaacatggatggagtcaggtaaatagtatgttaataattatatgtacttcttattttcatttctcttttggctaacaaaaaaggtgatattttgtgcaggtgtatccgaagatgctgtttcaggtcacatacagctcttggttcccggagaaactgcttgttttgcttgtgcacctcccctggtttgttttttttccttcttatatcactcttacaactctaacctatgatgccctgcattagtgcttgaggaatgtatcagtggaatatgggggattttaaggattctgtgatccagggtattgttaatactactttttggatttgctctaaacaatctctttactttgtggtaggtcgtggcatctggaattgatgaacggacacttaaacgggaaggggtctgtgctgcatctctgccaactactatggtaatttcataccaccttacaatacagttcaaaatttggctatgttgactattaatcaaattttctgctaatgcttttgtttgtttaagcgctatctatatattttaagactcttgtttaattgtcaattcagggtgttgttgcggggcttttggttcaaaactctctcaagttcttactaaattttggtgaagtttctccatacttggtaaaggctttgcttcctccagctctcctcacatttaacacactatagtttatcgcagaatgattataatttaaatcagttaaagcttactagttttatgcctgttacttgatcccatagggttataattcactgaaggattttttcccaaccatgaaaatgagaccaaatccacaatgctcgaatgtagcttgtctagagcggcaggtaacctgattaaatgcaaccacaaaactatctcagctcgtctttgttttgcgccttttgtttccatccatgttctggtaaaaaaattgaaatcccaaaatgcagaaagaatacatgcttgcaaaaccagaaagggatgccgctgctaaagctaagatggaagctgatgcatccacaactatcgatgaaggtccactccatgatgataatgagtggaacataaggtaataactccgtaaattagttataaatcaaaatttgtatttttggatcatattttctcctttccagccatatttgcaacaagaaatctgatgtgtatctcatgtctttttgtcagtgttgtcgatgatgaaaatgagaaggatactacaaaagctgcctcaagttcaggtaattccaacttgggactctatgtgctatccatgtgaaaatgtatcaaatataagtcctcttcttctgactgttatctaaatcctgtgtgatgtgtagatacattgcccgaagggcttactcgggagcttccagttgcagatgagtatgagaaagcaatagccatagcctcaggatcaggagaaccagaggaggaagatgatcttgaagatctgaagaaacagctcgaagctctcaacgctgcttgagtctttatgagggagaaaaaatagatattttagcatatttatacatgaaagaggctacaagtgcaattgtgtatgcaaaaagagtgttaggattggtaaattggatctcatggacatataaacgttttggatgatgacttctcccgtttctctagttgttaccaaagacaaaaagatacaattttgaagatatttcatggttatattgtcataagtcataactatccgaactagaacttagaaattcaaattagaaaaagattctgtccaatgatgatgatccaagtttggtttgtaatgtgtaaaccagctttttttgaggtaagatattaattgcgcggggaaatcaactagatgacgtgtgaatcgcgaattacaattacgtttttggatggagaactgtctttttttttcctttttatatccctaaaatactttttgtacattcatttatatcaggaaaaacagagttgtaaccaaattattacagagatattcaaagatatttcaacctatcaactaaagatgacgtgtatatcgagaataacaattgcgtttatgagtgggaaaccaaattatttcattaacatgatctttaggaataccgctaataagagattactaatcattatttgaggttttaatttaaatctttgtagtcctgattttgaatatttcgttttagctaaatcagctccaatttttcccagttatcgtttgtcgaattcatattactgttaatttagttaacttccgaagacttaaaccaacatttaatctttatgtcgttctctcaaaaattcaacaaaacttggtctcgaccgtgtgagatatttgaaatgtcagaacaccacacgtgtcgacataagcccgtaccacgcttttcgtctggatatatccaaattactttacagaaatcacttgtaattgtattgtttgttaataaaaactttgaacctttttgattactatattattcttttggaatttattctggtgacattaatgttctatcctccacgcggttctcataaaccgacttggcttctttacttttcctttatctttctctatatatttacacacacacgcatttgtacagagatattcaaagattagaaacattcttgatagatacaaaaaacattttttcagacacaaattcataaaatctttgccttgagtagatcaaagttctttacattaatcgttagaagatg

SEQ ID NO: 222 - DNA, 210 bp, Unknown
  misc_feature (1)..( 210): cDNA_ID_1690797_gDNA_ID_30942_Annot_ID_146844 3000 nt of promoter
cagtgtgatccacaatctttaaaacagaccggataaatgtatgttccttccttgttatctcggtcaactttttttgtttttttttgtttggtgaaatcaataacgtctttggctttaaacctttgcgactttgtgtacaaattccggagtgtctttctcccaaatcagcatcgcagattcgatttctcatcctaagagagctgaaaaatg

SEQ ID NO: 223 - DNA, 87 bp, Unknown
  misc_feature (1)..( 87): cDNA_ID_3090710_gDNA_ID_30962_Annot_ID_146872 3000 nt of promoter
gttttttttttttttagtgttgcagaggtttaggaagaaaggaatggttcgatcgtgactttgaattgggatattgtgtgtaaaatg

SEQ ID NO: 224 - DNA, 1618 bp, Unknown
  misc_feature (1)..( 1618): cDNA_ID_1710110_gDNA_ID_30980_Annot_ID_146890 3000 nt of promoter
tgacaaaagacatgataaagaagaaagttgaaaatggaagataatgtagtttaagaagaataattgatctggattaactttacttttctcttcaaaagtgttttacaatatacatgtggttctattttttgtttgtttaccaaataaaagatggaatagtaaaaaattattggtgattttggatcctttgtgattatattcctaaaatggtctaaaatccaatgtggggatgaaagatactattaccaatttactcttatcatatctttttttttgaaatttttttttatcttatctacatcagtaattcagtataatacaatgcctgatagaaaataaaataaaatattacaatgcctgattaagattcatgaaaagtggggcacattaagaaggtaagtgacgaagtggtgttcatgtgtcatgttgtggtcatttttctagtccataatttacttataaatactctcttttagtctatgacttataattaagtttgaatcaaaattgatagtgggatattatttcagtaagactttcttaaattttaaagagaaaaaatataaaaatggaaaagaaaacgaagttatccacaattcttgcttttcgacaagacgtaagaagtgattggtccatttgtcttttatgaactgacagttgtttggttactcgttttggatttcttatattttatccaccttttgtattcacatctatcatttggactaattaattatccgatgaagcaccccataagataaaaatcctttcctctgtatacccttcttaaatagcataacccttttttcttctgaaccctaaattctgctaaacacctcacaagatagataaaccatcttctcttatttttcttgttattacttgagtttatcaagtattattactggtaattcctcgaatttatccaattttgtttgtttttacttttgtttgtgtgtgtgtgtgttttacttttatcacgacgatatgcacgtgaaaatccagaaggtaaaaaatctctttctgctgattcttcttcgctcccaagaggcatttttgttagtattttattaaggcgagattattagaaaatcctttgtttgttttttacacacaatattaatatatatgtagatatagcctatggctatgtgttatataatcattattatttggtgctttgttcaatctatcattaacctgttttcactcaaatcatccatctaccttctctctgtaacaatcctctcttccctctaaggtttctatttgaatttttactttgatcatttgcttgaaaagtttcaagttgctgtcttctctgtgcttgctagttgtgtttggttttaattcaatgatcatggcttttattttgttttatcttgtattactgtatatattcaaatgctgattcttggatttgtagtcaaattggaacactgttgagagtcagaattatgatcttatctctgttttttcaatgtgcaaaatgtgaaacatttcttcctctcactccatatctgatctcttttttttggtgtaaagattcttaaatctcattctttgtttaactgtagagtttctgaaaaatcggtgaaacaacagaggaagcaatatg

SEQ ID NO: 225 - DNA, 2609 bp, Unknown
  misc_feature (1)..( 2609): cDNA_ID_2184016_gDNA_ID_30983_Annot_ID_146894 3000 nt of promoter
tcaacaatatataggttgatataatttcaatcatataggttatcgatataggttgataaatattagccacaaattcattgacaaaaaaaaaatrgccataaatattttgtagaaatttcatacgtattattatccattcgttatagatcagattaattatttgctcaaatctgatggttcatagtgtatacacacaaaaaaaaaaagagaaaaaagaataagagttgaattatagaaactttccaaatatgaaaaagttgggacttctgcattagacacatctaaaagaaatgcaaatggtgtaatcatatcattcgcactctttggctcttttctccgcttcttcgatcccaaacctgaagtggagactcacgcaggtcgcaggaattgtcaattattaaggggtattttggtaattctaataaaatcgtccgtacagtcccaagggtcgctttcgacctacttcactcccacttaaccgtaagtcaagctcccatctgggagaatcttttcgagatccttttaccaaagtatactatttaaaagactccgtacgttttctttatataaaaacaatctcattgaacgagttcaagagtcaagactaatgtttgatacaatcaatacactgttaaaacaacattaatgatacttgcatggcaccacatttaaatccagtagttatgaaaaaaaccaaacattgttcctctgaccaatataggactaacttaggtgagattctgtgttttcgtccattaatgttctcttttattaaatttgtttaaaaatagttaggtatgactccaaggatataccaatctatatttattgttttcatttttattcagttaatcaaatgtgaatgttacatcacaatttcgacaagggatattgatcgatttgttatcattataaatggaaagtaaagaacagccaaaagacaaaaacaatgcacatatatatgtttgattctggattcaattatacactataaattaaaatttatgtgtagctttgagtgaatccgtgagtgagtgataaattcagttttagattgatgtgaaaaaggtgaataataatataagagcagaggggaccataaagatagatatatcacatgatctcttgatcagactctgcgaagatgggcctcaatttctcttcttcccccattatttgtccctgcatatataaaccttctggttctggttaagtttttacttgtaaacgtttaaatcttttctggtatattgaaaattaacactatatagcaactaaacactctaacaataaatgtttaactataacatattattgtgctagaaacatgaatatgtcagtgaaattataggggattaatatgaaaagaattgagagagggtagggaccaagtgaggatgagttatataggctatggactttagaaaccgaaattattgggagatgacaatgagaaatggaggcgattaggtgtaactaattaataaactagactagattagtagataggggctttcgtgttcatgctcccattctcatttgttcattagctatctcttctcctcaagtttccactttttttgttttctaaagagtttttaaaatccaatactggcaaaaatttaatatcaattatggagcatgtgtgccacctacttctccttccactggtttttaagtttcttagttattctattatctcgttaagcaaataaattaaactgattttttcaattaacaagtatatcataaaatttcgttttttaattttagaaatggagctttcctcgaattttatgcagacttttgaaatatttcgtgctatatttagcaagcgtcgtatttcttctataaaataagtaaagaacccttcaaaaatatacaaaccccaagtattatcttcatagtttctgtatgcttgcttcacacaaaatctccaaactattaaatccaactaaattgccaaactgctagttccggtaatccttaatatgatggactccaaattttacaacccatgaagggagatatcaggccttaagtacataaactcaacgagcccacatagtttatctatccttattggttattggcttattgcataactcaaatgctttagagataattctcagtggcctcttagacattttttggctatgtcttgaagccccaccctgcccccaaaaaatatgggctaaagtctcatcaagaatactaaaagtgtacaatggaaacaaaaaaattctaatttaaaggttccaccgagacttgaactcgggttactggattcagagtccaatgtcctgaccactagaccatggaaccaatttgcaccgtctcacccaataatcttatatattccaagctacaaaattagaactccattacttcgtcagtaggaaatggggaataaagtcaataatttggtaatgataaagaaaaagaaagaaaaaacaaagtcgttattacataattaaagtaaactatgtgctttcacacacgagcttcattttgcctttgtatacttttgagtagatagatagacagactatagtctatataagatccatgtgacaatagttaaaatcctcatattttcatttccaatg

SEQ ID NO: 226 - DNA, 511 bp, Unknown
  misc_feature (1)..( 511): cDNA_ID_2686295_gDNA_ID_30985_Annot_ID_146899 3000 nt of promoter
aagttaggacacagaacaatcatttcgaaaatgattttgaaaaacttgcaaaaacatttggcgaggagaagatacaacgatggaaaggagctatgactaaagtcggaaatctctccggtttaatttacgagtatgacttcaatctctcatctctaatcttaattattgaatttataatcttttcatttcaagtaatattatatttttggcatatagattagtaatgatgtagtcatgtaaccatcttttcctttcatttcctactatgagtctatggtactaaaattaaccaagtttaagagtagtagaaagacgagtgaaggaatcgacactacatgtcgttctaattgactgtagatagaactgtgtggcgtttcagcgttcgagaaagaaaccatttattattagtcaacaaaagccaaaaatcgaaaagcttcccaaaatccgaaagcgttcttcgaagagcacagagttcgttgacttattgaaggagatcggaagctttgagatg

SEQ ID NO: 227 - DNA, 1478 bp, Unknown
  misc_feature (1)..( 1478): cDNA_ID_1687302_gDNA_ID_31580_Annot_ID_146935 3000 nt of promoter
ttcaagtgtttggcacatatagccacgtctcgagccatttctacttctgaaaacattcgtgtttatctgttacctgaaaaaaacacaggagattctaagttgaaggatgaatcataaaatccgcaaccagaaatgataaccatcaagccttaataaagattataaagcagtataaacgcaggtcataggtcataggtcatagagaaaacataacgtttaaagcaacgaagcagatataaaatgttttgacggctaaatagattgaagttatatagcattgaaccttatatggtacctgcataagaagaacttagttactgatcagcccactcaattctacatcagagaaaaggaatcaaccaagagacaaaattaagagcaaagtactcaaaactgaaactgctaattttacatcaaacaaacaaaaaaggtactgaaactgcagtaacaagactagaggtcaataatttctgagaaaatcacacaacctgaagtgatctcaacaagatacaagaagatatatgttgcacttctcaaagaaaatcacattaagcttccagagatatgggcattgatccacgattcagacaagaactagctacataaacatatgtaactgtctcagacaagaactagcaacataaacatatgtaactgtctgatctccaaaaacttaaaagaaatatctttttgattagacaaacgaccatttgaaaaatcactaaaccagtaaatgaaacacacacttatgttattactccgccattagaacctcatttacagtgaaacccaacatcgtaaaaatcaaaagtcttaatttttttccctctactttttcaaaaacatgataaacccaaaatcaaaatcgaaacccttaatcaccaaaattctcaaccgttccacgataaaattagacatcagttaattatcgaggtccctgcaagttctaattttacaccgagaagtaaaaaaaaaaggaacttgtaacgaaatcttcaacaacaaaacaaaatgagaatttttgcaaaattttagtagaaagcgaaaaatctaaccttgagaagaaaattcgatatctcatagagcccgaagaatcgtacgggcaaagagaggtcacgcaaaagatatctattttctactctctcttcccttctctgcataagtaactgcttttgactgaaaaattttggatcccgtcacaaggcgtgtgttattgaaatcgttttatttctgacaagatgcgcactataagtgcattttagcgataataagttatgtttctctataatacgctctttgtggtggtcctagttacgataaaccacgtatccaaacaaccctctaatcatctcgaacatcttattctttcccccgccatggataacagagtcaggagcttcgtttgcgtagctgaaggaatcaaaggtcaaatttttttgttgagagtacccaattgagagtattttctgtcggaaatg

SEQ ID NO: 228 - DNA, 1138 bp, Unknown
  misc_feature (1)..( 1138): cDNA_ID_1687315_gDNA_ID_31585_Annot_ID_146941 3000 nt of promoter
attttctgttttactctggctgcgccgcttttgtttctgcaacctgtaattcgagatttttccaagttattcagattccgcatttgatttcatctgtcatattgtttctctagtctttatctctttacttatgcaatatacttgtttacctgcatttatgtctttgagcatgttgtctgagtagtgacatagagttcttaaggatgggataaaatggttgtggaatccttaatctgtagaatggttaaggtttagaattgattgaatcccttcaggactagttgtgtttactgcttatttctttctgatcaactggaattcgatccaaggcattcccgcacccagaaggtgtttgatggaatgcttgatccactagttcctgtgatattcgtctctatcccaagggattggccgtttagagcgtttattgactttatcagtctatccttattgcctgcatagttagattgcgttaatgagaattagtctgggctagctttgcttgaggatttctatcacgagagtgaattgatctgttgttgaacatgttgtctagggatagcctgattgcacttgttaaccattcgaataggctaggataccactctattcgattatcccatccttaggaatttctcgtctatctgatttctctgttttatcgttatcgcttaatcgttctcattgcttgtttcttagtttttgcaattactcgaccaacttactggaccacacccagtgtttggcaacagactgtgcagtcgagtacagttgtctgattactcgacctcttactcgaccacatcctgcttctggcatcagcctgttgtggtcgagttattttagtaattctgttaaagtttttgttttgtgcatattcgtttgggactgttagaaacaccaaaactgttattgcttggcttgacttagtgacttctgatcacatctcatctgtttgcatcatacctgattggaatgacacctaaaatactacaacgacaagatagtgttttaggattaattgatcttaaaaacctattatcaaacacggtcacaaagaaatgagaatctcctattcaacgatatcatcgaccgtattgctcgccaacttagaacacagacaaaaacagatacaatg

SEQ ID NO: 229 - DNA, 988 bp, Unknown
  misc_feature (1)..( 988): cDNA_ID_2991466_gDNA_ID_33017_Annot_ID_146960 3000 nt of promoter
atcttctaatattttgatagtagagagttgtaataccataacatgttggaaatgtattccattttaaaatccaaaacatttttataacaattttatctactgttatcaatgtcttaaaactgtatttaagttcatcacttaaatttttttttggaaattcacagtatttcggaagatattctattaagtattaactatgttttagctttatgtgctgacttattcatgagtcatctaatgttgtggttgattccgttgcaaaattatgtctaagtttgtatggctagaacatcatttgagcaatataattaagtttgtgcacaaaaaaataaattatcacttactattaatttttcattatattatttaatcaagatgcttgcttaaaccgatctagataataaacaaaacttacccagtctgaaactacaagttcctaatagtaaatgttttgacatttacaaagcaattaagtaaaatgttatcaatgaattggttacttttctttttggtaaaaagttatgtcatttttaaatttttcacagaaaatacagaaatcacaggaacaaatgaaaacacgctgtaaaaacaacaatattattcaaagctgaattggttacttgtttagattgggtaacaaaattctaaccaaaactagaatcactaacactcattctttaccaaataatacttcaaattcaaataagagtttgattgtgaaagctgtatagctgtacgtatcatgtccatattacagttgtaagccattgttacaaaactactaaaaacaaaaataaataatagaaaggtccgagaaacttgaataaaaatttagaatttttaaaacattattatcgtaaataaaaagagaacctcccaagaaacaagtcgtccttatataaagccaaccacacccctttagcttctctcaccatcatcatcatcatcatcatcatttctctctatctctttctaaaacacaaccatg

SEQ ID NO: 230 - DNA, 501 bp, Unknown
  misc_feature (1)..( 501): cDNA_ID_75801_gDNA_ID_75757_Annot_ID_146964 3000 nt of promoter + ATG
gatctgactttgttttaatatagagaaatttaactagactataataaaaagacttcataaaatttattacccaaaattagaaaaaaatcaggtttcaatactgaaaatagactatgaatatatggccttatgattgtagttgttatattccatgcacacataagtaatttctttctatttgattttttttataaaaaaaaaatatctaraagtttaaatttaaaggtcttatatttttcagggacacaagttaaatttatcttctttaraaaatagattcttttcgacagacgtttaatccaatatctacatctggaagatttatcattagaccaaccccatggtaacataagtaatttttttctatttgattttgtttatgtgctctttaaaattaaccaagattttaacggccatagttcttataacttttaataatatctccactcacctcattctcatgaaccgaccaaacaaaaaaaagtaaagaaaaaaagaatg

SEQ ID NO: 231 - DNA, 121 bp, Unknown
  misc_feature (1)..( 121): cDNA_ID_1684752_gDNA_ID_75764_Annot_ID_146974 3000 nt of promoter
tacattaaggaccatttccttcacgcattatccaattctttcacacaaggagcaatgttactctccaaacatcaagaacaagaagaaaaaggtttgtgaaaaaaaaacaaaggcaaacatg

SEQ ID NO: 232 - DNA, 3 bp, Unknown
  misc_feature (1)..( 3): cDNA_ID_1686649_gDNA_ID_75765_Annot_ID_146979 3000 nt of promoter
act

SEQ ID NO: 233 - DNA, 1355 bp, Unknown
  misc_feature (1)..( 1355): cDNA_ID_1686700_gDNA_ID_75772_Annot_ID_146994 3000 nt of promoter
atataaagtataaaccaaactaaaccgaagaaattgaccagcttcctacaagtaggtgttggataagtttcttgctctagaattaaaaacaagtacattgtagaattgatgaatgcaatcctagaaaaaagtcaaagaatgttggcttttgatcgatgaaatgcatgtactacaccactaggaaatttattattctggctgatgtgctctgcatcaaaacattagttattcgtttacgttagaagttagataaccagttagtggcagatgtttatctgactttttttatttattactgatttataattagacttgtcagatataatgtatttaggatgaatttcttgagtttccaagttactagttcaaccgaaactataccaatttgtataattttgaagtacaacaagtcatagagctcgtgtgtaaaaacaataatagtaacgcgttgagacaaatacggacgtgaagacatgtattgtaagcacgtcgctttgtttccaagtaacaccctcaccggaaaagtccaataatataatgaaaaagataatccaactaaatcttttacaatacatctaaaacttttgattacgtttgaccaaacattaaaagattaattaagtagtatcatgtagacgatttcaaagaatctgagcaaaagtctcctgtgaccaaaatactaataagctctgaatagtaaaaaaaaagtaaataaaaaaaagtttgaaaatacataatgactcatgttaatatcactgaaagtattttaatctggattaaaaagctctagttcattgaatcgttgattaaccatagcagcaactcgacaatatataaatcatctttcgtatgcaaacttttgtcaacctttgaacacactataattaggtttattttattaacaaaattaaaatttatcggaatcccacgtccaagttgatgacgtttttggtgatttccacaaaatatgcatataaatatcaattagcttacaaatacatcaaaatagaaaaattacagaaaacaagaaaaaaaaattgcaattactatacaaaatgtaatctttactgttgacaaaaaaaatacaattcttactattatagtaacaccatagatagagaatgtcataaagcaaaaaaattaaatagtaaatacaaatcattattttttcaaatattttcaacaaatcattcttgtatatatacacacaacatcccttcaacatatacgcgtcctatttccacgttctcttacattttttcttgaaaacatctcgaggttcaaaatctttaacccctacaaatcaagaaaaggagacagaggagaagagagaaaagaaaaacgcagaaacaatg

SEQ ID NO: 234 - DNA, 3 bp, Unknown
  misc_feature (1)..( 3): cDNA_ID_1686703_gDNA_ID_75776_Annot_ID_146997 3000 nt of promoter
act

SEQ ID NO: 235 - DNA, 496 bp, Unknown
  misc_feature (1)..( 496): cDNA_ID_76034_gDNA_ID_75779_Annot_ID_146999 3000 nt of promoter + ATG
taattttaaaataaaacaaaattacttaaaaaaaaaaattattttcttgtataaaaaatctcgagcttccaagttccaacaccaattgtgttacttttgactttttaatcgagtgttttttttgttttgtagtttgcgtgagagcgagacacgagtctatgttttggtctgagtagtcgtgaaatgttttaaaatgattcagaagcggaaaatagaaaatatgataatatcacctggtttaaacattgtctttttagccctagcaagatcatcacaatctcacatggttcaacattaccaaaaataaataaaacaaaatcaatcaaaaagatttaaatatttagaaaaatcaacattaccattacatctagaaatcaagaaccaacttttctttttcctctttctcaaaaaaatatataaacgaacgttttactttgaagaaaaacaaaaatctcggagagattttactatagaaagtttcattccttctaacatg

SEQ ID NO: 236 - DNA, 36 bp, Unknown
  misc_feature (1)..( 36): cDNA_ID_2994211_gDNA_ID_76056_Annot_ID_147017 3000 nt of promoter
csaaagagattctcacgatcgagcaagagagagatg

SEQ ID NO: 237 - DNA, 10 bp, Unknown
  misc_feature (1)..( 10): cDNA_ID_1686762_gDNA_ID_76061_Annot_ID_147020 3000 nt of promoter
  misc_feature (1)..(1): n is a, c, g, or t
nccattaatg

SEQ ID NO: 238 - DNA, 130 bp, Unknown
  misc_feature (1)..( 130): cDNA_ID_1686778_gDNA_ID_76066_Annot_ID_147024 3000 nt of promoter
ccaataatcacgatccgattcaaaatcctccaccgtttctaatcccgacgacgacgaagatttacagaagtttaccgatccgtcaaagctaagacagattaaggttcagcaacgaaatcacttacctatg

SEQ ID NO: 239 - DNA, 848 bp, Unknown
  misc_feature (1)..( 848): cDNA_ID_3012624_gDNA_ID_76074_Annot_ID_147033 3000 nt of promoter
  misc_feature (1)..(1): n is a, c, g, or t
nccactattctattgagagcccatctcaacaagttgaaccatcttttttgtgtactctcacttcaccttttgacaaaaagtcatggaagccaaactttggaacactactttactttgccaacatcttgttttgttgaatacctttttcaaattggaaaccaaagccatatctaaagggaaaacctgtaggacaataaaacaaagaagtgatatctaaagtctaaactaatctcaatatatgtaaatcaaagagataactaatgaaaaatatgaaatttttcgcgaggattaatgaacaaaggattttttttttttccttctaaatttttttattagacaattggtattacaatgacaactacgaagctaatacaaaatttcggaaaccaacttattacataagcaaaattatgtgtcatatactgaaaattacgaaactgaaaaagtgaatttaacgatttttcctttcgataagctttattcgctaacatgttaacatgttagaacatagaaaatattggaaaaaaaattatgtttaaattgtcaaatggaaatatactttacacttttatttgtattaattattactttgctctcctggttataaagaaataaagtctatgattttgttagttttgttttcttgtaaatctttataaatgtgaaaagcttttgtttccaactctaatcctcaatattttatttttctgtttattggaaaagggctgtaaactaaaattatttacttgaggaacgattatttaggtgataagagtggacaatgatcgttgacacgtggacggtccacaaattctagttttgcctataagtatcaaagctcctgaatg

SEQ ID NO: 240 - DNA, 665 bp, Unknown
  misc_feature (1)..( 665): cDNA_ID_1686824_gDNA_ID_76078_Annot_ID_147046 3000 nt of promoter
agcagaattcaatgaaggattaagcttctgagccttgtttgtcacattatcctggtcttgacaaaacagatccgattttcgcttcacaggaaacgaagaatcctgttgattctcaacatccgccatagatgaatcaatcttcttacttcagagactcgcgattttggtttgaggacgacgattcagagttagggctttgaagctgaatcaaaacactcgagccaatttagtttgtaaccctagaagtttttgtagggttttaccgtctctgttttttattatttggatctctgaacacatttggcccagtattagcccatttacctatcttctcaaaatatttggttcttaacaaattcaagcctaaccattagtacaattttaattttgatttgtacattttcaaaaaccggactcgaaccaagatcaaattcaaccattgtggcaattttaatggtcgagtctccagtgtgtatgtggcagcaggagaacgtgccgggggatattaaaccggctcaatgctacagtagtaccggtttggttttctactcgttggtatataattaaaaccggttatccaatttgacaggcagagaagaagatttgattgaagtacagatccatcggagaagaagacagagagaaagagagattgaagatcaatg

SEQ ID NO: 241 - DNA, 171 bp, Unknown
  misc_feature (1)..( 171): cDNA_ID_3012505_gDNA_ID_76477_Annot_ID_147061 3000 nt of promoter
ggcctcaagaagccttatttttttcattttttaaaaaagctggttctgaagttaaacaagacaaggatgaagatagctttgtatccaaacagtcaccgaaataagcttggacgggaaattgaataacggccacatgaagaataataccaaagccgggagaagaagaaaatg

SEQ ID NO: 242 - DNA, 629 bp, Unknown
  misc_feature (1)..( 629): cDNA_ID_2991921_gDNA_ID_76498_Annot_ID_147067 3000 nt of promoter
tttttttttaatagagaaattgcaaaatgtacaaatcgaatttaggctacaggttaaaaaaagtaggttaaacagtcctcttcctaattaaccgctgccacttttactacttttttattttcactgtgaaaacttaacgacacactgtccttttttttattattcctgagacttaacgaaaactgttaaaaaaaatagatcgtccaccatccttaacggcgcaaaccccacaaaaacctagcgagtaccgttaaactccaacactcgccatctcagaccatccacgtgtccctcatgcgtagccaggttggaaagaatatatcaccggcgcgtgaaattgtcagaacgcgcgtggctttcctcaattggaaatttcacagacaagtagagggtaaaatagtcatttaacatcacccctgagagatcactgtcttcctctttcgctttcctcttcttaaaaaaagagttaaataaagagaagagaagagactctctcctcttcacttcgcgaactcagaaaaatcaaatctttctctctctctctctcgttgaaaacccatttctgtattgtgttgaagctacgttactactaagaagaagtgaagcaaaaacagaggtttttgaaaatg

SEQ ID NO: 243 - DNA, 502 bp, Unknown
  misc_feature (1)..( 502): cDNA_ID_1018625_gDNA_ID_76770_Annot_ID_147085 3000 nt of promoter
catttgccatcgcgcaccacctgatctcagcatgggtaaatcaggctcctgacgatgttcactcaaaacaacaagcgggtgtctctctctcaagtttgtagctagaaagatgaacttagatgcttagaaaccaaacgtttgctatggcttctatgcttattttgaattgctgagtcctaagtgtgtggacttcgctcgaagttatttctttgcaacgacgatttagatcaataaaaattaatcaaagattgacctcaataaatttgagttttatagttcgtttttctttagtggctgtgttcttcgaaatcagatgtttactgcttcttcctaatgttcttgttgtaaaacaaaaaaaaaagttaacaaatgagaattccactgttcttagagtacacatctccatagcgtagcattcactctccttccccagattctaaaaccccctccctagtcctcctccaaaccattttgttctttctcagagatctaaaccatcatg

SEQ ID NO: 244 - DNA, 965 bp, Unknown
  misc_feature (1)..( 965): cDNA_ID_3012465_gDNA_ID_76771_Annot_ID_147088 3000 nt of promoter
ctcgacattgagtttcctgaagattatccttttaaaccacccaaggtttgttacctactacaaatttgaaaggttaattttgttgtttacaatataaatacgttttatgacttattttttaacagtacattcaaaactccgatttaccattcaaatatcaattccagcggatcgatttgcattgacattcttaaagacaagtggactccttctctcactgttgaaaaggttcaaaaaaattgattcgtaaatcaaatatttgttttatgttgtttattttgttctttctcattctatttatttaaaggattttcattcttgttaattaagagttaataaataaatcacaagtgctcttatccataactgtattattagcggatccaaacccaaatgatcctcttgtacctgaaattggacaacttttcaagaacaacaggttccagtttgatcagagagctcgggaattcaccgagcaacacgcttgtttttgaaatttgtcatatcttttaattaatcatcatctccatctagatatatgttattgtagagttcttatatattataaataaaagtcacattctttgttctcctggaaatgaattataaatatttgaaccaaaacgtgaactgaatatgccatgcaaagcaaaatattgaattataaagacttttgaatacgactacaatagattttttttccttccgtgaaacatccatgatttatcatttccccgatcgtcacggactcacaagtctacttgaccaataatctttcaatcaacacagaatgttcaacgaagaacccgtaaacactcttaagggtttggaccttcactatcaaggagacgacctcaagtcaaccactaagtgcacatgaggattattaaatagccagagcttggaaagctttatctacaacaccaagagagaaagatacgagtgagtgagagtaagtgaggatg

SEQ ID NO: 245 - DNA, 270 bp, Unknown
  misc_feature (1)..( 270): cDNA_ID_3012455_gDNA_ID_76786_Annot_ID_147108 3000 nt of promoter
caataaaagataaatcgacgagattgcgaaacagacggtgattaaggtagtagaacaccataatctggtatgagtcattcgtagaggaataaagctctaaaatctaattatcctatccaatatcctctcatagaggtgagagctaagattttcccatcaactccatttgaagcgaaattctctgatctctcttcattttattttccctctacatctctcccaacgatttccaaatctcacttcactttggctcctccacctgaatccatg

SEQ ID NO: 246 - DNA, 34 bp, Unknown
  misc_feature (1)..( 34): cDNA_ID_1686958_gDNA_ID_76789_Annot_ID_147114 3000 nt of promoter
accattgccaaagcatattagccggatgagcatg

SEQ ID NO: 247 - DNA, 2100 bp, Unknown
  misc_feature (1)..( 2100): cDNA_ID_1687007_gDNA_ID_77065_Annot_ID_147134 3000 nt of promoter
agaaccacctctacctccatgaggacagccgcttggaactgtagaggactacgcaatgacctcgcagttcgacgtctcaaggagatcaagaagaaattctctccaaacatcattgttcttatggaaaccaagcagcggaatgacatcgtcaaagatgtgtgtagtgaagttgggtatgatagggttgtaacagttcctccagatggtttaagtggaggaattgctttaatgtgggaaagtaatgtttctgtttctgttctttatcaatccccaaaccttgtagatacttatgttaatattaatggatttgggttctatttaccttgtgtatatggtcacccaaatcaaacctatcgacacttggtttgggaaagattagaaagaacagcgactcaaagaacaggtccttggatggctataggagacttcaatgaaatacgtgggaaccatgaaaaaagaggaggaaacccaagaccagagagctctttcattgacttcaggaaaatgcttcaagtatgtgatttccaagacctcaaacacttaagtgatcccttctcttgggttggaaagcgacattcacatgatgttgcttgctgcttggaccgctccttggtcaatacagaatggttaacccaatttcctgcatcacatatggagtttcttgagcttatcgaatctgaccaccgtccgattataacgacaatcaccagcgattttgaacaacaacataaccaattctgtttcgacggaagagtggtcgaccgggacagatttagtgatgccattcgccggagctggaacaagagatttgacaatcacgatgatactctccgggcacgactcaccgagtgcagaagagcaatttcacaatggaaacggcgttaccggtctaatgcgcaagaagacatagccctcctcaaaaaaagaatagacagagcacatacagacggttcatcagttcaacgcatctgggcacttcgcctccaattatcaaaggcttatgctgatgaagaagaattttggcaactcaaaagccgaaagacttggttggcaagtggtgatcgaaacacgaaatatttctttgcctctacaaaaatcagaaaatccaggaatcgaatgcactctatctttgatgatgatggcgttgaacacagaggcaactctaatataggcaaggtggctcagcacttcttctcaaatcttttccacaatgatctaacaaccaacaacaatcactaccatgtcttaaacggattcacacaccgagttacttcagacatgaatgatgacttaacaaagaggatcacataagaggagattgcagaagctgtattctctattggaggttccaaagccccaggcccggacggattcacaggagatttctatcacaagtattgggctgatatcaaacaaacggtaatgaaggaggtacataatttctttgagaatggcgtctttaataaatccatgaaccacacaaatctatgcttgattccaaagccagaacatccacgacacaggagtgattacaaaccaatcgccttatgcaacgtgagctacaagatcatcttaaaaattcttgttggtcgcttgaagaaacatctatctagcatcatttcggaggaacaaacagctttcatcccagggcgtgtaatcactgacaatgttatcatttcgcatgaaattacacacgctttaaaagtgaagaaacgatgctctacctcttacacggctatcaagacagacatcaccaaagcatatgaccgccttgaatgggacttcctgcaagcaactatgtttaagtttgggtttgatgttcgttggatagaatggatcatgacttgtgtccgaactgccaccttctaagttaatataaatggtgcaccatatggattcattcaaccggaacgaggcatttgtcaaggagaccctctatccccatacctttttattctatgtgcagaagtcctcagtcatatgatgaaaaaagcagaacaacaagggcacatcaaaggaatcaaaataagcaacaagagccctccaattagtcacctcctttttgctgacgactcgctcttcttctgtcaagcaaacatg

SEQ ID NO: 248 - DNA, 1534 bp, Unknown
  misc_feature (1)..( 1534): cDNA_ID_1687027_gDNA_ID_77070_Annot_ID_147139 3000 nt of promoter
gttctgctaccaccaaggcttctcaggtgttctccaagtgtatgttcacaacgcaagaaacatcaacaacatctgcatctacgataaccaagacgtctacgccaaattctctctcacatacaatcctgacgataccatctccaccagaatcatccatagagctggcaaaaaccctgaattcaaccagaagcttatgatcgatgtaactcagatcgatgctcatgctgcagttctcaaatgtgagatctggatgatgagcagagccagacattacatggaagatcagcttcttggtttcgctcttgtcccaatctcagacatcataggtcaagacagtgtaactcaagactacagtctctcctccactgatctcttccattcccctgctggtaccgtgaagctcacgctttccattgttaacccttcttctacttcttcatctaatcccaagattaacaccacttcgatttcttccgaggtcgtgttgcttgaccctcaagtctctgaaacagtagattacacgaggattgagttccctgacatcaatgttgctaacgagaacaaacagatggttacagagtacttcaatgaatccggaaccggttcatttctctgtctcggctcaacacatggaccagaaacggacataacaatggtgtgcttggaagaaaaagagctttatgggaatggaagcttcatggcttcttcttcaacaacaacaagcttaagcgacgaaaagaacacagcagattcaaacgagaaagagaatcgagagataacagaagtatcaagaagaagaagcaaagaaggtgaagaagaagaggaagagaataagatgaatgaagaaacaacaatgcagaaacagatagcagagatgtatatgagaagtatgcaacagttcactgagtctttggcaaagatgaaacttcccatggatcttcataataaaccacacgaggaagatcacagtaacaataacaacaacactgcaacacagattcagaatcagaataataatgctaataataatggtatggagaagaaaaaagaagggtctcgtgtgttttacggtagcagggcattcttttaatggaatcaacaacaacaacattgcaaataagttgtttaacattttagcttcttctatgtttgattcccataatcttccctcaaccaatttttataatttattaaccggaaaaagtcttatttttgtggatgtatgtaatttcaagcataggtttatgtcaaatctaataaaaagtgcatttatgtaaaagaaaaaaacaattaagagcctaaaataatcaaatatctaaataatgtgtcgatgttaacagatcagtctgcaaaacccaagatttgaagttactactgggcccattaaaagcccaataaggaattcaattcattaatttgttaagactccagaatggcagaatctcttgaccgacgttaagggcactaacgactccgtctccggtcataaacccggcgagtggtgaactgagaaaattgatagccgactacaatg

SEQ ID NO: 249 - DNA, 1658 bp, Unknown
  misc_feature (1)..( 1658): cDNA_ID_1687041_gDNA_ID_77075_Annot_ID_147147 3000 nt of promoter
ggttgtcaatccaaatgggtgtgatgctaacaatcaagatgtgatcagaggtcactaagtcaagccaagcaataacaggttttggtgtgttctagcagtcctaagtgaacatgcagaaaacagaaaatcaaacagaaacagtgaaacactcgaccaacacagctctttgcagagcactkggtgaggtcgagtaacagacagaaaataaaacacagatactcgagtgcacagtctgttgccagacaactgggtggtcgagtacgaggtcgagtaagaagaaaaaattgcagaaattaagcgacagataacaggatgcagtaaacaataatagagtaaacaaagaattcaatcagataaagaattcccaaggatggggtaattgagtagtttcgtttcctcagtttacaggtgattgacatgctcaataaattaaccctagacaacaagttcattaaccaaatctaagtgccaccacaacagagactctcaagttaacctagtcccagactcaatcaccattgacgagagctaacctaacaggcattacgaatcaacaagttaaagccaaaacgctccctgcaaccaataccttggtacagggtcacgaatctctggaattagtggttcagacatttcatcgaacaccttttgggcgcggaaatgtctgggctcaaattccagttgattagaaagcaatcacctagcatactgagaattctacactactgtaacccatactcagaaacctattcactactgagacatcataacaatgatcataaacgttgaacaggttgaaaacatgatagcaacagtgtaacagcaggatgataacagaatgaataacagtaaacgaaatcaagaacaaaagctgaatactgaatactgaatagataaagagaaatccggattacaaaaggtctagaacaaaaggtctgcgggataaaactagataaaaacttcttgtctgcgaaaatgtgaagtacatgctacttatagccaaatattccgaaaccctaatactcaaaacgacgaagtattgggacggattaagaactgtactcgaccgaagtggtcgactgggaggtcgagtgaatagctggagtcttcttttcttccttgtgctcgagtgtctggttgagtgcggaatgaagaagactctgaagcttgccatcgagggtgtagtcgagtggtggtgaaagtaatactcgacttccaggtggagtgatgaggtcgagtggtggtctgatgatggagatgagggcactcgacctcgtggtcgagtgatgtgatcgaatgatggtctggtgatggagatgagggcactcgacctcgtggtcgartgggttgaagtgaagtggtgatgtcttctattcgacctgggggtcgagtggtctcttgagatcttgaagctcctactcgacctctaggtcgagtgggtttgtcatgattaggtccgcttcttccagttagctcgttaacagctccaaatcacctgaaatcaacacaaatatgcaaaatgcatgcaaacctatcctaaacatgtaaagtgatgacaaatgatgagaaatggtataaaacagtgatgatatgatgctaatgtgatgacaaatggatgctcaaaacatgcaaaatacacacttatgcaacagccaatg

SEQ ID NO: 250 - DNA, 422 bp, Unknown
  misc_feature (1)..( 422): cDNA_ID_3012422_gDNA_ID_77080_Annot_ID_147150 3000 nt of promoter
gaagaccgattctaagcctagcaactaataatttgaagttatcttattatattgtatgaacagttttttcaatattttttgctctattaatcgaatctcacaatcacattagtcacgttacaacgaccagacaatggtagtaacaaacaaaaaggaccatacatttttttttgtttaacaaaaacgaccatacatgttatcgctacatgattttctctgttatttttattttgtatctcacattgaacatgtggacgaagaccttcgtatatatatattttctaatgacacaccaaaaactgaattactactactagtagaaagtatatataaatgcgaagaagacatataactatcattcagagccaaacataaaaaaaaaatcaatacatatgcaaatatatagcaacaaccgaacgatg

SEQ ID NO: 251 - DNA, 416 bp, Unknown
  misc_feature (1)..( 416): cDNA_ID_3409291_gDNA_ID_77238_Annot_ID_147154 3000 nt of promoter
maatgagatttccctgcattaaatttttacaattagtaatatattaaaaactgtgaactaattccagaaaaagtgataaaaccaaaaataagaaaaaaataataccaaataatattaacattttttagttttgtttttttaataaagagagaaaaaaaaagagagtgttgtgtgattttatttgttctgtcgaaatctgggaatcatctgatactcttcttcttctcctccttcatcgatttgscttcaatcatctatcggcgacgagctccatccggtttgtctcctaatcagaatctctgatttcccgatccggctaattcctcatcgtcggatcaattagattatcttatcccaaggagaggagtgtgtgtgaatcggagagagcgagagacagagagagagagagggaaatg

SEQ ID NO: 252 - DNA, 347 bp, Unknown
  misc_feature (1)..( 347): cDNA_ID_1687073_gDNA_ID_77251_Annot_ID_147160 3000 nt of promoter
aaaaaaaaaaaaatcagtaatctacttgctactaaaacaacattaagacaaattaggtaataaaatattataattccttttgtcacattaaaatcattcacattcacactatataattccatatccgaaattcaaacataattttagccgtaaagtcaaagtaatggcgtgttgactaaataatgttttaacgattttctttccaaaactattcttaaagtatttcactttgagccatacaccgttgaccacttcaataccttcgcgcttctcttcttcttcaccaccacacacagccacaatcttttgaaatttccctcctcatcatcgtctctctccgatccatg

SEQ ID NO: 253 - DNA, 2686 bp, Unknown
  misc_feature (1)..( 2686): cDNA_ID_2026192_gDNA_ID_77261_Annot_ID_147167 3000 nt of promoter
  misc_feature (86)..(86): n is a, c, g, or t
catcgggtctagctcctctcatcgcttatgattgttgtgatcagagagagatcgagcagctgaggaatgttggaagtgaaaattgngggaatttatattccggctcgtccaccacaaaggacaaaaacggttaagacaaaccggtttttacttttcccccaaatatcaaaatcaaaccgggtttagattttccaccaaaaaccaaaccggttttagcttcttctttgaatttttgttgtgacggaggggatttgctttaaaagtttagggcttttaaaatcggcgacggcgagcggagaattcccaaggaagagtcgatgaagttgaaatcggtgttcgatgcttcggaaatcaaatcggaatttgaatcagcgggaataaaccctaaattcgcgattcaaatctggaagtatgtaattcagaatcctgattgcgtttgggacgagattccttcattgccttccgctgcatactctcttctccattccaagttcaagactcttacttcgtctcttcactcgctatttcattcctccgatggcaccacctcaaagcttctcatcaagctccaggtactctatactctgttactgtatacaacacattgcttttatggattctgaaaaacttgtaatgtctctgtttcctgacgaactcatattggattcttgcttttggttttgaaattgaagaatggagcttttgtggaagctgtggtaatgagatacgatactcggttggggatgttaggagggaaaccacgtcctggaggtataagatctacgttatgtatttcatctcaggtattgatttttatcacgcaatgttatcttggttttatcgaatgaaagacatgtgatgtgaaagtatttatcaataggttggttgtaagatgggttgcacattctgtgctactggtaccatgggatttaaaagcaatttaacatctggagaaattgtggagcagcttgttcacgcctctcgcattgctgatatacgcaacatcgttttcatggtatatttctgcttctgttattgcattttatctacactatgtgcaccttgccttatggttatttattttatatactctgcattgatgaattttattcaccagttgttgccttggtttgatgattgtgatcagggaatgggagaacctttaaataactacaatgctgttgttgaagctgttcgtgtcatgttaaaccaaccatttcagctgtcgcccaaaagaattaccatatcaactgtaagtactcagaaagctaccttgaaacattcgtaaaacagagaaacttattcactgaattttgtaggaatactttagattatggaatttgataaagggaactgatagataaacttcaatccattaaacctcgcagtatgcagcttccaagacatctttcagctttttttgtctagttggttacttttaaattttggtgttttgggattttcttctgatttccttgtccttccgtaatgcttgtaccgtatattccaggcataaatctaaatcatgcaatgctgcctgtgttgacacttttttttactagttagcaaataaatttccctgtatcctaatgtcatttgcataggtcggaattgttcacgcaattaacaagctacacaatgatctacccggtgtaagtttagcagtatccctccatgcaccagttcaagaaatccgctgccagatcatgccagcagctagagcctttcctttacaaaagcttatggatgcacttcaaactttccaaaagaacaggtagttcatgtactcttgactggttcgttgctgttaaatattaaaaccacaatcccttcagttacattgacgattataacattatgccacattgtcattggatttaacagtcaacaaaagatcttcattgagtacataatgcttgatggagtaaatgatcaagagcagcacgctcatctactaggcgaattgctaaagacatttcaagtggtaaatcttcgatgtcttaatactcttaaaggttctgcaattatctgatgatattttttatggaaactctgtgctcttttcttgaacaggtcataaatttgataccatttaatccaattggatccacaagccaattcgaaacaagcagcatacaaggcgtgtcaagattccagaaaatcctgagggaaacatacaagatccggactacaattcgcaaagaaatgggtcaggatattagcggcgcttgcggtcagctagtggtgaaccaaccagacatcaaaaagactcctggaactgtggaacttagagacatagaagatctgcttctctaactttaggaccagagacatgaaacagacatttggaatggttgtgtagtatctttgaagccactcttcaaaacccttttcttaaacttcacattttgtcctctcatcactttgtggaaaacacttggctcactcttatatgcaagacaaacagttatggtccttggtccttccacactatcacatggaggtttaacttctcttataaaatattcaccaacaagtgatgttatgtcatcgttaaagttggaagtaaatgttaaactttaattttaatgaagtaaatagtagctaattagcttctcttcccgcctataaaactagctcctcactctgtcttctattccataagagtaaaaaaaacagagagatg

SEQ ID NO: 254 - DNA, 1012 bp, Unknown
  misc_feature (1)..( 1012): cDNA_ID_1687158_gDNA_ID_77498_Annot_ID_147197 3000 nt of promoter
agctacggcaacatattttcccccacgagaaggagaatagatctgtgattgttttcttaatgctttccaatttggttcggtttgtgtttatttagttggaattccagttcaaaatcctgaagcgaagcagcttgtaaatttggatcttcatatcttccctactctctcgacgttgcatctgtacacggtaggtgcggaagctaactgttctcttctgtctctgctgattttatactcctttgaaggtatcttatatcatttttgcgggtacaagtaattatgttcgactgcatataaagttatttgatttgaattgtccggttcgcattaaccaaaccaacttaagctttcagttcttttttcttcccgataaaaagcaaactttcagtttaagaagctgagacatccaaaattcaatagcatcatcagctcatcacgatgcttctctgtttataatcctaatcaattttgcaactgggcgttgggcctcacctccgtaacccaaagtcaaacaattccggtttgtttaccgaattaaaccggtgattaaagtagaaccaacaacatccacacttggttttaaaaaccctcaatttcgtttgtctgctgtcttcttcttcttaaagttggatgtttcggctactccgatgcatttgcatgtattgtcgaactgaaagtctgtgacttttcttctcctctacgatagaaaccagtgacctagcactcccaactctcactcttatcactggacgcattctccaaaattttgatcttcgattaagccattcgtagcgaggtaaatgctcaagttttacctatctcctctgcttccactgattctgtttcttgattcaaagttttctttgtgtgaattcatattttcgtgtgaattgtgaattagggttttctctgttcccgtttctactctctcatcttttggggaaaagttgtcaactttcatgttttacctgtagccgtaataacgtactcttaatctcgtgtacgcaagatg

SEQ ID NO: 255 - DNA, 158 bp, Unknown
  misc_feature (1)..( 158): cDNA_ID_1687163_gDNA_ID_77500_Annot_ID_147199 3000 nt of promoter
tcgcttactcaatcaaagttcttcaaatttgcatatctgattttgcttgcgtctgtttccggcaactcgttatacgtttcttctccgatttgggttctcttattcaaattgattaaacgtgatttcagagaagaagaaacactaaacaaaaaagtatg

SEQ ID NO: 256 - DNA, 2081 bp, Unknown
  misc_feature (1)..( 2081): cDNA_ID_3012350_gDNA_ID_77863_Annot_ID_147222 3000 nt of promoter
aaaaaaaaactaacggaggtagacaatagtttagctggaatgcttgaagaaatggcaagaatatgcttcgagaagttatgatttatgaagaggttacctgcaaattttttcatttctttttgccgacggttggctgttagttaggaaaaagaatttttgttataggattttctcttccgtttcgtacaaacccaatcattattctcgtctttatacttaactttgcctctcattttcatgttatcaatcttttaaattaaatatatcgtcaatgactgttatgaataattagttcttcattctctgccttggttcgaacctcagtcacatggtgcacgttattgtgatttcccatacctcaagagttattcaagatcccttacagaaatatatttatataatcttttatctaatgtagttatttacaaacatgtattatctaccaaaataaaaagggctaaaagcttcttgagtgagaccgcttttggttcgattcattttcctacactccaatagtattacactattgtatataacaagaatcgtgggatttgtttaatccgtacaatgaaacaagaaagatatacaataacttaatatcatttttttttggggacaatcttaatatcatttctaatttctatagaaccaaaaacactcataacaacttaaactttgttttttgtgagaaaaataacaacttaattactagttactacattgacaatttaacatcttcagctaaaaccgaatgtatatgaacatttataatctagttgctattgtatatacgattggataatacgcatatcgacatttaaataattgagcctgaagataattcacaaatatgcaatgtaaatccgtccatacagccaaaagtatgtatgtcccatgcataattgaacaaaaagaaattatattaatattatttttgttgtcttctgcaaatgctaggactgctatcattatcatcattgattttaatattgatgtttccagaaaaataaataaacaaatataaagaaaaaaacaaacacaataagtaaagctacactattaggtaataattaaagctcatttttaagtctaaaattttaattataaaataaaaaacattaaaaagttaagacccaaagaaacataaatgcttttttctttcatcaatgtcaaaaaagaagttttcccaccaaatggtcaaacttggatctttgacaatattgttccaatttcatcatgccctatcttttctatttatacacataccttagatataattattaaacccaaaatttgtgttaagaaaaaaaatagacccaaaatttggaatatatatataagtcaccgctggaaaaaaaattattgcaagtaatttcttatatgaaattggaatgataatattttgttcaagtatccattactaaaattttacaacgctagataacgagattgcttgaagtcgaacttgtgaacaaattataataatgtaaaactaacttgtattgactaatctttgattttttttacaataatgagtgatattacattcattttattaactaaatacaacgaatatgataaatattcagtcctcttataaactttatgatagtgaaaatttgagacattgacaattctagcattctaacattttatgagattacatgaaatgtcaatttagaccttaaaccaaacgaatacatgattcaaatttgaccgacaagtacatgatgccttccctttgatcacgaaatttccacaaagagtccgtgtctgcgtaattaaccagcaatttcaagggtgtttacgtaattgtagcttaacaaataaaaaacacgaaagaagatggcgaagaaaacggaaagtagtagatagataaagaaagagaaagagaagagctggattcacatggtcttgttctttctctctccttcttttctcatcttgcggcttccctttctctctctatcgccacaatgatcattaccaaccaaactgattgaaactcatttgttctctctctctcaaatccactctctctctttcttttctcttctcctctctgtgtctctatcgccatg

SEQ ID NO: 257 - DNA, 1192 bp, Unknown
  misc_feature (1)..( 1192): cDNA_ID_78177_gDNA_ID_78081_Annot_ID_147242 3000 nt of promoter + ATG
tctgtgaggaaggtccgaagaagaatgacaatgatcaggagattggagatcttgtgatatatgttgatgttagtgatattcctctcttggaatctgcaatcactgagacacacaatgatgataatggtatgcaactagtattataaataactagccttaaccatttttcttgtttacatttctaaatcaaatcttctttctttcgcagagtccaagaacgttctagctattgataggtcagtagaccaacaagaaacagaacatgcaattcaggagaatgatgctgagccagagacaaaggtgaaccaaaccgatagtgatgctggtgattcaaaaaccaaacaggcaattcaggagaatgactctgaacctgagaagatcaacaattttgatgaagagacaatggtggaccaaaccgacagtgattccgaaacagaaccggaagaaaatcattctggtgttgactcagacggcactatctctgaagctgattcgaaccaagccgtagtgggatctgatattgcggatgaagagatgactctttcgggatcagaaggctctgctgctactgctccaaattcacctcctcgtcttgaagaggctaaagtcatcaaaacaactctggtatctccatttgcagtagaatcaatctcaactcaattcccaagaccaagcaaatcaacaactccattaaagaactcgcctctgaagctggtcaatgagaacaaggagaacaacatggagatgatgatgatgaatgttaacaacaatgagaatggagagagcaaaggcgaggagggtaagaagaagaagaaggtgacaatcgatgaagagaacttgaaaaatacgagcataaggcaactggagaagatggtgaaggaactttctataaagaccagtaacagaactgcgttgcaggtattgcccgggaataataagactgcagagtagcgagggagactcaaatgtgctttgtttttcttttgttgtctcagacagataaacaaaaagtgttgttccctttggtttgaataaaaaacactcaatttggaaagagatcttttgtttaaatgtgttgcaatgtgttgattttattacaaaataataagctcaaaatactcttttaagttctggttcttggaaattcccaaattgtttttaaagagctgttctagggttttctccgatcatg

SEQ ID NO: 258 - DNA, 152 bp, Unknown
  misc_feature (1)..( 152): cDNA_ID_1019253_gDNA_ID_78089_Annot_ID_147245 3000 nt of promoter
acaaatcatcaaatctggaagacaaatcattaaaaaaggcgacaactttttttggttcagattttgaaaatttgattttttatttttcttatcttggcgatcgaatcctatccgaaagattgaaacttgggaggtgggtaagtgagtgaatg

SEQ ID NO: 259 - DNA, 221 bp, Unknown
  misc_feature (1)..( 221): cDNA_ID_1685680_gDNA_ID_93807_Annot_ID_147266 3000 nt of promoter
aaattagataatcattctaaatatatttttaaaaaatattaattgactctcggttaatccaatgactcgatgagtagtcttgcttgccatccggagccatccggtttgccatccggttcggtttaaaaacattggttttttcacgaattccaaacttaaagtatggttgttcgttcaattatcgtttcacctccaacaactaaacttattaccatccaatg

SEQ ID NO: 260 - DNA, 2274 bp, Unknown
  misc_feature (1)..( 2274): cDNA_ID_94091_gDNA_ID_93827_Annot_ID_147276 3000 nt of promoter + ATG
atcgtcagtttcataacaatgcaatttcagctatgtactgtcttcttcacattttcccttggtacaagaacccattattttggacggacaattctccatggtggtgcaagggtatattctcattctcggttcttaaatctctgtaaattttttggaatgtgataaccattgtttgttaacagtaccaagccactggaagaggcttcgtcgtgaagcatatcaaattttctgaaaactaccgtctttattccagaagtcattttgtcaaagcgtaatctcctcttctttagttcttatgtatatacatttctgatgtatacctgtttagccatagtaaaggattgaaaattcattgatatgctacttctttttcgtttctctagaatggaagttattcttttattggttgtgtaccttgcgtatggcaatgatgaagctggtgcggtttcctacatcctgctgacagttagcagctggtttttggctgtttcttggctgtttgctccgtacctattcaaccctgccggatttgagtggcagaagtaagtggtgctatcttatttatatcatgttgagtgttgagtaacgtgtttctcattgaacaacaataaaattatgctttcagagtcgtggaggacttcaaagaatggacaaattggctcttttacagaggtggaattggtgtgaaaggagctgaaagctgggaagcatggtgggaagaagaactggtaagaactattctcagaaagttttcttgcttgtctgagaactaatttttctaacttagaaaataattattatatctgtgtgtcgacagtctcacattcggaccttgagcgggaggataatggagactattttaagtctacgattctttatcttccagtatggtattgtctacaaactgaagctacaaggatcagatacatcatttgcggtagagcgctccccttcattgactacttgtatctacgcctttgcatatcttagtctgctagtatttgtgcttaataatatcactcatctatctgcaggtgtacggttggtcatgggttgcatttgcaatgattatagttcttttcaaggttagtttattccatcagcatgcttcattttccgataacctttgatcctctgactaaatttgattacatgatctgagatatctcccatgtgaactttgaaataggtctttaccttcagccagaagatttctgtcaatttccagcttttactgaggtttatacaaggtctatccttattgatggctctagctggcataatcgtagcagttgtgctcacacccttgtcagtgacagacatatttgcatgcgtattggcttttataccgacaggatggggaattctttctgtaagttgttcttcttgctcacctcagataccttgatttctttctcatctctgcagattcctcctaattttgacaaacaaatcttctcccgttgtagattgcgtgtgcttggaagccagtcctaaagcgaatggggatgtggaaatcgattcgttccctagcaaggctatatgatgcgttaatgggaatgctcatatttcttcccgttgctctctgctcctggttcccttttgtgtcgaccttccagacacgtatgatgtttaaccaagccttcagccgcggtctcgagatctctcttattcttgcaggagacaatcccaattctggtctttaaacttttggaagctgttatgtttatgtttttcatacatttatttgtgtttagttttccgagtgtagcagtagtaaatgatgggagcctctctgtagctttaggcattttaagacttctgtaacatttgtccccaaaaaagaaaagacttttgtaaaacataacctagaatctttaagatattacgtagaaatgcctttggaaagaaagcgattcaaggaacaaagattaatttattcattaacggtaaaagaataaacctaattactggatccagtcattaacgcgcatgttatgtttgtcgttgttgacgaatccgtgatttggatcctttgaatgtttttggaagtattagtggttagggatcaaataaagcccaattattcgacaggcccatctaacaaaattggggacctaattccaggcgctgaaaggaatcgctggcacaagtagaaggttctagtcggaaggtctcagaagtctgtctacagaggtaccgttggggcagagagcaacatattactagaaaactccagagttcgttattggagcttctaagcagagagagatg

SEQ ID NO: 261 - DNA, 21 bp, Unknown
  misc_feature (1)..( 21): cDNA_ID_4254519_gDNA_ID_93827_Annot_ID_147277 3000 nt of promoter
atcgtcagtttcataacaatg

SEQ ID NO: 262 - DNA, 42 bp, Unknown
  misc_feature (1)..( 42): cDNA_ID_1685745_gDNA_ID_93838_Annot_ID_147290 3000 nt of promoter
cataataacggcgtagtttcagaattagacagtgaggcaatg

SEQ ID NO: 263 - DNA, 3 bp, Unknown
  misc_feature (1)..( 3): cDNA_ID_1685795_gDNA_ID_94265_Annot_ID_147314 3000 nt of promoter
tgg

SEQ ID NO: 264 - DNA, 106 bp, Unknown
  misc_feature (1)..( 106): cDNA_ID_3012143_gDNA_ID_94274_Annot_ID_147324 3000 nt of promoter
tgtctcataattcctgttcgctctctctatatgtatgacattgctttgttcttgacctggtttcttttggggtaggatgcgggaagggaggtgacgggtgaagatg

SEQ ID NO: 265 - DNA, 200 bp, Unknown
  misc_feature (1)..( 200): cDNA_ID_2731470_gDNA_ID_99055_Annot_ID_147327 3000 nt of promoter
actacggccttattatatcagttgactagtattatgtcctaaacgacaccgttcttaattagtaacattaaatgacgtcgttttataatcgcttaaccactggctattagttcgcatctcaagtcgtctctgccatttttggctttttaatcaaaccctagagagattgagagagcgaagagaagccatcatcagccatg

SEQ ID NO: 266 - DNA, 1360 bp, Unknown
  misc_feature (1)..( 1360): cDNA_ID_99140_gDNA_ID_99056_Annot_ID_147329 3000 nt of promoter + ATG
tcaattatgtaacaatcctaggcgagctatttaccgggttttagagatgtatagactctttaccttctgtctgtttagatattatgttgtttggtagtaacaaaagagctggcaatgtaagggagagaaggaaacttactagttgtaaacttaggttctcttacaacgttcacatgttatctcacatacaaaatgttatcaggataagaaaaccacaaaaaaaagaggcaaagaagtgagatgatcctagcagagaatcaatctctagttcatcgtcctaacaaagcaacacgatctgactgtacagcttgagtaaggttgatgtcgaaaagctcgcaacggataggcatttcaatctcatagaaaggattcttcaagacgtaatcagtgtagagttcataaatgtatctaaggaggctctccatgtgaggagtcccaggttcacaaaccacaaagaactttgttcctgagatatgatcagttatagagccaagtcagtaatcaagagaatgtgacggtatcttcttgcaaatggcgatgtatgattacctgggagagactggaaacaatggagatcgaaagtgtcggcttcgagaagctcgatgccagaacagccattgacaggtgaaagctgctgagaaatggcgtgcattgaatgccataaactagctactctcaagctatcattcgtatccattcttccctttgttccacaatcctgaatttttcccaaatccaaacacacacagaacagatcaaaattcaaatccaatttctttagtagctattcacaacccctagattaataccgaaaacactccttctactaaacctagtgatctcaaaaatttcatcttttggtctatccctcgaaattaacatcaattagctcgtcattctctagacatggaaagtccacaagctgcgagatcgagaacaagaggaagatggagagatcgtaccttgtagaatatcaaaccaccagatttgttaattatgtaaagactgtaaatcgctgccatttttttcccccgataatcttcaaagatccaaatccgagaaatcagcgagacgatgaagaacaacagtacagatcttattaatgatttttctttttctcaaaacggcgtcgttattatatcgatggtctctactcgcgccacgtcgcctaattaatttaacgacgtcgtcttttaaagaactagcgtctcttaaagcgccacgtgagctaatgtttaaaaaacttcaccaaaaacggtgtcgttttaataacttttcttcaccaactaccaaaaacgtctgaagaagaaaaaggtataagtaaagcagagagaagagcaagggagaggtactaaaaatg

SEQ ID NO: 267 - DNA, 1784 bp, Unknown
  misc_feature (1)..( 1784): cDNA_ID_1007243_gDNA_ID_99056_Annot_ID_147330 3000 nt of promoter
ttattatgtgttgtttgtaggtagttttagtagaggagcaaaacagagaaatgagattgtgtggttatattacaatgtgtgttggccagtcctctaagccatcgaatatatgagtagcgtagattatggttgctcctcgttcttyacattcctttctcagaaacttcaaaaggtctgctctagcgagaacgtcaagatcaacagttatttcatccaaaaggagaacctatagatgattcaagaaagtaggattcagataaattgttgaagcaagtttcatgattagatactataatgatcttagtccattgttttaagcatcaaaccatttcatcttctgaagcatcaggtttggctaaaacctgtatacttttggttggagataagggtttaccttgaatggcttcaggagtcccatacagatctgtacacgtcttctttggccatcggataccttgtgcagtctccatgagatgtcgatatccaacacctgaaccaaacacaattagaacaaaacagtaaggtggagaatcacattgatttgatgtaaaaaaacagagtaataatactccagacaatgaagtgctcgtaagtttggtatgtgacaaagatcaaagatcagaccatgctctagctgattttttgttttaacattggaattcagaatgaacaaatgagttaagactatagcaaatacttaaaaagtaaatttgaatccttcccaaaacttcaaagaatctcatgtaaagatgcattaacagaacctaacccatcaaatcaaagtcagatttttgaattatctactcaccttgatcaactcatctcttctctgaggatcaataccagccactccaaatatcatcttctccgccgaaatgtccatttgtatcggaacttcaaatcctgcaaatgcaacatcacgcctccactggaaagaagaattgacaatcccaattactttcaattccaaatcaatactcagaattcacactaaatttgttatccaatcacatccacagaaacacaaagaattgaaaattcatcacgaacctcgccaccgagataacagagatcaccagaagaggtcaatccagtatcatgaaacgccgagcgacccagaaccctaaccatatgcggctccaccatgtgtttccctcccaatatcttcagaattgtcgttttccctgatgattcaaatcactcatctaatcaaattgagatctcatacagacacatttcgagctaaatagataacgaatttcaaataccagcgccattagatccgacgaggagacaccgatcgctggaattaagcgtgattgagaaatcttcaataagtggtttcgatcccggtggtggatgaccgtcgattccaggatacgtgaaacgtaatccggagatctcaaccgttgaattccgcttcttctcctcctccgtcaccgccatttttagtacctctcccttgctcttctctctgctttacttatacctttttcttcttcagacgtttttggtagttggtgaagaaaagttattaaaacgacaccgtttttggtgaagttttttaaacattagctcacgtggcgctttaagagacgctagttctttaaaagacgacgtcgttaaattaattaggcgacgtggcgcgagtagagaccatcgatataataacgacgccgttttgagaaaaagaaaaatcattaataagatctgtactgttgttcttcatcgtctcgctgatttctcggatttggatctttgaagattatcgggggaaaaaaatg

SEQ ID NO: 268 - DNA, 603 bp, Unknown
  misc_feature (1)..( 603): cDNA_ID_3012251_gDNA_ID_99069_Annot_ID_147335 3000 nt of promoter
taggmttttttttttttttacttttcgaaaagccgatccagatttttgataattttgaagaagaagatgcaacaaaatcaagtgaagaaggttcgcttcttgctctctatctctctcaatcatgctttgattctaaatgtgggaaacagaggataaagtcttatccttttacaaatttaaagacaaaaaaaaataaaatctttcctttttcaattgcaattaggtttggttttgttgcatgagcataaataagatgtgtggataaagtttgtgttttgtctacttttgtgattcactagggcacgaaagagatggagtttttcacagagtatggtgatgcaaatcagatataggattctggaagttattggtaaaggaagctatggagttgtgtgtgcagctattgatacacatactggagagaaagttgctattaagaagattaatgatgtctttgaacatatttctgatgcgcttcgtattctccgtgaagtgaagcttcttcggcttttacggcatcctgatattgtggagatcaaaagcattatgctgcctccttctaagagagagtttaaagatatctatgttgtgtttgagctcatg

SEQ ID NO: 269 - DNA, 450 bp, Unknown
  misc_feature (1)..( 450): cDNA_ID_3012255_gDNA_ID_99073_Annot_ID_147340 3000 nt of promoter
atgagaagagcgctttagatggaggaaagataagagccacaaatctcgtctatgaattctgagccacgaaaacaagatctacctcacgcgccctttatctcacgcgcttccccttacttgtggttctcttacctcctcggaagttgaaacattacaacaaacacattcgtcttcttctttctctctttctctttggtcttttttttgcttactgttgaagaaaatttaaacaaaggcttctcttgatttttgaaccaatcatctttacttcatctgagggtttctgatttgggtctgattcaaaactctctcatccgttcactacaaagtgagtttctttctctttgtgcttgttagatttgaatccatacatttttcgaattgtttctgaaagtagtgagcttgatttgttcattcatcaggttgatagatcgatcgattgattttatg

SEQ ID NO: 270 - DNA, 817 bp, Unknown
  misc_feature (1)..( 817): cDNA_ID_3012274_gDNA_ID_99284_Annot_ID_147345 3000 nt of promoter
atgtggtgcagctaataagaattctccaggtatggtcgatggcaagtgttcgaaaaattatccaaaaaagtttgaggagataaccaaggttggtagtgatggttttcctgtttatagaagaatgcaatctgataactatgttgagaaaagtggttttagatgtgataataggtatgtagttccttacaataagatattgtcagttcgctatggtgctcatatcaatgtggagtggtgtaatcagaatggttctattaagtacttattcaagtatataaataagggtccagatcgatttgcatttgtggttgagcctgataagccacaaacaacagagcaaaatgagaatgtcaatggcacaacagttggtgaagaacccttaccaactgagaaaaagaaggacgaaatcaaagattattttgactgcagatgcttttctatatagtctttcccttttttgcatttatagaaattgtctgaagtctataatatatagtttctttattttctatattattatttcagatatgtattagcctctgaaacagtttggaggatatttaacttcccaatctagcatagatcaactcctgtgtagcagctatcatttcatgtagaagggaagcaaccagcttaatttaaagggaaagagtctaaaaaagaatttttggaacgtattgccaaccaagattctcaattcatggcttggttgacattaaaaaagaatgatgttgttggtaaaaatggaaaacgtgcacatgatctcttatatgcagatatcccaacatatttaacttgggattgaacaaataaaatg

SEQ ID NO: 271 - DNA, 659 bp, Unknown
  misc_feature (1)..( 659): cDNA_ID_3012301_gDNA_ID_99300_Annot_ID_147360 3000 nt of promoter
aatattatcatcgagcatccaacggtagcgatggagatttctttatggaatatctgatatccaccgttagattaagagacgaggttggctccgaattgcatatagttaaagggtaaaaccctgcgccgcccgcgactctcctctctgtttcgttttttttcctttcattcttcttatctcctcacactcttcgaacaaggaggaaccctaatctcaaggtaaatccattatcagtctaatttccctttctcttactattttatctctccggttctcgggtttctctaatccccgattttgcaaaatgtcagatatctttctttcttgattcatttcgcttctttctgtagataggattagtatttgtcggtgtttgagatttcgtagacgagatttactggtttttcaacttctctgtttgtttaatttggggatttggtatacctaatcgattgaaaagcgaaacttaggttaaaactaatagtaacatcactgtgtctcttcatacgcatctgagtttaaatctgttggcgcttactttcttgtatagtgagaaatttcgtggaagtattattagcagttaatgagttcattgaatcttttggaagtgatttggagattaattgatttagcttcttattatggtttatacacagatg

SEQ ID NO: 272 - DNA, 477 bp, Unknown
  misc_feature (1)..( 477): cDNA_ID_1685961_gDNA_ID_99301_Annot_ID_147365 3000 nt of promoter
tttttttttttttttttttgccaaacaacatcatactaatctatatcttcttttctcttctgttcaaaatttataccagtatattcaaatttagaataaattatgtaagtatttagttcttgcaataaaagaagataaggaaagaagaattatttgaaggatcattgtaagcaaaaaggttttcagttataaaaggatttcaattggtggcagcctaacaatttttctttctaaattatgaagttccagtctcaaacctaatctttaaataattagttgggtagctactaaatctcaatatctgtttttttacaccagtttaaaatttttatcccggcaaagaatatgtaagcgggggtgcgacaatgaccaaacaaacaagacacgtgaccgccaacattgtcctaaaatcccaccgtacactgaaacgtcacgccgacgcgactcctgaacacgcttccttcgcaacaacacatg

SEQ ID NO: 273 - DNA, 1670 bp, Unknown
  misc_feature (1)..( 1670): cDNA_ID_2992029_gDNA_ID_99849_Annot_ID_147373 3000 nt of promoter
tttttttttttcttttcttttatgttaaattgtgcgaatttcagatcttttgaccttatatattttttagtgtctggaatcaattttgagttcattactatttaataaatgtctttccgtcctaaaagaaagtttgaatccggagcgcaaaggaatcaactacttgggctacaactaggttaccaacccattttggtaggtttgttgctattaaatacgagagttctcgttctagttccagatacagatatgggcatcatgccatctttaatcatttattttgtgttttgaaatgcattaccatatacagggccggtattggcctaaaactggtgaagcctttgctttaggcgccaaaaaatatatgtagtacaaagggcatcaatttctgaaaacattttatagtgtagtggttagctctaaatgtagataattgtttttatggtgcatggtttaaatctcaattttgttattttgtgatttttctaaatttatgaatttaaaaatgctttaggcacctaaatcagttggggcggctctgtccacataagatagaaatttaagattatgagtgaaaattttatataaaaatatttgattgtcccgggttcattatcttgatctcgaacatgcctcgacggatccatgattttacaatctaagatccggtcactatagacatcttattttcatgatcgaataagaactcggataattattcaagctctagtgctagtggattattacgtcaactaatcttgcaatatattattgtttaaatatgggaagaacagaaaaatcaactttttatcaaaaaagagaaggaaaaaaacactaaattgaatttattaaacacgttctccacgtgcgttatagctgttcgtaccaacagcaaaatggaccgtccaccaattagattagaaccattcaatgttatacttttcttttttcacgtgtcacaagaagaacttaaaaatgaatacgaaaacgaaaaataattcctccaatccaaaagaaaaaagattttgaaaattagtacacgatagtgaaatgcactttatcaaaaacacaaacttgttttgttttttcttattatgtttaataattaaaaaataatctttacggttcatataatttgagtttggctacttttcttacttcaatttggctacttgtataaaacagtgagataataatttctttgacgttaaaattacacaatttccaaatgcagaaacttcaacaagagacatgtagggaaagaatggtggcttgtttggcttatttacaatttttaagttttaatccaaagaaaagaagatcccatcactcttttcaacaaaaaaaaagttatcaaattaatcattaaatcagtcacgtaaacgaatgttttcttacaaataattttgggattcgaggaaaattaccaaaaaaaaattaaaatagaataaaataaaataaaatgaaagacttcatgagaaaatagagacgaagttaagttgtgtttggctttgagctttggctacttgggatttaaataccacttttttgcttcttgtacccctgcttcatcatcacgcacacctctcttaacttcttcgatctcttctttttctctacacgattcgattgattcaagtatcaatcaatcgaatccgagataagtcatg

SEQ ID NO: 274 - DNA, 1297 bp, Unknown
  misc_feature (1)..( 1297): cDNA_ID_1685987_gDNA_ID_99850_Annot_ID_147376 3000 nt of promoter
aaaaaaaaaaaaaaaaaaaaaaaaaactagaagtttcaagagtatatttggcttaaccggattggtcatcctggtttaatgatgatgcgaaagtattgagaattatgtggacattaggtgaaaaaccagaagattctccctaatgatttatcaattgttacttgctgagaaaacaatatgataatgtgatttttataccagtcaaaataattttgactttatctattcgtaagcatatacaaggagatgattatgggttgatcacccactgtatgacatttagatacctaatggctataaaagatgcatcgattcaatggacgcattgactcgattgttgcatcgactagaaggtcatatttatccttgttataaacccgcaacatagagtttgtgaggttactttcttgattaaagtacaagagtatttcagtgtttatttattataaccattattggatatccgttgggataagtgtttaacattttgaaattcatgttcatacacaaaatggtttagtaacatcgatacgcatcaagccaatgaataattaatagtttcccccattattattggttttgggtcagaaaccaaatagttttcatctaaaatctttgaatgtgataagtgctccaccacagcacgttgagatgaaccctcgaaggaggataagaatacatgttggatatgaatgataactaagccatcctagaaggatttatataccgttttgaagactatcatattatatagtcagctattccaacataagggggagaatgtatacaactggtgaaaaagataaatagaaatgaattatcaatgattctcggagtaaagaatgtatattaagagtccaaaagataattcaattacagaatttagcgttgtaattgccagacgcatttgctgacccaaataaagtgatgaagtcacctataccagttgtaaattaaatgctccagaatataatgaatgtcctgtaaggaccaatttcaaactgctattgagtcttaagatcgcataaagcgtaatagaccttggttccaaatataaatatcctcgtaaaagtgaaggagcacaaaattaaaaatgaccaaattgaggaaataaatattttgatgatctcttgaaaagagagaatgatctctaaaagagacataaccatgacaaatgaaacattcaagtacttgacaatgaagagatctagctagctatgtcatgtcaaaatataatggaatcaaatgcaaatcgacgtcgtaatatatttgcatgctatgagcagttgatattatg

SEQ ID NO: 275 - DNA, 1602 bp, Unknown
  misc_feature (1)..( 1602): cDNA_ID_1686020_gDNA_ID_99880_Annot_ID_147392 3000 nt of promoter
tttaaaaactgaaataaaaatatataaattgagataacttacttgtttcaagaggtgaaataaacataggcaaagatgtaggatcttttgatgttgctttccaaacaacaactacacgaacaggaaatgaaaaattagacgatgatgaataacacgaagcacaaagattagtatacaaatataattacgtgaacattattgaagaaaaaataattgtcttatttttgagttatggagggcacataaattacatgttggtaactatttgttatatgttgattagcacaatagctaggaaaaccaaaacatgtagtcgattaaactaaccttgcgtaaacaactcatcatcaattggcaaagatctatgagattttattttccatggaccataacataaaaaggagaaaagaaaaccgatgacgatgcatcatagaaaggtccaagattgaagtaaaaaaagaactataaaccataattattacatatcatgcataaaaatcaagccgtgatgtttgagtttcaagggagaaatcctatatttatagaaattttcaacataaggttttagggttttagatatgacggcataaattatacggacataatttttttaatagaaaaatataagtccaataggcgaataagagaattaggattgatagacgaattaggggtgattagagttgattagggttaataggcgaattaagattgatacgcaaattagagttgttatttgtaaaacagaaaagattacattacattttttacacattttttttacatattaaaatatggaaatctcattaatgtaaaatataatcttattaattaataattaataattaaagggggcaaaaacgtccgttaatattctgagagcaaacgtgagcactttgatatataagataaagtttatttatttcccaaatgttacgaaaaattaattccgtcatctttttgttaacaaaagtttatcgatatgcttaaaatgatccaatcatcgaaatttaagtatttttttataaagtcaaattaaattttaaaattttaataatatttcaaaattatatactttttcatcttaaatttaaaaatttgtgatttgtttgacattttttcccaataaaatatagtttcaatttttctattttgctaagatagcaatgtctgtttataatacaaatttggatgtataataaatattttgtctcacaactaacacgttgaaaatcgaccactacttggtacgaaaatagcaaaataaattaatttggggcttttcttaaagaaaattattttatatttttctttaattttgtgtttgtgtcgtccttctatctctaagaagcactacccctcccgcaattgaaggttctcttcgtcgctcacatccaatctctatcgatctcagattccaatttctgcgaatattttcttcccagagagattacagattctagggtttcgaatagttctttccaatctagtcttcttccttttgtttctcgggcgaaatttcccttagggtttcgaagatccgaatctgtggacggagacaattcgacgtcttcttgagctgcaaagatgttctggcgaatg

SEQ ID NO: 276 - DNA, 878 bp, Unknown
  misc_feature (1)..( 878): cDNA_ID_4254334_gDNA_ID_99881_Annot_ID_147394 3000 nt of promoter
aatgggaccctttgattcgattcggttctctcggcctatatataaaccactcagactctgacacttgtcataaaacccaatcctcaagttggtggaattgagttttgtgccgtttatgtcacaaacaaactcacgatactctttaaatgagaaaaaaggagagaatctgatatcataattgaagcttatctagtcagtgtgtgaaatatcacgagtgaatatgaagtgacaaactgtaaatctaattttacagtttaacttttaaattttgtcaactatcttaaaatttataactgttgtacacgattttaaaatatcattacgtgcacgagaacaaatatgacttctttaaattccaacaaatttaaatactgacgcaaccaagggaaaaaagatacataaactttttaatttatcgactatttccacaatctataatttaagaatcgttacgtgatttttcgttgtcgacgtcacatgatttatatttagataattcattatgtgtacacataagcatgactacttcttcaaacaaacacaaaggcaaatacaatgtacggacgcaactaacaaaaaataaaataaagatgtgaggttataatttggtcttgagtcttctttaattttattaaatttaaaattaatactacatagtatcattataattatgagttcttcaatgaaataagattactaaggggaaattaaattaaattattaaaaaaaagagtatttaatttggtgaaaaataaaaaataaaaacgtgaaaaagagggactcatgggataaataaaaaggaaggaagagatctccgtcacacacacataaacactccacacgctctgcttcgtccaatcaccaaacacgctttaatg

SEQ ID NO: 277 - DNA, 17 bp, Unknown
  misc_feature (1)..( 17): cDNA_ID_2990236_gDNA_ID_1563305_Annot_ID_147435 3000 nt of promoter + ATG
acttgaaattcgaaatg

SEQ ID NO: 278 - DNA, 341 bp, Unknown
  misc_feature (1)..( 341): cDNA_ID_3051331_gDNA_ID_1563306_Annot_ID_147438 3000 nt of promoter + ATG
atatatatatcattcaggtttgtagcaactgctcatcatgtaaactgtgtttggatatgatacacacaaatagaaattacaagtttcatcttttggttatgtttcgtcttccggtttagtttggtttatctggattaaaccggtctcatcttcatcgtaaagaaagaaagtagaagcaaagcttgaagcttttggatttctaatgtgtgtgaatcgtgatgttgtcatcaggacagatgatgggccatgtcgtggcccgaactcagatgatcttgtctcgaagtaacttcgccgattgtatacggtgtcagggcgtgagagtttcaaaaaccctaaaaatg

SEQ ID NO: 279 - DNA, 3 bp, Unknown
  misc_feature (1)..( 3): cDNA_ID_3051342_gDNA_ID_1563308_Annot_ID_147441 3000 nt of promoter + ATG
gac

SEQ ID NO: 280 - DNA, 3 bp, Unknown
  misc_feature (1)..( 3): cDNA_ID_1816391_gDNA_ID_1563325_Annot_ID_147471 3000 nt of promoter + ATG
gaa

SEQ ID NO: 281 - DNA, 503 bp, Unknown
  misc_feature (1)..( 503): cDNA_ID_1663334_gDNA_ID_1563335_Annot_ID_147489 3000 nt of promoter + ATG
ttatactaagatactaatgaaaaatcctatcaagaaaatgaagaagatcataaaaacaaaattatcggatttgaagagaataaattttgacccaaaaaaaaaaagataattaaaataaaataaaaacaagaattggccaactgtgagaacatcatcaatgaagaccaattgcgagatccgacaacaccgcttcttttgatttcgatcttactttcctgggtatgtctcaattcttcttcctccttcagttcgtgttctgtgtctgattgattactctcacaaaactcatcttttcattgtctaaaggtctaatctttagctataactcaaaatctgtatctaagttctgacaagtttctgttaccaaattcaatttttttgatacatatgttcatttctcagaacaggagatgtcaattttggcgatggttttcgtaacataaacatgagatttgattgttctgtgcagatctcatagttaatctggtttgagtctagaaatg

SEQ ID NO: 282 - DNA, 307 bp, Unknown
  misc_feature (1)..( 307): cDNA_ID_3440503_gDNA_ID_1563342_Annot_ID_147509 3000 nt of promoter + ATG
ctgaatcataaggtctatatataaagaatgtttcatggtacatattgaacaatttggttggctcctatgatttgctataaatttaaagtctcattgcatatatatatattttggttattagtaagaaattacgaatatatacagggatatactaaacgacgccgcttcagcattcatttggaagcaaagcaaatttgaccttttcaataattcgtattcacataagagtgaacttcgtccttcttcaccatcgccactctgctccgttctacatttagaagagactgaccaaaatctcccattaatg

SEQ ID NO: 283 - DNA, 3 bp, Unknown
  misc_feature (1)..( 3): cDNA_ID_3051454_gDNA_ID_1563348_Annot_ID_147518 3000 nt of promoter + ATG
tct

SEQ ID NO: 284 - DNA, 3 bp, Unknown
  misc_feature (1)..( 3): cDNA_ID_3051473_gDNA_ID_1563352_Annot_ID_147524 3000 nt of promoter + ATG
gtc

SEQ ID NO: 285 - DNA, 732 bp, Unknown
  misc_feature (1)..( 732): cDNA_ID_3051510_gDNA_ID_1563361_Annot_ID_147542 3000 nt of promoter + ATG
tatatatatatatatatacggttttaatagttaccgatcacaaaaactattaaaattaatagtatgaaaatattatcaccacgatttttgtattactaattttattgctcttaattattttgtcatcttttatcgttatttttccattaaaaataaatacggctttgtgtcacgaataagaaaacatattttttagtaaaacaaattcgactaaaataaaaaggaaaatgttttgatcacttttttatattgtattacaggaaataaccaatgatagataataatatattattcaattgtcatcatttcttagttgacaaaaaaaaatctatacatgtttccgagacgttaaaagtatttacaaaactactccaacaattcacatttgttttataacaaatagggacaaaaatgatcattttaagcttattgaataactatgatcgtttatttttgtcaaacaaatggatggtttatttaattaagtcaagtcataagaaaaaattaatagtaagtgtgtaagaaaataattaaaaagtcacaaatggtcccatacgtgtgattcggcacgatacttcctaaaagcataccactaggctctctcctatataacttcatctccaccaacgatgcattttcgtcctcagatctcatctcactcacaagagagagatagagagagaaaaaggctctgctttctacattatttacgattatacactttccaacatg

SEQ ID NO: 286 - DNA, 513 bp, Unknown
  misc_feature (1)..( 513): cDNA_ID_2126653_gDNA_ID_1563366_Annot_ID_147550 3000 nt of promoter + ATG
  misc_feature (50)..(50): n is a, c, g, or t
  misc_feature (52)..(52): n is a, c, g, or t
  misc_feature (61)..(61): n is a, c, g, or t
  misc_feature (63)..(63): n is a, c, g, or t
  misc_feature (70)..(70): n is a, c, g, or t
  misc_feature (73)..(73): n is a, c, g, or t
  misc_feature (82)..(82): n is a, c, g, or t
  misc_feature (85)..(85): n is a, c, g, or t
  misc_feature (91)..(91): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (105)..(105): n is a, c, g, or t
  misc_feature (108)..(108): n is a, c, g, or t
  misc_feature (130)..(130): n is a, c, g, or t
  misc_feature (132)..(132): n is a, c, g, or t
  misc_feature (145)..(145): n is a, c, g, or t
  misc_feature (154)..(154): n is a, c, g, or t
  misc_feature (157)..(157): n is a, c, g, or t
aaaaatgcttaaatttataaatgttctgatcttcgcaatacttaaaaagncnctttttcangnttatgcnacntaaaatttnacngcaaancnatatntntaatntcncaacgggttaatacttaatacngnaacaaatcaaatncaaccattntcncaaattatatcatttttgatcttatgatattagttaccaaaaaaaaaaatagttagtccaacattaattactccatattactctaatatctttaccaatcacacccataagtattcgtaataattcattaccaaaacattatacttacagtaccatactttctatactttatcgttattaaaataacttttctacaaagactatatagaaaagatatctttatctttttatatcttttctacaagtacttttatctttatatacacttcttctatataaaggtcacggagagtattttaagattctcactttctctctaccaccaaacctcccacaccaccgtcaccggagctatg

SEQ ID NO: 287 - DNA, 257 bp, Unknown
  misc_feature (1)..( 257): cDNA_ID_3051561_gDNA_ID_1563381_Annot_ID_147576 3000 nt of promoter + ATG
taattttccctcatctctttgtctataaaaccggaaaccaaacctacggattctctcctactccacataagttacatctctcgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatg

SEQ ID NO: 288 - DNA, 3 bp, Unknown
  misc_feature (1)..( 3): cDNA_ID_2034901_gDNA_ID_1563385_Annot_ID_147584 3000 nt of promoter + ATG
gga

SEQ ID NO: 289 - DNA, 1032 bp, Unknown
  misc_feature (1)..( 1032): cDNA_ID_2182651_gDNA_ID_1563395_Annot_ID_147600 3000 nt of promoter + ATG
  misc_feature (9)..(9): n is a, c, g, or t
  misc_feature (385)..(385): n is a, c, g, or t
  misc_feature (395)..(395): n is a, c, g, or t
  misc_feature (760)..(760): n is a, c, g, or t
  misc_feature (785)..(785): n is a, c, g, or t
  misc_feature (843)..(844): n is a, c, g, or t
  misc_feature (981)..(981): n is a, c, g, or t
  misc_feature (996)..(996): n is a, c, g, or t
gatgctccnccggttaagtcagacatatccgtctgaattatacgttgtgtgaatgcgaatctcaaataatttgttcaatcattcagttagtatcttactttattactcggttaattattaaccataaataaaaataatgggagatagtgataatgacacaacgttaaaagatctaagtagttaagtagtttagatttgataatataatgggaagttagagataaccggtaaattagctatagtcggtcggttagcattccggttaacccatcaatggctcgtattcacactagtcgcgcgactaactaatagagaaaaagcttttgcgtgtttgttgttgtctccatcgctcgtttgtttcttcttcagccatatcggaaaaaancgatatccgnacgagccattcggtgtttgttccgagaagctccgatcgatctgtgttagggtttttctttttccgccttatgaatctctctatcgcggtttcattagattcagtttaactcgagtgatgaaaccaatctccgtgctagaggtaaaattctgttaggttttctcttttttgtttttatgcttcgtaccgatcgatatgattcctggttcgttttgtttccaaatctgcagctctttgatcccgtggctggtaggatattacggcgtttgtagctctggtatggcttttgttgttcgtttggttctgattttcgaaaattttcgaatttttaatcggaatctgatactagttcatcgttttattttnacagtcgtcgtggatagagttagancgacgaaatcagccttggtttcctaactggtatttgttctttagcctatgttttcaanntttctcttccggttttttggtggtttgtgaaactacttaatcttcttgattacctaattaatcatatcattgtttacatcatttattttgatatttgtagttatttggcatttcagtatctgaatttttgcaacaantgtctgagctaaaangagcgcctgcttcctccaagacctgcttcagctatg

SEQ ID NO: 290 - DNA, 1036 bp, Unknown
  misc_feature (1)..( 1036): cDNA_ID_3409571_gDNA_ID_1563398_Annot_ID_147606 3000 nt of promoter + ATG
  misc_feature (51)..(51): n is a, c, g, or t
  misc_feature (53)..(53): n is a, c, g, or t
  misc_feature (68)..(68): n is a, c, g, or t
  misc_feature (78)..(78): n is a, c, g, or t
ttgtaagttatagcttttaaataagtatttaataccgatttgatccgacancntctccgggttatacncaataaaacnaatttataaatcttaaatatctggtatcaattatcagttcttatttacggaccaaatttcacgctaaaatgaaaatttactattgataaattcgtggagaagatcaaatcagaagttaagaacaatgacaagactcatttagattcactgctttatgtattttgttagctatgtcttttgaaatcgaaatggaagaagagtctattgagaagatgtatcaaatgatggcggaaattttaatcgttgttgatcctacatcaaaatcctagaatttgattattttttccaattcacaacgacattcttttgttaatctgaaaacacaacacacttaaggtatataaactaaaacgtttgggtaaatctcgatgaagattatgagataaaaatggttatgtacctcctttaaaagcaaagatctaaaaccaacatttactctaataaaaattcagataataattgtaaaagtaacagaatgtactttcctaacatgtatacaaccggatatccatcattgtctgaaatggacacataccctcgaaagtctaaattagttatcactggttacttctctatttgtgtctaacgaataaagtccttagttgacttattatgtgttccaagtttatgggctttatagtggcccatcacatagattccagatttcattttatttcctacctactaagatctgatctgattttaatgctcttgaccagtagtaatctttctcttttcgttgtttccttcttcttcagttcctccttcttcagttcctccttcttcaatctctcgtctcttactaacgttatttcttcaatctcattgatcaaaaaaaccaaaaccctaatctcaatttcctccaaaagtttcagtttttaaaaatgggttttcttcttttgtaacgaaaaatgtgtcaaactttgaattgaccatttttttttatcaggattcgatg

SEQ ID NO: 291 - DNA, 529 bp, Unknown
  misc_feature (1)..( 529): cDNA_ID_1009988_gDNA_ID_1563421_Annot_ID_147652 3000 nt of promoter + ATG
  misc_feature (256)..(256): n is a, c, g, or t
ctcagactatagagttgtttgttttcttgggcgtcaatataacaaacgagaatgacaaatggttttaaagctgttgatgtttcatacacagacaaaatggatcaattatgaagaaccacgataaagtgatgggtataattggggaagcagaagaaattcttgacgaagcatggggttgtcttcagaaaatgaatggatcaagtcaaggtacacatgctccagggataaggcaaggttaggaattaggacacatctncacttactaaaaaagagataaaaaaaaattataaagggaacgttataaatatgttgtaaagtcaacatctgtttccttctagactcttcgcatttacatcacactgccgaccatataaaacggcaaagttcgtcgtcgttttatcacaagaccatcaacaccataaggctataaatccaagctaaaaggtagtgattaactccacaaaaccagaaaaaactacatttctaacatatagaagaaacagagaaaaagagagagagacccctaatg

SEQ ID NO: 292 - DNA, 133 bp, Unknown
  misc_feature (1)..( 133): cDNA_ID_3051713_gDNA_ID_1563432_Annot_ID_147668 3000 nt of promoter + ATG
  misc_feature (127)..(127): n is a, c, g, or t
ctcaattaaatgggccacaaaaagcccatttaaagaacgtcacgtgacgcgatataagcatgatccgaggaacacacttaaaacaatcaggttccacatttggctttgcacaccttccttgatcctntcaatg

SEQ ID NO: 293 - DNA, 587 bp, Unknown
  misc_feature (1)..( 587): cDNA_ID_3013477_gDNA_ID_1563442_Annot_ID_147685 3000 nt of promoter + ATG
caagatatgtagaaaaaatgagcataccaacccaagtgatgaattatatgatttcatcaccataagaaaaaatgttcaaaaacatgaatatgtggattaattcagtaattatacaaatataaaatcttcaaaaatatcactgagctaccgacatggtcactaacatatgtggatctcaaacgttcaaaacctaatcctatcttacgtaactttcaaaacctaattattacgtaaaaacttatcacttttaactttatatatatgcagcttagatatcaatatcatgaagatcttttattttagtcaaaatagccttaaaaataataaaatcaaatatttgcgtcacgacaaaaaaataaacaaaattttcttgtttttcttggtaaacatcaataaactaatcaaatgacaataacacactacccaatagcaaaatcagactgtactgacacgtgtcaaagcatgtgcagagatatgtaaacccattatgtcttcatcacctcttctttaacgcctctggctctgcatttctcagtctttttgcacaagaaacaaagctcaggaaaacctcaaaaccctaagctatg

SEQ ID NO: 294 - DNA, 185 bp, Unknown
  misc_feature (1)..( 185): cDNA_ID_1450557_gDNA_ID_1563471_Annot_ID_147744 3000 nt of promoter + ATG
tcacaaatttcccaagaaaacactcacatatatgatgctatatatagaatgatagtctcatctaattctctctctccctcggattcgttagatgtgatcattttttcttgatttttgatcagattcttgcgtatagctgtatatatacaccaagatacactcatcatcgtcatatatagattatg

SEQ ID NO: 295 - DNA, 3 bp, Unknown
  misc_feature (1)..( 3): cDNA_ID_3051821_gDNA_ID_1563472_Annot_ID_147745 3000 nt of promoter + ATG
gag

SEQ ID NO: 296 - DNA, 17 bp, Unknown
  misc_feature (1)..( 17): cDNA_ID_3051925_gDNA_ID_1563505_Annot_ID_147808 3000 nt of promoter + ATG
aaaaaaaaaaaaaaatg

SEQ ID NO: 297 - DNA, 260 bp, Unknown
  misc_feature (1)..( 260): cDNA_ID_1375747_gDNA_ID_1563531_Annot_ID_147851 3000 nt of promoter + ATG
ttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaatatg

SEQ ID NO: 298 - DNA, 246 bp, Unknown
  misc_feature (1)..( 246): cDNA_ID_3052021_gDNA_ID_1563537_Annot_ID_147861 3000 nt of promoter + ATG
tacaattttgtttttgttgcttagtgaatttacattttagacttttttttttgtcaaatacattttagactaaatggtgttttcttttgaaaaaatcatatagtttaggtcgaaccgcgaactcgagagagagaaaagaaaaaaggaagaaaggataacacaaaacctctctctatctctctcgtcttccaaaaatcgagcactacacattgactctcttctacaaagagtctggtcacactcatg

SEQ ID NO: 299 - DNA, 32 bp, Unknown
  misc_feature (1)..( 32): cDNA_ID_3052024_gDNA_ID_1563538_Annot_ID_147863 3000 nt of promoter + ATG
tcgatctaaccaccgccgatgaatcgccgatg

SEQ ID NO: 300 - DNA, 21 bp, Unknown
  misc_feature (1)..( 21): cDNA_ID_3052036_gDNA_ID_1563541_Annot_ID_147868 3000 nt of promoter + ATG
caaacattaaaaagatagatg

SEQ ID NO: 301 - DNA, 973 bp, Unknown
  misc_feature (1)..( 973): cDNA_ID_3052046_gDNA_ID_1563544_Annot_ID_147874 3000 nt of promoter + ATG
tcaaaaaaatcattaattgtaaaaatagcataaaaagttttaactttatctcgagtaaaataatgtgctaattttcattaactttttattttaatcatatttttaattgacttcgtatttttaatcgcccattttgttgactttacccaatatgtcacgtagttaagttgactaacaaaacaaatttttagagttaaatttccgttgagatgttatgttaaactacacaaaaaaacatcgtttaactaacaagtaaaacttaaaatgaaattcaatcttcttactacttagataaacccatggatacgtcaatggtgacatacaaaaagtgtatagtagagagtaactcaattatattatagtgatttagcctaagtttttaattctagaaaatttaaaaattttaatgattaaaacaactataagtttttaatatattggatgtatattattacaaacaataatatataagataacttgtacatgattcaccaaaatagtctagttgaaacaactataatttgaagttaaataggctaagttgaaacaactataattttgagattcaactattcttgggttacggatttttacattcttattaaaatattgtgttattggtttggggggttttaaatttcctcaaatgaatatcttcttatacgaaaagattagttttctttgtaattttattaaaatgatgattatatttagatgtggtcatgtggatgaaccaccaccagtgcaccaaaaacagaaaacgacgcctaccaacttgatgggcttttaatagatatagttagttaggcccagtttagtgttaatacgataccgtttgacgtagtttaacggccaccgacacgaacgaatccaaaacggcaccgcgtcaatcgcatccaaagctctgatgtaagaaactctacacttgttcgagtttcccacgacggagaaaagaaacgatgaggaagagatg

SEQ ID NO: 302 - DNA, 435 bp, Unknown
  misc_feature (1)..( 435): cDNA_ID_1448005_gDNA_ID_1563549_Annot_ID_147883 3000 nt of promoter + ATG
  misc_feature (5)..(5): n is a, c, g, or t
  misc_feature (11)..(11): n is a, c, g, or t
  misc_feature (60)..(60): n is a, c, g, or t
  misc_feature (64)..(64): n is a, c, g, or t
  misc_feature (119)..(120): n is a, c, g, or t
  misc_feature (134)..(135): n is a, c, g, or t
  misc_feature (146)..(146): n is a, c, g, or t
  misc_feature (152)..(152): n is a, c, g, or t
  misc_feature (243)..(243): n is a, c, g, or t
  misc_feature (396)..(396): n is a, c, g, or t
gaatnggtggngaattgcaagctggattcctaattagagaggattttttgtactaatggngtgntgcagctggattcctattttgaggacttaagtgtctattatcatcaaaaacaaanncaaaagtcttaatnnctactattagnttaatncaaaacttaagtacactcctttcgtccgaacatagccaaaacaaaagttgccactttaagttcctttgaccactgtcggcacgagaatcgnttgacttctttctcatatgggctttaaattagcccatctctataattttacttttgttgagggttttataagcccattaagtttcggcccactcttgacgttaatctgacgtcagcttgatttttccggcggatttctcaaatcgacaaattncgttttcatcggttgtttcagacgtaatttccaaaaatg

SEQ ID NO: 303 - DNA, 735 bp, Unknown
  misc_feature (1)..( 735): cDNA_ID_1397552_gDNA_ID_1563550_Annot_ID_147884 3000 nt of promoter + ATG
tgtaaaaatgattcactcactcgtatgggtgggttgggttttctcttcatgagatgctcatttgagcaagcaatgtttggaagtgggactatttaatatcatgtatgagttttatcttttgttataagaaaaaaagttgggatttcattttcgtgcccacttcacgtgaatctaatgccttcaagtttgtggtctaccttattttctcttatggatacatgtcaatttacgtgtcgtatgagtcaagcctttaatcatcccaacaccatgcacgtcttctagatttgttttcgaccacgattccaccacaaaatttgacattgttattgaattcattaacttttttacgtgttattgtgaaatatttatttaattttgttggtaaaaggagcaaaaaagattagggtacaacacgtcgacttcttccccaattagacccatatgtgatctgtcgtcactcgtcgccaagtttttttatgtgtcgtcttttaaactttgatccaattcattaaaaagtcttaacgcccacaacgaaaaggaacttctctttttgtttggtgactgaatcggtggaaaacaacacaagtttgttcctttttgtctctccagatcccttggcttccttcttcttcttcatcctcctcgtgagactctgtgttgaaatttctctagggttttaattatcggcgttggtttttcgtttttgagaatttgatttcgtttttagaaataatg

SEQ ID NO: 304 - DNA, 3 bp, Unknown
  misc_feature (1)..( 3): cDNA_ID_3052078_gDNA_ID_1563559_Annot_ID_147899 3000 nt of promoter + ATG
aca

SEQ ID NO: 305 - DNA, 370 bp, Unknown
  misc_feature (1)..( 370): cDNA_ID_3052084_gDNA_ID_1563561_Annot_ID_147903 3000 nt of promoter + ATG
  misc_feature (27)..(27): n is a, c, g, or t
aattgtagatccataagatgcattatntctcgaaatatattatttagttttaaaactaataaaaacagataaatatctcccgttatatagtattttgtgcaatatataatgttctttaatgaaaaatttgatgatgttatagataaataatgggaaataaaaagtattcaaatttcggattaaaaaatccatcgaaccgtccaccatcttgcatgtccatcattcccatttatttgtaatagaaaagtataccaacttgaaatattaaataccaaattttttgttataaatagtcccacagttttctcatccctccagaaaaacaaatcatcccaagtaatcctaactatacaaaacacataacaatatg

SEQ ID NO: 306 - DNA, 420 bp, Unknown
  misc_feature (1)..( 420): cDNA_ID_3030375_gDNA_ID_1563583_Annot_ID_147943 3000 nt of promoter + ATG
  misc_feature (197)..(197): n is a, c, g, or t
  misc_feature (258)..(258): n is a, c, g, or t
  misc_feature (264)..(264): n is a, c, g, or t
  misc_feature (268)..(268): n is a, c, g, or t
  misc_feature (275)..(275): n is a, c, g, or t
  misc_feature (286)..(286): n is a, c, g, or t
  misc_feature (304)..(304): n is a, c, g, or t
  misc_feature (307)..(307): n is a, c, g, or t
tttgaattttcaatattgatttctcccatggcgagtagcagttgcagcagatctatctctgtttcaaattctgattctctcggtgttttttgtttgagctagggctaaattagtttccttcttgggtttttattcgtaatccgattcaaagtttgtatctttgggagggatgggtaaaaggcaaatatcccaagatnaagtaggtccgcccataaaaccaaaagctggtttacgaagggaacaagctggaaaaggttnttacanaggnagttagntactttgtatntcatcgaaaacgaatcanaanaagcttctttttttttttattagaggttggggaggagatagtataaaacaactgtttagagttctgatttgtggtttttgagtcgggggttttgaggtttaccctttagaatg

SEQ ID NO: 307 - DNA, 185 bp, Unknown
  misc_feature (1)..( 185): cDNA_ID_3052173_gDNA_ID_1563592_Annot_ID_147957 3000 nt of promoter + ATG
ccagatccatcgtcatcatccatccaatcaaattgactcatcgtgttgtgacctcccagtgattaagccgcgactcctcctaactcgtaatccctcacgtctctgagaattctgagtttcttcagtttcattgcaattcaattcccgatctgatccgttcctgcttagatcggagcaaaacaatg

SEQ ID NO: 308 - DNA, 577 bp, Unknown
  misc_feature (1)..( 577): cDNA_ID_3052265_gDNA_ID_1563621_Annot_ID_148009 3000 nt of promoter + ATG
  misc_feature (14)..(14): n is a, c, g, or t
  misc_feature (107)..(107): n is a, c, g, or t
tatgaaattgattnactttttgaaaacatttttggtgcaattcaacaatatttgtttcacagttcttattttatttttgtagattaaaaagcttaaatttcaaaaancaagaaaatcttgttttcacaaaaattaggcaaagggtttccaatttccagattgtttaacttgattttcaatttccaatttccgaatcttgcaacttgatttctataatgataagttatctccaaatatgttttcttaaaagagaaaactcgatttgacttcaagttgagatcatatccattattattctctatattacgtacaagttatattttttataactctagaggaatgttagagcttgtgttaatggaattccaagtcagatatgaatattctcttataatcatttttgtccttataactgttttttttcccgggaaaacgaatctcagaaaccgaatttcctactttgacattattttatctccctcttgctctttgatttaatgcaactatctgaaactctatgaatttatcattttcagagttcaagatcatatgatattttcactttctggacaaaatg

SEQ ID NO: 309 - DNA, 868 bp, Unknown
  misc_feature (1)..( 868): cDNA_ID_3052285_gDNA_ID_1563627_Annot_ID_148020 3000 nt of promoter + ATG
tcaacaatgtaaacggcaagccaaagatccttcataggtaaggtgagattacaagcgccgttgtaaatcgaatgtcgacaagcatgccggttagccacatccgccggtaacatgagaatagagatcatagcaatggataaaccaaaaacaacaacgaatttggggaaataagcctggtttgcatcatctggatgctgatagttgacgaggaggtagatactggagatgaaaacaatgacgcaaactacgatcgcaacaatcacgagagcgagattgaaatctcccatcgcgtgcaatgtacgagatcccaaacctcagcttagattgagaaaaattagggtttcttgaagcttcgaaatttgaaattcaatttggggattatttatttttgtagatctggttttttttttccgtatgtcgaaaaccagactggaatgagaaacgaagactgcgtccaggtatgtgactcgctacggttatttacggataagccctcacttaaatgtcatatttacgaatataccgtagctgatgacagatgggaatgagggtgttacagtaattgcgtaaaacgagaccagaccagcctgtcctaactccaaaccaaaaagagattcttcgaaaatgttttttatctttaaatttctattaagataagaaaataaatgttttactttttccaaagtcgtcgtctctctccaagttttgtgaatccaccgttcaacgtgacgatgaagaaagagaagaagccgacccgtcgttcaaatcatccttcgttcctcaacaacattaaccccaaacctaaggttagggttttacctttatctcttcaatttcttcattcctctcatcgattcgcgacaacatg

SEQ ID NO: 310 - DNA, 3 bp, Unknown
  misc_feature (1)..( 3): cDNA_ID_1017964_gDNA_ID_1563633_Annot_ID_148028 3000 nt of promoter + ATG
  misc_feature (1)..(1): n is a, c, g, or t
nct

SEQ ID NO: 311 - DNA, 119 bp, Unknown
  misc_feature (1)..( 119): cDNA_ID_1580388_gDNA_ID_1563642_Annot_ID_148043 3000 nt of promoter + ATG
  misc_feature (28)..(29): n is a, c, g, or t
  misc_feature (36)..(40): n is a, c, g, or t
acttagatcagtctcaaagggggaaaannaacttannnnntagaacattaagaggcaacacaaatcacacaaaagatcaaattgaagcctaagaagaaggcaaaaagtgagaagcaatg

SEQ ID NO: 312 - DNA, 400 bp, Unknown
  misc_feature (1)..( 400): cDNA_ID_3052377_gDNA_ID_1563667_Annot_ID_148086 3000 nt of promoter + ATG
  misc_feature (31)..(31): n is a, c, g, or t
  misc_feature (68)..(68): n is a, c, g, or t
ccagaaaccctagagttgcttccgcttcgcntctcgtctcctcttatcagtcttctcttttcacggcnacaaggttagtcctaagtttcggcctctgttcttgcatcagtgattggatctctactgccttttaatcaaatctcattgaattgatctgggttagggtttgggtcaggttatcgaatctttctgtgttattttgattctatgaaatgaatttagggtttgggcaagttttttctggtctatgtagcttccatctttgtctgagatatctgattgggtcttttggattctggtgatctctgtaacgaaatcgattctctgtgttttttttcaggctaattgagagtgtcccttgcgttagagtttcttactagcttttttcgtctgaaacatg

SEQ ID NO: 313 - DNA, 14 bp, Unknown
  misc_feature (1)..( 14): cDNA_ID_2990879_gDNA_ID_1563705_Annot_ID_148157 3000 nt of promoter + ATG
attgaaggcacatg

SEQ ID NO: 314 - DNA, 739 bp, Unknown
  misc_feature (1)..( 739): cDNA_ID_1568384_gDNA_ID_1563707_Annot_ID_148160 3000 nt of promoter + ATG
  misc_feature (310)..(310): n is a, c, g, or t
tacaattttcctttgaaagagccgccagaaatttcaatctcactcccatcggaatcacagatcctccgtttctagtttaaagcaccaggttgcttgatctgcgatacaatcttgaccgtccattttacttgttcgtcaagattttattttaaatgttttaatgggctgggcttttgtagccttgaaatatgcccatatagacgagacggacaaactttttatggataatttaggtttttgttcaccaatcataatttttggtatgcaatgtttttttttctttttttttagcaataattattatttttgngtgaagcaataataatttgtttgcttgaaacgataagatttatatatatattcgctctaaaaatagaataaacttcagcaatcagattaatccgaatcaattccgttggtgttacagttattctacactctctatagatcccaacctctttcttttaaatatttatatacatctctctttttttgggaatttttttactagattccaaagtgaatgagtagcgaatacgacaactctcgttattagacagagatatataataatcgcgtaataattatttcctatttaaatatgataaactcatgtgtgtgcatatttactttttatttacttatgggatactcaccaatatttatttgatacgaaccataaccttcactaagttttctttctctagcctccctcatctttctctctctgtcggcgatg

SEQ ID NO: 315 - DNA, 221 bp, Unknown
  misc_feature (1)..( 221): cDNA_ID_2142375_gDNA_ID_1563722_Annot_ID_148187 3000 nt of promoter + ATG
  misc_feature (6)..(7): n is a, c, g, or t
ccttgnntccagatctctctctcctcttattcttctcattttagatcttcttccatctgaaatcacgtttctcccatttgggatctgcttttttacttcaacatcaaagacattagttttctgctgtttgatctctgtgccctgtgtgtatgatcttactagggtttcaaggaatatgggtctttcccgttagctaaagataattaattttgtgtccgatg

SEQ ID NO: 316 - DNA, 696 bp, Unknown
  misc_feature (1)..( 696): cDNA_ID_3042012_gDNA_ID_1563726_Annot_ID_148193 3000 nt of
  misc_feature (125)..(125): n is a, c, g, or t
  misc_feature (292)..(292): n is a, c, g, or t
  misc_feature (380)..(380): n is a, c, g, or t
  misc_feature (693)..(693): n is a, c, g, or t
tttaccatccttgatctctctctttcaatgcatgtgcatgtgcatcagtatctgtttcacaactagttttctgattattgcagtttaaatggaggaatggttggttttattcactctcagagaangcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcntgagaagtgaaaaaaagatgtaattttttaataaagaaagagaatcagttcacgctttgtaaaatgtccagacttttatgtgtaaacnttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcatnatg

SEQ ID NO: 317 - DNA, 71 bp, Unknown
  misc_feature (1)..( 71): cDNA_ID_3052577_gDNA_ID_1563735_Annot_ID_148207 3000 nt of promoter + ATG
  misc_feature (66)..(66): n is a, c, g, or t
  misc_feature (68)..(68): n is a, c, g, or t
aaatctgaaaatcggaaggaagaaaacaaaaacctttcaattgaagaacggagaaatcatcatccngnatg

SEQ ID NO: 318 - DNA, 60 bp, Unknown
  misc_feature (1)..( 60): cDNA_ID_3443592_gDNA_ID_1563741_Annot_ID_148218 3000 nt of promoter + ATG
taccggtaaaaggccgcgtaaacaaagaaagaagtaagctacctagataaaaccgccatg

SEQ ID NO: 319 - DNA, 323 bp, Unknown
  misc_feature (1)..( 323): cDNA_ID_3052635_gDNA_ID_1563754_Annot_ID_148241 3000 nt of promoter + ATG
tttcagggcgttagtgtttacagttcctctattctctaagtgaagatgaccaatacctgttggttacatcgaagctttacaattaccaaattagttcaaatcttgttacattgtgctcacgacctcacattttttccaagtaaataaagtgtcttactcaagaaaagaatttttcagagctttgaataagttcggtgaattccaagcctacaattcttgtcacacccagggattatgtttccatcctcttgtagtaaaaccattataatttgtctgctgtattcacctcatatttagtgatcaacatttttcttcagaacatg

SEQ ID NO: 320 - DNA, 519 bp, Unknown
  misc_feature (1)..( 519): cDNA_ID_3052666_gDNA_ID_1563768_Annot_ID_148263 3000 nt of promoter + ATG
  misc_feature (457)..(457): n is a, c, g, or t
aaaccgataatcaaagactaaaacagggattttcctcatttgtggtcatcactttttaaattttggtgtcatttctcatcttaatcaatttgtttttgagttttattcttctattagatcttttatacatcaaagaatagatgaagattccaccctaaaaccttatagtatgtcatttattcacaatatgttatacgtgttaattttctctcttttagtatactctttttttttctttcagattccatcccaagttgcttaaattttgttaaaaccaactaaattccatagttcaatttacaaatctgtgatcagatgctatctaaatgaatattaccattttagcccttaccttttctgaaatttaccacgtttacctcaatgaaccgtcatcgcaaaaccaaaaaccctttcctatccctaaaacccgagagagcatcttcttctcctcttaggntagaagaaggacgaaaatcggaggaggaagaagaagatcgattcgatttgtgatcaacgatg

SEQ ID NO: 321 - DNA, 179 bp, Unknown
  misc_feature (1)..( 179): cDNA_ID_3085115_gDNA_ID_1563769_Annot_ID_148265 3000 nt of promoter + ATG
  misc_feature (143)..(143): n is a, c, g, or t
gaagttttaaagaaagactagcaaaagtctgatatgtcaccgacgacttttgagaaaagagagaaagagattttgaaaggagcacatcttgaaatctcagatccaacttatttcttcttttttcttctgcttctttttctttntcttcttcttcttccctttcttcttatacaataatg

SEQ ID NO: 322 - DNA, 216 bp, Unknown
  misc_feature (1)..( 216): cDNA_ID_4362284_gDNA_ID_1563786_Annot_ID_148294 3000 nt of promoter + ATG
ctttgtagattgttttaactatggaatctcgtcgtggagtctaattcattattgagcttgaggattggttcggttgatggtcttttccaccgtttgaaagagttctttcagtttaacatctggtgttggatctagtcacctgtattgaaagtgggaagaaactaacttgtgcagccatagtcgcaaaggctgtgattttttgtctccacactcatg

SEQ ID NO: 323 - DNA, 124 bp, Unknown
  misc_feature (1)..( 124): cDNA_ID_1690084_gDNA_ID_1563797_Annot_ID_148312 3000 nt of promoter + ATG
aaagaagagtcacattcaagaatctctctcttctcctcctctcattctctcagcggcttcttcttcttcctttttctttcacatcacacaacacaaccactgtgatcttgatttgttaccaatg

SEQ ID NO: 324 - DNA, 1188 bp, Unknown
  misc_feature (1)..( 1188): cDNA_ID_2167783_gDNA_ID_1563829_Annot_ID_148366 3000 nt of promoter + ATG
atgtcagtgattagtgaataaggatcgcgggtcacatacataacggatacacaagatcaagctcgacaactaaacaatttctcatttggattaatcatgatcactcgtctctatttattgttgtgcgctgtggctttaaaattttaataatagatctaatacataaaaaatatagtgtcctctataaatcctgagtttcacaaaagtttaatttattaaaactgtatgagtgtgtttaaggggtctgcggaatcaccagtcacccattaatcatcaaatattcgctttgaattcaagtttattttacagtttactggcatctacagaagaaccgatcactcttgaatcatcaaaatttttgctttaaatttgagtctatattagcaataaataatttactgctagtattgaaaaagctaaggggtaaaagaagtatgtgcaaaacaatctgaaactttctaactaataaaaaatcttgaagacttgctatttttggaccatttccaattttcacttctatatttttattttattttaaaggtattgtactctaatggtcacctctaaaatagagttttctcaaaactaaaggaaaaaatagaaatgaattgtacaaatttctatttatagagacaaaaagtaaatatctctatttttttctatatttgagaaaattttatttttgactattgaagtacgatacctctaaaatagagttacttttataaataaaagaaaatatataaattattattggagatgcctaaaaaattatatgagacaaagtaaagtggagacaaaaaatataacgtttgatggtgctagagtctcttaaaatatattacttaaaaaaatccaagacttcatattaatagtttaagggtgttgatatatgggtattatctctcataccaaaaaaaaatcgatatttgtcctctccctctctctctcaccctatctataaatagcagccggctaccacatttgatcgacgagatgtgaatgaagcattcaacaaaaacatcacataaaataaacaaaggaatccacaaaaagaaaaaagcaaaaaaaaaagtttcctcttagagaaaaagagagagagagagtaacaaactcttgtcgtttcgttaaggtcaaggtgtcgttttgttctctctttctgtctctttaaacacacacaagaaaatg

SEQ ID NO: 325 - DNA, 32 bp, Unknown
  misc_feature (1)..( 32): cDNA_ID_2183387_gDNA_ID_1563836_Annot_ID_148378 3000 nt of promoter + ATG
cattcttaactttcaccttctacggaatgatg

SEQ ID NO: 326 - DNA, 41 bp, Unknown
  misc_feature (1)..( 41): cDNA_ID_1808991_gDNA_ID_1563839_Annot_ID_148384 3000 nt of promoter + ATG
  misc_feature (1)..(1): n is a, c, g, or t
ncttataggagtgagtattgttgcagatagataaggaaatg

SEQ ID NO: 327 - DNA, 603 bp, Unknown
  misc_feature (1)..( 603): cDNA_ID_3446177_gDNA_ID_1563858_Annot_ID_148416 3000 nt of promoter + ATG
  misc_feature (39)..(39): n is a, c, g, or t
aaaatattacatagataatatgtttcaataattcaaaancattagaaacagtattaaaaactaaggtaaatattttgataacaatttacttttgaaacagcaaaagaatttttaaaaatgaaatgggttttgattttaaattgtagaagcagaggacatatattaatcaaataaagagtagatcattcccttatcaagataaaacataaacatgcatgagttgatacttttctttatataatttttccctaaaaacaaattatatattcttttcttcttttgctagctattttcttaattgtgaaccaaattatatactatttcattgtatatcaatagtttctttaaccaaaaaaataaaaactgtctctatgtatatatgtaacataatcagaccaaccttaaagagagagagagagagagacatgttgactttccacaccaacgtgcgtccatgcaaatgagccctttctctttgccaaacgcacacgcagaaatcaacacatgcgtgtgcatataaagcttctgatcatacaaataaagatgcgtgtacaaaattataggtataggagcgagacacaagagaaatattaccaaaaaatg

SEQ ID NO: 328 - DNA, 3 bp, Unknown
  misc_feature (1)..( 3): cDNA_ID_2032973_gDNA_ID_1563882_Annot_ID_148455 3000 nt of promoter + ATG
atg

SEQ ID NO: 329 - DNA, 117 bp, Unknown
  misc_feature (1)..( 117): cDNA_ID_2702650_gDNA_ID_1563893_Annot_ID_148473 3000 nt of promoter + ATG
  misc_feature (3)..(3): n is a, c, g, or t
aantatggtctatacataattaatatacatgtacattgggtttcaattaagctctaattaactctttaaaattcaaatttttagggttttcaagaaatgatgaacgttaaaccaatg

SEQ ID NO: 330 - DNA, 268 bp, Unknown
  misc_feature (1)..( 268): cDNA_ID_3053090_gDNA_ID_1563924_Annot_ID_148524 3000 nt of promoter + ATG
catatgcttggcgttcttgttctatccagtggctcgtggctcgtcgttgctggctgcagtggggcttacgtctgagtcaagcatcaagtaccatatatggttggggcacttggtcatgatcatattcaccagccatggtctttgttactttatctattggatatccaagaatcaattagtctcaaaggtcactctttttcttttttacattattcgtcgatattgctctataattaatgcccttattaatcgttcgtgtaaatagatg

SEQ ID NO: 331 - DNA, 65 bp, Unknown
  misc_feature (1)..( 65): cDNA_ID_2052959_gDNA_ID_1563933_Annot_ID_148541 3000 nt of promoter + ATG
ggggagagggaaagcttcttccggatcctgactattcctcgcatatcgattaccgatggggcatg

SEQ ID NO: 332 - DNA, 3 bp, Unknown
  misc_feature (1)..( 3): cDNA_ID_2703300_gDNA_ID_1563948_Annot_ID_148567 3000 nt of promoter + ATG
aaa

SEQ ID NO: 333 - DNA, 1269 bp, Unknown
  misc_feature (1)..( 1269): cDNA_ID_1456083_gDNA_ID_1563953_Annot_ID_148574 3000 nt of promoter + ATG
taaaaaaaaaaaaaaacgattcatgggttcctcgaaccatagcatatccactagttctttattgggccgataataggggaactcttaaatcagcacatcaagcttcgtaggaagaaaatatgttttttgtggggcttaatctgttttatttcaaaacaaatcattctataacaaattttgatctcaaattcacgattaaataatatacacaagtttgagtcttatgaagtatatattttattgcaatgagccttaaataaaaagtcataatttgttgttttattatataacgttatactgaacaagcattccaaaaaggcctccgtagcatagtggtattgcgttcgcttcgtaagcgaaaggccgcgagttcgatcctcgccgggggcttcatttactcactcttttttaaacttccaaaaaaaatttactcactcttttttaaacttccaaaaaaagaaaaaaatcctttttatatctctttcttttttatgaaattagaatacaattcttcttagccacaactttccataactcaacaatatacataatcatcaaaaacaaacaattcaaggaaaacttccctccttaccataaataataatagtagtataattttagtgtaaaaatcttgaagaaagccctacaatacaaggctacaacaatcccaatttctcctcgtcggagatttctaagtaaaaccctagaactaaccattatatatattataatacaaatatattcatccctccctctccctgtgtcttactctgtcttctcttcgaactgatctgagatttttgattctgcttctcttctcatcttctcccaaggtatcgctttcgttcatagttcatacaccaattttcttactgttatcaattgtttgattgatatttgtagttcttcaatttgggtttcatgttctgtcttaaaagtcttttcctttctgttggaatcctctgtaaaagcttaatcttttcacattcttccaatatctagtagctgtatagagatctatgtagttctaacgtatattcaatttatagattctcaacttgcaagtcgcttaagtcaccaaataaatctcttgttaaagctataagagatctaatgagatttgtggattccttagtgttgatttgaatggcaatgtgagactaaaatcactacttgtggttcacccatatgagtatgttttaatttcgagacatttgtttgattatatatctgaccttagtgataatctcttgaatctaggtagagatg

SEQ ID NO: 334 - DNA, 1045 bp, Unknown
  misc_feature (1)..( 1045): cDNA_ID_3053192_gDNA_ID_1563965_Annot_ID_148598 3000 nt of promoter + ATG
  misc_feature (17)..(17): n is a, c, g, or t
  misc_feature (31)..(31): n is a, c, g, or t
  misc_feature (37)..(37): n is a, c, g, or t
  misc_feature (43)..(43): n is a, c, g, or t
  misc_feature (46)..(46): n is a, c, g, or t
  misc_feature (80)..(80): n is a, c, g, or t
  misc_feature (90)..(90): n is a, c, g, or t
  misc_feature (94)..(94): n is a, c, g, or t
  misc_feature (140)..(140): n is a, c, g, or t
  misc_feature (161)..(161): n is a, c, g, or t
tttaatgatataaaagnaccccctttaaatnaaaatnaatatnatnagatatattagtagaaaagaaaaatttaatgagnaaatataagntttnatagtaaaataataaagtaccataggtgattatttctctaaattgngattaaatgtttagatatacnaaaaaaaagttaagataatacataatgtttagatattgacatctgtattaagataaaaaaaaatctgtgctaatgttttaaagaaaatattctctatataacttccatataaacaaattatggttgtatgtctaaaattttgtactcttattttctatttaaagtgttaggtttctgaaaaggttttgtggtgagaagattcttaaacaactagtatattttatttagaataagttcgcgatgggttattggtcaaagcggtcacgacgaaatattcctgaaaagtagagtgacgaaataagtttttttttgttaattaaataagagttatgtcttttctatgttcttacgatactatatacgtgttttctattttgaaaaattttctagcaattcaattgaagtcgagttgaagatttggatgcattgtgaaaattgtgttaaagatgtcaaaaaagctatgtccaaatttgaaggtaaacgtatattatagtccacatttatgataacactatatcgatctcattcatggtagttggtacaatagcttaaggcttctacttagaattatattttttgaatccatatttatatttcatatttttggtgtaattgacactatataaaattctatgtatggttttactatctcaagttttacattatagttgcaaaattttaaaaaattttgttttatataatctttgtttttaaaatttgtgtgtttagtggagtttatatgcaaaaatataatattatgatgtgaacatttgtcacacagctttggaaatttatattgtttgaactgatcatatatattattgaggacaaccattttaaatgatatgtgattgctaggagttgaagcatgtaaaacagatatg

SEQ ID NO: 335 - DNA, 383 bp, Unknown
  misc_feature (1)..( 383): cDNA_ID_3436971_gDNA_ID_1563968_Annot_ID_148603 3000 nt of promoter + ATG
  misc_feature (73)..(73): n is a, c, g, or t
  misc_feature (150)..(150): n is a, c, g, or t
  misc_feature (175)..(175): n is a, c, g, or t
ttataaatatttttgttttttaaaaaaaaaggaaaactcgataatcttataatcgtttcttttgtatgtatgngaatacacaacaaaaagtgactttggtcttcgttggactattttgtggaaaagtcttatatcccagaagcccaaaanttgtaaaatccgaagtctatggccnaagtagagttctccacatctgacaaaacgacatcgttcgatggaactttacgaggcttcttttccctcacatcgtcctccgagccctcacttgacagaactcagaaatttgaaagagaaataaaagagagagaagctcccagagaagaaaagccctaaaagccccactcctctttccagtttcttttgatctctcagcatcgaaaatg

SEQ ID NO: 336 - DNA, 197 bp, Unknown
  misc_feature (1)..( 197): cDNA_ID_3029569_gDNA_ID_1564001_Annot_ID_148663 3000 nt of promoter + ATG
gtatacaaaattcagccctcgctttctattccattaatacattttttttaatccgtcatgttatgctaaaaaaatgaattctgggaaaacgatcagaatgaagtgagaagtgtatattgtgttatgtggttgctttacttttccattttactaaaaaaaattcttggaattgagcagtcaatgttgatgatgccatg

SEQ ID NO: 337 - DNA, 533 bp, Unknown
  misc_feature (1)..( 533): cDNA_ID_3053350_gDNA_ID_1564016_Annot_ID_148689 3000 nt of promoter + ATG
aaaaaaatttttatttaaaaagatatgattagaaaaacaaataatttgtgaaagcccttaaaaaaaaaaattgagagaatgtagaaattttcagataaaaagaataaataaaatttgcaaataaataaataatattaacaattttttaattcataaaatattatgattggctacagcttctctagctgcccaaactctgttttacaaaatcccaaaccaaacaagttatcattcatgatcgctttcgttatattcattctctcttttctctttccattttggctcccaccgacgtcatcaatctctaccggagacttccgccgattctcacaccgttcttcttctctccttccgattccggattccaatttcgttccttttttgttttctctcaaaacccctaaattttcttcctttcttcgatctggattttttgtgttccccaaatttcaagactttgatctgattccttctaagatttctccaaagcaaagatcttttttttgttttttgggatctctgtattgttgatg

SEQ ID NO: 338 - DNA, 19 bp, Unknown
  misc_feature (1)..( 19): cDNA_ID_3053452_gDNA_ID_1564051_Annot_ID_148755 3000 nt of promoter + ATG
catcggtttaccagcaatg

SEQ ID NO: 339 - DNA, 108 bp, Unknown
  misc_feature (1)..( 108): cDNA_ID_3016291_gDNA_ID_1564055_Annot_ID_148763 3000 nt of promoter + ATG
aaatgcagcatctgacaaagaaaagtgagtaattgtggtaccaccaagttccctacagacggagtcatccaatcttctgatgtctctaaggatcagttaagtatgatg

SEQ ID NO: 340 - DNA, 56 bp, Unknown
  misc_feature (1)..( 56): cDNA_ID_2048407_gDNA_ID_1564067_Annot_ID_148788 3000 nt of promoter + ATG
tttttaaaaaaaaaaaaaaaaaatccaaaatttctggagtagtttctcgagccatg

SEQ ID NO: 341 - DNA, 327 bp, Unknown
  misc_feature (1)..( 327): cDNA_ID_2025553_gDNA_ID_1564117_Annot_ID_148882 3000 nt of promoter + ATG
gttttgcagcggaagagatgatctgggtaagtgagagattctcaatgacatgtttccagagaatattagagaccttcccattgttggtgtcgccggagaattttcgaatttttgttgttgttcggtttttggtttatatgaacgcggccaagtgaacggatggtggacatgagagagtccaaaaagctgatagaacttaaaattgaaattaatgagaacattgaaccaaaatcaggttaacaaataaccagagataaccggtctctgtagtatactcaaatggttagtttttgccgatggtggtgccctaaactcgaaaaaaagatg

SEQ ID NO: 342 - DNA, 1378 bp, Unknown
  misc_feature (1)..( 1378): cDNA_ID_1032244_gDNA_ID_1564117_Annot_ID_148883 3000 nt of promoter + ATG
aagatcacctgttkcgggtcacggacaagctgcatcgcagcattatcgacatacatatgtgatagttcaacatctggatattcagaggctaaagctgttactcttttcctccacaatattgatgcctatacgaaacaaaacaaaaaaataattgtataacgaaaaacacacaagagtggagtggaaaaacaattcaaaacatacatccaagacattggctttgtcaacagaacacagcttgccacgccttttcctagcagtctcgaatgcaacacgagcaattctgtcaatctgaagaagataaagcaatgcattaatacacatacattgtcacagagcagcagattgtgaagagtaagtagtacctcgtgagcagcgtagatctctgtattaaaaccgacttcttcgccattttcgttgatcgtaatgcctcttggctctccaaagtaaatacctccagtgagctcccttacaatcatcatatcaacaccttgtgctacttctttcttcagtgtggaagcatcaactagctgaacaagcaaaaacagaaaaatttgagtatatttacaactagaaagcaaagtgataagcaaatcaatacctgtggtaaaactgtagcaggtctcaaattagcaaagacattgagatctcttcgaatgttaagcagacccatctcaggtctcagatgtttctcattcttgtcccatttgtacctgaacaaaaaatcatcataaagagaataaatttgctgaagaaacaacacacacacgcattacacataccctccgatagctccaagaagaatggcatcagactgtttagcagcagtggaagtttcctccggcaatggaactccgaccaaatccaaagctgctccgccgaaaggcatctcctggaaatcaaactctagtccttggagaaatccagctttctgaagcacattcttagcaacagatataacttctggaccgataccatcgccgggaagcagagtgatgttataccgttttttcaccggtgaagcggcggcgcacctaattcgatacggcgcacgaaacttatgatcggtgagagaactgtatcttcccggtatgatctccagacggatgttagtttgcaaaaacgccgccatctttttttcgagtttagggcaccaccatcggcaaaaactaaccatttgagtatactacagagaccggttatctctggttatttgttaacctgattttggttcaatgttctcattaatttcaattttaagttctatcagctttttggactctctcatgtccaccatccgttcacttggccgcgttcatataaaccaaaaaccgaacaacaacaaaaattcgaaaattctccggcgacaccaacaatg

SEQ ID NO: 343 - DNA, 223 bp, Unknown
  misc_feature (1)..( 223): cDNA_ID_3053620_gDNA_ID_1564118_Annot_ID_148886 3000 nt of promoter + ATG
gcctttaaagcccaatatgatcaaggccgaggaaaagctgacccaaacgtaatcgagacttgttgaagaagcctttgscctcatcgtcgtcttgtataataattttggttgtggcgcttctttcaatttgttttcagtttcgccatttccctccactctcaagctctcttttgcttctctcgctttctctggtgacccgaatctgctctgattgagagaaatg

SEQ ID NO: 344 - DNA, 802 bp, Unknown
  misc_feature (1)..( 802): cDNA_ID_1829152_gDNA_ID_1564119_Annot_ID_148887 3000 nt of promoter + ATG
ttttttttttggttggaaaaataaaaagtctctgttttcagaccgaatcttttgatgtatcacttgcatggctgtgaaggctctgtgtagcctgtaaagcttacacgaggattttgttgctccccttaatttccctctaawatctctccttctctctctctctacgataataatgtcttctvtgcaccgtttcctttcgccttctttctgtccgtttccaagtttcwttcgtttcttrtttttggctkwattwacrtgccatctctdtcgatgataacgacatgaaaccckcctcaaacaaaaccacattcacttattattagcctttgtttttttttgagtggccgtgaaggtgtgtgattrtggtgccctttcttcctttttgtttccctgcttaaggtattcctgatttttttccgtttcttgggatttattctgtgccattttttttgtttctgtttccaaattcttggctagttaattacgacctcaggatcatgtggatcctgttctttttgttatcctcttcatcagtgtttgacactatcttgtgwtttttccctctttttcaawaaccrtagatgsttattccttggccrgatgggycyckagtgawawcagmgtawggtgataybckakgacawtttcawawtvttcccttttttttttcttctttaatgttatttatgtttttttacttgacacttggtttcttgatatgtcctgatttgctttgacaacaaaaaatgcaggttaccgttgatagagtggtgttttggttctgttttggtgtgagcgtatg

SEQ ID NO: 345 - DNA, 589 bp, Unknown
  misc_feature (1)..( 589): cDNA_ID_3053643_gDNA_ID_1564131_Annot_ID_148907 3000 nt of promoter + ATG
aatcawatttgttttgtctgattaaaaaaagtttaawatatgmaaattaagmaagyacktcaatgaackttwaacatagaaaatattwacaaagagcagttwactatcaaggggyccaatttgattaaayaaattattttttgttcccattayaaattggcaawaacgttgaggmtgttrtrtcaaattaaaaaaaaaaatattttctattttgttggtgtgctcttaaattccccattgttacattgaggttgccctctaaattttaaaatattttatttttttgttggtgtgcccttaaatcacccattacacaacaaacaaaaaaagagactaaccaaaaaataattttataattaattttgtttcttcctacctacaagtatttacttaaccattgcctcgatcttttaaaccatccacattttttgaatcaccatcaacatctttctctcttctctttcttctctctatctgagtccagaaacattcacattaattacaaactgaaaaaacattgaaacttttgaataaactcacgagaagtactctgttttctcttcttactctgtttcttgttgatacaatg

SEQ ID NO: 346 - DNA, 22 bp, Unknown
  misc_feature (1)..( 22): cDNA_ID_3092689_gDNA_ID_1564156_Annot_ID_148954 3000 nt of promoter + ATG
ctcgggcaagagcaatgacatg

SEQ ID NO: 347 - DNA, 116 bp, Unknown
  misc_feature (1)..( 116): cDNA_ID_3028093_gDNA_ID_1564163_Annot_ID_148965 3000 nt of promoter + ATG
tataccttattggccccataaatacctaaagttggacaaatatcaataggtcgatatatatatgacgagcgaagtccactaaaagaaacagaacatcaaatcatctatccattatg

SEQ ID NO: 348 - DNA, 395 bp, Unknown
  misc_feature (1)..( 395): cDNA_ID_1009053_gDNA_ID_1564175_Annot_ID_148984 3000 nt of promoter + ATG
cgactaaaagaaayccaaaatgtattcgstcacatcactttaaaatcatgttttcyarktcaagtatattkaatkattcttttcaaactatatgaggttactgaaatgttatgcacdcaaaagaaataaaaagycaaaactattrddaaaagaaatgactagtcattaatactcggttgcaaaaaaaattaagaaaagaagcaagaaagagacctagtagtttcaagaatctccccatagaagaaaaagkcaatcattaaatatctcgaattctgtgtgcgccaataatattctccaaagtctaaaccatcaaaccggttattatatacatataaattagactaccgtaatcaatttccacttagagatcatcgagagggcaagagagaaaaatg

SEQ ID NO: 349 - DNA, 973 bp, Unknown
  misc_feature (1)..( 973): cDNA_ID_3063476_gDNA_ID_1564194_Annot_ID_149019 3000 nt of promoter + ATG
tacgtaraattaaacctgtcccgaaactagcttgccacagkgtygcatcttggtgtcaccctcgagcgccaaaccttgatattttgacttgcgttaaagattcacacatatggkatctttgtttaagatttggtattgyatatggtmsaatatatyyatgkrtattagatgmstggtctaattgtttgaattttygcaggtctattgagcatccaacttattcggccctgacaaggccgttatgtgaactttcttccttggttccgcctcaagtacttgcaacccacagaaaacttagggtaattagctcattgwtgatgaaatcctcgaaatctaccacgtatcatatcatttctttctgcctgctmgttgtatactatatcaatagctcatgctcaagcctgagcatgagcattgctctctgaggctccattctatgtgtcccacaaaacattagtttctcttcttatctcgyaaaatgcatctattatggttcaaatgatgaagttgtgtagctgtataatattgcacttggcaatgcaaaggtmttctgactcaagtagactaggaataagaataagaatrgaatwcaactgtttgataatatattacttcttgcagraaagttttgtwtatagcagactttaaattgatagctgthygaacactaaatktatctaamaraaaattgcaatggasaagatmcgtaatctttatgtcagatggtgatmgggaaagcacatgctgcacccgaaagttgaaasytattcctttttcaraatttgcarataatattcggggttcattttctacttgaaaccgccagttgatgattttcaaagattgctagtttctttattgcataattataatagcattgcttctgtacttctttcgctttcatggcttccatacattggtagtaaccctcatcaggtacttattaatttccattttttaggtctattgtatg

SEQ ID NO: 350 - DNA, 286 bp, Unknown
  misc_feature (1)..( 286): cDNA_ID_3053909_gDNA_ID_1564215_Annot_ID_149054 3000 nt of promoter + ATG
accaccacatttctttagctcaaccttcattactaatctccttttaaggtatgttcacttttcttcgattcatactttctcaagattcctgcatttctttagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaaaaatg

SEQ ID NO: 351 - DNA, 108 bp, Unknown
  misc_feature (1)..( 108): cDNA_ID_3042299_gDNA_ID_1564216_Annot_ID_149056 3000 nt of promoter + ATG
ggaaaaatcgagaacgaaagtggtgattctactcttaagccttcaaaatcaaagcttttttttgtttctttgttctgttttttgcaaaaaataatttccgcggagatg

SEQ ID NO: 352 - DNA, 496 bp, Unknown
  misc_feature (1)..( 496): cDNA_ID_2105398_gDNA_ID_1564227_Annot_ID_149074 3000 nt of promoter + ATG
gtcttgtagaaaaaaaaactgaaccaaaacaaacttaatttacttcgaagttttatatttcgttatacaaaaagaaaaagtctaaatttctaaatacatgtagaaaatatattcaaggtaataactaataagtcaaatatttgaccagacaagtgaccaaaaggaagacaacaacaagaaaacaaatagctttttagccatttggacccacgacagtagataaagtcttggacatattattactaaccttttgtggcggcttagtgtttatcttcaaccccacacattctctgtttcctcgaaactgcatttttcttctttgccaagacaaagattaaataagacaaatatcaaccctatcctttgtttatatcaacaacatctcgcaacttgtgttcacatgaaacttctcactactctctttcatttcctcttttcgttgacttactaaagtactcttgtttcaatcttcattctagagagattctgtttcatg

SEQ ID NO: 353 - DNA, 106 bp, Unknown
  misc_feature (1)..( 106): cDNA_ID_3053939_gDNA_ID_1564228_Annot_ID_149077 3000 nt of promoter + ATG
gaagagtgaatcaggcgktgtcataggtccaaatctttttatatataacagccttttgggtgctatgagagggtttggggaagcagagaagatactgaaagatatg

SEQ ID NO: 354 - DNA, 59 bp, Unknown
  misc_feature (1)..( 59): cDNA_ID_3053963_gDNA_ID_1564238_Annot_ID_149093 3000 nt of promoter + ATG
agacttttagctctacattattatcataccaagtctacaatcactcagagaagaaaatg

SEQ ID NO: 355 - DNA, 629 bp, Unknown
  misc_feature (1)..( 629): cDNA_ID_3054102_gDNA_ID_1564282_Annot_ID_149174 3000 nt of promoter + ATG
ttatctaaattgatgatgttttggaaaccaattatctaaaactagtttatgattttactttcgttttctaaaccaataaacccccttgaatgatttagaaaaaagaaacatatatacaataataatctttataaattaataaaaaaattyggttatattttgggaccggtataagaaattgacattattgttttaaaagttttatagaaacatatagtccattaataacataaattaataattctataaacttatgaaaatatatatacatttctcgaaatttcttacacataccaattataggtaagaaaacttttttaaaaaaagaccggaaaaaatcccatcttgaagcaaaacatattgtaacttaccaccagggcagagcaggtggtttaatccgacggcgagaagatagaaaaaaaaagtgaaaaaggtcgcaacttgttgtgtctctctttctccaactaccctttcgagcttagctgtccactcttctctcccgatgaaatcttcatctttcgtatctctcctccttctcatgccctaaatttcatctcctctcttgtattgattctgttaaaaatctcacctttcaattcaaaaccccttccatttttgtgattaatatg

SEQ ID NO: 356 - DNA, 689 bp, Unknown
  misc_feature (1)..( 689): cDNA_ID_1019508_gDNA_ID_1564308_Annot_ID_149219 3000 nt of promoter + ATG
araaaagtgatggttggttggactttgataataacaacgatatcgagaatcatattttgagaagtttgggcgaatccataattagtagagtgaaaaaagactctataaagataaagatcgacgattwtgatacagggagccagcacgaggtaaccttcgggtataatcatgaatctgatacatattacattggatcattatggagattgaaggagcttgctgctggagatgaaataggattgttttacgatcctatttcaaagaatttgtgtttctctgtgttgaaacaagcaaaatcctgcttgatcaaaaaatgaaataagcaaaaccctgatgatcacaacttgtttaattatggttaattatacagcatagtaattaataagatcttgtttgaaaggacatatataagaatatgtatcgacgataatcatttctatatattaataaatatacaagttttgacatttcacttttgttcctcttaaatatgacaccttgtttctcaccattagatcgaccgacgacataagtaataacatttattacatacaccaaaaaaacaagcaaatcattaatacaattttccattagtgtatataacaaacaagagactaatcttttctttaacatttcatagtattacaaaacaacgccaaaagtcaaaaggtttcgctttctagatcatg

SEQ ID NO: 357 - DNA, 80 bp, Unknown
  misc_feature (1)..( 80): cDNA_ID_3594167_gDNA_ID_1564312_Annot_ID_149225 3000 nt of promoter + ATG
caaataaatctgaaataaaagacaaaacgttactcttctctctcattctctttmgcttctcgatagcttctcaaatcatg

SEQ ID NO: 358 - DNA, 788 bp, Unknown
  misc_feature (1)..( 788): cDNA_ID_3052886_gDNA_ID_1564341_Annot_ID_149285 3000 nt of promoter + ATG
aataaggggaatttggatgttcaarggacttaaccacgattgatgactaaacaaagcagtggttagctgaattactaactaactagagctagctgcctaggctagtcgaaagaacaattctccgttttgagttgaccataaaataataatattcaacaatattggaggaaacatgtttatatgttcttgtaataataatattatagcaaatagccgaagatacgacgaagcgtatatgtgtgaaatgagtatattctacagcctaaaccctcggagataccaaatcaacacgacaacagcgacgggacacctgtatggttctaattcaacttcttgtccacatcttcttcttcttcttcttctttttttaatagatatattaagaaaacaaaacagaaaatctcccacgtctttacaaagaaaataaagaagaagaaaataaggaaaaagaatctgatagtaattgacaaaaataccctcatctcctacctcaagacagtaatatatatgtaacaactcgatacagagcatggcttatctcttatccgaatcctcccaatttgtctgtctctcttttgttttctctgctaacagatctctctaaatatctgttacttttgttcatatctttttacttttcaaactactaattttcctttcgcttcttctattaataacaacactctctctctcagacttcttttcttttttttctacggcgttgattcattcgcaatgacctcagtttctgtgtaccataattgacctagcagattctgtttttaatg

SEQ ID NO: 359 - DNA, 855 bp, Unknown
  misc_feature (1)..( 855): cDNA_ID_1034108_gDNA_ID_1564347_Annot_ID_149294 3000 nt of promoter + ATG
cgtgtctttttcaaacatcattcattcatttcttataatgctttctgattttaaaactcttgacactttgaacagaaaatggattcttgttatttgcatcaaacatcatctatggatgttaaaatcctattatcttcagatcaaatccaaaacckaaactatackaacaaatataagaatgaaaataagtttttttttaaaaacaacaagtgttacagctacattataagtrtgaattataaaatcttacaaatattagtaatttttgattaaacataaaacaaaactttttattatcgtagctaacaatcaaagttttatttttttttttaaaaacagacgctaattcgcactactacacaaatcaatagttttagaaaaaaaagaaaaaaagagagagatgatcataaaataaggaaaaagaagaaaaggataacaataattaattctaacaggatagtgcacatcacatggcagaagtaggacagtaatttgtttttggttacatgtgtataaaaatgcgattctttgcttcattcctctttgttaaaataaaatagaataaaaataaaggaagaagaagaagaagaagaagaagaaaggattcgtcttccttcttccacaccctttctgacacctcatctcccctcccaccttctccgtcccgttccgtttctccatcaggtaattattaatctcctcttaatcatccctctaatctctttcccgtttcttcatctcccgattctcaattccatctacacagatcctcgattccgatccaacagttcgaattcagtttccgattctgatctgatcgaaccaatactcactgagatttgatcggcgattatg

SEQ ID NO: 360 - DNA, 668 bp, Unknown
  misc_feature (1)..( 668): cDNA_ID_3054324_gDNA_ID_1564359_Annot_ID_149319 3000 nt of promoter + ATG
cgtaagctagaatattacaggatagatgagattaaagaaatagtcccaaatagcaagcaacaaaactaaaacattaacacaaacaaattctaaaaatagagacacaaacttaacaaagatacaatgaaacctcaatgaattaatactcgatatactaataccttaaaatattttttctagttctaaattaataatttaacctaaaaatatcacttctataaattaataattacgataatttaatgaaatttagtaaaccattaatctcaatattcttaatttatagaggttttactaaattgtagaaacaactaattcgagtacatccctgaattaataaattttagaaatgtgaattaacgaatacttttgttcttgtgaatggttaaaaaaaagttacttatcaagacaagtatgaagtatcacgtgattaaacgtttaatgacaccaacctaatgacaatttgtttgatttatttgtcacctaactagagactctctcacagtcaacgcagcttatgtgtcatagtaagactttttgtctactatagaagaaagacgaatttataacccctttaggtmttttctaacacacgcctctaatctccgcgcacacacacacaccctcacgaagaagaagaagaagaagaagacgaagaagaatcaatg

SEQ ID NO: 361 - DNA, 665 bp, Unknown
  misc_feature (1)..( 665): cDNA_ID_3066549_gDNA_ID_1564361_Annot_ID_149324 3000 nt of promoter + ATG
taagtagtgtgtttgtacatttgttccgcaatggtttgctgattagaaaatctgcctgcagtttcctcactaaaccaaaaaagtcttgatttttttccatgttgtgtaatctcttgatttacaagtatttggactaatacttctctgttcagagattctttgtctctgttctgttggaaagtaattttggtttgctttctctgtagattactttccagttagacctaaatccggatatttgtattgctctaatcattccacttaacttgagtataaaattttgctttaagcctaatcaatttaattgcttattgtgtgacattgtttcagtattgtaggtgaaaagcctgacacatagagaacaaagatgtcttcagtttgagttagtagagattgattctggcctggaatccttatcttggacttgaccacccttgggtgaagtctagaccactctttgtgcttctagcagccggtgtgatggctactgtcttgcactcagagtccaggcggttatactcctggtggtgggatagtcacattcccaaaaactctaaatggattcagcagaactttcaggtgcctctttctctctatgttctaaagtgttaagtgttttgttcctttgtattattgcttacggttattttcttgatgtagatatg

SEQ ID NO: 362 - DNA, 460 bp, Unknown
  misc_feature (1)..( 460): cDNA_ID_1394255_gDNA_ID_1564366_Annot_ID_149332 3000 nt of promoter + ATG
  misc_feature (426)..(426): n is a, c, g, or t
ataatagmactctgtacatacaataaagaaaatgaatcaagatattagtaggatacccatacgaatttaggaaaaatgaatcagataacggatataatattvtcttatataagtaaataaaatctgtaaatataatttttttggacggcaaatctataaaaatagctattggataaataaaaattggcatgtgaatgatatttatgaactgacatagccatgtgttataatctcacccacagataaccacaaaaatatataaacccaaaaagtaataaaaaagaaaggaataaaaggaagatattctcccgaaagaaagacagagaaaaaaggatattctaattagaaaccttaagaatattctttttaatcccttttatatctctaaacctcttccccctctstttcttcttcattcatcattcntcacttacgtttcccagaaaataaaagagctatg

SEQ ID NO: 363 - DNA, 312 bp, Unknown
  misc_feature (1)..( 312): cDNA_ID_3054388_gDNA_ID_1564379_Annot_ID_149354 3000 nt of promoter + ATG
tcatgaggtcttgttatatatatggtgatcacatctttaaagaaaatgttatagtatttgttttagtttaaacaattttttatgtgccaaaaacattattaaaaaaagagcaataccctactctaaaatagtaaagctaccaaattcaattcattacgacatggctcaaaagaaaaagtatttcgaatattatacgatatcaaccccattatcattgctataaaataagccaaactttccctctccattttcaataatctctcatcttctttcgtctctctttctacggttcaaacattaaaaagatagatg

SEQ ID NO: 364 - DNA, 1250 bp, Unknown
  misc_feature (1)..( 1250): cDNA_ID_2990066_gDNA_ID_1564380_Annot_ID_149357 3000 nt of promoter + ATG
ttttttgcatatgtagaacaccgcaccggcaccagatggtaaaactaagggagcacaagccttatccatgagaatctccggaaactttgctgctttctacaactgcaaattctacggtttccaagacacaatctgtgacgataccggaaaccatttcttcaaggattgttacgtcgaaggaacattcgatttcatcttcggaagtggaacctctatgtacttggtacgtaacatctcatacttatttcttaatacataaagtgcgagatctctaatgcatgtttgagttcaaaagggaacacaattgcacgtggttggagacggtattagagtgatagcagcgcatgcaggaaagagcgcagaagagaagagtggatactctttcgtacactgcaaggtgaccggaaccggtggaggaatctatttgggaagagcatggatgagccaccctaaggttgtttatgcctacaccgagatgaccagcgttgtcaaccccaccggatggcaagaaaacaagactcccgcacatgacaagtaagtcctacttttcacattacatagaagacgttatgaatatcacccaatcggtccatgtctcttatgttggttctatcatgacaggaccgtgttttacggagagtacaagtgttcaggaccaggatcacacaaagccaagagagtaccattcacacaagacattgacgacaaagaagctaaccgtttcctatccctcggctacatccaaggatccaagtggcttctcccaccacccgctttgtaaactcttcaatatcaagtctaaaatcatattttgcacatatatcacttttaacaaaaaaattatttttacatatatcacttttagcaaactttttctttacctagtcgtcactacttacgaccctatgtatgcttttatgcaaagaaccgagaggtcgataatctgagaaacatataagcaatcgagacttagccgaaataaattgattttctctctcaaataaaagtataaatggtaccctatatttatgtagcttttctaaaatagccgaggttttatttaattatcaaaaaagtcttttaagtctaaaagtaaaactcggtcacgaccaaagtaaaaactacgaaacagtaccttttgtttatgtatacttacaaaagtatcccaaatgtatttaattatcaaaaaggtccgttttaattacaatcactgaataatcatctggtgttactctctctgctcacaaatg

SEQ ID NO: 365 - DNA, 3 bp, Unknown
  misc_feature (1)..( 3): cDNA_ID_4263162_gDNA_ID_1564383_Annot_ID_149362 3000 nt of promoter + ATG
gtt

SEQ ID NO: 366 - DNA, 49 bp, Unknown
  misc_feature (1)..( 49): cDNA_ID_3054406_gDNA_ID_1564385_Annot_ID_149365 3000 nt of promoter + ATG
cactcaacaagttcatgaaatggtggatgtaagaaatgacgagkcaatg

SEQ ID NO: 367 - DNA, 791 bp, Unknown
  misc_feature (1)..( 791): cDNA_ID_2685721_gDNA_ID_1564388_Annot_ID_149369 3000 nt of promoter + ATG
agtaaaacctctataaattataatactacagtaaaacttcttttaaattaatattagataaactaataatttttataaattaacaaattcttccgattttgagttgtaactatagtaaaaattaatacaaatcgataaattaataagataatttttattaaaaaaaatcattgtataaaattaatataatatgctctcattaatattataaattaataattttataaattccttaatatatatataagaaattttagtaaaacataacctttgctatattcctttttcatttttaatatttttactacattcaaaactctttttgttgttgtctatacataataaattttaattattttgtaaatggttctaaaaagataataattataaataaaagaaaacttttttagaaaaaatcttttaaaaattacaaaattagtttaaactctctataaattaatagtacttttctaaattaataaaattttattgtctcgatattattaatttatagaggtttgactgtatgatgaatagttaaatacctttataaattttgttacaaatgttggatacatatatacaaattacaatctatactaaaccaaattaaccgaaaaacaatcctaaccagcattaaaccggagctatacatatgtagtagatcagtttaatttggtcctcacctcaatcccaagaaaaaggccgttctttgcattttctatcgtttcatgtctgtctgagtgacagaggaaaccccaaaaacstccgtaaaacctcacaaaagaatg

SEQ ID NO: 368 - DNA, 745 bp, Unknown
  misc_feature (1)..( 745): cDNA_ID_1566630_gDNA_ID_1564401_Annot_ID_149391 3000 nt of promoter + ATG
aaaaaaaagacatagaaatcttctcacatggtacgataaattttagctgaggtatcgtttggagtttggacattttttcaaaagtcaaaagtgatctggttcggtccgatttataaaccaaaccgaacaaaataaaccagaacggtttaactaaaatccctaatttcccgtacgatctgaccttcctttagtgatctcataacttagccattctaccattcaccgtctctgtttcgttcgccgtgattcatagtcgtctcgtctcaccgtcaccatcaccgtcttcttcttccattgacaggtttcattatttctgaagattctctattcaagtagtttttaaagttttcctctttgttactctgtttggttttttgtttgattttaacatttctttgttcccccgatttatcatcattttcaagcttaaatttttggatatgtttgcaagtgcctgaagctgattgatatctcttatgaaatctctctgctttcttctgattctgtttccttcaactcacagttcaatctttagtatgctcttttagtaatctcttctatgatttgttgtgggttctctattgttttctatacgtatttccaaaaattgaaacttgattatgtgtgattccttttaagcaagatcaatgaataaaaaagtttgctctttgaactgaaaatcagcaatctattggatattgactttgttcttactactgtaggatcttgtttagattctgcaatg

SEQ ID NO: 369 - DNA, 209 bp, Unknown
  misc_feature (1)..( 209): cDNA_ID_1025971_gDNA_ID_1564417_Annot_ID_149420 3000 nt of promoter + ATG
aactcatttggggttttacgtctgcgtttgcgtttgcgtttgcgtttgtgaacgcctttattcgattttggaaaagaaaaaatgttctgttctattttgttctctctgctagtcacagtcaaatgagtcagctaccttatattcgattttgagcgtccttaaattccttcactgtgagaaaaaacacagagaaagagagagaaacaatg

SEQ ID NO: 370 - DNA, 202 bp, Unknown
  misc_feature (1)..( 202): cDNA_ID_2705162_gDNA_ID_1564427_Annot_ID_149437 3000 nt of promoter + ATG
gtttaagaacataggctgatgccgtttcttattttcagacactaactttgtgccgttttatttcatggaaatcgaaatgttctctgcttctctgctggagctagagaaggtataaaagtaaactttttcaggtccaacgcagcaaaaagtctcccctttcctctctttctctctctgcgtccttctgaggctggaagcgatg

SEQ ID NO: 371 - DNA, 11 bp, Unknown
  misc_feature (1)..( 11): cDNA_ID_2709550_gDNA_ID_1564439_Annot_ID_149458 3000 nt of promoter + ATG
tcggtctaatg

SEQ ID NO: 372 - DNA, 245 bp, Unknown
  misc_feature (1)..( 245): cDNA_ID_1471083_gDNA_ID_1564444_Annot_ID_149466 3000 nt of promoter + ATG
gtactattagaaatagaaaggggaaaaaaaatcaaaacttttcctttttgatcagatctttagtttctgtaatgagtagattactgttgatccttggtgggttatttgatcccatcttcaaaattttgtctttttgaatagaatctttacttttgcagatggaggtcgatgaagaagaagagatatgatttagtctttcttcaaattgagaatcttggggtggttgttttttattgctagtcatg

SEQ ID NO: 373 - DNA, 10 bp, Unknown
  misc_feature (1)..( 10): cDNA_ID_3054564_gDNA_ID_1564448_Annot_ID_149473 3000 nt of promoter + ATG
ggagaatatg

SEQ ID NO: 374 - DNA, 170 bp, Unknown
  misc_feature (1)..( 170): cDNA_ID_1689239_gDNA_ID_1564498_Annot_ID_149559 3000 nt of promoter + ATG
acagttaaaccaaataattatttcgacttatatgagttagagttatgactgactcatcactttatatctctctttctcaaaaaaagtcaatggtgaatacgccttttccacagatttttgtctatgtgaacttcaacttttctcgctagtcgctactctagtctctcatg

SEQ ID NO: 375 - DNA, 904 bp, Unknown
  misc_feature (1)..( 904): cDNA_ID_1388444_gDNA_ID_1564514_Annot_ID_149582 3000 nt of promoter + ATG
ggtatgactacgtaattactgagtatatattatactttgaaattaaatttattcaaaataaggcttttaattaatttaacttgtaacttttcatagaagctactgttcatattttctttgctagtcttaggtctattatattattgactcacaacttaaaaactagaaaaaaaattgtataaataataatacaattcagggcaattttgcttaagaactagacaaatgcaaggtagtatgaattaagttgcaaccaattgcaatgaaacaaacaaaatttaacatatttcttcaaattactattatatattttttttaaaactttagaatgtaaagacattaaattgtaaacaaataacaatttttttcctgttttatcatctagttttaggagtttgtcttacatttgaagattaaaaaaaatatccaaaaattaaaagcaatatcatatagcaatctcgcattgttttggactcattgcacaataattttacttattgggcctttagtaatagataaacgatccaatttataactacgtcgttttaaagatataacatcccaactgggttctgattcggtggatccaagttcgggttgcaattcgattaagaatcaaaccatttttgaagaaccctaaaagttctcttcttcccccaaattttaatctgttcttgcaatcggattcgaaatccgaaagtcttagtctcgaatttgagctcaacagtttcttatggctccgaagaagtctgaaggaatcgctttgctttccgtttacagtgatgaagatgacgaagagatggaagacgccgaggaagaggaagaagaagatgagaagcagagaaatcaggaagagagtgaaaaaataattgaagaagatcaggtagaagaagcgaattatatg

SEQ ID NO: 376 - DNA, 3 bp, Unknown
  misc_feature (1)..( 3): cDNA_ID_3054754_gDNA_ID_1564516_Annot_ID_149586 3000 nt of promoter + ATG
atg

SEQ ID NO: 377 - DNA, 4 bp, Unknown
  misc_feature (1)..( 4): cDNA_ID_3054773_gDNA_ID_1564526_Annot_ID_149603 3000 nt of promoter + ATG
catg

SEQ ID NO: 378 - DNA, 54 bp, Unknown
  misc_feature (1)..( 54): cDNA_ID_3054783_gDNA_ID_1564528_Annot_ID_149606 3000 nt of promoter + ATG
ttgataatcactcattcaaatcaggctttgaatgatctttttgagaagataatg

SEQ ID NO: 379 - DNA, 786 bp, Unknown
  misc_feature (1)..( 786): cDNA_ID_2993463_gDNA_ID_1564533_Annot_ID_149617 3000 nt of promoter + ATG
aaaaaaaaackaataaataatckaattttactgaaataaattgtaatgatcaaawawatttaagcattgaatttttttgmgtagtccraaagmtmaatrttmaaaggcrgctgatcrtaawttgtcrttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatttatttatatatttaatgatgaaaattgtaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactatakcagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatg

SEQ ID NO: 380 - DNA, 494 bp, Unknown
  misc_feature (1)..( 494): cDNA_ID_2712623_gDNA_ID_1564535_Annot_ID_149620 3000 nt of promoter + ATG
agttttccaacttattaagctattagtcaactttcttaaaaatataagtcttactttattggttgaattgaacgacatgtgtattgctactttaacttattcgagttgttaatrtttttttttatcatcatcattcgagttgtttaattgtttaatcacaaaaaattaaaatggaaaattacctaaataaacattatattatgttgttgagaatattgatagttagtatgcaacaattcttttagtaagatcatgatgttattacctttaccttctaccacctaactgtttgaaaacacattttactcaattcatatattatattttacacatatacataagaaggagacaaatgcatatttcttaattgatttctgagcatttcaacagagagacaaagaacatagggacccgttgaggcatggctcctttgggtgtagaagaagagcaatagttactgtgagtggagcttgcagagattggaaaaaaacatg

SEQ ID NO: 381 - DNA, 281 bp, Unknown
  misc_feature (1)..( 281): cDNA_ID_2994259_gDNA_ID_1564561_Annot_ID_149660 3000 nt of promoter + ATG
ttactcactctcggttggtcaaagcgtgtttcgcccgggaagagttacccatgcgttgaatgatgatgctttggctcaagcactgatggataccaggtatccaactgaagggctgacgaactatgatgagtggacgattgatctgaggaaactcaacatgggtcctkgcctttgctcaaggggcttttggtaaattatacaaagggacatacaacggtgaagatgtagctatcaaaatacttgagcggccagagaacagcccagaaaaggcacagttcatg

SEQ ID NO: 382 - DNA, 242 bp, Unknown
  misc_feature (1)..( 242): cDNA_ID_3054943_gDNA_ID_1564586_Annot_ID_149704 3000 nt of promoter + ATG
cttgaattrgttctagtgtwaggatgtacatctgtttttttgataacactacctgtgacatcatcggtatccgtttgaatcccccactgtatggtacattcataaatcttgatgccatcttggacaaaagatataaacttagtggcatgccctaaagcaatgggtaagatcccgtcagctaaaggatctagcgtgcctgcatgaccaatttttgtttttttatctacaattttcttaatatg

SEQ ID NO: 383 - DNA, 49 bp, Unknown
  misc_feature (1)..( 49): cDNA_ID_3054977_gDNA_ID_1564597_Annot_ID_149724 3000 nt of promoter + ATG
tgtttacgaataatgtctaaatacattgttcgatttatacgtatatatg

SEQ ID NO: 384 - DNA, 254 bp, Unknown
  misc_feature (1)..( 254): cDNA_ID_1825731_gDNA_ID_1564609_Annot_ID_149744 3000 nt of promoter + ATG
tacgttctcgccatttgcgccattgattaattcaagtgcgttgaagttagaggtaaccaccaacttgcattttactctccaaagctctgatttttctgtcaaattcttttgaaaactttgatgcttgttttcttctcatcattgattcttttttgatgataggttagttctacacaaagcttgatcttttaggggttttctctagttattggagagtggtgagaattagaaactgcattatccgatctaaaatg

SEQ ID NO: 385 - DNA, 35 bp, Unknown
  misc_feature (1)..( 35): cDNA_ID_3055050_gDNA_ID_1564622_Annot_ID_149769 3000 nt of promoter + ATG
tagctctggatgttatatccatccacatgttcatg

SEQ ID NO: 386 - DNA, 363 bp, Unknown
  misc_feature (1)..( 363): cDNA_ID_1031100_gDNA_ID_1564626_Annot_ID_149775 3000 nt of promoter + ATG
  misc_feature (52)..(52): n is a, c, g, or t
attagtattatttaaaagaaatactaaagtggggtgagtgtaaatgataakngysttgtttggtgtascaaatagctggcataaggttggtattgaaaagctcatctcasaatcatcaacggcccaaaacacattgcaaattaaagaaaaagcaaagattttcctcattcttttgccattattatctctcatcgatttggcttgctacttttgaatttacccgtgttctactacgattcgggattagggttttttcttgagttagaaaagattgtttcttgattcttgggaatggctgggatttgaggaagaagaagtgcaaaagggttctttttttgagtttgtgaatttgctgcggagatg

SEQ ID NO: 387 - DNA, 126 bp, Unknown
  misc_feature (1)..( 126): cDNA_ID_3055110_gDNA_ID_1564641_Annot_ID_149799 3000 nt of promoter + ATG
aaaaaaaaaaaaaaaagaatctctatttaattgactcaaaagttttctcataacacaaactcatctctttcctctcaccttcctcatacatcatctctctttctctttgtctcctcatcaacaatg

SEQ ID NO: 388 - DNA, 356 bp, Unknown
  misc_feature (1)..( 356): cDNA_ID_1596933_gDNA_ID_1590610_Annot_ID_149852 3000 nt of promoter + ATG
tttttttgttgtattttactagttcatgatatgaatatgacttttgcgatagtagatttttaaaattatctttagtaaattaattaccaaaattgtttgcaaaacacgtgatgatctacactttaaagactttgaaatatattttaaactggtaaaaaagatgctttccgccataaagttgatctcatcaagaaacacaaagagaggtagcaattaaaatattcaaagatgaagagcattattagcacgagcaactcttttcctctgtctccacttacaaaggaacaaaacttgatctgctttatagtaaagaacaaaactcaggaagttcaaatttgcttgggcagagaaccatg

SEQ ID NO: 389 - DNA, 334 bp, Unknown
  misc_feature (1)..( 334): cDNA_ID_1026239_gDNA_ID_1590641_Annot_ID_149882 3000 nt of promoter + ATG
atatgatgaatatagtaatatgttatgctactttaaacgtttgaaaatcctattgtacacatcaaaaattaaagggtgtagtatgaagtgcttgattaacttttcattaaaacaaatgcatatgctgtagtaagattttagataagtagttcaggagaataaaaatataggttaacgttaacgtcaaagctaagtaagtccaaagtggaacaacacatacacacttttcttataaatatgggaagctttgtggttgccaaactcaaagcacattggggcttatctctctctaagtaatacacacaaaaataactcacatatagagagagatatg

SEQ ID NO: 390 - DNA, 3 bp, Unknown
  misc_feature (1)..( 3): cDNA_ID_1988848_gDNA_ID_1590644_Annot_ID_149884 3000 nt of promoter + ATG
aag

SEQ ID NO: 391 - DNA, 1727 bp, Unknown
  misc_feature (1)..( 1727): cDNA_ID_1597200_gDNA_ID_1590645_Annot_ID_149888 3000 nt of promoter + ATG
  misc_feature (447)..(453): n is a, c, g, or t
tcgttgtgtttttacggtcaatttggttctattcagatatggttatctccggttttggatttgaaatctcagatacagcggcggattcacagagttccccgagtgctgctgcgactgatggttttggagccgatttcctagcatgtatgaatatgtcctgggacaagttcgagacggacaaataaacgagaccatatgtttgctgcagctgacaagtctcactcagctttcttgttgattgatgagatataagagcagatgggattagctggatatgtgcaggaaactgagatggtatgcatataagttaaacaaatcgttggagcatataagcagacacaaacaatcagttgtagccgcagaggcattcctttgctcattgtgagatttggcagatctggagcactaaccattcgtagtctattgacaatcacacctgattcttannnnnnngtggatttatcttccaagttaatagctttacttgaaaaacgattccttactgatattcaaagcataacacgtctaggttcatggatgcactctataatttacttgacggttctattgacgacaatacaaagtttgaagatgagtgccgagctatttttggagcacagtcatatgttcttttcacattggacaagctagttcagaagtttgttaagcatgtaagcaaaactagtgtcttgtcttcttgactctctacttccattctctctctttcatctgatcactgggatggtttttggaaatgcttcagctccatgcagttgcatctgatgaaacagacaccaagcttctgcaactacatgcgtatgagaactacagaaaactttgggaagatgatttgatctagtgtatcatgagaatgcatgtgccatcctccatgaggcaaagatataccaaagagcaacactccaatcgttacattggttaaccgctggagcgttttggagcccgagaatgccagctcatccactttagagccaattggtcagatagaagcgagcaattcaaaaataataaaaatgaaaattaccgaacgacgtcgtattgataaatgggggctgtttggtagtacgtgtaatgttgttctaaatacgagtagggaagaggcgtaagataacaagatgcgtaggagaaaggaaaggattattgtcacttgcctgcgcaaattagggcttctccttcgcaagactctcttcgccagcttaaatcagtgtactctctctttctctgtctctatctcttgcaacttctctgtttctaatctcttcacgcatttgtgtatcaaggagtcattttttaacagaatatgaacatatttgataattcgaatcatgcgagttttattgaaagcttatgttcttgtgatgatttcaaacttttcgaaaacagcgactttcaaatttcttcagaaactatgaaaaccccatcttgtaattgccattatcggcatccaaaatgtgcttagctcggaaaattcgaattgaattagcttcgaaagctcctaattacattagaaaattcaatctttatacgaaatttttgaattctgaatctttctagcttcgtactcatgagtttaaaagcttgttacagattatgtagcacttcattggagattatctggttattgtagatagtaatgttacagagtctcataagtgctgttgttatgtgcttgtcaggcaaagtgctgaatataccttaggagctaaatg

SEQ ID NO: 392 - DNA, 70 bp, Unknown
  misc_feature (1)..( 70): cDNA_ID_3439206_gDNA_ID_1590652_Annot_ID_149894 3000 nt of promoter + ATG
aaactcacacttgctggcttcttcttccatggctttatcttttgtttcttcaactagattctccaagatg

SEQ ID NO: 393 - DNA, 23 bp, Unknown
  misc_feature (1)..( 23): cDNA_ID_1593869_gDNA_ID_1590659_Annot_ID_149904 3000 nt of promoter + ATG
  misc_feature (8)..(8): n is a, c, g, or t
gtcgcggnggttcttctgccatg

SEQ ID NO: 394 - DNA, 3 bp, Unknown
  misc_feature (1)..( 3): cDNA_ID_1593747_gDNA_ID_1590684_Annot_ID_149921 3000 nt of promoter + ATG
cat

SEQ ID NO: 395 - DNA, 239 bp, Unknown
  misc_feature (1)..( 239): cDNA_ID_1596158_gDNA_ID_1590743_Annot_ID_149977 3000 nt of promoter + ATG
cctccagcatatgtgtagagccgggcctgcatatacgattagtacttggagtcaaagtaacctcatggaaagacaaaactaagcttaaagacacagactttacacaagatacagattcagactactttactctaaagcaaaaagagcgacctctatccagtctccagcctatataaacaggctcttctcttccatttcctcttatcaagtgacaaaagaaaaacaaacgtactcaaatg

SEQ ID NO: 396 - DNA, 3000 bp, Unknown
  misc_feature (1)..( 3000): cDNA_ID_1596137_gDNA_ID_1590754_Annot_ID_149993 3000 nt of promoter + ATG
acttaggaaccgaaccaggctcaaaggcatactgtctcttggatccaaccactcacaagatagttgtaagcagagatgtagtcttcgatgaaactaaaagttggaagtggaatgatctaagaagtgaatcaacagaagattcaggaaactttgtacttggttttgaacaattttgaaataacggactaagaagagaaagagaagaacatggttctgagacaagcgagaagaacactaaggatgaagacacttctcgagtcactgaagcaacagaaacagaggaaccaattcaagaagaaggtcaaccacaagagaacacacaacccacactaagacgatctcaaaggcaagtttctatgccgaagtacttagaggattacgttctacttgctgaagaagaaagtgaatatctcctctctgtaataaacgaggaaccttgggattatgctgaagcaaaagaaacacaagagtggagagaagcgtgtgaggacgaaatcgcttcaattgagaagaacaagacatgggatttagtggaacttcctcaaggagctaagccaatcgggctcaaatgggtgtttaagctaaagaagaacgcagaagggaacataaacaagtataaggcaagactcgtggctaaaggttacgtacaacgacatggcatagattttgacgaagtctttgcccctgtagcacgaatcgaaacagtccgcttcatcattgccctagctgcttcaaacggatgggaagtgcatcatctcgatgtcaaaacagcattcttacacggtgaattaaaagagatagtatttgtttcacaaccagaaggattcacagagaaagggagtgagagaaagggagtgaaggcaaagtatacaaattgaataaggcactctatggattaagacaagcgcctagagcatggaacaacaaattaaacaagatacttggggaattaaagttcgtcaagtgttctaaagaaccatcgctctatcgtaagcaagagaaagatgatcttcttctagtagcagtgtatgtgaatgatttgcttatttcaggttctagcttaaagctcattaatgacttcaagaagggaatggcgtccaagtttgagatgagtgatctcgggttactcacatactatcttggaatcgaagtaattcagtataatggaggaattatgttgaaacaagggagatatgcagagaagatcctagacgaaaccaagatgagtgattgcaacgcagttcacattccaatggactccggtttgaagctgtcaaaagcgggaacagagaaaggaagtcatgactcggagacagagaagaacattgagccaaaagagtatagaagaaacattggatgtcttcggtatctacttcacacacgacctgacctctcatactgtgttggtgtgttgagtagatacatgcaagaacctaaagaaggtcatggagtagctatgaagcagattatgagatacttgcgtggcactacttcctatggactatctttcaagcgaggagacaaatcggggctaataggtttcagtgatagcagtcacaatgtagacgaggatgatgggaggagcacaaccggacatatattctaccttgatggctctctgataacttggtgtacacaaaagcaagaaactgtggctttatcgtcttgtgaggctgagtttatggcagccactgaaggagctaagcaggcaatttggttgcaagaattacttggagaggtaacaggagaagcatgcaagaaggtgagactactcattgacaacaaatcggcgatagcacttgccaagaatccagtatttcacggccggagcaaacacattcataagaggtaccatttcattcgtgagtatgttgagaatgagcaaatagaagtggaacacgttcccggggaagaacagaaggcaaatcttctaacaaaggcacttggaagaatcaaattcaaagagatgagagagctagttggagttcaagagttgtcgaagtgtgagttcaagcttaagggagtgaatgttgataagcttgaagttagcttaaggaataagctaaccaaatcctaagtgattaggattagattgcatctaggagttatctaaatacaatatttagtagttatctaatgttattaggagttatctaatagctagagttttcatataaatagagatgccaagttgtggtaatcctattgagaagtttagagtttgagagtttgagagattgagagctttggtgagagctttaggttttgagtaagtttcctaaagattaataaagagtgagtctttatatacaccattctcttgttctataaatcgatagtttcgagagtatatcgtagatctagttcgcttgtgtctaatacttgtgtgcttgggtattagttcgtgatcagttgtatcctgggattcaaaaattatgatgtccgaaaagcacttacgggcgatttattgaagtaaggaaaaagatatcatatcttgcctccgtgatttactttttgtccttaattactgttattgtaattttattgttatcgttatcttaatagaattcgtacttgtttctcaattcggtttttgggctattacaatcttaattcaataaatccgcttttagcttatcgctctagaaggattgagaatttttcgaattttttaaaacgattttaaaatcttctaaaaattgtttctgctatcatctttgggtgcttacgcggaaagtttatagaagaacgttattacttctttctttctcctctttctaaattgcttcgcaaacgctatgtagcgattgttatggacagtttcttatataaacttctctagtttccacgaacgctcatacttgagtgagtttgtgaaacgcgaaacaagtttttgcgaacgcttcctaatcgagtttgcaaaactaattcggtgtaatttagttacatgaattttttggttaatatactaatcaaatctgtttttctgtgaacagaatg

SEQ ID NO: 397 - DNA, 903 bp, Unknown
  misc_feature (1)..( 903): cDNA_ID_1596141_gDNA_ID_1590754_Annot_ID_149994 3000 nt of promoter + ATG
catcacacctcctacaagtgctcggaacagatatatctttgtgctaattgatgatcactctcgttatatgtggtctattctcttgaaagaaaaaagcgaacccttcgaaaaattcaagagattcaagacaagagttgagcaagagagtggagtaactatcaagacttgtaggacagacagaggtggagaatttgtctctcatgagttcaaaacgttttgtgaagagaacggtataacaagacatctcacagcaccacactctcctcaacaaaatagtgtagtagagcgacgaaacagatccctaatggagatgacaaggagcatatgaagatgccaaattacttgtggggagaagctgttcgacatgccacctatgttataaaccgagtagcaacaagagttctaactaatcaaacaccgtatgaagaatacaaaggcaggaaacccaatgtagaacacatacgtgtgtttggttgtgttggatatgcaagaatagaatctcctcatttgaagaaactagatgacatatcacgttctctggtacacttaggaaccgaaccaggctcaaaggcatactgtctcttggatccaaccactcacaagatagttgtaagcagagatgtagtcttcgatgaaactaaaagttggaagtggaatgatctaagaagtgaatcaacagaagattcaggaaactttgtacttggttttgaacaattttgaaataacggactaagaagagaaagagaagaacatggttctgagacaagcgagaagaacactaaggatgaagacacttctcgagtcactgaagcaacagaaacagaggaaccaattcaagaagaaggtcaaccacaagagaacacacaacccacactaagacgatctcaaaggcaagtttctatg

SEQ ID NO: 398 - DNA, 3000 bp, Unknown
  misc_feature (1)..( 3000): cDNA_ID_19124_gDNA_ID_1590760_Annot_ID_150004 3000 nt of promoter
  misc_feature (2235)..(2235): n is a, c, g, or t
  misc_feature (2245)..(2245): n is a, c, g, or t
  misc_feature (2353)..(2353): n is a, c, g, or t
  misc_feature (2521)..(2521): n is a, c, g, or t
  misc_feature (2533)..(2533): n is a, c, g, or t
  misc_feature (2967)..(2967): n is a, c, g, or t
ttcttatcaagtttccaaaactgttaggtgacaaatgaaggattggagcaaggctattgtgttgttccgagcaaacaaagacttatccttctaatttcctttttgaaaaagaacctaaataaaaagattatggtatttttctcgacttgcaagtcggtacaattccatacggaaatcatgaaaataagcgacgtggatgtctctgatattcatggaggcatggatcagaacagaagaactaaaacctttttcgacttcatgaaagcaaagaaaggtatcttgttatgtactgatgttgctgctcgtggtctcgatattccttccgtggtacgtctccacatctatgttcttgcattggttttgtacgcatttacttaccaatggttttatggaaatcatatttctggcgatttttattatctgtaggactggattatacagtatgatccaccagacaagccaacggtaagacaaacacttcctcatatttggttttgcatatccctttgcctctgtatgtgtatcttagattgttctttggtgctgttatttcaggaatatatccatagggttggtcgaacagcccgtggagaaggagcaaagggaaaggcattacttgtcttgattcctgaagaacttcagtttattcgctacctgaaggtaagaatggttattgaaattttattgtgggttaaccaacttgagttttaatttgtaatttaaccctcaggctgcgaaagtacctgttaaagagcttgagttcaatgagaagaggcttagtaatgttcaatctgcgctggtaagacttctgattcagtaatgttgtgggtttaataactttccatttgtaataacaacgtttcttgttctgtctcacaggagaaatgtgttgccaaggactacaatctgaacaagttagccaaagatgcgtacagggcttatctctcagcatacaattcacactctttgaaagacatctttaatgttcaccgacttgacctcctggtaaaagaaacttaaaaaacaaatattcttccaaagatttttgttttcataatagctaatatctcgtgttttgacgttgagtatcacaggctgttgctgaatcgttctgcttctcttcgccgcctaaagtgaatctgaacatagaaagtggagctgggaaggtgaggaaggcgagaaagcagcaaggtcgcaatggcttcagtccttacagtccctatggcaagtccacacctacaaaggaggcataaagtgtcatttgtttacaaaattactattttgctccgtagttttgactaattaccaccaccaagttttgtttaaagagtaaacagtgcatttgatttaaatgaaatgttccttggctactattaatatttcagttctatgggttataactttttaagaattgttgatatcgtttgcttataataaaaactgatacatggaaatggaataagaaaacataaagaaaccataaagagctttattaagtgattatcggaactacatgaaaagtgaaaacatattcattgaatctaaaccggtctaaccggaaaccaaattcagtaatcgaaataaagaaaaagaaaacgctaaaccggcctaagatcttcagcagctaaaaccgctggaactaaaccaaaccaaaaactgaaacaatcagaacagcagagacaacaaaaccggaactactgaactggactgcggttttgaaggcattgctcttcttggccttgggagttgacgccggaagagatgatgatgacgaagaagaagaagaagaggatggaggaggagactctgtagaagactccgtctccataacttttacgatcatcttctgacccttttcgcagtggccagagacaccgctgatgaagtaaaacaaaccgggtcggtctagtttgaaaacagtgtcttcgttgtttgagtagagttgtggtttggtcgctttgcatttcttgtactcttcttctgacaccactaacactgagtctttcgtgtacttgaaaccttcaccaaaaaccgcacaaaagagttaatatatcttattatcttacaagatgaaacgtttaaacttcatacaaaagtgttcaatatacttaattacttacggagagtgtcaccaactttaaaccggttatctgacgcccattggttaaacgcatctccaagagtcttagattttggtacgatccaaccattttctcctccaacttcaaattcagngcttgaaacncatgaaaacatgtaaaatgttacaagaaacataacgataatgatcttctttgatgaatccatttgttgtttttttggattgatatgaaggaagctctaaccaaagttncagagattgttttttttttagtgttcgtaatgacttgtgacttgtgaggttttgagtttaaaaagagtgagacttggagatttgttagagttgaccacttcttgagggatattaatggatatctctttgacttggtattttaatttcttgaatcaaaaagatattttngtcgaaaacaancatgacttgaagttgttaaggaatatcagaatttgtgggatatttttgcttgttattttgaattacaaaatttatgtagacgatgtgtattccaaaagaattgttaaatgcttattaacggatacatcatacataggagaatgtgttgtatttttggtgacgacaaaagcaaatttcttcttcttattgaccctttcagcatgtgggttgaaattgtcatttaagagagttttggtaaaaagtattagatttgaaataattgaggcactttgtcccaaaatattctaatcactttctccgctctttagccctttagggtttatgacgttaaacccagaatccaacatttgacgattcgattcgaaaatctcagtgaagatcgaaaatggcgaattcaatggctacactttctagaagactctatcgatctcttnctatcgaaccctagaatttctcaagcttccatg

SEQ ID NO: 399 - DNA, 927 bp, Unknown
  misc_feature (1)..( 927): cDNA_ID_1596099_gDNA_ID_1590760_Annot_ID_150006 3000 nt of promoter + ATG
  misc_feature (13)..(13): n is a, c, g, or t
atgaatcagtttntaaaaaaaaatattttttagagttttcacacgttaagaattttattaatgtttaattataaatatactattttgcattaaacaatttccataattctaacccaatagtaattcaataaatataaaattatcaatcaatatttcttgaaaataacaatatcttgttattatttattgaaaatacattgaaaacctaaaaaatacatctttataaaacagttttttttctttctagaaaatacactaagaaaaagctgaggcttcacaaccgaattgttaaccatcttgattttgggagtagtttgtgaattgtaagccaaaagaagaattgactaatgtatttttaaaataaaaataatagacggataaaactgaaattatgtgcattttagttaatcacatactcatattttttttaacacaagtacatacttatttatataaaaaaaattgccgatattatacgaattactgaaattaggtgtataatgaaataaatgttaaaaaataaaaaaataaataaaaggttacgaattacacaacttcaaaggctcgttaaaccctaaaaccttgtctccgcgccgcgttatcactcttacgtttctctctctctctcaacttcttccacagcaaatttcttcgattctctgagctctctcccatccttttcaagtggcttcgtttctaaaagtaagtttttttaatctatgggttctcttcaagtggttgttccttttcgaatctctgtaccctagatgaaatcgagtacagctttaattactctgtttttctttgggattgctctgtttcccttctcttagaggtgtataattactctcaaatttgttgtttttttcattcataaattcattaatattgctgcagaattgattggttgaagaaagtggaaacatg

SEQ ID NO: 400 - DNA, 2750 bp, Unknown
  misc_feature (1)..( 2750): cDNA_ID_3055551_gDNA_ID_1590760_Annot_ID_150005 3000 nt of promoter + ATG
  misc_feature (1)..(1): n is a, c, g, or t
  misc_feature (2088)..(2088): n is a, c, g, or t
  misc_feature (2522)..(2522): n is a, c, g, or t
  misc_feature (2534)..(2534): n is a, c, g, or t
  misc_feature (2702)..(2702): n is a, c, g, or t
nttcttcttcatcttataaagtataaacggaaacaaaataagaaaatgtaatattaccatgaaccgtgttcctcctccataaatcgaaccgtgatcggttaatactaccctgaaccagactataccaaccggttcaggtcaagcaccaggggccgcatctttagccctgccatggaagtaaccaccgtattctctagcgtaatctttgacgtgagatgccgtgtcatagatcctactacgtgcataatccatctgattcgatccaaccgggtgcattccccggaaatagcggtacgtccacgacactaaagccaccgttccgacaagaaatccggagaccgttaagaacccgccaacgacgacaaaaacgggaatccatatcggactcgagatgatgatcaatggaagaaagacaatgaagccgagcacggcagcggtgacgcttacaccaaggaggaagaggaggatgccagtggagataaagagagcgaggaaaccaaagagctgcgaggatgttggtgaatgggatcggagctgatggaaaaacgacgagatggggctgttgctaacggtggtggtggcggtgctaccataattgggccaatattgggcctcgccgctagagaacctttccgccattgtagagagcgattgttgttttgtgtgtgtgtgtgacagagaacagaatgaggaagggtaaaacaaatggaggacagattcagctttgaggtggcattcatgcaatgtttgtaaacacgtggagattggtcttggttttcactttgtctaaaatcgagattttggtttagattcggtttagtctaaatcgtattgattgggtttggtttgggtttatttgccgaaaaccatggaaaagggccaatgccaattgaagaacactaaaccaaaccttcaagttacaagaagagacaacagaagcgaaactagaaatactacaatagcaaattgtgtacctttatgacaacaattttttgtatgttaaaaatcagtagtagccaacgcctctaagctcagcagaactcggttgctgcatatcaccggcttttcccaaaaacacaactcggcctgtaaggagagaaaacagagatcaatatttaattgtttcccaatgaaatatgtaagaaatggagttttaggggttgagccattagtaccgtttctacgaattgctacttctcttatacgtcgaaccaaaccagtgacaggatcagtgaatatcttcgtctccagattaccctctaagtagataacagtactgttgaatgaacacgaaacaagttgttatgacacatacacaaaagcaagctaccattttgaatctagcaagcaagattcacctaaagtttcatcctttttcaccgattcttgatcgatatcagacatgatacatacatttgttccttattctatcatcacataaccttacaagctaaatatgatctcagaagagaactaacccgggttcaacattcttcaacacaagatctgccaagcgttcagggtaaacagagacacggtgccactgcaccgcagaccggctcgcatactctctcggatcttcgttaataagcggtctccggttgttcctgatcccaccagttcctacagagaagagagtgacagttctaccactcttaagcttcttctgcagaggaagctgacccacttgccccaccaaaattgcctgtattaaaccagaaattagtctagaacacactaattattaacctatccagaacgagaatctaatgatgttcacaaaatgactcaacaaagatcatacaaaaggcaaaattgcaacgatcgatttaagaaaaacaacaaaaacagagtatgtatcaattggaattagaatctaagtttgataccttgaaaatgccagagtcaaggccattttcgagtggacgctcttccataacgcgttcttctccggaaaatcgagaaactggatctgaggcctttggttcaatgggcgattctaactcgtcaaagtcggagtcttctggggaagtgatgttgttggtacagaaagacatggaagcttgagaaattctagggttcgatagnaagagatcgatagagtcttctagaaagtgtagccattgaattcgccattttcgatcttcactgagattttcgaatcgaatcgtcaaatgttggattctgggtttaacgtcataaaccctaaagggctaaagagcggagaaagtgattagaatattttgggacaaagtgcctcaattatttcaaatctaatactttttaccaaaactctcttaaatgacaatttcaacccacatgctgaaagggtcaataagaagaagaaatttgcttttgtcgtcaccaaaaatacaacacattctcctatgtatgatgtatccgttaataagcatttaacaattcttttggaatacacatcgtctacataaattttgtaattcaaaataacaagcaaaaatatcccacaaattctgatattccttaacaacttcaagtcatgnttgttttcgacnaaaatatctttttgattcaagaaattaaaataccaagtcaaagagatatccattaatatccctcaagaagtggtcaactctaacaaatctccaagtctcactctttttaaactcaaaacctcacaagtcacaagtcattacgaacactaaaaaaaaaacaatctctgnaactttggttagagcttccttcatatcaatccaaaaaaacaacaaatg

SEQ ID NO: 401 - DNA, 1185 bp, Unknown
  misc_feature (1)..( 1185): cDNA_ID_1596076_gDNA_ID_1590766_Annot_ID_150020 3000 nt of promoter + ATG
attaaacgatcaccattaagaacttccccaagagtttcctgtttctcaatcacaggccctacaaaatataaaacaatcctaaatcaaaagaccgaaactagggacagatacaaatcctaatgtaaaactaaaaggacatcattgagaaacctaacctcgacggcagaacggcaaatcatagtattgataggtctcactgcaaacaaaacaaaacaccaaactttaaaatggggtttaagaaaatgtgccatctttgagttccatggtcaaactaaagctagaacaaaaacatatcttacacattctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgaactgagtggttttgactagaccatcatcagaaaagtctccaagacggtagtcggatgttagatcgctcaagtaatttttggttttgttggtctcacgttttcagctgcccatttgatttcagtttgggcttttctttatctctaaaggcccaatttcatttaggtttagtttatttgatcattatccttactataaagccttcgcctttcgaggaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaaatg

SEQ ID NO: 402 - DNA, 3000 bp, Unknown
  misc_feature (1)..( 3000): cDNA_ID_3034909_gDNA_ID_1590766_Annot_ID_150021 3000 nt of promoter + ATG
ttgacaacaaacaaagatccttcaacgtccttacgactctgaatgacaaaagacagatcaatcattaggtagggaagcaaacatcaaattatgtaatcgaagattgattgagactaacccattggctgagctcaatgttgaattcatagaaagtgacatgagcggctgtgatgaggatttcctcgatgtatggatcgatccgctggagaactgtgagattgaggagcctcgtactgttttggtccagatttgggattatcttcccgttttgagacatcttttataaatcaaagatcagaattttgggaaatctggattcgattttaccctaatcggaagaaccctagaattctgatttaaggtagctgagagatttggggacggagacgaaaacgctaacttttggaacgcacttcgctattttgttgtctgctttggcaaaaaaaaatggtaatttagttataaaacttaagagaataaatatactgaccataaaagcattagagtttgcttcaaaaatacatcattagagcttgcttaagagattataaacaacattaaagaagaatatttattcaattagagtataatcagtgggttgatccttttaattcaaagatcaattactgcatagtcaatagaatttggttatggaacagtccacgaggacaattttcaaattgaaaacgaaaatttctgtttttattcacatctgtggattgattcgtctttgaaataagcacatctaattcaaagataatataagctacaaaatccattaaccaaaatcactgcagttatttcaaattatccaaaccaaaagctaaagaggagagtagcagcacaactcttacactgtttaacagatatgtctgaaacaaaaacgaaagggtaagaagaagtgtcttatagccaccaattttaagtaggtgaaagctcagaagattctttgtggtggtcccattgtgctcttgaggtacaaacacctgacattttgccagttcttcttcaatagcgagacgaggaagttgacgctcatctgcacattctgaaagatctgcttctcttccattgaaaggttaccaactgcaactcccatgcacagaaccttcttcagctggaacttcactgttgcctttgtttcattcacctttgactccaaggattcctggtggctcacaagagttgggaattttcctgtgtaaagtaaagcaaaggaatgttacttaagaatcatcaaagaagcataatctcacaggataaaggattggcattgtatcaaaaagacattgacaaaagaaatagactactaaaacctatccaaaatcaaaacggatgtaaagaagaacaatggagtattagctgtagccagaacttgcctgccttgttaagaccaggaccaagaagacgaggaatctgcttaatgacagactcagaggccaagaaagcatggtatttctttgcaagcttcttgacgagtttcttgttcttgttaagcttttttagagactcaacatccatgttttccaaccccatcttctcagcctacgaaaagatacaagaaatgaagcctaaataaacaatgaccaaattccgaaaacatcatgcatctacattcagaagacatatacaacatcaaatgaaactaatagagccaccaaatgaaatgagcacaaaaccattatacaagaaacagagcacaaaatgatcaatttccatgaaaagatatatcacctcttcaacatgctgggcatctccgagcatgcagatcttcattttaggacgggggatatgtggtaacttgacagatccactgaaacgcttgtccttttgagggtcatagttcttcagaccgatctggagctcaatagtctcgacaaagttacgtttctttgcctcggatttccctgtgatagtagtgatggcttcacgaacggcctcactctgaagcttactgtattaacccacaagaacagagttaagcaaattaactaaacaaacaaaaatacacaacattgacaacctcaacatgaacaacccacattatagacactaccatacaaaataatcttatcttaatacacctaaatttttatgaggcaagatttagatttgtcatccaaatttagaggccttagtaaagagcatttatgcaaaactgcagaacaacttcgtgtcaatcctagactattaacatcataaagctatcaataacgcacatccaaaaaacaatcacgattcagagacgtattgttctctaattaaacttattgcatatgacagaagaacaatacgtctctgaatcacgattcagagacgtattgttctctaattaaacagtgaatgtaagagatgcgtcaagtacctcattttgagcttgtctcaatttagctaagatctgatcctggaaacgaaacaaagacaacaaaaaaaagaatcaaaatctatagcagaagctcgagaaacaagaataatctaatgtacagtatacatataaacgaagaagaagaatcaagctagaagtgaagcagtcgttgaggcacaaacctgagtgacgagacagacagaagaaaccctaaattcctcgaaaggcgaaggctttatagtaaggataatgatcaaataaactaaacctaaatgaaattgggcctttagagataaagaaaagcccaaactgaaatcaaatgggcagctgaaaacgtgagaccaacaaaaccaaaaattacttgagcgatctaacatccgactaccgtcttggagacttttctgatgatggtctagtcaaaaccactcagttcagttcggcttaagccattcaggtttgactttgtgcctctacgacgtcgtcttgtgactttgtgttctctctagctatggaatttttttcttcttgagctgttgttagattaagattttagaagatgactgcttctggagctcttcttgttgcacatattgattcgtttcttttggaacccagcagaagaagagtgccaattc

SEQ ID NO: 403 - DNA, 1036 bp, Unknown
  misc_feature (1)..( 1036): cDNA_ID_1583732_gDNA_ID_1590770_Annot_ID_150033 3000 nt of promoter + ATG
  misc_feature (842)..(842): n is a, c, g, or t
tatatacttttcgacatatcatttgaattatagcataatagtctcaaaacatgtaaaaacctcatgatagcaccaaatttgcagtatcatgcttgaggtgttgttgttattcgaaacaatcaaatccatggggaccaggcccaattggagcttgggctttttggtatatatatttgttggcctttggtgaatcttccttgatcttaacattttctctctatgcggttctctgttctcttgttaattacttgttgtttccgtaatgggcccaaacgcctttaaaagtcaaatttattgcttcagagttgaaaaaattcaaaaatcagattagtttgcacacaaatcatcgcgccgagaagcagaggttagttatgagtcttagttatggagtcgcaattctaaatctccattttccgggaaaacgcgagaaacttttgttttctttgaatttgctctcaatttggaaacttattcttctatgatcttcggttacttagttatggagtttcagtgtaaaatactcttgattctttttcctcattatcgcttgattgttcgttttttgattattttccgggaaaatctttctcgggaaattttgttcgacgctttgatttttctcatagtttggaatcggattctttaatctccagtttgaaagactctgaatctttcctcattatcgctcgtttgttcttgtttaattttcccgagaattgtttttaggcgcgatcttaattgggattttggaatgtgaatcttttcatgttagtttgttatgtggagtctcagtttgatactgaaagactctgatgaatcaatctcattttcccgagaattantttttcttaatgcgctatgaatttgctcttactatggaatctgaatctttcatgttcttagtagttgtggagtctcaccttgaaagacactgaatctttctcattatcgcgagaaattcatactttgggcacttggaattaattgggaatctgaaaatatttcaggttagtctgtcctgcgcatatcgaagatg

SEQ ID NO: 404 - DNA, 349 bp, Unknown
  misc_feature (1)..( 349): cDNA_ID_1663178_gDNA_ID_1590770_Annot_ID_150034 3000 nt of promoter + ATG
ttttatttctgaaatcactttccttgcatttttacatgagaagacatgttttatttaaccaaaaaaaagggacataacatttgctagtttgtattttcgctcacacttgttgccgttaacctttttcctaaaggtaattagtttttcttcgtttagataaaaaaaaatttggaacgcattgagatgtgaattacaagtcataattggtgaccgacatgtactttttctcaaataaattaattgaacgaaattaccaaaccaaaaccggttttcagatatacacttaaagtcgatatttaagggtttatcaaaagtcagaaccacgacgacagacaaaacataaaagatg

SEQ ID NO: 405 - DNA, 3000 bp, Unknown
  misc_feature (1)..( 3000): cDNA_ID_3055505_gDNA_ID_1590772_Annot_ID_150038 3000 nt of promoter + ATG
gtatactatggatgaaatcctagaattaacaatcaaaatacaattatataatttgaaaaactaaacaaaaatattattattaacataacaaatataattttaaatttcaaaaaaacaaaatttataaattcattacaaggtgtatcatagtatcatacaaaaaaaataatagcatctatctatagatcatcttaaaaataaaaatttaattttttatttaataaaaatatagacttatgatcattgtatttcttgaagatgttatttctatataaataatattaattaaaagaaaaatctctaattttttaaccaaaatattaacccacgggtcaatatctacgtaatacaagtttttaaatttttattccctctaaaacaaaactcaaactacaaacaaacaaatactgcattttaataataaattaatatacaataaatatccaaaaataaaacatgaattacccaacctttaaatgtgtcaaaaatatattatcatatacaaataataattcttataacaaaatatctataacttttcaataaatatattttcggtatactacggatcaaaatttgattttttactattagaggtatgttttagcataataatataatttaacataatacattggtgggagtatgaaaaagaaaaccattttcgagcacaagcaaactatatgacgccagcgatttatggcttcactgtgaccctttcaaatgatttctagagaggttaggattttcaattgattgttggttgctgattaagacactttgattgatgaaaatgacgtttatacttcgatcgattgtttaattgtagtggattgggccaaaaaaccataaatatatgttgaccatcgtatgaagaagctattttagatattattttaaagaaggaagaataataaaatatagtaaaaaattgaattcaagggacaaattaaaatatatttatcatggaaaatcagcagacaagaaaaagtcaaattgtagtagagtttataaagtgagaatattatttatttacaagtaatttgcaaacgcttaacgtaaaatttgccatcagaatccatagtcttattctgaggaaacatatcaaacatataccttatatatgacaaaaaaaactttccaagtcacaagtttttacaatttaccttatatttctagaaaatacaaattaattttataaaataaaaaattattatacaatataagcttcatatatattacaaatttgtcggtagcgaaaaatgtttaaattacgcattatctttaacttgataaaattaattataatatatattttttgaggtagagagtataattgcaaagatctgcgatttggaagttctttttacacaaaccccttgttatcacatccaagttggatggagtttgaattttttgaaaatgacaagaaaattttgttcacgaatttaatcttaaaataaaagcgctcaaattgaacattacttggaatggaaaacacaagatacaaacttttagtaaacaatacaaattaaagctttgaggactctataactttagtctttagaggtagaggccacttttacgtccatgaaagaggaacttagacagataggctgagcgaagtgtgtcaaaccaaagctgaaaatgcaacaccacaaatgagagagccgtggcagaagccacgtaaactaagaggattaagctccatttaggttcttgatcacggatcaagatcaatgtcgctgtgaaggcaagaaccattgaaataattgaaacaaacaatgctaaaagtcccaacattagcttcgttggtaaagtcgtctggaaactagcttctgcataacgagatgtcaggattgacaaaaatatcataatagatgtcacagatgataggagggcaaccgaatctgatatgataaacacttcaaaccagaactcctttctaaaagtagggaagcctagtgtttttatgtcgccactcgtatcgtttccaccaggtagagtaaaggcagctgcaaagaccacagttgctatcagtgttgatacaagaatgcatgcagtcgcagtttctttcatccatttctctccttctttgcgtaagttgtcatgctctttcgtaaatagatcatgcgccacctcctcttttttgttctttgttttgatgtatacacgaggaactatctctttaacagcctggaaagtcattagaagttttgtaaagatatatacaagatgttaaattatacccattgtggaatgtgtttagcataccttgtaccaaagaatctctctttgcatctgaagtgctgctcctgatacaacttgtaacctatttggaggtggtaaacgtgccacaagatgcaacaagttgtcgttggattctttctctttatacatagctatcaaatctttgatggccccgagttcatagattctattaaagattttttcatgacgatttatagcagcaatgtggaacaagctttggttcttatgatccaccgtccatatcagatctggataagaacgaatgagaataagtaaaagctcaagatttccagattgtgcagcatcaaagagtagcattggagatgatcccacaaattgcgaaatttcctccactggcaattttataacaaaactccatagctcctctaccaccatatgagctaaagtccgcattttggcttcacgaaatacccctttaaaaactaaatggaaagagttcttgtcaggtgtgatgttcaaacaaaggtttagactataggttatataattctcaaactttggtcacttctgagcacttgttcctactacttatatatatatattttgatatgaaaagaatgagttaactaagaggtgtacttgtgagaaactcgttaccaaacgacctgttcaccccaaggttaatttgatattatacctgtgagtttttggtctaaattcaccaagtatgagaaagactctattcggtatagagggttcgaagttcaa

SEQ ID NO: 406 - DNA, 154 bp, Unknown
  misc_feature (1)..( 154): cDNA_ID_1692104_gDNA_ID_1590785_Annot_ID_150066 3000 nt of promoter + ATG
taatatacaacttgtaaaaataaaatatttgaataagcattataaataaacccaaagaggtgttagatttatatacttaattgtagctactaaatagagaatcagagagaatagttttatatcttgcacgaaactgcatgctttttgagacatg

SEQ ID NO: 407 - DNA, 1150 bp, Unknown
  misc_feature (1)..( 1150): cDNA_ID_1455908_gDNA_ID_1590789_Annot_ID_150073 3000 nt of promoter + ATG
tctacataaccgttggactaaaatggtaataaaaagaagcagaacagaagtaggtgaataaaactgagaatggaaacaagaaacaactgaagaaatcggatttatatacgtttttgatcatattctttggttcaaactctataaataagtttcttggcttctttcttataagaagaatcgactatactttaagttaaaagaccacaagcaatacacagttacaagaagaaagaaaagtagttccaagtactctctctactttaagttataagatcacaagcaatacatagtatttaataattaacacaagagtcgagcttggactttcttctttcttgggccttcttctattccgattcatcccattgacaaacccaaagcgttgatactcaaatgctcattcgtaaacacgtatcctcattagctttttctttcccattttgcttgaatgtaactaattaatttggtatttttttaattagtaagtgtagtatgtcaatattgtacaactagatgatactgatccattagagtaacactaaagttaccaaagtttcatacaactccaacgacaagcaaggttaggcctttccatccaatattataatctaagaaggagcgattgcccttgatctgacccaacttgcgagtggaaaaatctaatgcttatttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcgatctttaaggggatgatttggcaaaagtgttgtttttatttttccttttactgttttcgttttatcatctttcaacgtctttctctcccgacggccaaaaaccccaattttgccaaatccaattttacacccagaaaccctaattttccttactttgatttgattttgtgatg

SEQ ID NO: 408 - DNA, 289 bp, Unknown
  misc_feature (1)..( 289): cDNA_ID_1692111_gDNA_ID_1590804_Annot_ID_150091 3000 nt of promoter + ATG
  misc_feature (9)..(10): n is a, c, g, or t
ttccgcagnncttgttcaaacagataaagtcttacccgttaaatttaaaaccaccaatatatgtagtaatcaaattgcttatattattcaaattgcttttttaaaaagagaatttcttacaaaaatatgaagtatcatgaacaagtccacaatgtatttctttttgagaaaaattattaacatctccatgttgcactctatgttaaagattgtttttttcaccatcccttgtacccagaaacaaagcattagctagaaaccaccaaacttaaaaaaaaatcaagtcatg

SEQ ID NO: 409 - DNA, 97 bp, Unknown
  misc_feature (1)..( 97): cDNA_ID_4262542_gDNA_ID_1590810_Annot_ID_150094 3000 nt of promoter + ATG
  misc_feature (45)..(45): n is a, c, g, or t
ttagttcttaaacttcagctgagagaaaaccctaatttctcaaangagtctaaagagacggagagtgagagaagagagaaacatttcgagacaaatg

SEQ ID NO: 410 - DNA, 1354 bp, Unknown
  misc_feature (1)..( 1354): cDNA_ID_3055440_gDNA_ID_1590819_Annot_ID_150110 3000 nt of promoter + ATG
tcacatacgaagattgacagccatccatttggaagctcacatgttgacaccaaatcatgtcacgtgcacatttttctcttttcccatgcatattttgactgctccctatgtgataaatttgactgattaaactataattagttagatcatctcgtatctaagatgattgcttaaaacaatactattattctactaacaactaggttattcccaagatcataacttttgattttgatgtaactagttttgtaattttgtacatatatgagacttttttgaattgcttaacagaataaataattgaattttatgaatataatatataaattttcaatttgatcgacaacaatgaacggtgttttatttataattgtttttttgacaatcatgaacctaatgatttgttttttctattttatttagtcgacataatgaagactaatgaagatacaatatgtgattgaagtgaacaagttagatttaattaagatacgtggaggatataaagaagggtgataaatacgtgaataaaaagtgaaataaacaaaggcaaacgatcagacagacaagtcgtgaacataaaaacgggagagacaggaaaaacaaaagaaagccagacgagcaccaaaaaagaaactgcaaatcttcgtttatgtaaatcttcttaccgtctctctcttgtatttcttcaatttcaaaggtggcttttttttctttctttgttgggtattaatctgagagaaattgaggaaaactgttttcccctttctatgttctcagctttggcacttttctttgagattatggttaattggttcccttttggaaattgatttcaaatcttatccagaagaaatttggtgccttctgtttttaaacaaattttctagagtttccgtgtttaatttttgtttcttattttgttttctattaaaaaattcgtttcttgctcgtgttagttttcgcatttggagtttcgtgacagcgagagttgctcgttttctggggtttagcgattcgcatttgttgatttctggggtcacaacagaagaattcgagcttggaagattgaaatttgagatcttttgatcttgaatcaagcataaattctggattttgaagtttgagagtgacccagtgactttggtctgaatctcggaggtatcttattccaggtaaaatccattaacatctctctctctctctctcaagctcctttcttcttttaagagaagtttatgttgattttcgtggttaccattcatcttcagggatcaaggattagacttaatgcgattaagcaaatgggtttttcacgatgactctccttgttgttggggagattcaataaatg

SEQ ID NO: 411 - DNA, 1487 bp, Unknown
  misc_feature (1)..( 1487): cDNA_ID_3022296_gDNA_ID_1590839_Annot_ID_150135 3000 nt of promoter + ATG
  misc_feature (9)..(9): n is a, c, g, or t
tattttggnctatacattacatttttttttttttattactagatctcaatatttttccgcaaagattacaatttatgaccacagagttatcaaccatgtaggatcatcaatagcaagtaaaccggtataaaccgaaccaggatcatgccattctggtcattacctcttgaagaagaaactttgtatctttataacacgattccgtctctgctaagttcttcgtcttagctgcatcttcaagctgtgtcgaaacaccaagaaaacaacaaacaaacatataggatatatcagaaaagagaagaaattttaaaaaaacaatagtctcttcggttcgaacgaaccaggacttcattagtacacttaccttttcgaaattgtcgaacaatttgttggctaaatcagtgagaggttgcttgtcttcagaggcagcagcagagatgagattgtcgaaatcgtagaacaaaaatgtggatttaagcctcaagtactttttcacatagtttaaagtatctggtccgatcaaatcctccattgccaagagatcaaaagcattctttttaactctatacattcttcctttcgtcccgatatccgctacatacactcctttctttatgaatgttctcgttcccgtcttctcattcacgatatctgtatattcaaatcgaggacgaattcaaaaccggaaatcaaatgattctaccaaatcgaattctcatcttgaatagttgtatggctcaaaatgttcaaacatttgaagaaagaaaacaatcaagaatataaaatggcgcttactgttgtaaataggaggaattggaagaggaccatcaatccaaaacccattgtcttgtgccaaggaaacattattttcgccgagaattccggtaagacctattgagacagcaaatcctaatgtcatccgtcttgtgatctgtaccgaatccggttcttgaaattcttcagttctcctgcaagcaaacccgctggatttcccggtttttcgactctcgggtagtttcggaagagacggtaaagtgttggtgagactgttgaggtctatgaagtgagccattgcagttagagagtaagctttaggtgtcagcctctgttcttgtgtattgtttacggtttttatccgttataaatgagaaaagcggccatcacaaagattttatctgaaccaaggggtgttttcgtaattcaatattttaactactcgttgttcctgaattgataaagtagagttcgtgccgttttacgtgacaaaaaaaacttgtatcttctttgctttttccttcaccgatctgtattgccgagtgtcgccgattccccaaaatcttccctccgttgctgatcataagcacgccgtttccaatcgaaattctccgtgttatttcatcgtctctgccatcttcactgtctcgcgtcgccgtgttcgattgaggtactcccactgctccgatttgagtatttagggtatgtgtatg

SEQ ID NO: 412 - DNA, 955 bp, Unknown
  misc_feature (1)..( 955): cDNA_ID_3239163_gDNA_ID_1590839_Annot_ID_150136 3000 nt of promoter + ATG
tgtgtcaaattagcccaaacgatcaacactcgagaaaagataccaattccccagagagattgagtcagcaagaacactaatctagctagacttgtgtcaagtgatccccaatgttctttgatcaggtagtttattaatacactaatgcaaaagaaatcagaaaatatttgaagaagagatagagtaagaaaccttcatagattgcataaactctcggcaatggctgttgacgaactctttcttgggaccagaagggctcgcgagttcttccatcactccaccagctagttccaaaaccttaacaactctctgcccggaaaaccaaaaataaaaacacaaaaacacattcacatcaaatcgtccaataaaatctctaaggaaagagtgagttttccaaaatttcacattctcaacattctggagtcgctgcaacgaagtgttctgcgtctgcggatccattggactctccacgatttcttttagaccagagagagagaactccaaactgagatatatcacaataccgtcaaatccactcatacacataccctaaatactcaaatcggagcagtgggagtacctcaatcgaacacggcgacgcgagacagtgaagatggcagagacgatgaaataacacggagaatttcgattggaaacggcgtgcttatgatcagcaacggagggaagattttggggaatcggcgacactcggcaatacagatcggtgaaggaaaaagcaaagaagatacaagttttttttgtcacgtaaaacggcacgaactctactttatcaattcaggaacaacgagtagttaaaatattgaattacgaaaacaccccttggttcagataaaatctttgtgatggccgcttttctcatttataacggataaaaaccgtaaacaatacacaagaacagaggctgacacctaaagcttactctctaactgcaatg

SEQ ID NO: 413 - DNA, 182 bp, Unknown
  misc_feature (1)..( 182): cDNA_ID_1692214_gDNA_ID_1590843_Annot_ID_150146 3000 nt of promoter + ATG
agatgaaagaacatacatttagaccctgaagcaaagccaaagctttgatattctcataaagaatagaggtcaagaaaatcatcaacgaaaagccctaatttgcactacacggtatttcccaactattgtcttaaaacctctgccttgcattacaagccacctcttcaaagtgatacaaaatg

SEQ ID NO: 414 - DNA, 950 bp, Unknown
  misc_feature (1)..( 950): cDNA_ID_1568887_gDNA_ID_1590844_Annot_ID_150148 3000 nt of promoter + ATG
  misc_feature (1)..(1): n is a, c, g, or t
nctttcattaccctgtctttccaactattatctacattttacaattagcagggataactcatgttgaaacggggatttttatatttctctcatgaacatatatgatgcagccaacactgcatttcttcaaaggaggctcgaagcaaggcgaggttgtgggtgcagatgtcacgaagctgaagaatctcatggaacagctctacaagtgaagacctaatccgtcctagtaaagaacgtgttgaatagttgcaagatagtttaagactgaaaatttgaaatcaatctaaaaataatgaatgcgctgaaccagtttcgtctttgttcccccctcgttgttcaggattgtaattgcccttttgttttgtttgttttctccatttcctttgggcttagtttccggagatttgtttgtgtccgtcggtgacaacttcaaaaaatatcgacaagtcataactttttatcaaaattttgactaagttgtcaggcccttagtcgacactcgacgcccctgacattaaaagtattgactccagtgccctgtgacggcctaaaagagggcctattttgggactcttttgctggcaaattgcgccatatgtagtggagtaaatgtgtaaaaaaacagtggaatcaacataaccattttttgatcagaaaagaaaacaaaaatgtggtgtaatgagaggaggatatgtggaaacttgatttacttaatttcaaaggagtctaaaacctacggagtcaagagagagttaggccaactaattgtcggagagattgagattggaagaagggtattatggtactttacgaataatattacgttgattaatttggatactttgtcttcttcttcgtctctctcccctcgcgcatcttcggtgctataaaacaaactcacgactagatcattttggagtgagatttacgtttgatagactactacaatg

SEQ ID NO: 415 - DNA, 63 bp, Unknown
  misc_feature (1)..( 63): cDNA_ID_1685373_gDNA_ID_1590854_Annot_ID_150153 3000 nt of promoter + ATG
cacacaaacactctacacattgcaaaacaaaaacaatttgaccattttcctcttcaaacaatg

SEQ ID NO: 416 - DNA, 2070 bp, Unknown
  misc_feature (1)..( 2070): cDNA_ID_3447941_gDNA_ID_1590858_Annot_ID_150163 3000 nt of promoter + ATG
  misc_feature (1)..(1): n is a, c, g, or t
  misc_feature (27)..(27): n is a, c, g, or t
nttactctcctcttaacgataatgtanaagctgcgaggcgtgtgattcaagatctggccaagcgtggctgggaaatcgaggcatgaccgttctttccctccacaagtttttccagagtactactctcttttccctatatagtctacagttattattttcgtactgggaattatcctccatagaagttaaatgctctagtcgaactcagggtcatatacttagctcatcgtttgaactattagtctattaacgattggtttttgttagttctttggttttttccatttggtttgtagtctcatgtatcaagctcatcatctgtaaaggaacgaataaaagctgcgtgctctgacctagataaaataagaaagagtcttcctttgatgcagttaggattgatattctaggtactgacacttgagtttgctagactgaccatagcatagaccaatctcaagcacttgttacgaagtgttggcatgagtctcaaagagtgcttacattatgagaaacaaagaattgcagaatgcgtttggattgattaaacatgtgtgaaagactaaaaaaacatcatatggttcacgttcactcagggaggtggtgacattgactctccggagtacactcttgagtaacaaaagcagtatcttaatccaagaaaagacacaaaggcacaaaggtatgacacgcttctggattgaattttgtatgtttattgtacttttggtagagaatagttgaaaaaatagttttgcaataaaaatgttagaataatagaagttttatcaatagcgaatcatctcgagtcttagagagacaagaataaatcatctcgttacatagagttggttaattcatggaaaggagaaataaaaaattaaattcatagaaaagaaacaaaaaaacaaagcctaaacacacttttggattactgatctctgattattcctctagccctcagttgatcaaacctctccttcaaaagcttcttctcctctctgatacgagcaagctccatattccctagtactattaggacactagagactggaattgatatcaacgatattcgataccaaatatcacgtttaccaaacttttccacaattcttgctactacacccgccatgactggatatggatctggatcgcgagctgtaactactcatacgaaaagaaaacatagacataaatactcaaatccctaaatcggatgataatatgcgatacatcaagtttaaaacgaagaatcttcacaatcaaacaactaaacaagctggatttatagtaatgaatgagagagagagagagaacaaaaaaaacctgaagagagaaaagaccaaagctgctccagagaactcaaaagtagattgtgtgttccgtaccctacccatcttatatagccccaaaaaacatcattccaagattagttgactttgggccagaagcccaacgtatgcagtagcccaaacccaatattaagacaacgacaacccgtttatgctgagcatgggtatgatgcttaagttaagacaacgacaaccttttcctcttcgcactttcaaattgggaagtagagcgagtttttaacagttgaattgtagtgctctagtcgaactcaaggtcatttacttagctcatcgtttgaactattagcgaatgggttttgttagttctttgggtttttcccttttggttatattgatctactgattagttggaataaagtttttcaactttttttggtaagataataataataatacggtggatgcaccaccaactgataagagtctcttgacttagggatatatgatctgctgatccaattattatttattattttagttacttgttgacttgtataattttgttgccaactccatatcttagggaaaaacaaaacaacaactactctttctctactccattaacaaagtccaccatcagaacctaaaccctataaaagccatacactcacaacagcaaaagcatccagtaccattccccccaaacaagtacttcaagaagattggtgaacacactgagaaagttaaaagagaaaagatg

SEQ ID NO: 417 - DNA, 2375 bp, Unknown
  misc_feature (1)..( 2375): cDNA_ID_1692312_gDNA_ID_1590873_Annot_ID_150188 3000 nt of promoter + ATG
  misc_feature (122)..(122): n is a, c, g, or t
  misc_feature (1721)..(1721): n is a, c, g, or t
  misc_feature (1756)..(1756): n is a, c, g, or t
  misc_feature (1833)..(1833): n is a, c, g, or t
ctagctatgcggtcgatgttgtcgttgaaaaggaggttctaattgcctgttgatcgagtttgcatacaacaaaggtgtacctggataaagaaaacaacaagaaaaacacacagttagtaatngaaaagaaaatggaaaagaactagatctaagcaagtctgaaatctcaaatgtaacaaacaaacacccaattagcaatggcgccaaattgataataggtttttcagtcaattatcctaaaacaccaatcatgtcgttgtagtattttaggttgtcaatccaaatgggtgtgttgctaacaatcaagatgtgatcagaagtcactaaatcaagccaagcaataacaggttttgctaacaacagatgacaagatgcagtaaacaacagtagagtaaacaataaaatcaatcagataaagaattcccgaggatggggtaattgagtagttacgtctcctcagtttacaggtgattgacatactcagtaaattatccctagacaacaagtttattaagtaaatctaagtgccaccgcaaaaaagacccttaagttaccctagtcccagactcaatcaccattgacgagagctaacctgacaagtattacgaatcaacaagttaaagccaaaacgctccctgcaaccaataccttggtacatggccacgaatctctggaattagtggttcagacatttcatcgaacaccttttcggcgcggaaatgtctgggctcaaattcctgttgatcagaaagcaataggcattaagaacaactaatccagaagggatctatcaatcaaactcaaccacttagcatactgagaattctaaactactctaacccatccttagaaacctattcactactcagacaacattatagagaacataaacattgaattgaatgaaaacatgataaacaacagtgtaatagcaaaatgataacaggattaacaacaataaacaaaatcaagaacaaatattgaatactaaatagattagagaaatccagattacaaaacgtcaagaacacagtgtctccggaataaaacttaggttaacgaaaatgtaaagtacatgctccttatagcgaaatatttctgaaaccccaatactcaaaacgacgcagtattgggagggattaagaacggtactcgacccagatggtcgagtgagtagtggagtgataagctggagtcttcttttcttccttgtgctcgagtgtctggttgagtgtggaatggagaagactctgaagctggccatcgagtatgtagtcgagtgatggtgatggtgatactcgacttcctggtagagtggtgtgatcgagtgatggtcaggtgtggaggtgatgatactcgaccaggtggtcgagtgaagtgatcgagtgactctcatggtggtactcggccaggaggtcgagtggtgaggtgaattgatgaagtcttctactcgaccaaggggtcgagtggtctgttgaggtcttgaagcttctactcgaccagggggtcgagtggtttgacatgatcatgtccgcttcttccaattagctcgccaacagctccaaatcacctgaaaaacacaaatatgcaacatgcatgcaaaactatcctaaacatgcaaagtgatgagaaatgatatataacagtgatgatatgatgctaaagtgatgacaaatggatgctcaaaacatgcaaaatacacacttatcaggtcggcccangaggcaggcgtatcctttggtgggtatcctttggnggcttatcttatagcggaatccagcatctatgttgaaccgtctacaaaatccactaggaaatcgtactcctccattncttcttttaaagctatctctaggggatcctccagaatgatttcccctacacattctaccagacgcctcttctatctcatcgagagagataatctgatcatgagatgaagcttgcttcaaagtctcattcatatcaaacttcattatgaaatcgccaaggtgaaggtcgatttttcagttcgggacatcgataatggcgctggcggtacacaggaatggtcggccaaggatcagtggtccttatgctctttgtgaacttccaggataacaaaatcagtagggatttgagatcccccaatcattatcggaatatcagccaaaatcccaacaggatggcggatagaacgatctgctagtactagggagattttagtttgtttgaaggtgtagtatccaagacggttagtaactgtgagcggcatcatgttgatgcttgatcctcaatcacataggcatcactcaaaaagttcatcatcaatagaacaagacaacacaaaactctcaggatcacctttctttcgtatcgtctggtcttgcaggatg

SEQ ID NO: 418 - DNA, 386 bp, Unknown
  misc_feature (1)..( 386): cDNA_ID_2038824_gDNA_ID_1590876_Annot_ID_150190 3000 nt of promoter + ATG
  misc_feature (149)..(149): n is a, c, g, or t
cgttgttatagaaaattcataaaacaaaaaaagactttgaattctgtcccagatcaaaatcaactggcaatcaatgactcagtctatgtattttatctattattttggatgttaatcacatctttaataacttcactaaagtcaaaacngacattgtcactaattccatcttataaaatccaggttgtcttcctgtccttagtgggaaatatatatagttactgagccaatgatgaaagaaaagtctacaaacacctggctaataccataaagagtagactttgcactttttggcttttaattaagcttatcttactcgcacgtagtctgtttttttcctgaagatggtaagctgaagaacttctgaaaaaagagagaagaaaatg

SEQ ID NO: 419 - DNA, 1590 bp, Unknown
  misc_feature (1)..( 1590): cDNA_ID_1692324_gDNA_ID_1590879_Annot_ID_150195 3000 nt of promoter + ATG
  misc_feature (13)..(14): n is a, c, g, or t
  misc_feature (50)..(50): n is a, c, g, or t
agaagaatatgannctgaaagagtgaaagaatttaaaaagaggtctgatnagcaagatgaaactatagagaagctagcccacactgttgaggaacttagaagtaagctgaatcagttgcagaaaaaagctcaacctaaaggcgggattgacactatcccgagaaagaagttcacttcaagatggtctgaagagacagtttaccctccagaggaaaaaaaagcatatttttgaagagaggggaattgagtattctgctgcacaattctccagggaggacgctgagtatgatgatggtatcagagaggattatgcagaccctctctatagttcattttcctcttgataagtgtgaggagtcaagctagagactttaaacaagctcacttgggaggaagtcccatgattatccttgtgaataatttttactttcttgttatttttgatttgtttttgttgtgtttgtggttctcacgattagaggaataacgtgaggctagagtaaaaatttaaaacttttactctacagatagcctagagatcgagtacattggtcgagtgtgagtgatatttaaaacccaaaaaaatttaaatcattattttactcgaccaacagaagctacagagacttgcagggagaagctatagagacttgcagggatttcctgcagtttacagtaggttttctgcaaattttctcagtcaacagagtgtgggccacgcgcttaggataaactggagagagaatctaaaactcaacctcaaccactctttttgaagcttcactcgacttcaacaaatccactcgacctacctcttttcatctcaccaccgacactcaaatctctctacaccacgaatcgccgttcaaagagccactcgatccagataacttcactcgacctcctagagccactcgacctccgcgccgccgacaccagttcattccctccgtcacccgaccagaccacttcactcgattccttttatatactcgacaaattcatccacatcaaccgccgtctctttcaaaagaagctactcgaccttgtttccccgtctcgtagccgcactcgaccgacggcgcgtcaaccgatttcaacaattcactcgacgaccataaagcactcgacccctgcaaaagcaactcggtttcttgttcttgaattcaacagagcctttcaacttcagagaagttactcgacctctaggcttcacgactcactcgacctactgaagcattccaactcgaattcggagaagatactcgatccaattcgtctaaggggaactcaggaacagctcagtctactcgagtacagaattgtactcgatcaatagggtctatttcattgcatattgataacaattttggcttcattgctatctttgagactaacctattgacatttgagctttgagttctaaatttctacaggggaatcatgagcaattacagtggcagttcttctgttgatcctgactacaacatggatgacacatagtcgtcttcttcaaggcctgagagagaacaaagagaatatgaaagctttagaagaaaagctgagatagcccgagggaagagagcgatg

SEQ ID NO: 420 - DNA, 282 bp, Unknown
  misc_feature (1)..( 282): cDNA_ID_2994796_gDNA_ID_1590883_Annot_ID_150199 3000 nt of promoter + ATG
  misc_feature (52)..(52): n is a, c, g, or t
tttttatacgatcagattcgtaaaatctctgttttgcgatctttctctgcgntagatctctgttttccctagttgtgattcgttttgatctttaaactctctcatactctgttttcaataaatacgacaaaaaaaactgcaaaagttttttacttttttaacgattggtggcttttaccatatgacaagaagtacattttaggattgtgtttggtttactgactgattttggttttgtttgtggttcaaatgtagtaaaaaaacaaaaaacaaacaaaaatg

SEQ ID NO: 421 - DNA, 3 bp, Unknown
  misc_feature (1)..( 3): cDNA_ID_1692403_gDNA_ID_1590901_Annot_ID_150226 3000 nt of promoter + ATG
caa

SEQ ID NO: 422 - DNA, 840 bp, Unknown
  misc_feature (1)..( 840): cDNA_ID_1692410_gDNA_ID_1590903_Annot_ID_150230 3000 nt of promoter + ATG
  misc_feature (11)..(11): n is a, c, g, or t
  misc_feature (565)..(565): n is a, c, g, or t
  misc_feature (607)..(607): n is a, c, g, or t
caaaattagtngtaaggttaatctttgtaaccgtgtcttcttcaaaatcataaacttctttttttgcttcaattttataagagtatttggctatcatatctatagagagaaaattggtttgataactacgtgagtttgttgaataatttttttaaaggaaagatagataaatagtggtttgaatattttattttatttcatcttatcactatcgaatatgtttttcgttatttggattatttttttaataataaaagccacatttgtttattcgccctaagctatatttagccttagcacgacactgaaaatagaaagagaccagagtcgttagattttacgagtgacttctaacttacgagattaaccgcagactggttcaaaagaccatcctcactttcctaagatccaagtaatcaaaattcactttcactcaaatcacctctctatttaaacaacaacaccactttttcaatcctcattaacaaagttaaaaaaacaaaacaacaccatcttcactttttttttcttcttattttttgttttctttctctatacatattgnatcaaaaaataaatacattttcctgtattttattttttttgngagtattaaagaaaacacaagacaagaatgacatacacagcggtaactatgctctctctctgcctaataaatatcttttcatcttatggcaaagagtgtcgagttttggcccgacttgtaatgtagtttcatcaatgagactcttaacattatatcatatcattgcctcactttattacattttttgtaacgttacgcgctgttagttctcttaattcattatattaagcatg

SEQ ID NO: 423 - DNA, 2084 bp, Unknown
  misc_feature (1)..( 2084): cDNA_ID_1692421_gDNA_ID_1590906_Annot_ID_150233 3000 nt of promoter + ATG
acggttgcctctgccctttgagtggtgtcctgcagatgttgtgagtctatctgatgttagagatgaacagcttgctgtgttatttcaacttgagcatacattagaaatggagatctgggttacaactaagattgagcccaacatgttgtcgtggggcagcaaggtcttcttatcagtggatatgacaccactcactggcaacgattttatgttttcgtttatggctacaagtttcttcattgatgaagagaagaaaatcgctgtggtttttaatcaaagcaaagacaggaagcacaacacagctttcatcattggacaggatggatccttgaaagaagtggatcttggagaagttcgaaacagagatctcaaaccacttgtgtgctcttatgttccaagttgaatgcaacttgaatagtgcattttacgaaacccataatctatttcttgcacttttacttgtttctttttctcttttgtcatcttcttctttgaacaatatatagaaatttaattcgtctctcatacttctttttgtttgccatatttgacttcgttttgttgccttaggttgtttaatttacttcttctgttgtagtagactcattgctaaatctctgtttctcttctaacatttgttatgtttgtattcttggaaataggcagctctgctagctgttgtgatttatgtagaacagagtaggctgcgtttaactttaaaatttgcaagtaagtacgcttagatttgaattttccattttaacttttgtccttgtcagttttacaaagtgcaaatggctgctaggctgacacgtagaagattgaatgatttcttggagttaagttttgtcctttgatactccctggtcttcaagcatacttacagagtaaccgtagctgaatatcaacctcaagcaagtcatggaaccatacaccttcctccaatccaccagttttgggctggttagcgctctcctagatttatgtttcatataagctaaccattaaaagtttaagagaagcttgtgtagtaagaagacaagctaaatgagttctcagtagccttaattcttcttctttttttttactaaatatgagcacttatagatgaagactagtgatgcattgattatgagaatactaaaaagttaagatgaatcaaaaaaattatttggttagtattaaaatcttcaaatgaaacttagtgttaagatttgttgagatctttcatactatcgaagtcatgtagagtggaggtacgtagccaggcctaggagaagagaagagaaggagaagcaagctaagaaactgaaagcctaaaaacttttgaatgttgatgattaaaaaagaatagatacatgctaacagcttatgcatttttgaaatagtttttgttaactgtcgtgtagcttgtgtgtaaatatgtcgacgacaagtcaatgatgtcacacacactacacaaaacaaaacactgcttcaaactaccttcaacttcgagtccattactataagcaaaagtcccaaatcaaaacatcaattttcttgttcttgtcagctactcaaacctcaacatgttacatatattttttcagataaaacaaatcattctcatcgttcttatctgaccaggaataattcaatggaagtatgagtttgactcggtttccttttgatattagtcgtacttttcaacattttacctagatagagccgtcctcttataattattcatcatttcatgcttctcatgttacatttctgcaatttttcaactctttgattttatataatcatttgtttcctttcttaatcaaatccatctggctaacattatttagcttgatgcaattaaggtatattatctaatgaggtgatgcttccacgtctttatattattataatccctcaacaattttaaaaaaagatcctgactttcaattttctctcttgtttcttcttttgatcatcttcaacaaaaaaaagttacgatctttctctccgggtcatcggaatttgagctagtttagctaaagttccgatctttcctctctgggtcgtcggaatttgagctttttaaaatcatg

SEQ ID NO: 424 - DNA, 1559 bp, Unknown
  misc_feature (1)..( 1559): cDNA_ID_3055286_gDNA_ID_1590931_Annot_ID_150275 3000 nt of promoter + ATG
tttttcctcgacaagactcttgtctcttcaatcaaaaatgcgttggtttaattttatactgtatttagtaagtatatatgctttgccccacactcatgcattaatacataccactttattggtctctagactaatctggttatatgtgcccatcattaattcaaattcattaacttacgtaagaataccacccttataaatcaactttttaaaaaaacttatgaatcaacatttaatatttaaaatttgacaaacctcgttataaattttatataactattgctaaaaccattgcttaataatttgaaaaatccgttgcttaatagttaataattaatcaaaaacacattgatcaactattatattctttttatgccctcgatttggtatcttgatatatcaagtggctgttacttgaattcagaatctacgttttcaatgttgtttcctatgatggtcaagtggccgctacttgatttcagaatctacgttctatgatggtgaagatatcgtaatgaatgttgtagtttcttttattaaatttttagttggtatgactgatttaggttgcagccacttattttaatttgtataaaaaattaagtgatactactaattgatacttttattgatttatttaatatgattcaataaatttggtgtaaatctatattaatttccactaacatcatccttagtactgtagaaacttgatttagtacctacagcctttctagaacaatttttatccaaaacttagatttgtttacgttcatgttccttgttccaaataactaatttaagtgcttttattttctttctttttttgacattatgcctttgttaaagtaatgcatgtcacatacagtacaagaaaacacgagtttcagacttcagtgtaaaacaggattacatgtattgtaagcgaaaataattaacatcaaatagtaaaaatattttacactatgtaatgttaatgatgtgtaagattagcaagacttacacgttcgcggaaagtaatctaaattatatacttccattaacaaaaggtaatctagctagaattcttaattgactttgatagctagttcttgtataaacaataattcttttctcgttgatatatatatcaaagtggttatcatctatctaaaaatctatgcataagaattagaatatccttaaaaattctaccagtaactttcaatagagagttatcaaatatgaatcatgattacatcattgtttattacacacatatttacacgtaacacataattagttccatggtcatcgttgattactctgacgataatgtaaactaaaaccgggtggatttttaaccggacccatttgccatcactctccataaatcctaaccgtccatctaatcaagcgtagatctaacggtggatatcgaatcaaaggttaattccctccctatatatattagaaaattgatcctgaagcgtgtaccgtacacacatccccatacgaacactcacaatcgttaaaaagaagagaagagaagagagagaaagcttaaatcggaaaaaatg

SEQ ID NO: 425 - DNA, 3 bp, Unknown
  misc_feature (1)..( 3): cDNA_ID_1692542_gDNA_ID_1590933_Annot_ID_150278 3000 nt of promoter + ATG
  misc_feature (2)..(2): n is a, c, g, or t
gng

SEQ ID NO: 426 - DNA, 2522 bp, Unknown
  misc_feature (1)..( 2522): cDNA_ID_2992736_gDNA_ID_1590940_Annot_ID_150290 3000 nt of promoter + ATG
  misc_feature (11)..(11): n is a, c, g, or t
  misc_feature (30)..(30): n is a, c, g, or t
  misc_feature (123)..(123): n is a, c, g, or t
  misc_feature (133)..(133): n is a, c, g, or t
  misc_feature (1429)..(1429): n is a, c, g, or t
ttgaaagtaanaaaagctttcgatgaagtnttagacagtaacaaactaacaaacatatccgctcaactaaatttacctaacaaatttccatagttttcaaccaagatttaaattaaaaatacnctggaaattntaaacaaccctaaattatgttttttttttgttgtgtgagagcgaaatagtcggaattagagtaagaccaatcaaattttaaatatttatcgtaacttttatttaaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatgggtcggctcaagttcgcatgtccggttcttgagatcaatttaatctcagctcaagacttagcccctgtctcaagaaacatgaaaacgtattccgtcgcttggatcaacaccgatcctatgagaaaactcaccacgcgtgttgatcaatccaacagagctaaccctatatggaacgagaagtttgtgtttcgtgtcaacgacaagattctctacgttgacgcatcagcgattgtgattgagatctacgcagcggcttgggctaaagatgctcttgttggtactgtgaatgttcttctcagcgatctttttgctccttggtctggttttggtgatggtaacgacggtggtggtgggaataacaacatgaggcttgtgactcttcagattcgtcgtccttcagggaggctacaagggtttttacgtctcggtgttgcacttcttgacggtggtcaacggagtatgcctttatctattgaggttttcgatggaagtcgaaaaggagagaggaatagtgttaaaagagaccaagaggcttcaagaatgatgcatcgccgtacgaatagcgatcaaacggatttaaccacgtctacgaatgattacggtgtgaaaacaggggttgttactggcaatggaggagnaggtggtggtggtggcggtattgttgttggtgcggatagtatggttaatggttcgctttgtagctctgatattggaccatcagcgtctgtggttgcggctgcgattgcgcaagggctttacaatagacagaaaacagcggttaaagcggctaacaaagaggacgcaagttcgatacttgaagggaaaacagagggaattgagcatagagttgaacggtggagagcagagaaaaatggcacgggtggagcgggtggagcggctggatcaagcgatgattctagcgggaaaggaggagcgggaaggagaagaaggaggaggagaagaaaggagaaacaacaagggaggagaaacggtggaggagagggtaagaaagggttgttttcatgttttggaaacgtgtttggatgtgagatttcgataacatgtggcggtggaagcggcggagaaggagacagcacaaagaagagatataataacaataaagtagtaaatcttagtgctgtagacgaaacgtttagtcattctgcgacttgagataagagaaagtgtttacttatttttggtttcttttggtggtgtaaaacgtttgatgatgggttaaaccatacagatttgaaagtattgaggttaaaacgtatgaataaactttcccgttacatttctggtaaatggactaatttgaatatttgtataatactggggttattgtgaaaagcttttaaagaaagggaaaagaaaagagagctttttgagaaacgcattaacacaccataacttcatcatcaaccttctcctctttcttacgcaattacaacttcaacgcctctctatctcttcgccgtgaatgtcgagatagtcgtaagctctctgcttttcaaatttctctcaaattgaggtagagagagagggcacagagatagagagagaggggcataggaaacggtgattttcccagttcccggaggaacaatcggctgatttctctgtaatcgaagaatctaaacctcacccactcgaaatcagctcgtgggttttggggggtctctattaatttccaaattctggagaaaaatcttgtatttcttcaagatg

SEQ ID NO: 427 - DNA, 415 bp, Unknown
  misc_feature (1)..( 415): cDNA_ID_1692588_gDNA_ID_1590946_Annot_ID_150300 3000 nt of promoter + ATG
tcgttggtctcctgagctgacgacagcgagcttcgacgattgtgggccaaattactttttcccaaaaaaaaaacccaaaaatgtccatatcagcaattagctagccacgtcatatatttgacagttggataatattcagttagcttatattacaaaacactgccaaatggccttgcctcattggtcatcgccattacattaatggttttgaaatccgttgacttttgagcaaagactattttggtcaaacattgttttgcatttctttccagttttcacgcatgatccatcttatctcatctttgacattttcgtccaacaaatgcaagtcttgatttttgttttcttccttcattacacaacataaaaagtctcaaataacaagaccgacttgacgagttgagaaacaagtatg

SEQ ID NO: 428 - DNA, 2669 bp, Unknown
  misc_feature (1)..( 2669): cDNA_ID_3055241_gDNA_ID_1590947_Annot_ID_150303 3000 nt of promoter + ATG
  misc_feature (2394)..(2394): n is a, c, g, or t
  misc_feature (2410)..(2411): n is a, c, g, or t
ctggccataagctcggacaaaggggaaatcatgcaggctaagctaggatcgtaaagaaatcagttggatcagctcgcccaaagctcaagctcagctggaaggagtgacggttactcaggtcgagtgacagtccagctcgggcagctggacgagtgacggttgagctcgaggtagctggacgagtgacggacgagctcgaggtagctggacgagtgacggatgagctcgaggtaactggacgagtgacggactagctaagcggttatgggcgaagagatacaactcttcagaaaggtgcaactcttcagaaaggtgcaactcttcggaagggcgcaactcttcggaaaggtgcaactcttcgaaaatgtgcaaagaacggatgtgttgattcgggaagcatccattcgccccctatataagggagggcgcccaggaccattccactcaccacaacacaccgaaaacacaagaaactcaccattaaaactctctccctcttgggagaataaatagtcttaggattcggtagccgggctgtggccggcaataaagaagaagggtcggatcgacytaacctcgagaaggaaggtaagggatcctagactttgagtctaagggttctaggatgtgagttagtagtcggatccttgaaaggatcgactagagggctgggtagtatccgggtcatgtgcatcctacacaagactcggtccgggtagggatcggctgaggcggggacgcggctcggcggaggaacggcgggtcttaactgacctgccgagaatctgccggactgatgcgcgatcttcccctctctgaattctctccacggatccgagtagtgtatggcatatagagcattgcatggacttgcatatgattaagtaaatgagcttacttatggctctatgactttcaggaatgaatggtgatcgtgggaaggacttggcttaggcgcgagagactcaaggccgggatgatgggtggtgatagttcggatagtctagggatcgattatatgacttgtaatagcttatatgcaaactcgtaggttgtatcgaatcctttgcttaatcaataaagtatccgattgtttgtttactctattcgtctcatatattgaatcacggaatcatatggaacggattagactaggaaagaacctcataaacggttagggtcgagtcacttagtggcttgggtcgagagaactcgtccggactttaggcagtccggatcggggcctttcacataagcttctttgcttttggctcaaaactctcaaggaccctttgtcgattagccctatctatctttttatcatttttctggtaacttttggagtatgccccttattgttgtgctttaaacttttgaactttttccctttatctttgtatttggcttctacattgtggaatgaaaacaaacattgtccaaaaataaaataaaaaaaccaatgaggaaaaaaatcaaacaaaaataggagaatcatagtcatatttttggatttaaattcaaatcttttttcatggtacataatctgcagcatttacagcaaaaatgaaacaaaatctgttagttttaaatttgaaaatatgtttgcaccctataataatctcacataagttcttaaagattgaaaaacaaaaatggttgcatatgtcaagaacaactttttattggttcatataatagttttacttctttttgttatctcatcatatgcaagatttaatacgaaggttacaacagatgaaatatgtggcatgtgcgcacgcagagcagtcaatgcgtcattttgctatgagttcatgaaatcatcccctcaagttgcaacattggatacttatgatctctccaaattttttatcaattatgattttcaaaacacctttgatctaataaagcatttccagtcactcacaaacaacacaaccgatcccagttctaagagttcttatgagctatgtttacatctttttaatcttatcaatcctcttgaaaccgcacttaaagctttggcaaccaatgactatgacactttaaacaggaatgttgatgctatgtctcaattcgcgaaggaatgtgaaagcgagctgtcaagtgtcatcaagcctattccaaagctcttgaaaagggtttctatcgtcgaaaatgtatccgacattatttttgtaattgtggaatgttttttaagaaaagaagaaacttcatgtaaggaatcagtatcaaatctacaataataaattaataatcataatgttgtttggtatgatgttgccattaccgatttacaccgataattaattgttttagtgttcagaaaaatcgaaatccaccacaagagcataccaaatcacgaaaaagcttgtttgatagatcggattggancggctttcgtatttgnnaaagtcatcgttcacctgtgaaaaattacgcaactccggcgaggactattttcaactatgggcctagcccaattagtccaattagtaaggagcttaaaatgcttttctcaaagtacggggcaaaagtaaaagaataaaaaagtagtggaccttgagaaaagtcatcaccagctttccttcctatgccacacaaacgtgttcttctgaatatgagtcaaacacagagaagattaggagaacgtggaagaagaagccatg

SEQ ID NO: 429 - DNA, 7 bp, Unknown
  misc_feature (1)..( 7): cDNA_ID_1692605_gDNA_ID_1590947_Annot_ID_150304 3000 nt of promoter + ATG
tcaaatg

SEQ ID NO: 430 - DNA, 764 bp, Unknown
  misc_feature (1)..( 764): cDNA_ID_1692663_gDNA_ID_1590961_Annot_ID_150332 3000 nt of promoter + ATG
  misc_feature (241)..(241): n is a, c, g, or t
cactgaaatcataattaacatgatgatttatacgagtaaatgatttgattggcatataaagaatgcctaaagatggtgtgatgaaaaacttaatacaattctaacggctattttttgctatatactgaaaataatatcgtctggagttataataattagaattttgtatggttaaatttctattggtaatgtaaccaatgaatggaatgaaacaaaattgatgtagtcagaaaaaaaatcntatgaaaaatttgatatattttttttaaatggaatgaaatagctggagactaacacacattttcccatcatctatccaaatatatgtttaaatggtaaaagatagaatagataatgaaaagaattatgagagattcactaccaatttcaaaattatgagagattcactaccaatttcaaaatatctctaaaaacaaagttttcttctcttttttttttctttcttttctagatcttcatatctaattcaaaagagaagctcacttttgacgagcgtgaaagacagaaggtacttggataacacaactagttcagaaaaaaagtaggtgaaaattggctaccatcttgcctctctcatacataagtattgtttacttccttggttcttaaaatattagaacccattttttgtgtttctaataattgttttgttgttatctaagactaaactcatagttttgtatactttcaggtcagatcgaagcagacaatactgatattttggaggaacctattctaaaatg

SEQ ID NO: 431 - DNA, 930 bp, Unknown
  misc_feature (1)..( 930): cDNA_ID_1692672_gDNA_ID_1590962_Annot_ID_150335 3000 nt of promoter + ATG
ttctctagccgaaaccttttaagttttagcttgagacccttagcttcaattgtttttctcttggacactgtctaactttgattcttcttggaattgattaggaaatggctaagaaagttggagaagttatagaaaaatcctgcgtagagaatgggatcacaaaggtggcctttgaccgtgcaatttacacttaccatggctttagctgcttcagcaaatagaacacggtctccaattttaagtctttttttgttttgtccttctcagaaatttgcttgtatagaacccatgattgaaatttagattagtcggcttggaacagtgttaacttcttcctttttaatgtgttcatttgttcttactacttatgcatctcaagaatgtttatatcgtctatacgatgataatatatttgaaaatggttgatgtttacaaagcttcagaaggtaagacatcaaatgtgctgcttagttaagagacaggtacaagtgcttgcaaatttaggacagaaggacaaagacagagacgaaaacttcggcgcagtgaaggcagttcatatctgtgaagtatagatgcgatatggttggaagttaagtaactgatagtctataaatagaaaagtgcgaggtatatgcccaccctggagttggtatgtccgcttctatctcatctacctattattagcaaactatagacattattagttttctgttttttccttttatatactcacttctttaatgtagattctgtttaataaaaacagtaacagaacagaataaaatcttgatttcttttttttcctcccattcaggtctcatacttcgtttggcaatgcaatgagggagcagccaaggcagtattgaagggtgaagcagtatctcgtttcttgaccaatcatcaacctgtaagtagatctccactaggatg

SEQ ID NO: 432 - DNA, 2681 bp, Unknown
  misc_feature (1)..( 2681): cDNA_ID_3055223_gDNA_ID_1590964_Annot_ID_150342 3000 nt of promoter + ATG
  misc_feature (2)..(2): n is a, c, g, or t
  misc_feature (24)..(24): n is a, c, g, or t
  misc_feature (85)..(85): n is a, c, g, or t
  misc_feature (103)..(103): n is a, c, g, or t
  misc_feature (162)..(162): n is a, c, g, or t
  misc_feature (225)..(225): n is a, c, g, or t
tnctaagaaataagaagatgcatntttcgtcaagagacacatgattcaacgaatttagacatccaacatcaaaccaacacgaatnttagtaatagacaagttnggttaatgttggaacggacaacgtcccatatttttgtttacattctatgtttccaatanaaaatttggtttcgcacggaaaaggtggaatttaagaatcattgtatacaatactataaatgngatacttaaactgataactgtaagtaatactcctagcaaactctgatttttcagcttgtcataacttttgttaaccttttaagagacaaaactatcactagacatttatagcttgactcactatacaagtattgacttcatcagttgcaattttgtggggaagagttggatcaaattatgaataagggctattaagtacggtttgcctatcctgaggtactttgctctatatgggaaggaacatagttattactttttataaacataaattttgacaactgttgtttttattgtaaccaacaaattgaggatctttatagcttatagtttctttggattgattacgtaaactaattgaaacgactagtacctcctcccctatttgactaggatacaatcatacaacgtaacaggttgaattgccgacatatgattttattaaaaccagtgtttaaaaactgatattagactatctggtcgaaccaaattcatttataaacaaaataaagcaacacaattaccatgaagactagaaaaatacgataagtaaagctataaaaatatggtgttgtttcaatttttaattatcttgttttactcttaatattagataatgatattttagctgtatgcttgacattgacatatgttttgtttccatttaagaataaagcactgttggtacaaggttatatgctgtgtcttaactcttaacacaatattataacttaatccacaacctttattaagaactaatttcgtaagatatggatttggattacgaaagtgactgttgagtatgaagtctatatcatatattaatatgaaattaggttggtctcttcatgttttttagatcaaccaagcagaagagagtagagggggaaatatcaacgtgaatgtcacgtgaacggagtcgtgcgtgcgtgactactcgtggcgtaatgtcgggtcgaccactgaagtaatgggctttaaaagttgaaggaccatatccatatggctcttgtgggaaccactttacacttagtcttgctcgtgggatcgatctgttttttgtttcttccttttgctcaaaattgatctggttttgctattattatatcatgactactagcaaaacttacatttttacttatcccatcaacattttcagatcaatttttttgtaaacaagattaaagtgaaattggactaacaatgattttcaaattaggtgtgtatgccctgaaactcagtatctgcttcatcccgcgatcttccaaatataagaaaaaaacggtcacctaatttaccgacaacaaacctaatccactaagacattattcaagatctagaaacgaaaagtcatgagatataaagatgcacgtgggaggacaagggaaaggacagaaactgtttggttgggagacaaataagtgttacgaaaggggaagtgaataagtctctctttaaactcaaaacactgagaaaagagtttgagtgtttttgtgacagatttggcttactgtcttgtctccgtcaagttgtaaataccaaagtcttatcatgttttttctctgtctcctctactacaattttaagaattgtaccacaaaccgatccattcattcatcatccaagcttcttgattcaaactggcaacatgttaactcgttatagatgatagtttggtgagttctataaaattgcgattaaagttatttctcttacaatttttcttggaacattttatatatgtataacttgtacatgaacgtagctcaaaagctaagaaaaaggtagcgccataatcattatgatgaataaaataaaccccagtttctctgaaagtgttggtttttaccacaccatattctagaagttaatttattggggttctaccacaccatatgcaccatgtgattcatgttattgttctaattctaaaactttcactgcgattttaattataatggttcactaatcactatgaaaacattagatgaaaattactaacacgtgattcttccagaaatcccgaatctctcagttacacaaaaagtaatatttttgtcatgacccagctttttccaatgccgtacataagcatggggacaggcaactaaaaaagctacaccaatcaaggccttagttcataatcgaacaatcacgtttagcccaaactttaaatgggcttaaaataatgtgggccttgacccacaaatagaaaaacacgtgacattccctctttgataatgattgcaaaaaaacagaggtgtgtttactcaaacgtttcccgtgtcctctacggtcagtatcattctttcggtgacgctaatttctccggtggttggaggagaacaaagtctcaaagagacggcgaacgaagacgaagacgaggagcgtggagagagtagacggcgaacgaagacgaagacgaggagcgtggagagagtctacctctctcgacgatg

SEQ ID NO: 433 - DNA, 195 bp, Unknown
  misc_feature (1)..( 195): cDNA_ID_1380819_gDNA_ID_1590981_Annot_ID_150358 3000 nt of promoter + ATG
aaaaaaaaaacttagaaaaatacgggttgtttgaaaatgacagaatagacgactctcgttgcattgaatttgagtgaaccccacactctctttcaagtctcaacggccatctccattctcttctatctcttcttcacaaaactctttcacccatttttcctccattaaacaacaaacgacctcgtaaggaaaatg

SEQ ID NO: 434 - DNA, 351 bp, Unknown
  misc_feature (1)..( 351): cDNA_ID_1711067_gDNA_ID_1590986_Annot_ID_150363 3000 nt of promoter + ATG
  misc_feature (73)..(73): n is a, c, g, or t
tctcttcgtaacgattacatgaggcatagctccttatttatactaaagttaagcccttgtaaaaccctagttnacattacacatgtcatcatctagttaccataaatctattctttgttcattgtacctcttttgcttgtgacaatcttcctcttttgcttgtgtaataggctaagggtattaaatttaatgtttatttttgtataagagaataattaaagcgttttttaatcaaaaaaattaaacacctaaagccgcatcaccagcgttgaccaacgttccggtcaatcgaattcggtattagggtttaaacccaaccgtcccccatttctccaccgcgcttagctaatg

SEQ ID NO: 435 - DNA, 3 bp, Unknown
  misc_feature (1)..( 3): cDNA_ID_3055727_gDNA_ID_1590989_Annot_ID_150367 3000 nt of promoter + ATG
tct

SEQ ID NO: 436 - DNA, 1636 bp, Unknown
  misc_feature (1)..( 1636): cDNA_ID_3055734_gDNA_ID_1590990_Annot_ID_150369 3000 nt of promoter + ATG
  misc_feature (1076)..(1076): n is a, c, g, or t
aaaaaaaatgaaagacaataattcatttgcatagaagttgttgtccgaatattgttatgtgctttcaaatcaaaatacatttgcaatgacaaaccaaaagagataatgttggtcttctataagtgttgtcgtcgacgacctgcagctaaaagaaaaaaacatgtaaatacaaagcattccataatccaaagcattctctaattcaaaaactcaaaactgaaagaattctatcaaaaacaagactatctgaacaaggaaaataaaagttaccttagtattatgaaagtaaagaatgttgtgaaaaagatgagaatcagagcacatatgacctggaaaaaaaaagaacataaagctgaagcatgtaaatttaaattatgcatttcataccttgacaatctcacacgtcaaaccaagatgagcctgatttcataccaagtaaagaatgcggtgtgaccaaaccaagataaaaacaattcattcactataaagaaacaggaacataaaaaaccttaacaattaattcaaacaaaaacaatccaaacacatctcaaattcagatgtacgaactacaattcatagacataatattcagagatttcaattgatagacatatgacaaatacattctacatacaaaacatataaaaaattgatctcataatcgagtgtgaacaaataatctacagcctataaatcgtcttcaatcatcactaataaccaagaaagagactgattatgcattcttacaaaccctaattcgtttacatcaaatagccctaatttattttgcttgaattcccaattcacgaaactctaatttcaataacatctaccaacccaaattaatcacgatttatacaaaacttaaagatagaatcatacctttatcatgagactggaccatggtttcacacaagactccgatatgattcacaatcctctccgatttaaactcgtcgacgttgagcaccgtcggttgagatgatgagcacagtggattagagacgacttccgggcgataatctcttccaatttgatgatataaaagcatgaagatcttccggcgataatcaatngttcaattgcacagccgagttcaagagagagagagagatcgataaatgaaaaaaaaaaggcaaagaagaaaaaaacttgttttgtcaaaaaagctcaaccaatgaaaacatgccacgtatccgatccttaacatcatcaaaaatcttaaaattaggtgcaatcctaacatttaatcacattttttatttattttttctcaaaattactcaaagattttggttaaggatctgttaagtccctcccaatagacctgctcttacccacttaattaataaaccggaaattaaaattggttacaaagttaaaaactaaaccgaaactaataaactaatcagacaattggaccgaagtaaaatcatctaaccgggtagggtttaaggtctgatgaatctgattcacttttgaaactccttcacttccaataacacttctcgaccatctaccgccacttccgatatcgtcatcattattcgacgagcttctctccgccgccgccggaaccctaacctcccagcctctgaccaatatcattatcactccgattgagccacttccaatg

SEQ ID NO: 437 - DNA, 1224 bp, Unknown
  misc_feature (1)..( 1224): cDNA_ID_3055730_gDNA_ID_1590990_Annot_ID_150370 3000 nt of promoter + ATG
  misc_feature (177)..(177): n is a, c, g, or t
  misc_feature (1050)..(1050): n is a, c, g, or t
aataacactaccaccagatacttcatcaccatcaattgattccatcatctgctcagtgaacaaaacctcgtcttcttctttctcttcatgctcagacatcttcaaagccttagctttctttccacgctcagaagtcggatcccaagtattatccggtttcatccggagctccgcttnaccgtgagcgtatttacactcgtttccatgactacacgaagcctcacgcctaaaataagaacagagactcgtcttccaccacggtgaaggagtagtaatcttcgtgtctgacgatttgagattggttttctcgtcttcatcggcgcgtttccgtttctcaccaacagcttcgatgttatccgttgcattcgaatcggacgatggaagttcgtcgattgatgatgtctccattgcaattggctcgacggaagcaggagctgttaggattttggtggctactggaagctcgttgatttcgattgatgatgtttccattggaagtggctcaatcggagtgataatgatattggtcagaggctgggaggttagggttccggcggcggcggagagaagctcgtcgaataatgatgacgatatcggaagtggcggtagatggtcgagaagtgttattggaagtgaaggagtttcaaaagtgaatcagattcatcagaccttaaaccctacccggttagatgattttacttcggtccaattgtctgattagtttattagtttcggtttagtttttaactttgtaaccaattttaatttccggtttattaattaagtgggtaagagcaggtctattgggagggacttaacagatccttaaccaaaatctttgagtaattttgagaaaaaataaataaaaaatgtgattaaatgttaggattgcacctaattttaagatttttgatgatgttaaggatcggatacgtggcatgttttcattggttgagcttttttgacaaaacaagtttttttcttctttgccttttttttttcatttatcgatctctctctctctcttgaactcggctgtgcaattgaacnattgattatcgccggaagatcttcatgcttttatatcatcaaattggaagagattatcgcccggaagtcgtctctaatccactgtgctcatcatctcaaccgacggtgctcaacgtcgacgagtttaaatcggagaggattgtgaatcatatcggagtcttgtgtgaaaccatg

SEQ ID NO: 438 - DNA, 2504 bp, Unknown
  misc_feature (1)..( 2504): cDNA_ID_3055738_gDNA_ID_1590991_Annot_ID_150372 3000 nt of promoter + ATG
  misc_feature (18)..(18): n is a, c, g, or t
  misc_feature (61)..(61): n is a, c, g, or t
  misc_feature (65)..(65): n is a, c, g, or t
  misc_feature (109)..(109): n is a, c, g, or t
  misc_feature (121)..(121): n is a, c, g, or t
attttgccggtcctgcanacaagcgcacaaatctcggttagattattcagataatcaatgnagtnaacataaaagagattcaattacccgatttgattgaagaatatanactaaatcagtnttaatcacaacaagaatataacctcctaattttggcaatgaattaaaccaaaaattatactctcctatatgcgatcccgtaaaatgagcaaagccaaatataagtcctcctaactacattccttatcttccttcaaatattccataacatttaaatcaaataactattcctaattatctaccataacagcttttaaattaaaatttaaacaaatcaaatcaaatttgaaaatatggaatatcctcaaaattccagcgcctatttacttctagactcacaatcgtaacctaatttgttttgtgctatataaacaatcgaaatcttttaccatcaccacacacataccattatctctcaagcaaacagtcgattcacatgtacatgttttcatttcagttttcagcttcagcatttggttgggatgatcacaagcttttgtttcaaacactaatatctggtaaaagaacagattaaaactcaccgtcttaggtgccataagagaagaaaaagtaatggtcttttccggtggaggtccagctctgttgtggctcaaagccgtgatcactaagcagtctccggaggtaacagccttcactcgtcctttaagccatcagttcttcagccttcaatctatataacagaaattttgaaaaaataatatgatttaattatctactcccagtttgaaacaaaagcttgtgattatctatatgattcaaatttataaccatacctcatctgcatgaagcaatgaggttacgattgtgtaatccggtcatccctctcattccaccaagtaccttcacaaatatcacatgtaaaactatatatacgagtatgtttaaaagataaagcctttgtgtaatcacaaaaaacattagaatccataccatatcaacggtgatgttccccactggaacctttccatgttttaatttcagtttcttcgaacggtcctgaaagttgaaagttgtgtttgtgtatgaagtttctctagaatagagagagaagagcttgatcactacatgaaatctgccctgaacatagaaacaatataaatcacaacgaagtagaaacttaaaaaaaaatcacatacaatttgatctccaagcaatcagattgatccatcaaggatagacgagagattaagggatataatctcatgattaatttttttaagcattatccaatcccaaatcacaagtcttttcttaacaaattaaatgtgttagttctttaaaaatgagatgatgagtatttttaagagtgaattggtgtaatagccctattgttgtttaagttaaagggaatgatcaaatgtctgaataccatttcctgaagtatatggacgaaacgctagaaacagaacattgacccatcttttttgagagagagaggaggatcaagaacatttcctaaagacaactacgcaaagcattaatcactataactctttaatcgactctgttgtttctacacctcaaaagatttgtccctcggtcacaataacatttcaaacagaaaaatttgtatccaatggtcacttatttctcaaactttcttctacctcttaactgtttattactcctaactcttatgtttaattactgcgaattcaaggaaacatcaagtaatcactggcacactttattgatcactgagtttggttatttaaaaacagaacgtacagagaccaagcataatcaaattgtattttaacaagtaaatggcacaagaaggcccttttagccatgctaaaagataacgattctttcaatacaaaatcctttatgactctcaaattctgaaaaaaacgaatttggaaaactcataattgaagtgcagagaaagcatcgtcaacttcgtcaacctaaaaagagacaagaggacagaggttgagaattgaatacctgatcggagcaaaattgtctctgacgattgaattcccaaatccgatcaattgaagagactgtggagatgatgaatctggcttcacaaactcaaacacaccacattttacacgtattttaagatccaaagaccggaatagaagaaattcgaatcgccatagaatgaagaagaaagaaaaagagaaaacggaaggacggaatcgttgatcacgattaagagaagattttcttcagttttgctcgtcgatttcatcagtcggaggatacgaaagaagagagaattcgcgaaatgagaaaaaaacagaggaaaagaattcagaggctattgactgaaggttaaaaagagcgttgagttttctcccaggcactttctccaatgcagtctattagcagttggaaacttttgaaaaaccagatctcagctacctctttttactaaaaacagaattatccaactgttccttccaaaaatg

SEQ ID NO: 439 - DNA, 1245 bp, Unknown
  misc_feature (1)..( 1245): cDNA_ID_3055752_gDNA_ID_1590997_Annot_ID_150380 3000 nt of promoter + ATG
atcagcataagcttttgttgtgattttcaatcagaaaaaaaaaatataaggaaccaagagcttttggcccaagtatcttccccatgacaaaaatatactcttaatttgttggcattaaattcataaggttaaaatgttgaaatttggtgagagatgatgtgaagaggagaaacgagagaagggctctataaaattgcaaaggccaaattgaagtacaaattgttgtcatttgtgaagaaggtggtccattcttttggtagcccagacgttaggaaccaaataacaacataattttctatttattttcatctatttttattttggaaaatgagttttcttgtaataataattattgttttatttttggactttactttcatgaaagaaaacgactgggtggagaaatggacaattaattcttgggggcaactatcgtatgatgtggaaagttaattattgttaatttagtgggtccattgggcctaacgggcccttcttgaatgattttatgagaattttctactgtaagatattgtaagacactgtaactttaatgaatgggggatatacgatgtttttttttattttaacaatccatcgttttatacacatgtttcgaagttcacaaacttcgcagacaaactaggtttgaaattttttaactaatattccaagtttttgtttgttttattaacctttccgtctataaaagaattaagaaaaaagaaccataaaattaatgaatctacttagcaatattctaagatttgctgtctttaaataatgaaacaaagcttaagaaaataagattcttaatatttaaaaaaatactatgaaatttggacagaattgctgagttttcttatttatgtacaaacaccactaagtaatatgtatcattagcttatgtatttttaccaagtttgagaggaccatacaactaatattatcacgaattctattattgcatattgcaaagtacaaacagaattaatgcaaaaatgttctttttaaaataaatgtcaagaatcatgacgtggcataatcgtgacgataacataactttgatcagaaatactcaacggtctagattgagtcctgagtttatggttcttctttatcttccatgtctcttctccttcctcactcccctcttccctctctttatctctctcaagatttgctctgtccagagctccaaatttcaagaacataaacactacacacaaaacactgaatacgatg

SEQ ID NO: 440 - DNA, 2559 bp, Unknown
  misc_feature (1)..( 2559): cDNA_ID_3055757_gDNA_ID_1590998_Annot_ID_150384 3000 nt of promoter + ATG
  misc_feature (62)..(62): n is a, c, g, or t
  misc_feature (66)..(66): n is a, c, g, or t
  misc_feature (205)..(205): n is a, c, g, or t
  misc_feature (371)..(371): n is a, c, g, or t
ggtggggaaataggtgggtccattaatccattgccctaattaactcctaatcattcaatgtnttgnctatttagaaagggaaatttcagaaaacataattcgagatttttctatagaccgacaaatgtaaacgattctgattttgtattttgaaagctatagtataatgttttggtgtcattaattttaactcgatgatgcttcnaaaataaaagaaactaaagatggtagacgacacgtgatcaatagctaagtaaacatgtattgcagatctgcagacaatatacacgtaccaaagtttttgttcagttaacatttaacagattattattgcattgtttcatgtaacataactcattcactatattgcngaatatacggtactttctgtcatatcgtggtagtttaaacattttgtgtgtttatcaatgtgtatcatgaattaactcttatcgtacgttaaattcctgaatcattaaagaaacaaaattttgagatcatcttgtatatgtttaacgatgacgcatctgtatcttcaatcaatgacttcgttatatttttggtaactttgaggaagaacccaatgtaaaatttaattgatttgaatttatgttatgtcagattttgcaaatactccaatttattatagatatagataaggtattatatgacatactattattatcaattctgcaaataatccaatttattagggatttagacatagtccttgaattgttaattaggatgattaaccttaaaatgaattaattatatcttaccattttttaatggtatgaatatctttataaagagttgcataaaattttaatggtgtaactgttatgtatccattctcttcaactgagtgaccttttcgtttgcgcccatttcaacaattataagtttcgtttaaactgaaattctctatcacgtccttaattttagccaaaattttgcagcaaattcggcattattattttattacactatgatccttatattaagagacatcacctttgtttatcgaagtttaattcttcaagtatgcatcttatattatccacttgacatatgtatatatgtgcttaaaatatcaaaaaaatttgaccaaaaattttctaacttaaagctcgattcgttttcaagtcaatgttcttctataatgttgctatatatcagttttataataggtgaaataatgctataataaaacactaattttaaaagctcacaagaattctcataaataattatataatgaatcaagttaattattcaatatgtatgtattttaaaacattttcgtctttttagttaagccctgttcgtttctccatttgacagatccatccaactgattcattcaacatgttcatctagatgattcattcgactcttgttcgttttatttttagtaggttcatttaactagaccatccgaatgagatgttgttcgtttgcttatctctatctccatccaaatgatttgtaataatacaaatacctaaaataccaatgctttcatctaattatatttttattattacttgtaaacatattaattttaattcttaatctaaaatatatttaaaagtaaataaattttaaataatagttttttacatttatgaatttattttacggttttggcgggaaaacgtgattttacagttttgacgggaaaactcgatcttacggtttggcggaaaacagaattttacgtttttggcggaaaaacgtaattttacgtttttggcgagaaaacgtgattttacgattttggcggggaaaaatgattttacggtttcggtgagaaaacgtgatttttgcggttttggcgggaaaacgtgattttgcggttttggcgggaaaacacgattttgcgggtttgacggaaaaacgtgtttttgcggttttggcgggaaacgaaaatttacagttttggcgggaaaaaacgatttgcggttttggcggaaaaacgtttttttacggttttagcgggaaaacggaattttacggttttatcggaaaattttgattttgcggttttagcagaaaatttaatttttattttttaaaaaataattggaaaataagatttaagtctatttgtttttatctaaaaatacatctaaataatcaattaaaataattagggtatttttgtcatttgttaattttgactgaatcatctccatccaaatgatccaattaaattcagccaaatgagtttcaaaatttagcctaaattttcaaactcatccaaatgattcatttggatggatcttctgaatgaaccgttttttgcactaaacgaacatcaaaactcatctccatccagatgatccatctgactgatgaaacgaacagagccttaatagaatctgaaaagagtgggtcctcaataattaaaaaccaagaattcaaggggatgggatttttcctataaagaagccaaagcctttctcaccattttctctcatcaccaaacaaacaaacacattcaaatctcataaacacattgataagtaaaaatcctctcgagagacaagaatg

SEQ ID NO: 441 - DNA, 136 bp, Unknown
  misc_feature (1)..( 136): cDNA_ID_1839149_gDNA_ID_1591003_Annot_ID_150398 3000 nt of promoter + ATG
  misc_feature (132)..(132): n is a, c, g, or t
taaaaagtagaaaatttactgaattttgactaaaattttaccggttttttctgatcagttgaaaaaacagagaaaatttcttgaaattttgattaaaattcctctgaatctaattgttttttgttttctggngatg

SEQ ID NO: 442 - DNA, 102 bp, Unknown
  misc_feature (1)..( 102): cDNA_ID_1443346_gDNA_ID_1591026_Annot_ID_150414 3000 nt of promoter + ATG
agatgtgttcagagaccgttggattccatttctttgtcaaaagactcaaaactacccaaaactcttccatcttcaccaaattctctcaatcactcatcaatg

SEQ ID NO: 443 - DNA, 281 bp, Unknown
  misc_feature (1)..( 281): cDNA_ID_3055807_gDNA_ID_1591035_Annot_ID_150426 3000 nt of promoter + ATG
aaaaaaaagaaacaagcagcataacaaagctaaaaggcccaagtgaaaagtaaataaacaaaggcccaaccaagcccaagagaaaaccaatgtcagttttgtttttttgtttttgaatttcaccggttattcattaaagaattgtttggcccgccaacaacatacgtgtccatatccacagtctctcacctctcgcagtgcccaaacctcttcttcttcttcttcttcttggcttctcctcctccttttccaatttcaaaacccaaaaacaaatcagcatg

SEQ ID NO: 444 - DNA, 755 bp, Unknown
  misc_feature (1)..( 755): cDNA_ID_1692880_gDNA_ID_1591037_Annot_ID_150432 3000 nt of promoter + ATG
acaatacaaccattgtaacccaacaatgtcttgttgaacccaacaatctccgacgtccgacgaggttatatgaggcatatgaccactatggtatactatttttcttttagtttattttttgttatgtaatatcttaattgttttgaaattttaattttttgtatatcgtatgtatattttacaatatctttttgtttcatggatagatgaggaagtgacaaagtagaagaagtgagcaaagaaaacacccgtgtcaaagcgttaaaagactgaaaaatgaaattttgtagaagaagaaataatataacatcgagacacgatgagactaacttttgaatcaacttcattgtagtaaaacttttgtggctacgaccttagaaatgaatctattttatttatttattaatcattgaatatgtgtagtatttttattttcttacagcctaagcctttgtatttgtattatctaaaatagttctgttaattttggaagactgttaatttggtgttcatttcattcaactactgtcctctcacaatatcaaatgacaaaactaaatcatcaaatacatgaaacatgttaatattgttttcataaaggataataaaccacttatatgggcttatatgactctatattgggctaggcccatataatggtcgccacatagtcaaataagtctcacgaacacgagtagtcatcgaacggaaagttaaaaaactgattttgcctgtttggttttggatccgagatg

SEQ ID NO: 445 - DNA, 94 bp, Unknown
  misc_feature (1)..( 94): cDNA_ID_3092211_gDNA_ID_1591038_Annot_ID_150434 3000 nt of promoter + ATG
ttacgaagatgctgcattgcaaagtcggaaaagctttgccttattaaattttggacagagttttatatttagtacagctttgtcaacagcaatg

SEQ ID NO: 446 - DNA, 449 bp, Unknown
  misc_feature (1)..( 449): cDNA_ID_3055825_gDNA_ID_1591051_Annot_ID_150449 3000 nt of promoter + ATG
atagtctaatataacatttttcgattactccaacatcaaaatcaactcttttttttaatattatcatactcctctatcaagaacaaaaactaaaaaaaaaagtataacacaaaccgtaaacacgattactaatatattaatgtttaaaattatcaatcgaatcaatgattaaaaaatcaaataaagttaaaagtaaaaagaacaaagaaacaaaacaaaaacacatttagacagctagagttttattacaaaagccaaagctttattttgatacccccaaaaacagatatctttcagtcttcacgttgcaatatactcacatttcgaccacatactgacaaaaactccgtatatatatatacgtataaaaatacggtcttcttcttcttcttcatctcttacaaacacagacacaaaaatcacaaaacccttctcactctctctcaatg

SEQ ID NO: 447 - DNA, 2589 bp, Unknown
  misc_feature (1)..( 2589): cDNA_ID_1808168_gDNA_ID_1591053_Annot_ID_150453 3000 nt of promoter + ATG
  misc_feature (26)..(26): n is a, c, g, or t
  misc_feature (1616)..(1616): n is a, c, g, or t
ctttgtttcttttactcaatttaganaaactttctggttattcatggtttccttaacgtttttgttttggtattttgatgcagttacttgttaattttggatcgtaccaattggaaaaccaagatgcttacatcactgctaataccatacatcttccttagccttcctagtgtcattttcaacttcctcaggtaacacaatcttttcttgtcaaaagacacaactaattcttaaaactatagtctataatctatatactggactggtttacatggaatttttcaatttttgttatcagtggagatgttgggaaatggattgctttcgttgcagttgttctcagacttttcttccctaagcatttcccaggtgatgacatcttcatattgttgtgccttcttgatttgtatctttgtattgttgtcatacaatcgctgaagatgtctcgagaatctttaaaatgctttgaggcaaatctatactaacattcaagtcagtgtaattgctgaaacaaaattaaagtctcacacttttgttgttgtggttttcaaaatgtgcagattggcttgagatgccaggttctctgatcctgctactggtagtttctccacacttccttgctcaccatatacgtggaacctggataggcactgtaatcagccttttcattggctgttaccttcttcaagaacatattcgagcatcgggtggattcaggaactcattcacacagccccgtggagtgtcaaacactttagggatcatccttcttttggtctaccctgtctgggctctaatcgtccgtgtcatgtaatccacattcctctttcatggacaagttgtttcttgctcggctgctccaataaactgcgtgaaacatcgagcagagcaagtatctatggtgttcctttcttctgattatgttgcagacccaaatactacctcaagctcaatcaatgttctatgtataaaaaaatctcatttttcaactatttgtttgtctactataagaaaaagttctttattgaatgattgtaaaaactagccttcatgagttcatgttgtttgcctagtgttgaaaattactcgtgacttccgtttcgagtattcacattcgcaatacgtggcgttttcaatatgaagaaaactacacgctgtttgaattttataactagacttcatgtcgtctaaaagtaggggggcggcttaaaaccctaaccctagtttgtctgactccttataaatagttctctctccgccgtttataatcttaagtcatctctgatctccgagttcaacccaaatttgaatctctggcttcttaattcttattgatatttcgttttattggttaatctgttttcgatttcatatcactagtctaggattcgttcttcttagaaagaaagggtttctcagtgatgaatacacagatgacgagtccgatgaaatccattcattaaatcatggggacaaacgaggcatttgtctgagaggaatccttttatacttttttcaatcttattagttttttctgctaaatgtttttcaaagttgtttgttttgtgattttcgaaaattgaagaaaaaaggcatgatgaggattgttttattgncatctgattctcatgatgaatatatacctcctactcattctgagtgccttttcttaatttcttaccatcaaacttcgttgagtctataaactttattcgttctatagtcgaaattattcaattggatacttatcaattgatcgaaatctaaaagtttgactgtctcagcagtttttgtttttaaaactaggaaatttttgataatctgtgcaagctgggtcggattcatagctactattgtgttcttggttctggaaattataactgttatgctactattgtggatgtgaggacggcttttcatggatgtactctcaattctaactatttgacatggttgcgtaagaatcaggagatgaatgtactgaacctaacagataaacaactgatctttagagaagcactgccctagatgtgtatacctagaagtcaatcgatgatacttctctgagaaatcacttgtaaactttgattttgtattcaagaatcttaatataataaaataaactctttattcattcgttgtgtcttctttctcataaacaaccttcatcatcactattgaaatcttaatattaatgatatgcataagtgatttcaatctgcgatcaaaatgttgtgatatgagaagcataataaccgaacatttagttatcctttctctggtgtattccagaccggtcttgaaccgtttctagaaccaaactatttattcaactttgtatattccagtggaattgataactttataaccacgtcaccaatactgattgggacagtatctctatttccacatcagctttagacacgtggctattaatcaaccatatactcctgaaaacaatccaatggaaaattttcaaaacttatccgaccttatcttagcgaaacaaaatctctcctctgattattactactcaacttcgcattatcactcaaacaaacatattgacatctgagtcttgtcatcatg

SEQ ID NO: 448 - DNA, 502 bp, Unknown
  misc_feature (1)..( 502): cDNA_ID_1019620_gDNA_ID_1591055_Annot_ID_150456 3000 nt of promoter + ATG
taaacgatagaagagagacaaaagttacaacccaaagccaagcgtgtaaagatcaaaaggtcatatttttcctgaggggaaacttccgtcgcaggttaaaattggagggcttttttgtaaacaattcttaagaaggctacttgtagtaatttatttgtaattttagttaactgtgtaaagtaaatactttatccagtaataacgtatcactttagttgatgtctattggttaatagccgaagctcgttccaaaatcgaagagaatctataatctcatcacgacacaccaaagccaaaacctttattgtcggaagctgactcagactcaaacaatgtctctagcgtcaattatatgctaaattcaccagccgcttagagccaatcatataatctcgattctcttcaacggtcctcaattatcctaaattcagatcataaaaaagctaacttttaatttctttctttctgagaaattggttctcatcgttggaatcgaaaaatg

SEQ ID NO: 449 - DNA, 974 bp, Unknown
  misc_feature (1)..( 974): cDNA_ID_3055849_gDNA_ID_1591056_Annot_ID_150460 3000 nt of promoter + ATG
  misc_feature (13)..(13): n is a, c, g, or t
  misc_feature (25)..(25): n is a, c, g, or t
ttgacatattggnttgttttatacnaattcacattaacttctttttttcttacattaacttatttctaatataacaaaaaaaaatcatttggtcgtttctacattatcatcatggatatttaggattttttgtttttaattctactatgcatgatgatcaatctatcatatatatctacatgcaatatatgtgattataatgaacgactgtacgaaagaacttcatgatatgcacctatccacaacacttggatctcctattgacaattgttattagtgccataataattaacgatagacattcttatatgtagcattcgagacacgacggacggttctccgtgcaaatgtgcaatattctaaaacgtctgattagtattacaccaatactctgtaaataaatgcgctatgtaaaagaaaaagtccaaacctagtgtagaaatctttttacacttggataaaagacttccacaaataaaatatattttaactaatcacttatgaggtaatgaatctcacattttgttctctattttcttacgtcgaaggtaaaaatgtctgtgtttatgctcctccaactacttattttccaactaaacatttctttccatctatctaaaaaatccctgaagaaacaatgtgaaaagatctgataattactttgttttgtgtggaggccattttattttcctttatataataaaggggacaatatatatattacatgcattgataataaagatgcacctagaagtaataatattctttttgttattactagacgacagaaaccgtgcccttttgactcgggtctttactcttaacctatcgatgagaccacagaaagaaatataaaattgtaacgaacatattttattgagcttctttaccctcatatgtatgtaaatcttcttcaaaattaaagagagagagagagaaaaaaaacttggaagaatctgtctttgataatcatg

SEQ ID NO: 450 - DNA, 1782 bp, Unknown
  misc_feature (1)..( 1782): cDNA_ID_1031872_gDNA_ID_1591066_Annot_ID_150470 3000 nt of
  misc_feature (1)..(1): n is a, c, g, or t
  misc_feature (3)..(3): n is a, c, g, or t
  misc_feature (10)..(10): n is a, c, g, or t
ngntcatttncttactatattacttttattttgaaaaaaaatgttaatatttatatcgtattaatcatgtaataacagtcaaacgttacaaatatattcatattttttcagatgtacacatcttatatagtaggagaaacattatcctttcacctttctttttctgaatcttgtaataatgttatcttatgcgtcaggaaaacttatttaatgagaaatattttcctctgttttgaaatcttcttgtggtcatttggacgacgacccaggacatggtctacgctcttctactacttattaatattatatatgagtttcttacgatccatatattagaccatgtatatgggtgatatttttagagtatcacaagtccaaaaattatttttatattaataaagcaattagaatatgtttgatcagtatcagtccattgatatttgtgatactagtatcatctgacgtggcttcttctgattggtcacatttgacaaaagcaaaaaatattatatataattattaaacaaacattataaataatactaaaaaatttcttaataatattttgtaagtatcacctatgaacatgctcttagatcagatatccgttttaagattttttttaaaaatgttgacacaaaaaaaaagttttggattaagtgccggatgaaaattgaaatcataaaaaaattcatatttttttggtagcaattttgtgtgtttgattgcatttgttgaagattcagtcgatgcatgcatgtgttgttgaattcgaagttaagattacgtaactatggaattagttatagtttgtgtatgcttttgagcttgatatcgaaattttggtaggtggagccgtgaagaacattttccattttgtcccaaagaaattctgatgattttgtggtgttaagtctgtcgatgagcgactgattttctgaacaaacctaatttgtctctggtgccgaaagtttgggtaggaatataaacttttttcctaatttttacccaaaaatttaagaaccacacaaacctgttagtctaccttcttaggaattcacgaacgtcgctactttacgtaaagggaaatagaaggaataaatcgtagatggggtcattatatagaatggtaatttgcactagggttggggctggtgttttagttggcttcttgccccttcaaggtcctgaattggtgaatttacgttccatcacaaaaatattattttttgacttcctagttcctacgtgccggcctcgttttactgatcaataacttggcctataatatcaaaaagtggtagtggcatttttatttatttaagataatagacatttagattatatagttgcaataatatagagtttttagttaagatataggttttatacatgttgtcttaaatagttaaattaaaagattattttgtaatcttgtcaagatagtgagatttttttggatatttactcaaaatctgccgaaattagaaaatctatatctagagggattatatagtccaacaagaaagctatatgtatatctcatatacaaaaactttgctaaccctatcatatacgaaactaaaacttacaggaaaatataaaatatatatagggaggttgacaaaagataatatatatataggaaatgtatggtggatataaaaccgatattttctattcttctatatatactggccattcccttagttgaaatcacataaagcatcagaagaagaaaaagaaaactacaaaatcaatcaaagagaagtaagagaaatg

SEQ ID NO: 451 - DNA, 2879 bp, Unknown
  misc_feature (1)..( 2879): cDNA_ID_3038771_gDNA_ID_1591076_Annot_ID_150482 3000 nt of promoter + ATG
  misc_feature (2)..(3): n is a, c, g, or t
  misc_feature (2524)..(2524): n is a, c, g, or t
anntcgagcggcaagttggtgatcgaagtttcctactttggatggcatattcattctgagacacatgatctttgtgatgagacaagttgtcctgtggccattggagatttcttggtagcgcactcgcaagttcttcccggatatacccctcctgtaagttttttctacgtatctatgcgggttttgttgattaatacgaagcattttggatataatgacatgatgatgcattatgctcatttgaagttgatgtaattctattgcagtcataacaaattgcctagtgtaatcgaatctgtttagttggataactgaaatagactgagaagtggtttaacttggtttcgatagcatattatgagttccatgtggaagtattatgtctattaagcggctaaagtgaagaagtttaaccttcttgttgtcaagatttgctggttatggtttctatagttatatgtttgtcataccaaactttcgttttgtgtttctgcatctaaggaaggaccagtctaatccttttctttctcatagggttcatactcactaaaaatgaagatgcttgatggacgcaagaaggagttaacttgcatcaagttctcatttgatattggatttggatcctccgtggccgacatgtagagctgatttgctcgacgggatacaccatcttgttctataccatggaaccactctcatttattttgtataaaatacactctcctgctatacataattgttgatcaaaaaccctttgaaaattctcattctggaccattcatgaatccccccatttatagaaaaaacaaagtaatgaattattgattaggttttatagagctgtggttagttctagttgcaaccttaaagctgagcctactttaaccaatagtacatcattacatccacgttcatggaattataaagacgtgacatacatcatcattcaaccaaacgtaaaccattaatgacttatcagaaaagatgaattttttcatagcttcaatataccaacatgttaaaagggacattcctccccttttgctatgtatttggacaaagttgggctaaagttgggtaaattcaatgttttttgttaccctaatttagcttatcggttatcttctttagtactacaatgacccgtcaaaggagaaacttttgaaaagctaacccacaaagtagcttttttgttcagttgagtactcatttcgtttttctcttatccagtctcatgtttgtcaatcttgattaggtttttgcctctcctctttcacaacttcttatcaaaggttgaaggttgaagcaatgatggatatgaaggagagaatggtgaagaaacttaagcttattacatctcttgggaacttgaagcaggcgatagctctccacaaaagcaatcttgatcacacaatctttcatcaaatagatgagaaagagtgtcttacgccaacgacaattgaggtttctgaggataaacgacttcaacagaatcttgatgagcttttgtgggcttttgaagagaaatgtgtagctggtgggcaagattctgttgtcttcttcacaacaagtctacgaggagtgagaaagactttcgaagattgcagaagagtgagattcttgctagagaatcataaggcatcattccgagaaagagatgtttcaatggattgtgagtacaaagaagagatgtggagattgcttggggagcaagttacacctcctaggctcttcataaagtgtaagtacattggtggagcagacgaggtggtgtctcttaacgaaaacgagaagctcaagaagcttctagaagtgttttcatcagctaagtcgcggcagtgtgagatgtgcgagaacgaaagatttttgatatgttcgaaatgcaatgggaggtcgagagttgttgcagagcacgaaacctggaagagatgcatagagtgtaatgagaatggtcttgtgaaatgtgctctttgtacttaatccaagattccaagtgcttaataacaatttatttatatgactataactaattgttttatatgaaacaaaatgctatgaatatacaaggaaaattttcgaaaacaatactcaaggagttgagtgagttttccaaaatgttaaaccaaaatcaaccaaagtgaagaaaaaaataatgttctattgactcttctaaaatccttctactacggaacacgtatggcgacattcgcacgtgcgatacccgtaggtaaagacacgtgtcattccttcaatgggcaggaccgtactttcacttgcgtacttttccttcttcttccgacaacaaacccagaaacagtctttctctcttccgactccgtttactagatcagccttctcgcaccgaaatctcaaggttcgtgttcctcttttctgtctttttggattgaaagatttttctcatgtttatatataaatcttcaatccaaatcaacaaaagcatgttccatccgatgaacttatttggggactttcctctgtctaatccacactttataaaaatcgnacctttgtattgtgttcatagaacccaaacgctgattagagtaaatttgttgttctggcaaaaaacccaattagctctgaatgcgtctacacatttcttgaatcggtcattctattgctgctacacactcaaaatcgatatttcaatgtctttgtgaattggaaaacatattgaaaatctttgctgctttatcagtttttcattcgattcatcgctgagcacattcacaacaaaaacagatcactgattattagaattgtattgattctgagtgtctctccaagctaatggatctatatgatgttgtgtctaatgtgtaatgtgaatatgtttccagtgatttcagaccacaatg

SEQ ID NO: 452 - DNA, 3 bp, Unknown
  misc_feature (1)..( 3): cDNA_ID_3062300_gDNA_ID_1591080_Annot_ID_150487 3000 nt of promoter + ATG
gca

SEQ ID NO: 453 - DNA, 1770 bp, Unknown
  misc_feature (1)..( 1770): cDNA_ID_1693072_gDNA_ID_1591090_Annot_ID_150501 3000 nt of promoter + ATG
gaaatatttaacttggatttggttttaccacatactgtatgtaactttcctgtcacaggtcattattattaaacgtattttagaatttaatgcaaagaatgtgacatgttacacgacaatatataataagtgtgttttttgattaaagattattagtctttttcacgaggatataataagaggagagattccaaatgtcaagtgctattttcaaattgttaaacagagattgaagatctttagcataaaatgttaactatgacttgtctattcacaaccaaagtcttacctcaatgtataaaccgacgtctttccaacataacacatttgtattctcatatatttaaataaaagtgaagcttttctttgatctagatcgtggttattttaaaaatataataaaatcaaataactatggttacttaccaaagtaaagtggggttattttttgctgtggtgatgttttatgctttgtataagacacttttgcatctctagtttatttctaagcattttggagtaaagagagaacaaaaaacaaagtataaaaatatccaacaagatgcttttgggggaaacactgcattgtggtctgtggggacaaatttgctggcacaaaaattctgcagaagaaaatgaaaataatttgatatcactataggatggtccaaaaaagtactaacaagtttaaatatttaatttgattcacagcatcctttttagcaccgtaaatttgagtcttatgtagtactgattattaatacaaaactaacaagattatatatcgataaatatgaagcatcctattcctatggttgattatatgaatcttttatgtcacacaccctattacgacaggttttaatgatacccacatcacacgtgtataagttaaatgcaatgataacatcctttactctgaatacagatacatttgtggctaaaaaattgtaaatgcaaatctttggactttggttcagaaatgaaaacaaatgtattttttattcgaaactgtgtcttaaaaagaatccaaagtggaaatgtccaacctggaaattcagacgtaaagcgaacccaaaagaaaagaaaaaatgaaaaatggtaaaaccgtaattaagtgtaaagtcaagggtagttccatatttctcccttgttggtcgagcgagaccagaaaattcgcagagagagagagagagagatagatctgagagtagtggtggtggcattaataatggcgtaagtggaagaaaggaacctagccgttagatcttctcaatcgctacaaacattcattgttcaccgatcgattctctctctttcttcttccccattgctccttccttcgtacccctctctctgtcttttgaggtttccgggtcgggttggtgagaaaactccagcggcttaacggatcttccactggtagttttctgttcctcacaaggaaatcgaaaatttgataaagcgaaagtgaaaaaggcgtgtgttttctttgtaaaggctccaacttttttgatgaacagcttgtgcttgttgtgaaggttgttactttttgtgtattggaatttgggttttttctttatgttctgaggaggagaaaggaggaagctttcttgaattggattcaaatttgagctcatatggtgagtttctagggttttgtttgtgattcctggaagaatctgattccttttctattagggttggagagaagtaaagcagaaaagcttttttgttttggagcttagtgagtgttgtggataaacaatg

SEQ ID NO: 454 - DNA, 677 bp, Unknown
  misc_feature (1)..( 677): cDNA_ID_1693098_gDNA_ID_1591092_Annot_ID_150508 3000 nt of promoter + ATG
gatttgaacatttgatagattttaacaaatgttatttgggagaccccaattggagtttttttttcttttcaaatttgatttcaattctgtagcaacatggaaattaattagtatgaaatcttcgatggttgaaaaaaatactaatttgtaaattatatggaaaagaatccaaaaaaatatgatttgacccatacgtcggtgtttgttgagtaaaaatcttcttttttttccgtgtttaaggtaacaaaacgcgtcgtcacagatttggaccgtattaaaaacaattgacaaccgtgtatcctcccttaatttatcaataatgcaacattttgatatattcgtctacttcatcaataagaaaagtgtaacacgggaaataattaaatagtctaaattctcttctgttttttttggtttgttcttagaggaaatctttatcttggaatctttaatctatctagaattaaaagtttatgctcgtaggattgtctacttttaaaagtcaacatattcgatacagatattttgtatatttatataaagtcgaagaccctgaaacttatcttcacggcataataagaccaagaagaaaaagaaaacattaatttcaaccaaagcaaaacagagagaaaaaaatagagagagtgaatcaatttcggtggagaaagagaagaatg

SEQ ID NO: 455 - DNA, 947 bp, Unknown
  misc_feature (1)..( 947): cDNA_ID_3055919_gDNA_ID_1591099_Annot_ID_150517 3000 nt of promoter + ATG
gctgcacttggtgattcagtacgctgcagtataattcatatccttctttttttgcttttcctttatagtgaaatcttttatacttggatacaggggcctggaattttcgaacctgtgcatggatctgcacctaaacactacgggaaggttgcctctggatcttgatatgcatgatactgtatgtgaaaccactcgtttaatatcggttgcagtataattatgtcgacattgcgaattgcaggacacagtgaatcccattgcagctgttctatcagctgcaatgcttttgagatacggattgaaagaagaaaatgcagcaaagagaatagaagaagcagtatcggatgtcttggaccgaggattcagaactcgtgacattcacactcctggaactgtaagtctcctcttctcttggcaaaaactgcatgttgtttctagttatatggaaaaatcgaatttaattttacatgaatgatgagcagtttggtttttggacagacgttggtaggttgcaagagaatgggtgaggagatattgagatcccttgatgctaaagtctctgcttcgactggaaacttggtttagctgcaaaaactataaacaaaaatatgcagagagtgacattgagaaattcaatgtttgtttctatccgataaattgataagttatatatacatatattcctaagatcgccgcacttgaactactacgatgasccctccttcttctgtgaggtgctgctaataaatggatatatatgttgtatgcggtaacgtaaggtgtccatttacaaaattaaaaactttggggtcaattctgaaaataaaacaatgtgaaaaaagsacccataaatgcaaagaagtaaagtctgattgtactagtagtatccatttgacttgcggtttcaaaatccgaaaaagaccaatcaatcctttctccctgaaatg

SEQ ID NO: 456 - DNA, 3000 bp, Unknown
  misc_feature (1)..( 3000): cDNA_ID_1008780_gDNA_ID_1591112_Annot_ID_150538 3000 nt of promoter + ATG
  misc_feature (782)..(783): n is a, c, g, or t
  misc_feature (811)..(811): n is a, c, g, or t
  misc_feature (892)..(892): n is a, c, g, or t
aagaagtattaacatacccattgtcaatttgacgtcttggtgctgttgaggcagtcaagaaataacgcccgtctggagaccattcacttgtcacagaccactcggctttattacttcctagctgcttcttatttacaacatcccagaaggcctgaaatataaccatttagaaagaatcgtttagaatgtcaattgctgacttattgtcacccgagaactgaaaaatatgaacaacacaagggatcgttatttaccatatcaccaggcaagttaccgaatccagccacacataaaactgtggaacatcgattgaaagttacaaaaacaggtatgtacagaaatcctctgtttaagaagaaacaaaaacgagaggacaacagaaaacagggatgaagaaaagcatcatacctctcccttttgggttccatcgaagagtgttataaggaccttcgccaagttccatcaatggtttacaattcttgtcaaagattgtcacacaagcaggcataactgaagtcggagttgagggaaagcaatgccagaaggagtatatagatccaaatcgaaataacatcttaacaagaacacaatgatattaacatgtcaatgaaaaaacattattcctaaatgaactcgtagagataagtcgttatagctgatggaaaaaggatacagccatatacaacagcaaactctgaacccgaaaaggaccactgaacatcatgaactggtccttctttacctgttaaagcaccaaagagtcagtacaaccaacaatcacnncagcagatacataaagcttaggacttangtaatggaacaaggccctcatgtgtgccgtctattgtaaggtagtgtagcttcgtttccccatagtaactttggttggtcntgtcaacatctgattgtacaaccactaggagtccagtggaaccatggttccaactaaactgcacagaggaacatcggaaaaagctacgtcgagcacttggctggctctgcaattcttccccacatccaaaaatctggacactgcctggactcccctatatatgaatgaattaacatgttagagttgcttgtctatagaggaaacatttatacacatgatgttctgcaacttcaggaatgaaaatagactactttgtgagagagaagactgcaacagatttaacatatagaagaaaagatgtctttttttgctattcaaaagtataatgcgatagcccaagcagtgaaaagtacctttgattctggaacaaacacagcaacatgggaagctggcgttttagaaagctcaaatgcagcaatcccaggaactctgatccgggatgttattcctttcgagaaatctttcgggtcaaagaattggacctcatttgtagctaaccggcacgcagaagattcatcaggacagaagcgaattgatggcctatagagcaaccacagaaacactcgttattataaaagcagcataataagcacaaggactatctataattgatgcatcatatatgatgccaataaagcactgagacctgcttaccatgaggctttagtaatggatttttggtaatgactgtgtgctagatcccctgtctcagtattccaaatggagacattcttctcttggggagtagtgggtttttgaaaagtctgaagataagtcccacatggagatagctcagcagctgtaacatttgctatagtgaatgaccgcacttctgtcaagctggtggcatcatagatactaataactccatcagatttcatcgccattaacttcgatccatcaacactgaacttcgtgttagagcatgaaacctcgttcaagcttgagagtgggctggccattagtaaatggaggaccattccacacagtgaagccttcagcttctctaactacacagaaaagcgactttagataagagagagacatttaaacataactcgaagaatgaaattgagtttcagagatatgtacctaaaatctccaacgacggtgaagaactcattgcttacttgatacacctaatatataatgcaatgatgaaaattaaaatcccagaattgatacactggttacaaattgaagtcaacataaaagctctcaaatttgtactgaacgtataaaaccctcatcatcaattacacagtgatcgcggtagaggaaacgataatcaccaaattactttactggattgaagtaaagtaaacaacttttatatcacaatttctcaaaggtgaaatgcaagaacaggaaaatctgaaactggagaagaagaagaagaaagcacctaaatgaagcacgcaataacggagacgatccggtaatcgacggcgagagaagtcggtcgctgtagtggccggcttaagctctgaaccgtataaagagataccctaacttaaatttcatcagccttttgaatactctaggtaaaccagaaggttactgtatatttataaccaaagagaaaaaaaatcagctttttttataagctagaggtttttagttctctgtgtggagtacggctgcattgtttctaccaggtgaatctcttgctaattcgattcaaattaggtttttttccttagagaatcatatctgtttataaagagtcggctttgagttgtggtacgatttcgtatttggtctctttactagatagttcaccaactgctcgacgtaatttctcaatgaatccctactctctttttcataatctccggcgaaactacctgtagattgttttagatattcatatataggttattgagctttattctgtctgttatatactgtcactttctcaaaattcaaaattttggatatcagaagtcccaattctgttcaatgttttcctattgtaaagaaattgactttttacttcaacaatccaaatttcttcaccatttgtctgatatttgtatatatgtttacttattggatgatttcatcagtaatttgtgggatttccaagctccagtttttcgaatatg

SEQ ID NO: 457 - DNA, 2146 bp, Unknown
  misc_feature (1)..( 2146): cDNA_ID_1693205_gDNA_ID_1591117_Annot_ID_150547 3000 nt of promoter + ATG
attttccactcaaaatgtcaagcttgatcctgtgaagattgtagtcttgcagagaagtaaatactaaatagacaatgttctaattgttcagtttcttatgtcaaacagaagaatgtttcaatagaagggaagtttacattttgttatagtgtgatgtctaccaaaactagttacaggacaatccaatggaagctttagatgatcttccttatacttaacagacacaagacaaagaccatgaggcgacgcaggcaaactagtatactttgcaagcaccctcctgtctttggtttcgagaatcattgggacaatgtctgaatccagtgcttcttttccaatctgaatcagcaaagctacctgcatatgtaaagaactttagactaaaaaaacattatatcgccatgtcaagcatgtaaaagagagtgtagaactaaccatgtttctgacttgtctgtacaaaaagccagaaccttcaacttcaagctgtagaagagatccctaaacaccaaaacaccaacaaggtcaaagtctgatccttaccctaacttctccagaactaagatctttcttctttaccatttgaatgacatcgaagcgagatatagttttcaaaggatcaggtactccatcttcccgagtagcgttagcaaatgcagagaaatcatgctttccaacaaaaagatttgcagcttcccgcattttagaagcattcagtttataagcacagtggtaagcccaatgacgctggaacgggtccatgaaagtgtcgttgtatatctggtagcgataaaccttgctagaggcagaaaaccgagcatgaaactcaggaaccgctgcactcagctctctgacacggatatctttaggaagaagaccgttcaaagcagcgtgaaagctatccaaactagtatagtttgaaaggagtgacaaaatgagctacctgaagaataacggatgatttagtttgtgttgagaagttgagaaagagagagttgtgactttagtcaaacctgaccccaagcgtgaactcctgcatcggtcctgccagctccaataagctgaagctcttttctaccgagctctgtaatctgaattaaggctttttctaacattgattggatagttggtggtgactcctgatactgccaacctgagaaaccaaatgcgcggatataaggaaacaagattttgatagatgcatcaaaaacttaagaacacaagttttgtgagaagacgaacctgcaaaacgggtgccatcgtaggctatcacaaggcgccatttataagcaccagaatcactaacctttaccgaactgttcaagttggtcatctgcaaaaataaaacaaaagttcagattacatcaccaacaaaactttcttggcatttccaaggaagtagagaagaagaaattgcttttgtggcgcttacggagatattctgaggagacgaaagatacccattagtaaagagtgaaggaggaagtgctggtgtaacgcaactcatcctcttcttcttcttcttcttcttcttctttgtttgctgccctgtctctctgtgtaatctcaagattctgattagggaaagactttaaaacggtgcgtatacggttagttagggagcggtaaattggtcagaccggaccattggttattagattgatttggtttaatgctactctaattcttaggttctttctaaacgcatcgttttgatatcacccttttctctctgaggccgtacgtggaagtttcaaactctcaccatctcctctctctctctcggtctgcagaagaaaaaaagctcggcaattttatatttttccatcgaagagattcccaattcttgagctttctcaatcaggctggcgtaataaacggtactccaatgtcttctttctgaccctagatttaacctggttcagttcgatagtagggtttgtttcccccttccgatcctcatttttgatgtcagaattgtgatctagtattcaatttcagattcttttttggaaattagggttcataacttaatagaagtttttaaatttcgtacagtggccatggcgttggctgattttgataaaattgtgtacattgaggtgtgatatagagcctgatttggttttataggtattgtttggtcatg

SEQ ID NO: 458 - DNA, 969 bp, Unknown
  misc_feature (1)..( 969): cDNA_ID_2182487_gDNA_ID_1591154_Annot_ID_150595 3000 nt of promoter + ATG
aaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatgaattttttactttgtcgtctcccgttactagttttcgtacccgtttcaatgctacttagtcaggtagttctagtagcaatatatgtattattgttccaattaataaattcaactcgcttaaaaactaaaactcaactaaacatttttctataatacttttgtctaatcctagcaatacacactccatttactaatatatacattacctataaactgtgttgtatactaataccccatattcaccagaagacttatagagcatttcagtttggttccgtgtataccacatcatcagccgaatcaacaagtgtaaaaatccacgtgtgcatcagactgccacgtaatcaatcgtaaatagttgatttcaatagggatagtttcgtattttaattctttttaaggggcaaaaaaaacatttttccgtccattgaggaagcaaaggttttcgatattaataaaatccgagagagagagagaggaagaaggagagaatctgaagaagctgaaccagacgaaccataaaccgaggcgagagaggagagagcgagggaggtgatctcttaccacctcttcgtctccggcggcgagaaattcagtttcaatcggagaagagaggaaaaacaaagcgatacgcgagagaaaaagttgtgcaacgatg

SEQ ID NO: 459 - DNA, 41 bp, Unknown
  misc_feature (1)..( 41): cDNA_ID_3594363_gDNA_ID_1591156_Annot_ID_150599 3000 nt of promoter + ATG
  misc_feature (5)..(5): n is a, c, g, or t
  misc_feature (15)..(15): n is a, c, g, or t
  misc_feature (23)..(23): n is a, c, g, or t
taatngctagggatngttttatnactccaaaaggcaaaatg

SEQ ID NO: 460 - DNA, 969 bp, Unknown
  misc_feature (1)..( 969): cDNA_ID_3435522_gDNA_ID_1591159_Annot_ID_150603 3000 nt of promoter + ATG
gtttttgattgatgggttttcttgatttagcaatttttaagatttacttgaaagattccgtaattttgttctgattcggattctttgatctgtgctcactagctctaccaaagcagcttcctttctgaatccctagtgttcaattatgtgaacagattgtttactttagcttctcttccttttcattctagttttgcagagattttaggaggaacatgattgtttgaattgggagagacattggttcttgtaaaatgcgggtgcttggtttgagctcaagcttatgctctggtgaggataaggaagaagaagagattaatggagaaggctctctcacgcctgtttatctcaacgtctatgatctaactcctgtcaacaattatctctattggttcggccttggcatatttcactctggcattgagggtaattgtggcttcttctctattacttactagacctaaccaaacttttccctgccatgttcattattagtctatctatcctgccgattcatatctgccgagtctagccttgaataggaacaatgatacttctcaattgtagttgtgacttattgattaggtgacaaaaatgcttggttctttagacaatggtgtttattatattaggtatggaatacagaattacaaggaaaaagtggaacttgaggaatctagaatggaatgccttttcaaatcctgccttattgtcctaaaccattctcttgcaataattacaacttgcctgatgagtttataaatatatttctgctgaagctgttattgttgctaaatgtttatctaatgtggaattgttttcactttgctatgtctactactagctcatggtttcgagtatggatatggagctcatgagtattcgagcagtggggtatttgaggttgaacctaggagctgtccaggtttcatctttaggcgctcagttttgttgggaaccaccagcatg

SEQ ID NO: 461 - DNA, 3 bp, Unknown
  misc_feature (1)..( 3): cDNA_ID_3012422_gDNA_ID_1591193_Annot_ID_150647 3000 nt of promoter + ATG
aaa

SEQ ID NO: 462 - DNA, 445 bp, Unknown
  misc_feature (1)..( 445): cDNA_ID_1693477_gDNA_ID_1591208_Annot_ID_150667 3000 nt of promoter + ATG
acctcaaaaaaaaaaatctagatatttccaattagatgcgattgcgacatacatttgtgagacctgagagcatgaaacacaacaacatcatcaaaatgactaataattaatcagaaaattaggaagatttgattattatttatttttaaaggaggggagcccacaatatgattgtgaggaccaataagaagccataacctaaataagaattcactgaagagacaattaagacacataccaaatcggaaactgctcctttttgggtcgtccatttacttcacttccaagccctcccattccaaagctactctctctctttcctctcatctttgcttcttcgtcttccatctctctatgccttttagattctctaaacccatatcttcacttcttctcctaaaccacaggaattctctctctttcacatcatcatcatcatcatatg

SEQ ID NO: 463 - DNA, 810 bp, Unknown
  misc_feature (1)..( 810): cDNA_ID_1709992_gDNA_ID_1591235_Annot_ID_150700 3000 nt of promoter + ATG
ctkgtggctcctaatctctagagactcgtagcgacttggcagattccaattggctccttggatctccaccgttggccaaatcagcttgaccgacttgatgtggaaggaaacaaagttaggacatgccatatctattatctccaacatatcaccaaaaaagacacctagcatcattcgaagataacaaatggttaagagtcataatctttttaacaatgctaaacagtgatcatttaatttttataattgaaatcatgagacgatgagagaaacctgaacagttagaacatggcaaaagttaagaatcaagataaacattaggctaatggtcaagccaaagagctactaaagtttccagctttaccaaaatagtagtagatgatacaaaaatagttagaagttgcacgtttcagaacctaggtaacatgtggatgggtcctatagaagattacataggaagaggtgtttacacttattgaggaagaaagagagaaaaagtagtaactattggtgccattgcaaagatataagaagacaattagtttttttctttctttcacatttcgtgctggttgatgattccaaagctgtaagcatctctgcactggaccccttctcaaaaactcagccagccacaagatgatcactcaacatcaaacccacaaacttctcgccacgtgtccagccctcagaattctatccttcctttccatttccattcaacaactaatatagccttcttagtcccctgctgcctttacatacgatctcactcaccatcaaacaactacaacatctgcggttagtatg

SEQ ID NO: 464 - DNA, 692 bp, Unknown
  misc_feature (1)..( 692): cDNA_ID_1693546_gDNA_ID_1591237_Annot_ID_150704 3000 nt of promoter + ATG
acgtctctcacttctcagattaatcaacaactatctattgatatatcatgcagaattttaagaaaatataagaaacatcgttaactctgttaaaatacaactacatattaacttattaagatgagtccaacttattaagctgaactaaatgttggcattttagagaaattcaaaatttgtatctataaaaagttggttatttttgaagaattttgaaagagttgaaaacttataattatgcattagttcttcatttccataaaaatgttagataggaaaaagttgttaccaactttgtagatacggtaaaatcatagccgttcattggtagacggatcaaaagtaaccacgtcagctatccacgacaaaaactttttctctctttgccgcttcatgaacttatggcggataacaaaaagcgcaacagaaaattcgaatttttcaatatttcgaaaaagaaatttaaaataactcgcgcattaaagtaaaatagatctgaaccatccattcaccaaaacccttcatcgaacagcactcatatctccacgtcascatccgcgtttcagtatcttaactaatcagatctcttcctattctcttatataaacaaacacacaattctcgaagataacagtatcaaatcaaaaccatcacagcaaaaataactcactccctagaaaagtttgaaaatg

SEQ ID NO: 465 - DNA, 22 bp, Unknown
  misc_feature (1)..( 22): cDNA_ID_3056128_gDNA_ID_1591256_Annot_ID_150728 3000 nt of promoter + ATG
agccaagttgttttcaagaatg

SEQ ID NO: 466 - DNA, 2149 bp, Unknown
  misc_feature (1)..( 2149): cDNA_ID_1693605_gDNA_ID_1591257_Annot_ID_150730 3000 nt of promoter + ATG
gacgaattctattgagtggacacctcactcgtggtgccttgcagctcaagtaatcaacattggagccgaagtkgartgagttttggakcggacacccgtcgccacgccatcacccgagacacctatcgcctgtgggcgaggcacctgtccgaacatgtggcagcgggcggtgcagtcttgccgaccttggacggactataaataaagctctctccgcccaatttcatttttcaaaggcaagagagagactacaaggctgtccgactgataactcgtccgtaaccgagaaaaacttgcccaaattcagtaaatcttgcccgtggtcgaagaaactttgtccgttactagagaatctttgcctgtggtcgagagaacttgacggtgagtaaggtatcgtcgaccgtgattgaggagtttcgcccgagacccaaaaaactttccggactaccgaatccgtgagttgtggtcgaattgtgtgtttgtttacatgctttctagagctagtctttagatcatatgcatgcttactcacttagacttaactaatcggaagtcggcttaagttaaaaattgaatcttaaaatgacatgggcgtatgaggaacttgatatcactaaggaatggaatggactagtatttgactaggctaaggtgaatatggacttaactaattttacttgatgaattaagatatgattcgagggcttacttgccttgttagattgttatacttatatgagatatgctatgaggttgtgaataagtccttgatatattatgtataactataaatacgtgaattagttcttgatagtattataattgtttggggtgtggtaaaatacttatatagtactacatgaggttattgtgtctaagtggtattctaggtttacccgataccatcatgcttagaataagctactgccttcctttttgtgttatgattgtgtaagtaagtcttgatcctgagtggtcacttacatgatggcacaagactcggagcgtctgccgggtaatgcatgacgatgcattaaagtgatgttccgattataagcctttgtggctatagctcgggtgttcacagttatgtacgtatttgtggtgtgggtgtgcacgtacgtgtgtgtggtagcatacatgtggagaacatgtatacatgtatgcgggagtttgtgctgatgttgtggtgcacctctttggtaaggttggcagtatgctgggcccaaggttcattcatgtgtctaatttggctccatattctagtattattataagtatatgataatatgtttattacgtgctttgtgatctctgatggttaagtttacttattgagttgattaaaccctagagatttatttgtgcatagacccagctcagtgggtaatgttagactcatgattctacttgtcttacaggaayccatagtggaatgaccatagcggatgacgaacactacgaaatgccggaaataagatgttttgcgttgcttctgcaaaattacttgttattatgtaaattttaacaaggagatataaagatatatttttgggtaactctttgcaaagtacaagctatatactatgtataaagtgtttttgtaaaagcagccgagtgtttaatgatataagacctagtctgagtcgctcaacactagaatatcatgatggttggcaagcctaactggtgttcctagtgggaagagggtcgattataatttggttaagaaatcggattcatttggaacctttactaagttatggtcgatcatcttcactgtagcgtaactgggtcacccgtggcttgtccgaccatagggcgattcgtgggcgttacaagcatcatctaaagagacaggttgcctaaaggtgagttcctcgcggaacctcgaggagaaccacaggccgtcacgaagggcggctatggctacctccttgtttaagtttgcaatctttgatttaattgctttgaattttttgacgtaagattgcaaggattcgttctgaagttaagtcagaccccagaggtcggcttcagatgtcctatttacgatgagtaccgagtattgttttaaaaaggcgacagcgagctggtcgaaggtatcgatagagttcccttcaaaactagcaatatattcaggggcatg

SEQ ID NO: 467 - DNA, 2741 bp, Unknown
  misc_feature (1)..( 2741): cDNA_ID_3056141_gDNA_ID_1591259_Annot_ID_150737 3000 nt of promoter + ATG
aaaaaagtttggcgaaaaaaggtgataggtatcaataactagttgagatgggatagagataaattttaaaaaatggaccgacctattacaaacaatttaataaaagtaacacaagagtacagagactaaaacagtagctatggttttcttttggcgtctctgtaataaattggtttctggggatcttcgtcctatctcccatgccattcactatcaatacatttattgatgccttcattatcatctttcttttgtttttttgccgattcactttattttttttaactcgtaccatattctatagcattgatcctcttgtagtcgtaggtcgacttttgtttttatttgatagtaacacttatgtccttggtgatatgtatttttcagaaatgctttttcgatttatttaaatgtgtacccttttgtcgaccaaaaaaacaaatgtgtaccctatctttagtgtttactttgtagtttgtacaaaaatacgtttttctgttcgagcaagtttacttttgacaaagaaatgttattattataataataataatatattgaaatatcaaaattttgtgtgtaaatttattaaattatttgaaaatttcaaaaattttcaaaacaatacgagtatctttgcttaaatatatctaaaaatacacaaaataactaaaatatccaaaaaaatcctaatattttctatatataagtataaatataactaatatatacttatatttgagatatgttcgaattttttgggttttaaagtttagaaccgttcgggtattttaaaagtttgggttcgagtttggatcggatttttcggatcgggtttttcggatcgggttcgggtattatgcactggcctagataaaagaaagaaaccattcatcacctataacatttttactgcatccaccgttattatcagtatacgaacattacctcagtttcagcattatagcttagcaataaatagctgaagaaatgtagttggtattattgttatagcttagctagtggtggcaacatgtttattttctattcaccaggtgatgatggcttatcggatcaagtcttgattcgaacattaaatgatttacatggatcgatatataaacaagttaaaattggctcacatccatagatcgatcccataatctatgcgtttatacattcactgcactgtattaatttaacccaatcatatttgctcatctactacattaaattctgtcaaagtttcaatagtgtgttacacaataacggtcaaacaacaaatgattctccaataacaactatttagacagtcaaaaattttagcgtgagactagacggatcgatagggcataatagcatatatgtatagcccatagattaataaatagacattactacaaaaaatttggtgctaaacaagttttttcttaatggacccttttattagattaccttaaataaaccgatgttaaaaatcttgttttacaaaagtaataaaatgcggttggatatcaacatttcgtgctaaataatccgmttttaacattttaacttcaaaaaattaaaaataaataaaaaaatcaaacacatccttatcttcatgaatcgcctctaaatacgtagcaaagattggtcactttgttgaaaaagacaccacttttatcaagtctgaggagtctgtaaaagaacgttatttcttgtttgtcttcatacatcttattgttcatacgagtgaacgaatgcttccacttatgtaaatagacatgtgagacttcttcgtaggttggcatcacctatagttggatattttcttgttggtaagtttttagatagccaaaatactattaaacattcataagcaagtgaaaatatttatttgaacgatttaactaaaatgttgttatgtatttatacaaacatatatatttttttatacatatacatgttgttattttactaaataacgtttttgtccaaagttttttttactgaataacgtgtaatcaaataaaataataaaagaacaagggatctcttcttaataaaatattttgatttcatataaaagtaggtgatatctataaaataaatttacaaaatgttttagtttgtgaatgaacttcagagtaaaattgtaaagttaaaagttaattttacaaatttaaataattagtttagttatttagcagatacatatagtcagtctgctatcatagcatttaggttgaagcctttaagtttatcttgttcaattttttatataatatatatatttttttaatctaggtggtaaacaagctttatcacttaaaaggttaaaatgagtgggacaataatagatgtagctcataagttctatgttgaaaaagattaataccaaaaatcaatcatttacttataatcaaccatggagtagaaaagcaattacacaaatagagtaacttctaaaatatttacagctttttaggtagtgcaattactattagtactatttcttaattctctcaataaaataaaataataaaaaatcatatagataatcccaatatccccaatcttccactataattgaacaaaaaagactcctttttaaattcaacctctcccaccttctctctgcaactctctcattttcttaaaatctctttctcacagaaccaaaaaccaaaatctcagtctctaacaaacaacaacaacacacgagtcacgaggttgaagaagaagaagaagaagcaaatatg

SEQ ID NO: 468 - DNA, 1256 bp, Unknown
  misc_feature (1)..( 1256): cDNA_ID_1379239_gDNA_ID_1591265_Annot_ID_150751 3000 nt of promoter + ATG
aataaaaagagatgttgacaaaacgataaacaatccgacatcaactgcgattaatttggccttatgatgaatagatattactttttagatatcgaaagtgtatgttactttgtttgttagccaagtgcttatctttcttcttattttgaaactaagcataatcttacgagtaaaaaccaaaatctggctaaagacctataacaacacttacttactagccgttacatatgtttcactcaaagcataaatttttataataacaatttgtttttattctcgtatcaataatttttttaaaaaaaaaggggaacagcttggcgaattattccatttttttaatttaaaagtaaagaactgaaaaagggagaatctcaacatcatcacatcacatggcctctttcttactattatgtaactcaattattccctctgcaatgtttttctggtccctaactataaacatcttttgtgatgtttggtactaaatgatattttatttatttacaaatagataatgattctagtagtagtaccatactagaatttagagaaatatatgtggagactggagagagaaatacaatttagttatgcataattatgtagaaaggttttgaaagtagctagtaaggtgaagttttattgtcaaaatattagtatgagttttggaacaaaaactagttcatctcttgtgtaattaaagcgtgttatagtaatagtaggctagcaaaagaaaagagatgcacatatggacacggattcgtacaaaggttagaagaaacacatgttaaggtttgaaagaagaaaatccacccctgtttaatgctcctatacacgaaagagctctcaacgcgtaatatctgtcaaattttaattcagaggacgtgttaaattagccataactttagtttaaagctaaatttgataataattacaataaattccaattccatttgttgagggaatagaaagaaatcaaacgaaccaactaggaacggtcatttagccagaaaatgacacatgtcagttaactcctttgaacaattgacagaaaagttctagagtggattaccggctatacccggtaaacagtcaattactataaaaacgcgttatagccatatttatgatccaaaggggtttttggttgtccgtgtcgttcgtcgtctctctcgccggacttgttcattcagatttcgtctctctctctctctcgcactcttctttaattttgtcctccgtaaaatcttgagatg

SEQ ID NO: 469 - DNA, 446 bp, Unknown
  misc_feature (1)..( 446): cDNA_ID_3056202_gDNA_ID_1591291_Annot_ID_150790 3000 nt of promoter + ATG
agagattttatatattttttaaataatatcctttttataacattttattttataaacacttaaaatgcctaaaaccaattaaacattttaagcattagacaataatgatcaacacatacttagtgactatcgttttcttgaaaattgcttcatgtacattgagtggaattattatagttgattagtcttcattcttgacttttcacccttcaaaacaaaagtttttttctcactatgagtcatttgataattaattgaagaaaaagaaagaatcaataatgcatgttgacagaaagacatattaaataaataaataaataaactaatgattcttcttaaaagtccaaagtaagaaacagtcaacaaacgttggctatacaacaagaaataaatacatcacatttttcagacaaaactccaatttcacagtgaactcaaaaacaatg

SEQ ID NO: 470 - DNA, 1110 bp, Unknown
  misc_feature (1)..( 1110): cDNA_ID_1012213_gDNA_ID_1591294_Annot_ID_150794 3000 nt of promoter + ATG
tgaaaggaacgttcccgacgtatcttggtcgtccttggaaggaatattcacggacggtgataatgcaatcggatatatccgacgtgatccgacccgaaggatggcatgagtggagcgggagttttgcgttggacactctaacttatagagagtatttgaatagaggaggaggggcaggaactgcaaatagagtgaagtggaagggctataaggtaattacaagtgatacagaagctcagccatttacggctggtcagtttattggtggtggaggctggttagcgtcgaccggttttcctttctcgttaagtctttgaaattaaaaggttgacttattattttaataaagattgtatttctctatctacatgtatcattaaatcgatgttcataggttatcattctcaagttgaaccaagtcaatgcataactcgggctggtatagttttaaggcctaaataaccggactttacggggtttattgggttgattacttgattvtaattcataaattaagataaaccgggaatcaaackcaatgttggtgttgtgtcacttgtcggcattaaagcccgaaagagatagagatagggacgccacatgttagagacgcacatggccattttaatatttgctaagataatgttctttgttttcttttaatttgtagacattttcatgtgtttttttttggttctctccaatgtgtatgcttgaaaaatataccgaggaacccatagaattgtaaagaatgttcgctttctatggacctactacggatgtagacgactttgacatatacataatacataaaaccattttttgtctttaaaccaaattacaatataatcaagttgattaatcaaaataattacaacgttatcatgaatcttcacatgcaagatcctacacacacacttagacgacaagaagtcaccgtggaacaagcgcgtcacgttcatcattcacatttacttaatcccacttaaaaaggcaaacaacaacatgtcttctctaacataaacaacagaacataacaaagcccaaacaatcttagtaataatcccaaaaaccagaaaaaaaggagctttgcttttgtaggaattaatg

SEQ ID NO: 471 - DNA, 3 bp, Unknown
  misc_feature (1)..( 3): cDNA_ID_1710148_gDNA_ID_1591295_Annot_ID_150797 3000 nt of promoter + ATG
saa

SEQ ID NO: 472 - DNA, 2792 bp, Unknown
  misc_feature (1)..( 2792): cDNA_ID_1693769_gDNA_ID_1591299_Annot_ID_150804 3000 nt of promoter + ATG
gacttggagactatggggcaatgggtcaccgttagagctagdggatccatcctttcgtgataactatcgaataaatgaagtttcgagatgcatccattgaccatatcgctttactatgtgttcaagaagaagctgaagatcgtccaaccgtgtcagctattgtccagatgctcactactagctcaattgctctcgcagtkcctcaacgacttggttttttcgtccggagtagtaaacatgaacaagtaggatactaggattagtggatcgtctatctatcaatacgtccgctctttgttcagtagatgatgctttccattactaatgtagctcctcgttgaagacaaaagtcgcgatatatgatttagtctattgaattaagcatcgatcgacaacaaacaaaggtttagttgttaattagctctttcttaggttttatagtctgtttatttgttagcattaattatagcgtttttacgattaaagtaaagcaaataaatggtgtaacatatattgtacatgaaaatgtgtaatggtggagggagggaatcaaaacctctgaacaatgcatgtgaaaactttcttctttttagtgttyttattgagtaactagattatatttaccaaataaagagagttgaagtaagacacaagcatatgcaatacttttgatagagtgtcttgcaagcaatatatataaaatatagatgttaatatacatacatgtgatgtatgcagatacatattagtctatatataataatttttgtagagaaattaattgtgttaccttttaaagtcatagatatgataaatgatgttatctaataacttttttcttttcaagattagatggagctctatagtagtcgtttttgctaaaatataggatattacataacttagcaaacgataacataattgatgtaatcctagttcaattatatttctgtaaaaaaaaattcatacataactttttccaacaaatatgaactaaactatcgataccataaaaagtaaccccacatgtgtttggtaccaaaagatgctgcgtagatatgagtgcgagactgagcttgacacacaaattttatgaaaaacaaacacacacacacactcattatataaatatgtgtatgtgtgtgttgataatgagagaggagagaaagaaagcaaaagggtttgaaaaagaaaaccacatgtttgaaggatcatatcacatggctccttaaccccacacttttgccttccctctttttcttcaagcttctttattcactccttaatacacacataatctcttatatagaaaccacatgttgccaaacatatatatacacatattttccaatatatatgtatggtttgttcactaataatctatattttttgttactaattccaagaacattaaatgtggtctaacattgacaattggtttatgtaactctaatcctaattaagaagtagtgagttaaaacttaaatctaatgtttttgccttttggagatgtgatagaatagttgaaaaccccacatttgtttgatatgaaacttgggacatgtctatggtatcaaattcattggatgatgaacacatttgacttttgtaaaatttagaaaattacttctaaaattttattcataaatttttcatgatatatctaatttccgcattatgggtggttgtcttttttttagtagatatatttaggtgagaaattagacagtttttgcattagagttgaaaaaagttactaactaatatctcaaattcaaatttaaattttaaactttttagttaatgggactgagctacaatttaaaattgattatggaagaaaatctgaaaaggctctaacttttcccctcaaaacgggaagacaaatttttgtcttctaatccaaagttcatcaaaataataacccaaactaaaccgctaaccaatataaatcaaaccagaccaatattcacaattttattaacttatacgcttttacaaataattaaccaaattagtaatgtgaatgaatgtaactatttttccattatcaggaatttattcattaagaagtggaaaaataaagataattaggataataaatcgtcaaaccggaaccgaaatctcggtttgctccggtcttcttaaaccgtaacgtcgtttacaaaaatttgatctttactttaagttttgtgccttttacttcatctctcatctcttcttctgctttgagaagaaggaacaataaatgcagttgaagtcacactctctctctctctctccaagtcgctctctttcgaatccaccattgctgaaactkgatccttctctgtaagtcttcaaatctccagagtgggttttgcttccgggaaaagtactactcgctgaatcatcttccaagattcttcattttgttactcgatcgtttgatccgatttcctgtcatcggtattaagagaaggatctagatatagcttggtactaaagtagctagatattgaagtagcttcagcaatgtatttacattttgttcactgattttgttttgtttttgctgattcatgaaatggagtcaatttgagtaagaaagttgctaaatttgggtcaaactgcgaaagtcttggattctagattagaacttgtagtttaagtttttgggcttctcaaagatgtgacctttaaatgcttgattggtttgagaatgttggttttggttaccttggatccatttgctcaatgtgaatgatttgtttgtgcagagaatctaaatggtagataattttagcagaatg

SEQ ID NO: 473 - DNA, 10 bp, Unknown
  misc_feature (1)..( 10): cDNA_ID_2687382_gDNA_ID_1591309_Annot_ID_150822 3000 nt of promoter + ATG
cacaaagatg

SEQ ID NO: 474 - DNA, 121 bp, Unknown
  misc_feature (1)..( 121): cDNA_ID_1375975_gDNA_ID_1591317_Annot_ID_150833 3000 nt of promoter + ATG
tgagcttctccatttccatttccatcgccatcggactctctcctcttacaaacttttcatttttgttagctctcatctctacgtcgaattgctttttctcttcttctccgattcgaaaatg

SEQ ID NO: 475 - DNA, 3000 bp, Unknown
  misc_feature (1)..( 3000): cDNA_ID_2144243_gDNA_ID_1591323_Annot_ID_150845 3000 nt of promoter + ATG
aacttaatactattatttataggctaattagtaattgctcatgtagtcatgttactacttactactattatagtagtattgtttattaccgtgatgccaacaggcaacaaccataatcaagtctcttaaaataattttgtgatctataatactaataagataattgaatataccgtatgttcatcttcagataaaggtaaggtcaaatggagtgctacacgtcaagacaataagaattaaatttgactctgtagatccggaaaacaaaatgaaagaaagagtaagaacttttttgtggatttttctttttgattacaaatttgtaataattaatttttttgggggaatggaagatagagaaaggaagagcattaagaaaataggagaacatatggaaagttacaataaatacttggtacaaaagttgcagaaaataagtaagaatatgatccagaaaagattagaggaagaaaagattcttccaacgtagattcaaattattcaatattatacaaagggtactttggaaaatccacaataaccacataagaaaacatgcatcctcatctttcgactttctcactttttggtgattggtatcttttttttcttcgaaccttccgtgtttgatttatcgccctcttgttcttttgtcccttttatattgctggtcctaatctgatgaagaaaattaatcaagaaattagaatgatttttctttaaatcaggatctttacagttaatgactgattatttctataccgttttggcgtagccttgctgggccggatacccacgaactgaatgatgagtacaagatatgttaatttccttcaaggttaaattagttaattacatgaatctcaaataaccaaaactcctatatatatacacacctggtgcaccagaggaagaatccatagttgagaaataactaaacaaggaattgtgagaagagtagattcgttaatgataagaagcttggttttgttttgaagatgatgctcgatcttcctatatatatatatatataattttctacttttttttccttagagacacgactcataattggtttgcaattttgcatacaaagtcaaaccacacttgtttattcataaaaatatagatttatgagaaagtgtacctaccatatacaaaccaagaacttaacgtgttgagattatactcgccaataatctaaaatgatgtaatactctacttaatagtataagtttactacaaacgtgtacccggattatcatatatgattgttttttagtaaatttgttatcttcaattgattattggggggcaaggtctcctgtaaatataacaaataaaacacgatatagagtggctcttaaactcttaagttagaaatagaaaaataataaagtgaaagactattaggtgagtagatgagagagtagaatggaaaatgtcggataacataaagaagaggaggtatagtcactccatgccgatgaaggatggtcaacgatgtatatgttaagttaagaggcatataaggtgaaataagtaaaaatgaaagtgttaagtagacgaaggcgtgacctagaagtggtctttggatgtgaccgaaataggtcggaagtacgtatgagtgaaaactaaaggaggttttgcgagcgaagataaagaaaggtgtttatgctctctagaataatcatgaactagtaactaagtgaaagtttggatccccttctcgttaaaaaaagagttgtaccacgttggcttagtatattggtagacaaatccggatcatattcagatgcatcgacttgtgcatgtactatgcactcgtgtagttatcacctaccacctttgtctttatctccctataaataaactagtgaatcccgagatgtaaggtgatatcatctctataccgtttgcagtgcaaaatgcggcgggtcagactatcactatgtggagcaaatatgatatatcaaccaactaacccctcatataactagagagatcttaaccggaaaaaatgatccgcagtttcatacaaaaagctctatagtttgttctttaagcagattaaagccattgtaagtcaatagcttttgattaagatttcaataaaaagagcaatttatattcctactttacttaaatgaattatttgtggaactttagtatctacggaagtgacgatgggacaatgaagtatggtgacgtatgacgattgttttggttagattgcaagcacacgtaacggaacaatccaaaatgatccaaaaatttaacaaaaataaatgtcagccaatgataatttattatattattcttaggttattattattgaaaaaactttaaaattcataatcttcctaaaattcacttaaatttatccaaatttaaaatccttcaaactaatccttaaattatttgtagctagccaaccaactacattagttaaatttaaatgcattgcaagctcacatgtatcaattatatataatgacatgttgtcaacatcacattaaaaacaaaaatattatgttttctgcgtagaaaaaaaaagctttgtggttaattttttttaatatcattttttatttcaataaatattttatggataaattaaaaatatgttaactccattagacttaacactaataacagctaaacacaaaaattgtaacatcttttgcaattcattgtaatgtttgcaattagtgggccttcttttgagccttcttatgaaccgaatatttgcctatttgggctttaaaacatattgggccgataaaaaagagctacaaaataaacagctaaacaatttttgatttaccatagttttttagtttttacccgacccggaaacaaaatccggattttttcctccgacccccccaatagatctgactgaaatcaaaattttccgactctttctttctctcacactagtctttcattttcctcctcaactctgggcttgcttcgttctatgtttctccactgcta

SEQ ID NO: 476 - DNA, 620 bp, Unknown
  misc_feature (1)..( 620): cDNA_ID_3095417_gDNA_ID_1591346_Annot_ID_150858 3000 nt of promoter + ATG
gatgaagagctctattcgaattcaagtgagttctgtctatcttcttgtctacttctcaattttagggttatataatrttatctattaaactctaattaggttcaatttagtttgactttttttttcccttttactcaatttaggttctatttgggtttatgtgagacattgtgtggttttatttccagggagaattggtaccagttttagtttcgggttaattcttctcattgtttatctctacttccatgattggtcttcttcacttatgatctcaaagatcaatcttttcaattgctcttggattctgagtttaatggataacaagatttgctatgaatggtttcacactactgttggaagatctatagaatgagcaatattgctcgttgagcagagaatatataaaatatataacaaagaaacttgatagattaaaatcaaatccaatttgttgttattttcgttttcgtgtgcagatgtttccagttaggaggtttaagtctagttattattacagtttcttttttacttgtttgctaattttactctatttcataaacttgttatctacagatattcttttgatgtttggtgcttactagttggggatggaaatg

SEQ ID NO: 477 - DNA, 247 bp, Unknown
  misc_feature (1)..( 247): cDNA_ID_1693908_gDNA_ID_1591351_Annot_ID_150861 3000 nt of promoter + ATG
gtytttgagaaccccgccrrtgttttaagattttttwatcatatatgatatatatatatatatatatataagcgcgtatgaattcggattatccaaaggttaaactacaagaaccaaaacgacatagtagttttgtcgtttagaatctataagcgcagacaaaagtcaactttagaatcaacccaaaaatagaagtcaaaattaaaaaccaaaaccctaagattttagagtagactctcttcgaatg

SEQ ID NO: 478 - DNA, 144 bp, Unknown
  misc_feature (1)..( 144): cDNA_ID_3056264_gDNA_ID_1591352_Annot_ID_150864 3000 nt of promoter + ATG
ccaraaaggtmcgggttttgtwttgcttacaagaacaatgtttattaaggatatattgatcttacaatgtgtcttgtatcatcatttggcttcagattttatagacgaaattaagaaggaggtgaatttcagagtttgtcaatg

SEQ ID NO: 479 - DNA, 1018 bp, Unknown
  misc_feature (1)..( 1018): cDNA_ID_1025094_gDNA_ID_1591353_Annot_ID_150865 3000 nt of promoter + ATG
ggttgttgttgcgagagtttgctttatccctgtgatttaatttataaacttcaaatctaccaatattttagtatgcaaaatgttagtgtgcaacatacaataatatgatggtacgaaccttttgggaagtggatggaaaaaatacagactabcaataaatttaggatggtacgaagttgtatgttcaattacatattactagtgaaattttttaggatttgaatggttacggcagttgaggcggacaaaaccgtcaacggatcagaccgttttttatttaccattcatcaattatagtccgcagtggtttggactaaaaaaaatagaagaaaaccgatgcggaccatctgccgaccgtttttacatacaaataaacttggtccgcagcggtttattgtccgccccaaaaatgagatgaactaaaccgcagacaaattagaccgctttgtccgctgcctccattcatagccctaatctatattaatgcatattaatccgcaatagtgaatgatgaattaaatacgggcttattcgatttcagtcagatttgcatcatactacacaactatttatattttagatttggttaaccaacttataaaaactttaaatactacacaaccatttgttttttagatttggttaaccaacttataaaaacttaatttatataatcttgttggtttttgttaattttcacatagatgtccaattgttcccacacatctcagttttgatatccatcttcttatcttcgttaaccacctaccaaatgtcacgtggacgctccattcggtttctatccggattcgcggtggattctcctcccaccccaatcatcggttcatttcagcatttggttatatccaaataattttaaccggtttataccgaaactactcgaaccagacaatctttgattggtagaaagagagccacgtaagattatctcttctaatggcaaattaaccaaaaacgtaactgaagatccaaagagagagagagaaaaaagacgatg

SEQ ID NO: 480 - DNA, 56 bp, Unknown
  misc_feature (1)..( 56): cDNA_ID_1693928_gDNA_ID_1591354_Annot_ID_150867 3000 nt of promoter + ATG
tcatatattcttgaactgagcatgcgtatttttgataggcaagaaatcgtatgatg

SEQ ID NO: 481 - DNA, 422 bp, Unknown
  misc_feature (1)..( 422): cDNA_ID_3439599_gDNA_ID_1591360_Annot_ID_150880 3000 nt of promoter + ATG
aatacaaaactatagatgtttccaaaaattgtgtatagaagtttaattaatgacttagtttgactcgtttgaattagtgacaaagtaagaatgattagtaaatgacacgaatacccctcaaacttaaggtttggttgttttcgaagatgcaaaaacagttgaagacaaatgtaattttcgtcttttcgaaaatgaactcagccttttgtgctgttgaaaacaaagttgatctctgtttctgacatgcaaatcttactctcttgtttttgtgtttttggtttttgtctaccaaaaattatttagcaatagagtccaaaatatttgtctttgtctgtgtattctaactcaatcagtcaaattagcagctaagctgaagttgaattattcgatcctaaagtacttcattatgtgtaaaacagatg

SEQ ID NO: 482 - DNA, 322 bp, Unknown
  misc_feature (1)..( 322): cDNA_ID_1694019_gDNA_ID_1591381_Annot_ID_150901 3000 nt of promoter + ATG
ctatgaaataaatgatggatttttttccttctaactctctaatgatacaaaatacaaagattccaaaacatataaactttaattcatttttaaaaaaaaatagtattttacatatgagatgagatcagaatcaatagagtacaacaaaacactctgtcagattcccacttagttttgaggattccccaaaaaacaaatttggacaataataatgctcaaaatttaattaataagtttcctcaaagtataattaccaaattatgaatgaatagtattgctctctctcagaatcaaaacactgaaggagaaaaaaataaaaatg

SEQ ID NO: 483 - DNA, 712 bp, Unknown
  misc_feature (1)..( 712): cDNA_ID_1694031_gDNA_ID_1591383_Annot_ID_150906 3000 nt of promoter + ATG
tgttaaaaatgataatagtagcgataatattatataactaactaaaaatattttctattattttttcctaaaaaaactttttttaactgtaacaaatttttaaatttactcaattttatcgtaaaaatagaaaatggcacgttgtacggatcctaatcaaactawactttgtttttttttgtgtgtatgtgaaaatcatggttttaagttcgttaaattcgcatactttccagatgtccggttcaaccgatctaaccgaaaccaagcaagaacgaaatgggctttaaagcccagtgaaccaatcaatgaatgtagaggaacgagagtttttctgaactctgttaaatttcgtttgcgtcttctttccattctctgaattccttccatatctctctctgtgtgtcttttacaaagaccagatctctcatctgtgttttgttggtttatctcgaccaaagcccacacgtcacgttacgttaggttacaaaacaagttttttcccttataaaaaaaacattgataaaatcgaaaaatcaattcctattttgtttccaaagcaaatctatatatctattacccatctcgaattcgaccgaacccatgttctaatctccttcgcaacattggaaatctattttaaaaatccgttcagattwaaaattagttatataagtagtttggtgactcaattaggtttacacacaaagacatg

SEQ ID NO: 484 - DNA, 1737 bp, Unknown
  misc_feature (1)..( 1737): cDNA_ID_3036089_gDNA_ID_1591388_Annot_ID_150910 3000 nt of promoter + ATG
cagctttggatgctaaaggtaaaatatttgaacagtcaattggttattgctcgaaaggaatacagcaattgtctgaagcaactgcttacaagatcgtcttccacgatctgagcaatgttctctgggatggtctgtacctcggggaagttccttcctcaaggattgagccgtttcttcaagagctcgaacggtgccttgagattatctcctcatcggttcatgacagagtccgaaccagagtcatttcrgacatcatgagagcttctttcgacgggttcttattggtcctccttgcaggtggaccatcgcgtggcttcacaattcaagactctgctgccgtagaagaggatttcaagtttctatgcgatcttttctggtcaaacggagacggattgcctttggatttgatcgagaaggtttcgacgactgtcaagagtatacttccgctgctgcgcacggatacagattctttgattgaacggtttaaagcagtgtgtctggagaatcatggttctgacagagggaagcttccgttaccgccgacttctggtccgtggagtccgacagaaccaaacacacttttaagagtattgtgttaccgttacgatgaacctgcgactaagtttctgaaaaagacctataacttgccgaggaagctaacctgagagtgacctacttactacattggtacaaaacccggtttagtttgaaatgtggaatatattttggttaaagcggctagcgattggtatttggcaaattaaattacttgtacaagaaagtagaaacgttttagtgaaatattcttcttttgtactaatcgaaagcttgtgggctttgttacatgttgtcaactgttataaatttgtatatttaataccttttgtttttcatctttctttttcaattttatcagatttctgattgataatttcagatttctacgatgggtcattgaatggtcttttaagaactcataatgtttatgtgatgggtaacatatatcagatatatgatatggttgaaacttgaagtcatgattcatgatccgtttagaaacgtttgaaatgagtatcagaaaatgattattgtagatatcaaacttttcctgcagacacgttctagtattttgctaaaataatagtttgttgcttattcaaccaaacaaaaacacttgttcaagtagcgcaatatcttcgatagttcgattcattattattatgatacccttcttcgacttctttgatttcctcgagttcttctccatacgtcacatgactcacatcgtcagcgatttcatggcaatgttacatgtggtggacgacatggagtatccgcgaccgcgagatgatcttgaagaggtgtttgctttatgaactgtgacgatgaatcggctctgttttcctgtttccaacggttgtaatcacaccatcatcgttgtcttcatctatactaatattcaaatggtcaattataaagcccaataatctaactaagcccaaaaatgaaaacacacggactcagcccatacaaattttaacacttaaggctaatgggtctgtcacgtgcggaatagactgaaaacagagcatcgcacgtgccgcatcaaaatttgaaatcacgacgacttcaaaaaaatcccaaatggtaagaaaaaaataataagttgcagaaaaaacagaaaaccctcttttctctctcttctctctctctcgaggaagaaaggcaacaactatg

SEQ ID NO: 485 - DNA, 77 bp, Unknown
  misc_feature (1)..( 77): cDNA_ID_3056319_gDNA_ID_1591391_Annot_ID_150918 3000 nt of promoter + ATG
gattcttcaaactcctctctgaaagttctcatttttggtttacatttcctttgagtccactgttacttactaaaatg

SEQ ID NO: 486 - DNA, 131 bp, Unknown
  misc_feature (1)..( 131): cDNA_ID_3056323_gDNA_ID_1591392_Annot_ID_150919 3000 nt of promoter + ATG
ttattcaaaatattttcaccaactaaaaagagatacatcgaaacaaatctctctaatcatatctaagttatacctttttctttataaacaataaacaatagctttgatttgaagcaagaggagcaacaatg

SEQ ID NO: 487 - DNA, 241 bp, Unknown
  misc_feature (1)..( 241): cDNA_ID_3056342_gDNA_ID_1591402_Annot_ID_150935 3000 nt of promoter + ATG
agatgaaacgtaaaaatgctagagagaggaggagacatttataggttcctcctgatcctgaaaagctgtagaaagaagaaggaaaccttgagtttgtttactgagaaagtggtgggccttatttgggctttattattagtttaagcccatttggcttcaaaattagattctgatcaattagaagcgagagtggcaacgaatcagatctgaatttgccgattactcagaaaataaaaaaatg

SEQ ID NO: 488 - DNA, 172 bp, Unknown
  misc_feature (1)..( 172): cDNA_ID_1694109_gDNA_ID_1591404_Annot_ID_150939 3000 nt of promoter + ATG
actttggccgtacggaaacagcgtcgtatttggatgtctcattgtctttgtggcaaaaaggcagcgtgctaaatccgtcctttgccaccgttgagcggccggtgaaccccaagccgaatcaccgtctctcccacctctctctctcccctctctatctctccttttttacatg

SEQ ID NO: 489 - DNA, 1839 bp, Unknown
  misc_feature (1)..( 1839): cDNA_ID_1694121_gDNA_ID_1591406_Annot_ID_150943 3000 nt of promoter + ATG
agaacgagaaaaaaaaaacaaatctttaccatcaatgtgatcacgatggtgatgtgtaacaaagacaattagctttctaggtaaagcatcaacgattttcttgagctggttaagacaaaaaaaaatgcagttgtgaataatttaaaatgcaaaatgtaaagaccagatcttctgtaccattcgaaaaagaagtaaagaatatagtatgaagagcgaaaacaacacgtagctactagctagggacaaacctcaacgtggagtttagagagacatccaggatccactatcaacgcatccccatgagctacaaaatcagccccttgatggtcccccaaaccattttctggagcaaacacaaccaaatttgttgtcctgaaaggtttcaatgttttgctatgcatcggcacaatcataacaccaggtggatattcctgagataataaagacattaaaaagtaggattctagtaaagaacaacatcataagatggaaccgctttgatgaagtaagatgaagaagacaagtatagatacttagatagtatggcaacaagagacctggatagccagagaagatgacaacttatgcttcatagactgacgggaaccatccccaagtccaagtagtactaatggtccaacgcgatcactgcccaattttacatctataagagagtcgaagcatgattccattgacatccacttacagttgtctgcacaaaaacaaaactttttgtttcagtttccaattctcaacgtttctttcgaatcgagtgaagctatttccataagctctgaaaatgtggaaatcaagagagattaatactgtatactatcgaattaaggacgaccttgtaaactttgatctgtatttaagagcttcccggagataaaacaagtacggacacaagagtcaggtccaaactcaggctcttctacagacctgacgaatctccactctcctacatcgctaatatcaatccctaaattctccagcagctgcatttactcggaaacattaattcgcggaaacaatgagaaaaagaggacagtgctaaactcataaattaccagaatcagtgtggattcgaagtcgaaattcatcaaatcaacctcctccgagcatgagtcaagtatagaaatactaaatccggacctcactccgtcttccagagcctgtaaatctgttgacggtaagtcccagagatcggaatcgacaaaggaatcgtaagcttcatctccaaatttcgccggctgtttttgcttctcgagtaggaactcaacgtcgtctctagggctcttgatgatcaaagcaagtttcagatttcccatttctgcagaatcggaattcacaagtgtgaagaagctcgccgatgaaagttttccttgtttttcaaagtttaagcggacccaaaccaaatcggttaaaccgttgggttacggtttagcttggtttgatcgaattataccggattcagtcagattataatttgataatcagatagaggcaaaaagtgttcaactttctttcttcttgggttgtgtgttgttgttgttaaatgtgtgacgtcatctcaaaccaactgtgcttcttcggaatctgtaagaaaaaaaatcgatcctttcgactagggaccgcctaaatcatacgcaaacaaagtctcttcctttacccgtctacacgttcgaattttttctccgggtcgggtcaatgtcaagaacgacgagaattgtatataatcgtcgattcacgtggccgggtttatcatttactgctggatctcgttttcaattttgagtcagattccccccaattgagagattctagggttttaagatg

SEQ ID NO: 490 - DNA, 254 bp, Unknown
  misc_feature (1)..( 254): cDNA_ID_3038249_gDNA_ID_1591418_Annot_ID_150961 3000 nt of promoter + ATG
ttactacaagcctaaattagatctaagcccattcaccgaggcaaaaacttttcttaccaaaatccgcccctaaattttgaaaaatcaaaatcaaacccctgaaaagtcaaagcgacggcgaaaggaagaagaagagagagagaaaaaaacgagacgacggtggcgatcgaaaccctgtgccctaatttaaacggaaacttggttcgccgccgttctgcgtcgcccggcggcggaaatgtgcgcttggggcgatg

SEQ ID NO: 491 - DNA, 1735 bp, Unknown
  misc_feature (1)..( 1735): cDNA_ID_1694223_gDNA_ID_1591434_Annot_ID_150981 3000 nt of promoter + ATG
ttttgggaacaaaggctgattggttctctgatattagctcttgcaggacatgttgcagtcgcttagaaagaactttggcaatgatcttatagaacaccgtacatagagcaataagtctgtaatctaccattttttgtgggctttgaatctttggtattaatctgatatgagtgaggtttatctttgcaggaaaaatacttgagaggaagaaagattgaacttcagaaataaaaagagatcccacagtgtcctagttggactagaagaaacaagccgagaagccgtcatgttctggtgctttgtcaggatggataaagaaacacgccacttttatttcctcagcagttggtatggagataagaatgttatttgttgtgactgaaatgcttggttgaatcacctcccttacaaaatcgaccctttcaccatcttgagaggtaaaccgctgattgaaatacttagtaatgactcgcaaaataccttcctcttcaaattgagggagcccctcattatcttcaataactgaaaacttgtttactgtcgctcgtcctttggttatagcatggaagtaacccgagtttatgtcccccaaagcaagccataagtgcctgcttctttgtttccagaagttctcttcagctttataggccacaagtagggtttggtttatgttggttatcatgttttgatcatgatcagagttttccattgcttcctctagtttcttcccgttttcctcaataatcttctgactattaatatgcgtttcctttgtccaagagatgatttctctacggcatctattgttcaggacattccacttcattttggtatgatgtatggtgcccgcttggttgtctttacaaactcttgggacctcgtggaacaatggatatgggaatcaccatttctgcaactgttgcagaggtcatggaatctcataaaagacagagacacataattgctttacttaatcaaatagaagatcacattgagtctactcgccaaggtagaagagatgagagagacaagtctatctggaggcaacatgctgacagttttaagagtatcttctcctcatagaaaacttggcaataaattcgcaccccaagccaaaattacgattggtataaaggagtgttgtttcctttctcaaatcctaagtactcttttgtaacatggctcacttttcgcaatcgtctagcaacaggggatagactcagcaaatggaatatgggagctcgggttgaatgtgtattgtgtggagaagaagaattggagacacgtgatcatcttttttcttctgcccctactcctctcaaatttggctctccttaaccggcggcattctcaaccggagcaacacttcaagttggcaatcaatcacttctcttctcctcgattagaaccagccatacatccatgtcttcatgatacgctatgtttttcaagtttttgcaatatatgtttaaatttcaatattttccattgagttcggaatgtttactcttttgagatgatggtttattggtttctattcaaaaatttggtttttaatcatattcatgaactctgaaactatttaaaacttgaaatgtttgttttggaaagtgttaattggaactagcaattgtttatggttgttggaaatgaaaacttccaagtaattgaactttaaggtgttgtgtagtgagctcaaagcatttcgttagggatgattgttgttattctaatg

SEQ ID NO: 492 - DNA, 235 bp, Unknown
  misc_feature (1)..( 235): cDNA_ID_3056421_gDNA_ID_1591442_Annot_ID_150996 3000 nt of promoter + ATG
  misc_feature (4)..(5): n is a, c, g, or t
  misc_feature (26)..(27): n is a, c, g, or t
aatnnaagaccgttactttattcagnncttgtatgtttgcttgtgaaatatttcttcattctttcatgcttatcttctcaagatgatcctgggagcaaataaagtcttcttcttcttctaatgtaatctaaagtttgaatctttttgtttataaatccattttctcagcacaaaaaaaaagccaaagtcttctctcttttctctgtttgtcaatgttcttgttcagctgaagatg

SEQ ID NO: 493 - DNA, 2191 bp, Unknown
  misc_feature (1)..( 2191): cDNA_ID_3056425_gDNA_ID_1591443_Annot_ID_151000 3000 nt of promoter + ATG
  misc_feature (147)..(147): n is a, c, g, or t
  misc_feature (202)..(202): n is a, c, g, or t
atatgttctttagcattaaacctgttattcagctatgaaataaaacaattgttagttataatatctatattaaggtgaatatatatttttgtattaaattagataatgaactcttatcttcttcttttttaaaaaaaaatagtaatnttaaattagattaaaaaaaatagcgtttttacaacgagtgcaacgtataacagtngattgaaatcagaatgtagaatgaataagctttgtgattactttgaagccagcattggaagcaggcctcatatcgactgtccttctgtcgttgaacggtccttcttatcttcttttttgttgataacagtacttcagggaatgatttcccaaagcttgaatatattcattttctatgtacaatcatctaaagattagacaaattgttttgcaaaacaatcatctttgttctataaagaacaacctactacaattaaaattataagtttcttttctgtattaaaaatactggaaataaattagttttagaatcggaatggtcaatcggtttaaatatatccatggggttacgattcatatttaaaatgaaactatatttacaaacatcaacaaagaatcaaaatcacttacacatcaattgacccgaaagtatattcaacttggacctttagcggaagctattgacatgtagaaccgattataatcagatcatgttcttcaaactgaaggagaattttggtttccaatttggataggagagaattagtttccaattcatcagttagataactttttcgagtatttgttattaattaataaataaaatgatgcaaagaaatttaagaaataataatgttaatataaaacaaatctaattcaagaaaaccatataaaatacaaaataacattagaatacataatcacggaaactttacgactaattaacattagattgaaaattttaaactaactcagaatattttaaataaaaatattattaaaaataaaagaaaaaaagaaataagttttagttaccatgggacgagtttatatgtgagacagatttatatggtgagatgagtttggatgagagagattttttgttggtcttttaaaaaacaacactatagtatatcaaaataagagttaatcttctttcacacctctaaatgttaatcttctttaacacatctaaatatataattgtaataaaaaattattaaattacctatgttctaagggtaaaattaaaaaatatagaaattttaaattatataatttaaaatacaaaaatttgtgaataaaacatagggtatacgggtcatatactagaagataaaataatattagacttactaatatcataaacttatgacttaataaaaaccgtacacaactttatcaaaaattattaatcaacacaaacaacaatagacattgtacacaacaaattcttcattttgtaaaaatttaaaataaacaaaaacttaacccttggtgtaccacgggtcacattctagatacgtataaaattaggagatacacactttgtatatagatgcgtataatatatatgcttccggaactatacaaaaccatataaaaacatactaatataatcactaagtgtaaatagatataaacaatgagttttgataaattgaatatctaagatcattatttaaatatagatgatattgaattgaaacattaaattaattcaaaacgaaaataatcaagcagctgtgtaccgcaggtcaatatctagtttgttacattagcagtaaatagtcatactttatttcattatctataaaaattgtacccaaaaacaaatttagttagagaaagcgagataaatggtaattgttggtgtgcatatcaattgaagatttcataaattttgtgacccgatttcaattttaatccgattcgccaatggtattttggataaatactttgaatgaccaaggttttttgccaaatattccagaaaaaaaactaatatatatttgataggtcttatccatttccaaatcttgaaaattggacgcagatgggaaatataaaaagtcatttccaaagtcttgaaaattggaagcagataggaaaagtaaaaagttattttgaccgttttcaattgtcattatcttctctatataatccaccatcctttacaacctcaaatatacgttacattattgatatg

SEQ ID NO: 494 - DNA, 747 bp, Unknown
  misc_feature (1)..( 747): cDNA_ID_1694307_gDNA_ID_1591445_Annot_ID_151005 3000 nt of promoter + ATG
  misc_feature (563)..(563): n is a, c, g, or t
ggctaatcaaaagcgagatcaaacacactagaagagtaatttagtttggagggagtggatacgtcacctgatagagctcgggcttaagattcgctgataagagttgatgcagcgaatcatagccgcaaatcgatcttcggcacttgtttctccgttttctgatatcatatgatccattttttcacgagtctttttcgatcacgaaaccaagatggcgatgacttttatgacaacagtgatcgatcggtttggtcaattgattacgaattattttctgggaatcggaatctaatattttattttagttaggctgtccagacctaaagcccaccagattatattttaattcttaaaagaattattgggcttaacaacatcctaaaaagcatctatattggtggtctctcgttcaaatctctcatctacaaaaataaaatagtaaataatgttttttttaattaaaaaatctctcaataaagatgagtgagtctctcatttgagagattacaagaaacttttccaattgtttagagaaactgtcctaagagaataatattacatcntattttattaatattttttgtaagtgaaaaatttagaaaaaagtgttccggcccattgacgatccatcatgttttcgtccttttaatttttagatctgtatttactctttaccgataaaataataaataaattcaacggggagagaggaaaaacgaaagggaacaaaaagaaataggggatatg

SEQ ID NO: 495 - DNA, 1950 bp, Unknown
  misc_feature (1)..( 1950): cDNA_ID_1694325_gDNA_ID_1591458_Annot_ID_151013 3000 nt of promoter + ATG
tctctttttttttttgtttggttcacgtcctatggaaggcttcataacttgagccatcgcccagtcttcttcgactcccgcgaaatagaaaacaagagtatgcaatgaagaattgccttggaaaacaagagtatgcaatagagaaagtctcgaaagtgttggaaggttgaagataaagagaatacagagaggtaacggaaaaataacgactgctttttctccaaaatgacgacgttacaatcatctccattacgacgttttactcttttttcagtaactttttctgtagtttgtttggcatcacatagcaatgaacattttatgaaatctgtggtgtctgctttcttctcaaagcacaactatccaaaactccaaactgttggggccatatatattactaaccaagttgatagtaaaaaaaaatacaaatccaactcataatttagtcttgaagttataagaaagaaactcaacggaagtctgaatcatagtcattcaaaagacagcagaaaggggaaaaaacaaaatcatctaagacaagggtatataaaaccatgatagatcctgatttcataagatcttcaaaggtcttgcacactcaaacctgaaataaacaattggcaaatttaacttagatagagatagacgcatgcgttcatggaccaaccaaaaataacttgtgacctaaacatgccaattaaaagtgtgtgaattatagtagattaaccacaagactattcgaattcaaaaaccaaaatccaacaatattatgacactagaactttcaagtgatgaattactcaaagctaggaacatctatccaatctaacaaatgttatgagataagaggtttcaagtgtgtaatgtttgggctgagtcacagagagagagagagagagagatagtgaacctggaggaagagactgcttcaacttatcggccttctcttggtcgaagacacatagtgtgtagaggtaccttgagcacctgaccttgaacttcacaatgtccttgcttctcttgatcttcacagaccttgcatccttccttctcgccgtcaaaaggaagtccttgatctcatggatttgcttcggctgcagattatccaaaccaacatccattttcaatcaatacaaaacaaaacagaacacacaacaagacttcgaccaaaatgttactgcatgatgaacacttcatacatttcaagatgaaacttaaaccaatgggtcaattacgaggaagactcttatctactagattatcagtaaccaaacaagaaacccacaataagagattgattactttcagctcaatcatgcaaactttactaaaatcctagtcgtgagaacagataatcaaacaaataatatttagcttcaataatcctcctgagaataataaaactgagaggcgaagaaaactttaccattgtcggatctgatttagtggctgcaactttcttccactcaagagaacaaacagcaaaagcaagaacccagcgtctgaaagaaatagagaaacctaaatatgaagaaaaccctagactctcatatacgcgaatttccaaatgtaccccttaggcccattaatccgaaaagttggccattgggtttagtggcccaagttgttttgtttggcaaatttcaaaaaactcggatccaataagaaaagggtatttaagtcattgcgtctatttgcctatgatttcaacattagcgccacaaaaagttttttcccgctccactaaaaaaacacttcttcctctctccaaaagcacacaaaaccctaccgcttcgtctctctctctttcgctctgcagtttcctattcaaaattgattggtttctctaaataatgtaacaccttcgawtcgataatccttctctctcaaatcaacttagtatctccatctctgcttctttagggctccttgttcgaaggaattaaaatg

SEQ ID NO: 496 - DNA, 3000 bp, Unknown
  misc_feature (1)..( 3000): cDNA_ID_1694329_gDNA_ID_1591458_Annot_ID_151014 3000 nt of promoter + ATG
  misc_feature (605)..(606): n is a, c, g, or t
atagtccttttcaaagacattgcgtaaatcatctgagaagcctgcaggttgacacatacaggcaataatctttcttcaaaaacaaagggaaaaagaaggcaaaactgtcgaaaataaaataataatcaaagaaagttaccagtaaacaagggctcattgaaattttgatccttccttgactggttattcattctccaaaactttaatttggatgaaggcatcttctttctcttacgtagagtatcactaggatccttaagcctttcacttatgttcctgttcaaactatttgatcagtacggaacagctaatgaaataatcaaagccacatgaagcaacggaaaagttattacttgttggttaatactgtgacaccatcaaagttcttcctcttccttgcccttctttgtggttggggaggagatggctgaagcaccagttgaggtgatggatgcacttaacataaagaaaaaagtgttttaaatagataataagagagagaatgtagtggttaagcttcaaattatcagactatgttgctagctcaccaaaatctgcacgttcttcctcagaaccagcagaagaacctggagatcctgagcgannaaacgcagaatgccttccagaatttaacatttcttcatcaatactagggatagtgggttcttctcattcaaagtttcatccaatgactcagtgcgttcaactctgacatcctgttgttgtgcagcaaatgatggatgggacgtggggcttagatcatgtgcagcgtcacgcattctctcaatctcgggaacagttccaggagaagtggcatcgtttctctcggaattgggaatgcgctcttctgtcaagttactttgtctaggatcctggacttcagtgaattcctctgtgacgttacgaggactataggttccagtatcgaaagcaatattggagtctcttggctcattgtctggtcctgtctcatgagccgtttcaacatcaatttctccggtatgcctacgcacaggttctgttgattggctgctcaaagcataaaaatatgtaacaacattattaaagaagatcaactaaacagataaggaagattaagagcaaggtgtagtaaaggaaatcaaaactctatgaagagcctcactcgacatccatcgggatagattctgagatgatgtcctgtaagaaaggcatacaaactttcattcaataacaagtgctcggagacatgggaaacaagaagtcagaatcaacttcaatgtcataagaagcaagcagtaatctcacctcgtcgaatgttacagcaacataaggatcaatgccagtaggaatttgatctgaaaaataagcatcaacatcataaacacctcaaaatcatggtatgctgcatctagaaccaaggaaaaaaaacacagacaaaaggtacctgtgagagtgatatcttcctcactccgagtatgattatcgaattccctagaattcacaagaaaagaatgttaaagatgagtcaggctttagaacagataaaaactcaaataaaagcaagaaagaagaatacatgtcgagagtgtcatcttccaagtcgaactcgtccagatttagtgcttgaggcaaagtaacagactcaggcggggcctgtctggcatcctcaggcaagttaacttgagtagaaacgaaagccttagctacccaagtattaaggagattccagtcattgtaaagataatccactttctttgaatatattcgcactaccccaactagaaggtgacttgacgttctcaatgccaatggtacttcaggaaacattatattatctgcaaagccaattgcaaaattctcgaaaagtcagaaactttattaaagcagagaatttcaattactacaatgggttatatataaacaacaaaatcggaatttgatgaatgcccatgtaaaaattcgtattgcctttttgaaatttcgaattggatacaatcaaaggggattcaaaaaaaaaagaagcgaactttggatcaaaaagcgaaaattgaagagaggaaagacgaaccaacagtgtcggggatgttgatggaggtgtactgagacttcttgaggcgttggtgcacatgagcggcgcaccacaccgtccccaatggaccctttcgagccaaaagcgtatgtgaataaaacattttaattccttcgaacaaggagccctaaagaagcagagatggagatactaagttgatttgagagagaaggattatcgawtcgaaggtgttacattatttagagaaaccaatcaattttgaataggaaactgcagagcgaaagagagagagacgaagcggtagggttttgtgtgcttttggagagaggaagaagtgtttttttagtggagcgggaaaaaactttttgtggcgctaatgttgaaatcataggcaaatagacgcaatgacttaaatacccttttcttattggatccgagttttttgaaatttgccaaacaaaacaacttgggccactaaacccaatggccaacttttcggattaatgggcctaaggggtacatttggaaattcgcgtatatgagagtctagggttttcttcatatttaggtttctctatttctttcagacgctgggttcttgcttttgctgtttgttctcttgagtggaagaaagttgcagccactaaatcagatccgacaatggtaaagttttcttcgcctctcagttttattattctcaggaggattattgaagctaaatattatttgtttgattatctgttctcacgactaggattttagtaaagtttgcatgattgagctgaaagtaatcaatctcttattgtgggtttcttgtttggttactgataatctagtagataagagtcttcctcgtaattgacccattggtttaagtttcatcttgaaatgtatgaagtgttcatcatgcagtaacattttggtcgaagtcttgttgtgtgttctgttttgttttgtattgattgaaa

SEQ ID NO: 497 - DNA, 1157 bp, Unknown
  misc_feature (1)..( 1157): cDNA_ID_1028034_gDNA_ID_1591466_Annot_ID_151028 3000 nt of promoter + ATG
tataaaaaatattaaatgcatttgaackccatacaaattctcctaaattataatattgctaaacatatggataaagtaaatggtatcttatgtgtaaaatataatccatttaatttagttaaaattgttaaaattcaaacaacattctcttatagttatatcatattctatggtcatccattcatttaaccaatataaattatctttcaaaataaataaaactaaaatagatacatttttggtaaaatgcttatagatatatatattcctctatctatttctttatatatatcatttatttatttatttatacaaaaatatgcttataaaaaatgtgtatatatataaatatttcattaagaagttattatactattgatctgcttttctttgtatttttaatcaaattactattgatctgctatggtaccaattcgattcggagatccagtgatatggaaaaaaccttcggtttgatgtttgcattgtggtgaaatacatattataaaatcatackcaatcactaattcactatataatggtgaatgcaaggttccccctaaatactagctgcaatacgttaaatttaatagaataacaacaaatgcaaagccaagaacacttgtttaataataagatgctcattcttgccagtgtcttctatcaaagaaaaactcacaaaacatggtgtgtatgtggtttgtttttaagttttaaccaagacaaagatcgttggtcttacggtagacacatgaatacatatgagtgggatttggtacaagaacacttgtttaaaaataaacaagtttaagcatgttattattaaacaagtttaagcatgttattattaaacaagtttcctagatttggtttgttttagcgaagacaaagatcgttggttcttcttaggtgtattataaaaatgttgtaatacgtatttgttcctcagaatctttagtttgttatgaaagtgagtgaaaacgcaaacgtgggtttgtggggagcgtttgcgttctaaagtttcaagaatcgacgcaaaacgtgagatgtgtttttggtaagcgtcgtgtctctctctcttatcctctgttcacgccattcacaagcctgtgtgaccacaaaatacgacagaattagagagaaaagatagagagatg

SEQ ID NO: 498 - DNA, 74 bp, Unknown
  misc_feature (1)..( 74): cDNA_ID_1694368_gDNA_ID_1591467_Annot_ID_151033 3000 nt of promoter + ATG
cckacgttatgchctagaaagagattgyctcacttaaatgatcaatccattttcccgacgatttgacagtaatg

SEQ ID NO: 499 - DNA, 849 bp, Unknown
  misc_feature (1)..( 849): cDNA_ID_1028984_gDNA_ID_1591471_Annot_ID_151034 3000 nt of promoter + ATG
ggaaacaaaaaaaaaactaagcagcaaaacacattccacatcaattaatcccttgtgccattcgaatccagaatcgctatacctacaaagacatcaattccagatctctaacctaaccagaataggtgagctgaattacccaatcgaaactcctcactctttacgaattcgaaatcggagtgaaaaatagagttacgcagaatcttacgttgttctcggaagtaatttttgccttgaaggcgacaaccgaggcgatcaagagcttgaccagtctcacggatccaaaaaccgackgagtaaaatgctctgcctagggttcccattgatcgtcactttcttcgagctcacaggtaaacgaggactcaacactgaatgaagaagacgaaaatggtcgaagctgaagaagagacggaagaaaaaaaatcagcgaaaatggatttcaacaggaacattccgggacggcgaaacaataaattacagttacagtggtttaatatggtttaatcgaaccaaaacaatacgaaatatgaaccaaatctaattcgatatttcaggtagtagtttcattaaaccgattatattattcggtacgaatttattactatattttcactaaattgaacggtccaaaacctgccgaccaaaaatcaaatggccctatcagtaacaatgtcgtttcgtatcgtcgtcacttgcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaagatg

SEQ ID NO: 500 - DNA, 1558 bp, Unknown
  misc_feature (1)..( 1558): cDNA_ID_1694410_gDNA_ID_1591485_Annot_ID_151046 3000 nt of
  misc_feature (1261)..(1261): n is a, c, g, or t
  misc_feature (1284)..(1284): n is a, c, g, or t
cgtttgaggattggaaaaagcaaccaagtgcaattaattagggctcccgttaagtagttaactaatcggtaacttttcttttgtttcgaaattttaatgaccatcttttactggatctgaaagacacatgcatatatccaaatcgttaaactttaacatgctaactgtcttgggttagtgatagggtgaatttttgtatataacagtggatgttacagttttctaaagaaaatttaaatactaatttggcatttcacgcttcattattagtgtggctggtgacaaatctgattaattcatagtaaaatgaaaataataaaatcatataacaagaaattattggaaatgacaacctaaaagacaaatcattttcgttaattattagcctaaatacaatcattttccattaagtataaagattaagagaaactaatggccacgttgcaggttttgtccatgacacactacttagttagggagttctatattaatttgtttcagtagagaattgtcgtatgtcggcaaaagaaagaataattggctatgatccactcgaattttgcgctttcaatgtacggtaaactctctcttgactccaaaaaccttttgagtaaagtagagaaactgtgtccggatattttgatttgagcaattgtcatcctaaaccctaaaatgtgatagccaattagattctccactctttctgataaaagaattcaaccattcgttttcttttctccgcattttgatagatctctcgaaatttcaaaaccagaattaatacattccttatatcattgaccatatgatataacaatacataataaatcaacggtgataaaacttgatttaattaatttgactaagacttatagcctaacggcctaatggttcttatttgtataacgcattgtcataacttttgtacgataaaaaaagtttaatttcatatatatatatatgaataaaatacactcttttttggtaatgtatatgctaattttttttaaaaatgtatatactattttcttggataagatagacctagcaagcattgacttatattttatttctttgagtatgtctacacaaacgttcggatgttgtcaattactagtggatgtatcgcctgtaccacggcatttccacttggctaaaagatgaatctatgaacgattctgttgtttttgtcaaccaagtggatagtgaaaagtgaaaacgatcctatcatcagtatatttgtcaaatggggttatgtggntagttcgaatttgtgagcttccntaaaaagtatcacattcttactgggcttggaggttcaaattgggcctaagtgatttcataggagcccatatataagctatgaatttctctacttaacaaatttcaaataacagagaaaaataaaataaaaaattggaacgagactgttgttgttgtggtctcaatcctatccacagatggttaatgttttttctttatctgctctgtttttcaatggcttctatagttcctcttctccgtactctcttaactttcaaaacctcacgaaatcatg

SEQ ID NO: 501 - DNA, 111 bp, Unknown
  misc_feature (1)..( 111): cDNA_ID_1694413_gDNA_ID_1591490_Annot_ID_151051 3000 nt of promoter + ATG
  misc_feature (8)..(8): n is a, c, g, or t
caaccacnacatgccatattgccatgtggcttcaacccccacatataagtccacgacattgcaggacataacgatcataaaatttggaggaaatacaaatatagaagaatg

SEQ ID NO: 502 - DNA, 2832 bp, Unknown
  misc_feature (1)..( 2832): cDNA_ID_1694416_gDNA_ID_1591490_Annot_ID_151052 3000 nt of promoter + ATG
  misc_feature (8)..(8): n is a, c, g, or t
  misc_feature (353)..(354): n is a, c, g, or t
  misc_feature (1176)..(1176): n is a, c, g, or t
  misc_feature (1192)..(1192): n is a, c, g, or t
caaccacnacatgccatattgccatgtggcttcaacccccacatataagtccacgacattgcaggacataacgatcataaaatttggaggaaatacaaatatagaagaatggaagaattggacatagtaatcgtgggaggaggcattgctggtcttgcaacttcccttgctcttcacaggttcactataatctcctcattttctcaattataaggtaatttaaattagaaaacatatacatgaactattgactaactaaacatacaaatatgattataaaggaagggcataaagagcgttgtgttggagagatcagagtctgtaagatcggaaggagcagcatttggtattcnnactaacggctggcttgctcttcaacaacttggtgtcgccgataagcttcgtcttaagtctctcccaattcatcagtaagtatataaatatttatattttaactaaccttatctagttataatgatttccggtatggtactaaaacaggataagagatgttttgatcgagaaaggtattaaacgaagagaatcggttggaccagcatcctatggagaagtaagaggtgtactaaggaacgacttggttcgagctttggctcatgctcttcctcttggcactctccggcttggttgccatattttgtcggttaagctcgacgaaacaaaatcgtttccgattgtgcacgttaaaaacggagaagctatcaaagcaaaggcacgtttaacaacagtagatatatttattgatcaattattgagtagtgccgtagtggaattttttagtatatactttatattagccgacagtgacatttatgggtcgtgatcggttttaatggtttgtgtttgtttgtttttcactgaaagcaacatgtttagcatgaaatgcatggtcttatatattttgataatatacttttcttttaatttaggttttgattggctgcgatgggtcaaattctgtagtctctagatttctaggattaaacccgactaaagacctcggttcgcgggccatcagagggttcacaaattacccggacgaccatggattccgacaagagtttataagaatcaagatggacaacgtcgtaagcggacgacttcctataactcacaaactcgtcttttggtttgttgttttgctaaattgtccccaangtaattaataacccgncatgctacatttcatactatacatagacttctattgttttcatataacgcactaacgtatttataatttgttttataaatagactcaaacttcttaaaaaatcaagaggatatcgcaagattggcactagcatcagtccgcgaattctcagaagagtggaaagagatggtgaagaattgtgatatggactctttgtatatcaaccgtttaaggtaccgtgctccttgggatgttctgtctggaaaattccgacgtggcaccgtgacagttgccggagacagtatgcacctaatgggtccattcttaggacaaggatgttcggctgcgcttgaggacggtgttgttttggctagatgcttgtggaggaagttaaatttaggtcaagacggtataattaatgtatcttccttctcttcaaggatgcaaatagaagaagcgattgatgagtacattagggaaagaagaggtagactcgtggggctttcgacacaaacttatcttaccggtagtttaatagcagcttcttcgccggttaggaagctattgcttgtagttatgttgatgattctgtttcgtgatcaaattggtcatactcgatatgattgtggcagtctataaatttatcttatgtacgaactgtctaaattgcgagagttgtgtgcttcgtgagatgattgtatcatgaggttggttactcattgttcttgcgaatgtttcctgtttgttcgcttctgataatttttgttcgattattaaaagaactatgatattagtctttctcacttgtgagttgtgaaagacaaaagaagtccaatcaaaaacttatttaagaaaattatgggcggtatcatctgcaaaaaaatattctcaaaaacattttaatccaattaataattctggattcaagttttttggaccaaaaataatcaataattattcaaatacatttttcgtatattttgatgaaggaagagaagtccatatcatttgttttacaaaaaccccaccctagttgataaaagacttaaagtctgcattataacataaacagaaccaagaaaatgtagagagaaatgtcaaattatccagtagcccactcaaaatgtagaagctgaatcaatggaggtgatagaaaacttatctagagaaaaccagaattgcaaaggctcaattcgaagatgttttttttgatgatcccatctttattcttatatatatcaaaagtttaatagtatagaagatcgattttttttttgtcagtttagatttttgatatactaggaaaagccaaaaagataagtattgagtcacactcactataacaagtacacaaattgatattggatggaactagttgttttatccaaaagccgagttaatgtaagtggcgtcatggcttgcgtcaacggtcaagttacttcataaacaaagagcgcttgtttgactcgcaaagacccaccacactcacgtaaattgattgtctcccaagtaatttaattgtcttaatgaaaagtcttcgctgttcctctactctatataaataaattaaaaacactatactacatgttacctatagactacagatattaaaacaactacccaaacaaaactttagatctgaaaatctcagctttgaaatg

SEQ ID NO: 503 - DNA, 1266 bp, Unknown
  misc_feature (1)..( 1266): cDNA_ID_1694432_gDNA_ID_1591493_Annot_ID_151062 3000 nt of promoter + ATG
ggaaaaaaaaaaagtgaagacggaaagagaaatctaaattagggttttgaccaaagggtttaaattgataaagtgataaaaaaaagattgagactttcgacacctgatcgaagacggacacgggttcttcaaaaaaatataaaacccagatccgatcgaactttggctgagaaaatttgtttgtggaaaattcgaagagaaaactagcgagcaaatccgtccactgtcccttttttattattttcaaagcaatgtccacgatttcttaactcgatagataagacgttgtactttaatactttaagcactttccaatttaatgttaaacttcctaataattattgtgaatgaatttttcttaaataaatgagattatcttccaaattaataaaatatctgtttcgaataaatataaatttatggaccaaaaaagtcgatttaacactattattattgggtttactgcttgatttatgttaaaacgcttttattggtaagtcatccaataatatattcccacgtaagcatcagatctcggcggcgcgaaactacgcggcgttcgcttagcacaaaaacgtagcgcagtttatttaaagcaaaacaaaaaattctgttttcacacttttgcattgcagcatcttgtagctaacaacatcatcggagagaaagcagcttccccttcccggagatatcgtacataagctaaagcaaccttaaccttccttctccactgtaaaaccctcaaattaaggtcacgatttcgtcttatttttccaggtttgattcacaaagaacttcgtgttttaacgatgctattcttggggtaggatttagggttttgtttctatagttcatcgatcctgttcagtcttaagctaaatcatatgatttgcatcggttgaaaaacgcgatagttatcgggagtagggtttgttgtggtattcgagaagtttcaggaaagtgagagttttctattaatggcttttttttgtatcccgaattctttggggttaattggtgaaaagaatgttctttgtacgaaattatatccaattttccagctttacatgtttttggagatttctggaataagtctgagatacttaagaacgcatctggagattgaaattgtggcatccaatgtagtttcaatcgattttgtctataaattttgtattcttattagattgagtttcgtcttggattgagcgaatttgtttcattgatgattttagggatagattgatcatggcaactgcaactatg

SEQ ID NO: 504 - DNA, 399 bp, Unknown
  misc_feature (1)..( 399): cDNA_ID_2186680_gDNA_ID_1591495_Annot_ID_151066 3000 nt of promoter + ATG
ttggccatcaaatggccgctccatgtgatagctcgattgacctcttggcatgaatttatctttgctggtttcctttttttttttactctttttatcccatcttagttccctccatggacaagatccaacaaatttcaacacctaaaaatgactacaatatgaatatgcaatgcatgtttaatgacgataaaagacaaaatataactaaaatgcaatgaaaccaagaaaatggtgaaaatctaagagttaaactaggtaaaatacaaacacatcaatttcccatacttgcctttttatttgtaatcaaacaaacaatgcaacaaatttttttatgaaaaaggtttaaaagtggagagttataaccaaaatgcgtagcttaccatttctaagctcgagatg

SEQ ID NO: 505 - DNA, 767 bp, Unknown
  misc_feature (1)..( 767): cDNA_ID_1399782_gDNA_ID_1591502_Annot_ID_151078 3000 nt of promoter + ATG
ttagcttggcctgcgttgaagctcatgctctgactgttgttagacattttctaatcttctcttcgaaaaaaacttgatttgattttagagaactgtttagcttttgtaattgtgagttgtgtgatgaaagagcattacgggtagatgtttatatacttgtggggaaccttgtagttacgtccacgtggaattttgtgattgggtgtcagtttagtatttgaaacgtgacgttgttagattagtactctccggttgaatagggaggttttgaccacgagacaagcaaattccgttgtagactagttccaaatgtgctaatattagcatcttcacttcttgtaattctttttgcttttaggaaatgattttctttgaatcgacatctactatattatgtaagaatacttagttttgatgttttctaacgattagggtgcggtcgattttgttcacctagtctctacaattgatgttttgctaatatgtttacctaaatataactttaatgaaactggctaattgaacgaacatgttcttgcatggccaccataacaaataaaaaaaacagtagacatagagtgttgaagagaaaacaaagacctaatgttggatgtatatcaaatattgggtcacgggtcagctaatcaaatgtatataacactatattgagatatgacactataaaatggcgcaaagtgtgaaagttgaaacatatcctcatatttagcatcactcctctaatattattttttcaaacaagaacaatg

SEQ ID NO: 506 - DNA, 25 bp, Unknown
  misc_feature (1)..( 25): cDNA_ID_1694566_gDNA_ID_1591526_Annot_ID_151114 3000 nt of promoter + ATG
cagcaacagccaacagaagaaaatg

SEQ ID NO: 507 - DNA, 729 bp, Unknown
  misc_feature (1)..( 729): cDNA_ID_1694584_gDNA_ID_1591530_Annot_ID_151120 3000 nt of promoter + ATG
wgcattatggtatttttcaactaatatacacccaaaacagtatccttattaaacagctctctctctcgttttgttcaaactaacaagagaaaaatgtcagcttttgttggaaaatagataaaaattatgacataaaacccaaaaccaaaacgtcaacaccatttatcataaattacatttgtagttagctaaagtacaaaaacaacactgtaaatgatccattgaccaatcgagtagtcattaacgaaagatcacaacttaacatcacccagtctaatcaaaactccaagaccataagaattttgctaaagcagcagtatagtgataaacacacaaaacgggaaaagttgttttacaatttagaatgtcatatacttaaattattatttgcatagggaaaaatagaaagagactcactccccaagtgagggcaaatagaagcccctgctccctgaatttcacagcctttatcatcaatgctcctctaacctcaaacactcaaaatccacacatctatacccatacctctacatacacactccattttctctctctatctctattatatcttcgattcatgtgccattttggtatataaatatataatcttgcacacaataaggttatacttcccatcaccttttgtatcattgctatctttgttcttccttctggtgtctcttcagtgtaacaaaaagtctctttttcagttatattaagtaaaagatg

SEQ ID NO: 508 - DNA, 1108 bp, Unknown
  misc_feature (1)..( 1108): cDNA_ID_3056536_gDNA_ID_1591531_Annot_ID_151121 3000 nt of promoter + ATG
gatggtcgcgaatggcgagattaatccctctcttgacgtggatcgtgagcaatccaagaggcttttgatccatttgagaagaaagactttttgactaggtccggtgctggagatggtaaaggaggaagaagaaaattgtaagaagaatttggagatgatgctgaagatgaattggtgcttgtaatctcgtccccaactattcaacacgttctcgttcccaattgctcttaatttttcttttataaaaaagtttagcgaattatagtatcattttttcaaatgattgggtaacttgttgttcttaaaatttatttattcacactaatcaaaaatgattaggagtttaggacacgagactaatctaataatcgactcgagagataaaacaatagtcatggactgaacaaaagaaatatctcgtcacaatgggctcgacgactccctttatagataggagactaatctaatatgggtctacttttgaacgtcaatgaagtattactaccaacttgtaataaaatcacaataatgggcttgagtacttgattaacaggcccatttaaaagattttacgtttaagaatctttcaaatttaacaaacaaagagattattgcatggagagacggttttggtgcttgtaatgggtttgtctttccttgcggaagaagaatcgggtcaaccattctcatccttcctctacatcaaaaccctaatttctatattacatctctaacctcattcatatttgatatataacaccattcatttccttgatctctcactcatcaccctcacccaccaccaccatcaaaccctagttttgtttttcccccaatttcgtttccttgatcgtggatcattcttgttcagatctctgttagcgtctttgaatggtagaaacaactccgatcaccagagaatatttgctttcccattgcacaaccgcaagggcgagctttttccttcgtcgtctctccgccgcatcttctttcaaatttggcttctccaaagaaggctggtactaccgttgcatcggcgtcgacccttgaactcctcaacacggtttgtttttttaataaacctttctgattttgaaatttgataatg

SEQ ID NO: 509 - DNA, 1739 bp, Unknown
  misc_feature (1)..( 1739): cDNA_ID_2730950_gDNA_ID_1591533_Annot_ID_151125 3000 nt of promoter + ATG
tacaaaagaataggataacakaactatatatatatatatatataacgtagtgtcaaataaattaattagtgtgttattttcaaatatacccataaaatccttttattttctaaagaaaacacaaaataaataatcgaatttaagtatgatttttatccattatttttgccaaatagagggttctttactgcatatattccttaaataaaggaaagaggtgactattatcctaatttcttaagtaagaatgcgattgtgaaggttttgatatatcckactttacaaaaaaagaaaaaaaaagcattgcatgtgatgagaatccatctcccccatcctcccacccattctttccaactcaaccatctcctttctcttcctattaataaagtatcatcttctttttgtttctctttttattttttaatgaaaaataaaacttttaaaaaaatttgtatttacttcaattttcttacagttccacttggatagacaaatgccctttaatgagatggtggtggactttaagtatatgttatacgcacaacacacacacacacacttttatagacatgttttttaataaagaaaattctttcgaacatattccagatctctaatttttcttttgtttgagatgttatatagaattggtctcagctgacactcaaaaaccagatctgactctagggttttgtgtttgttttttgtttttcttgtaagaaaaactatatattggaaattttctgattcgtctcacttgtgggcacagtattcttatttgattaaaacctatttcttatataaaaaggcatgagatgatggcaccacattgtatatttgtatatatacggaaacataaattgggtatatgcatgtgtcttatattcaaaacaaatattctcaagtcccttccctttttaatttacaccagccctatagctaaaggctacacatatatacatttgtcaccattaaaaaacatgtactgttaaacatcaaatttccaagattccgtttatatttttcacctatccttttttttatttatctttgaaaaacaaaacttactcactctgatcgaatattttatgatatgaaataataatgacttgtaattgttgtgtagtgaaaggggatgtttttttgtttcttgtcctgatgctaatgtgggctccaagctccttgtcccactctctttatatgtataaacatctctctccatagatatgttttgtgtttgtaaacaaacagtgtacagatagagaagagagaggttcataactactctgaagaagattgaagcaccaaagaccatacaatgcatttctccatctaaggtgagaggtcaatgaaacaattaacaaaaagttgaaagtttcatttatttttttcttttccaagaaaattataaaaagttggatagtaaaagggaatagaaaagctattatccctttatgtgagaaaaaaaataaagatgatttcagaaaaacaaagccctttgtttctctctcttaactcatcttatactttcttcttctattagtaaagatgagtactctctctaccaaataaataaggaaacataaaaaacaatctctccttctttctctacatgaaaaacaaaagattcctcaattttgttcttatttttcatttagtcacagtacctctctcactataaaccacactgtcttgagataaaatacaaaaagagaagagattaaaaacctcatccgatg

SEQ ID NO: 510 - DNA, 1006 bp, Unknown
  misc_feature (1)..( 1006): cDNA_ID_1023870_gDNA_ID_1591537_Annot_ID_151132 3000 nt of promoter + ATG
tactaatataatacttttctattttagactatatgttatttaactacttaagttttgaaaagaaacaaataaaatttccaccttactctcattaatatattccatcatttcttatattggttaaatatattagagtaatagatatataaaacgagatatttttgcactaaaataaatataacgatattctgaaacaaaattaaagatataaaacaaaatttaatatgaagcggatggaattaatcatgtttttttcacctttttcacaatattcatgtatgggtttgattatggagttatggcctataaatataaggttataattatgtcaaaagaaattgtaagaccttaaagttaagtaaattgaaaaatccaaaataggattatccatccatcatccttacttacacatcattaaaatccacaaccccatcattgcccatcactaatcaataaaggtcattactaaacccaaaaacagattatcgaaacatacgtgggtccccacttccccaagtccttttccattttcataaagtatgtttctttcccattatcacacatagccttacgtgtttcacttaaccaccgtcgattcagatcttaaataatcaaacagtaagcataagagcagcgtaggtacactcgcgtcgcagaagatcaaagtcaacgataggtcagagtaaggaaacctcgccatgaagtgaaagttaataaacaccgtagctcccgaggtacaagaaacaggaaaaaaaaatatttatgtctgaaaacttgaataaaataataatatttttatatttaaaaatgttgggaatattattaatttattaacaagaacacagtaacgcaatcacagactccacagtccaaggagttttgcatactcaccaagccacaatcatttctctcttctctatctctctggttttgaatcggcgacgactgagtcaactcggtgttgttactggtttcgtcgtatgtgttgtaactgattaagttgatg

SEQ ID NO: 511 - DNA, 997 bp, Unknown
  misc_feature (1)..( 997): cDNA_ID_3087914_gDNA_ID_1591538_Annot_ID_151136 3000 nt of promoter + ATG
caaaatagattcaacgtaggttagttccaaataccattgcaaagtaaaactatgtttgtttcaaccattttttgtaatgttagtacaactggaaayactaagttggtattatggagttcgaatttgttttttctcaaaactcaatgaaaattaaagacattgaagaagtactagtaatcatataaaattaattaagttagaaattttaaaattaaatcgatttcacttgtttttagtagactcagtaccacatatcccttatgattttaagcccactttcaatataatcaccaacttagaatgaaaatctcctaattttatatatttttaatttttgaatggacaaaacatttgaaggtctgtaaatataaagttcagttcagtgtactaccaaataaacaatttgtaaatatagaaaatactactaaacatgaaatacmcggaaagtaatactatttttttcacaaaaagtaatactatttgatagattggtactaccaaaacattgtgaaatactatgttgtaaaaacctgcgcccatgtaaaaaataaacggcgcacacgtggtgaataaaatatttggtttccccccaaatgtattggcgcccgacaaaatttgagttttcccccaaaaccaaatattccaatttttagagcactttcttccccctaaacattttcgatctctctctcatctctcatcttcttatttcatctttcatctttccccttttcattattatctctcttctcccatctcccatctctcatctctcatctctcatctctcatctctcatctctcatctctcatctctaatctctcatatttctttcatctttctttgataatggatagagagtgtgagagacacccgatctacaatcatttgaaagaggcgaagaggatgatagagcaaatggaaatggtcgggatgatgcaagggattcctaagatatgtccttgtggtgatagcatcgtcgacaatcgttatgatg

SEQ ID NO: 512 - DNA, 948 bp, Unknown
  misc_feature (1)..( 948): cDNA_ID_1694638_gDNA_ID_1591549_Annot_ID_151148 3000 nt of promoter + ATG
tgatccaggcattgcaattctttatgtttgaaatccaaagcaggtgggtcgcttcacttttatcgggtcgggttaaacttccctcggaggagcaaatgatggaagatgttatagctttctatgcaaagcttaaatctttgggtattcccaagagatttactcattttctaastgatccgcaatggactccaatgttcgaaaagcttaagccacatgaagcagttttgatctcacaaagtgagtatttcaactggattgcggaacaatgtggttgctcgtccatcgaacgttggagagaggaacagtataacatagccatcaaaaaagatgatgacaattttcgtgatgaatgggatgatgatgatcaaattatacaagaagcgtaccgagattttgctaaattcaaaccgagcaaagtttggtctacataaaccaatctttccaaagaaagtgcacttcgaagatccaagagttgatattcccatgttgaaatgaataaaggttgaaaaaacttttttgcagtccaaaaaataaaatgaaaatgtcttcggttggttccaattccaatctaagggtgattggcaaagtttgacttatgtaatatcctttatgtatttggagaatatattagcactactttatttaaaataaatattctttatcaaaaaagaatatatgaacactcaaataagatctcgatttagtcaattacagcataattgttgcaacacgttaatgtttcattttctgttcttttttgttctctttgttgcgtatctccatgtcactaaattgctaacactcgtttttagttgggttttaatttcatttcttaattaagactaaaaaattgattttttttagaccgaaccggttaatccgaaccgaagacgttcctatataaacccaattttgagaacagagcatcatcatcacacaaaaaagatg

SEQ ID NO: 513 - DNA, 855 bp, Unknown
  misc_feature (1)..( 855): cDNA_ID_2990159_gDNA_ID_1591559_Annot_ID_151167 3000 nt of promoter + ATG
  misc_feature (279)..(279): n is a, c, g, or t
  misc_feature (507)..(507): n is a, c, g, or t
gagatccactcaatgtagcagctatgttctccagattcattcgtatttgtaaaaaaatgaaaactagaggtggcttgattgttggaactcgacgagtattgttccaggaagcagccgtcttacttcttttcaataacatatgttaaataaatcgacattgtttgttcaatcatagagagaacttattattattattattttttttttattgtagtagtaatcatgttcattcaaattgagcaattatttgctttctatctacgcccaaaaaccaacttntcaaatgcatcgacatgtaagaaaaattgcttttatgttttaaagttgtgtaacatttctcttggaactattgattgtctcaacgttgcaaataaagtaataaaatcctacaagatactaataatatccaaactgggcttataatcctaaaaatgacttccataattaaaacgaatttagtttattaattagtgtaatggaatattttgtcaataaaataaataatcncgaaggattatataaaggaagaaaaaaaaaggaaggtgggaattttaaaagggaaagacacctgtctctctgacccacccacccattcatttctgtggctactctatcgtcgtcgtctccacaccgtcggtgccctcacggatcaatttctagagagagagagagcgagagagacgattcgtttttctagattctcgtcaaattttttttccctccttcgatctctcctttttccttattcagcatttccccattttttcacgcaagatccgtgattttccagggattgatctgattgggggatcgtgaaattcgtttgtgttttctgctcgattaaccggagaaatg

SEQ ID NO: 514 - DNA, 1041 bp, Unknown
  misc_feature (1)..( 1041): cDNA_ID_3056611_gDNA_ID_1591574_Annot_ID_151193 3000 nt of promoter + ATG
ttcaaggtttttttttacgaattatagtaaaccaactattatttagttttaaacttcagttagtgtatgtgttggttaaatcatcaaactcaaaatatacgataagtagttggttaaattattcttgaaaaagaatattaataacccaatttttatactctcttacaataatttaattgaattgtaagctgacacatcatttagatttccagccacaaaacctcacttactaaatttggcatatgaattacaccaaaccttctcaattaattgcccaaaagcaaacgctattacaactttcatttcattttctctatctatactacttatattttctttgtataaaatgtaaactcgttaacacacacaaacaaaaaaagataacgttgaaaaaaataaaacacatatttcagactgtagtttagatgtggtaaaatatagcaagaatataaaaatatcaatataagtttcaaaatttagagaagaaagaacttcattgattgkgagttctaaataaataatggttagtatatattagtgatagagggttaggaagaagtcgttatatacataaactcagtgtaatgtttctgtcaagctttgctttgatttaagattgtactttcttccttcccactgtttacaattcgtgtggtcgtgaactaatcacgccaagttctctcgtttaattattaatttgatgtttagtttttcttggcaactttagagttatatatatgattaagttttgtaatcaaatacttcatattttcattgattttgcatattaatgcatatgttttcataaaaaaagaaaaacgagtgtaaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatg

SEQ ID NO: 515 - DNA, 538 bp, Unknown
  misc_feature (1)..( 538): cDNA_ID_3056625_gDNA_ID_1591576_Annot_ID_151198 3000 nt of promoter + ATG
  misc_feature (393)..(393): n is a, c, g, or t
caccctagtcaggtcattgcctaaagtacctcccatctttattgtcatttccgaaaacactttctagtcaatttgttaccactcaaggcacttctcatctcgtatttcactagttaaagcatttccaatgtaagtcgatgctcaaggcgtctctctatcaggccgacaacatccaagccgcctcctactaggaatcatggcaagctatctccatcatatgttgccaacaaaagtacactccacactccacactccaaaagtgttggtcttctactcttctttgctccttcgagaaatcaaataagttaatttcttcattatttcatggttgccgacatgactttccaaatacgagtattaaccgcaataaataaatagttcttataaaaagtnagatgacgtgtcatgtattgctcatcaataaagtaacgctttttcattttatttccattgaccgacacaacaaacaacacgttctctctcatttttcttcttctccgatcaatctagggtttactctcaccggcgacgaacaatg

SEQ ID NO: 516 - DNA, 248 bp, Unknown
  misc_feature (1)..( 248): cDNA_ID_1694780_gDNA_ID_1591579_Annot_ID_151206 3000 nt of promoter + ATG
caaacgccgacttgtggaccatttctcagaaggaaagcgaaccacttagaactgtcattgaaagattcaagaaggttgtctcgaatatagccataactgacgatgcggctatcggggctctatgaaacgcgttaagttttggatcacggtttcgagaagacctaatcattgctcgaccatcaactttggatgatgccttacaccgtgccaatcgatacatcgaaatcaaagaagagaaggccgcaatg

SEQ ID NO: 517 - DNA, 858 bp, Unknown
  misc_feature (1)..( 858): cDNA_ID_1694796_gDNA_ID_1591582_Annot_ID_151212 3000 nt of promoter + ATG
attaatatatttagatgacttatatagtcaattagtcatttcgatgataaacacaatgcgtgattaatgctgatgcaaaagaaaaatcgcgttatttacttcacagatctgattagattttggtatttgtgacaacctttattaaaatgtacgacctctattgtcaaatgtaaatagtttcaaatgcttctttgaaatctaaacatatataatcaacccaaaaaagagagagtctaaatctagtcaacaccgacgcatttgttttgatgtaaccatatataaatgtgacttatccaactttgttagttgagattttttaatttttggtgtgttctagaatgttaatgttaggctaatgtgtgtttcaactattgctaatattgtattaagggacaattattaaaaacaaaacttgaaaagagaggctaaataattagtgagtggggtttgtatgtaattacaaattaggctgcgtcatagaggattgcttccatcggatctcaaatgtggacctactaccgacacttctgactcatgcttagtctccgaacacaagacttcgaatcttaaaattaattttcttagatttgtctttttatttatttttcttttatttttaaatataacaattccctccaactataagatccaacggctgatatcattctaaacctttacagctaaatctgaatctccaccgtccgattcatcatcttccttcttcttcttcttcactcactcagatctcaatccccaccgaaaaagataaaaactcacactttctctctctctctctagaaaaagaaagaaagaagaaaaacttattgttattcccatttcgcccctatccgaaaaatg

SEQ ID NO: 518 - DNA, 573 bp, Unknown
  misc_feature (1)..( 573): cDNA_ID_1694799_gDNA_ID_1591583_Annot_ID_151216 3000 nt of promoter + ATG
tgactgtgggatcatcctagactagagttttaatctcttgatttgatttttcctcgacgagttgaactaaccagcttgtgattttttttagcttctcgggttgtggtagattttattatatatcacttggttgtcctatcacttgaactcgaatatttacttctacgaattgactttgcgaaataagctaatatactagtattatggtttcccctgcatatgtattttacattgtatttaacctggattttgaaatcagttttaaaagtaactgttgaaaacataaattaaacaaaactttttttaaggctcaactatactttagaaggaaataaatgtgtttcctagtcaatttgtgtcgatgaacagtacacattgactttgattgtgtgcgatatcgcgttagtttgatttaaaatgattgtgaccatacacttcagaaatcaaaatgcaatttgaccggaaaaaaaaaatggtccagtataattattattccatggcacaagtagatatggaaacaccattgtttataacccaaagcgaacgttacagagctatacaagaaattatatg

SEQ ID NO: 519 - DNA, 336 bp, Unknown
  misc_feature (1)..( 336): cDNA_ID_1694818_gDNA_ID_1591589_Annot_ID_151227 3000 nt of promoter + ATG
tactaaaatactacacatgtgtaaataattttttcagaaataaatggggccacttttgtaagtaataaatcagcttacattaattattttaccacccaataaaaagattccacagacttggcatggaagtcatgaacattcacaaaaatctaagaaaaactgaaaaccgaaaaaaaaacaaattattaaaaagcaataaataaataaactcagaaaaaaaagctattaagattccacaaaaactctgtattgtctctttctctctcactatctctctctcttttgtgagctcagatctgaccagagagaaagaaacaaccggagaagaagaagatg

SEQ ID NO: 520 - DNA, 360 bp, Unknown
  misc_feature (1)..( 360): cDNA_ID_3056654_gDNA_ID_1591590_Annot_ID_151230 3000 nt of promoter + ATG
ttgtttattcaaccgaacaaaaaacttgttttaaaatgaacaaaaatccaaatttatacagctcaacctgtatgtttttttctaaatttagcaacagaaaaataccaaattgaataccttcacatgatataaaagataaacatgaattgttaagtaagaaatttgataacccacatgcatttggtcattatttaacaacaaaaagcagactcaattttaatagtatatctttagatcgaatcagcataatgacgtatctttctgacgtatagcttttgtcttagttgttctttacgcatctataataactaaacctgtgtgaacaagacctaaaacagagagaaattcacaacaaaaatg

SEQ ID NO: 521 - DNA, 746 bp, Unknown
  misc_feature (1)..( 746): cDNA_ID_2172319_gDNA_ID_1591610_Annot_ID_151258 3000 nt of promoter + ATG
tttatttgttaatttkatttctgttaaatttaatttagaaattatcttcttcttttttaattttcgttaggagttaggaaattcttgtagttatcttttactttttgctactatatggtgcttttactctctttttaaccaatccacaatttcctttttccgtcccaaaaagtaaattacatataattaatagatagtggcaaaacttccaatacaagtattagattaatatgtaaaatgagtatcaattagtgtttaaacttttgattttaaacactttttttttaacactaagaacttgaatggttattgttattagatgctttgacactaattatagaaatcgcatcataccattttaattctttgtaagtcaaaaacttatccataacattaaaatattttgttttataaaactttatatttgacagcatttatcctctcataccaaaagtttatgatatcaaactagtataattatttactacgctaaactattattctatgtgttttattagtttaaataaattttatagcggtaattgattcgcttatagatgtgttttggtcttggacatgaaaatacaaaggtccatataattcttctacttcattttttaatttcgttttttcccttaatgcctgttaggtgttcgatataattccgcagagagtgtgggtatatacagcgacgttgtggaacacggaaactcaaaatagctccatatactctttgagatactatg

SEQ ID NO: 522 - DNA, 16 bp, Unknown
  misc_feature (1)..( 16): cDNA_ID_1694927_gDNA_ID_1591617_Annot_ID_151270 3000 nt of promoter + ATG
kggtaaggctgaaatg

SEQ ID NO: 523 - DNA, 881 bp, Unknown
  misc_feature (1)..( 881): cDNA_ID_4255182_gDNA_ID_1591624_Annot_ID_151282 3000 nt of promoter + ATG
tgacattgtatctatcggagtgttgtaaattatgtaacctcttttgataaagacgagactctttttcatcgcaacaatgacatatcctaattcttagaaatccttatttggctgctatagaagaacaacatatttttttctttttccaccagccattctcccatctactcggtggtgcaatattcacatggaaaacagttggatttaaaggagattacaaaacttaattcataaaatcgaactctatatatggaaattaagggtgacatattaaatgcaattcaacccaactaaaaatgttgcaaccgaaacaaatcaatcaaactaaaataacatgcaagtccaaatatatcataattaataaatatgattcttttgtctaattaagcatctggttctatggtgtagtggttagcactcaggactttgaatcctgcgacctgggttcgactcccggtagaacctcatttttttctttctccaaactaaattttaaagttctaaacaaacaggtcaacagctatcacatttgggcctagtttgaattagtggactccaaggcccaagatacgtaaaatcgctatttcgttttaaggttctaaagataaattatctgtactattaaatattttaatattaaaaaagaaaagaaatggttttatgatccgatcccttctcaatctcacggaggggaaaagattcctccaattcaaatctctgtctctgtctctcaactttcaatttctgagagagtcggaaatattctccagatcgcctaaggcaaattcgttttccgattcggcctagcgacggcgagagaggagaggaagaggcaagttgattgaccggagaagaagacgaagccgttcttggagaaaatg

SEQ ID NO: 524 - DNA, 2128 bp, Unknown
  misc_feature (1)..( 2128): cDNA_ID_1695023_gDNA_ID_1591639_Annot_ID_151305 3000 nt of promoter + ATG
ttgggaaaacatgattcgagatattacgacgagatttaactggaaatacgaaaagcgaaagccacaataccagaaacgctacatgctccatgtccccacctctacccaagaaggtcgaaacccatgatttttggctcacacgcctgtctgtgctgctattcatatgctggattcttacattctccagtttctttaccgaatctctcgtctccgaggtttctaaaggggcaaagaccggagagcccaaaacggaaaaccctagaagcaccattacatcctctaaagttatggttgcttcaccccaagggaagacaaacgatttggtttcagggcaccatttttcagaaacagagagaatcagagatgggtttttggtgatactgtaagtagatactttaattgcttcaaaaatcccagcttttctccatgtttgtgcgtgtaaagcttccatttttgcaagccaagatacgaaaggagcatctacaacccaaaacccagagaaagttctccgcaaagagaagagctttagtagctgcgaagaggaaacagagagacgttcatcacggcggggaagctcagccacagagcctccattgatggaggtaacaaagggttttaagaaatggttttttctcaagcaacgacctttatcagttaccattacttcttctctctcttcaatgagaagactcgacgatgacgatgcgttctccatctctcaagatgatgaagaagcaaatgattcaggaaaaactagggattttgaaagtcaaaatcggagacttgaagaaggaatcagtttttgctaagaaaggtgcaatctttgttgaagatgagcagagaaaaatgtactcaacattttgctttttatcattttatggcaaacaaaacaagttccttcattaaatctaaatgatgactgtacaataaattaacgcaacataccatgtgtataattttttctaaatttaggaatgtacacaattgacgaaacatcattttcataatttgattttttaggggaaaatcattaatacatacatacacaaaccaagaaaatttttttgtcattgaagagattcatggtcacatcatgaactaaaaatcacagagacggagaaaccaaaccatgtttcttggtcatcaggatctctctgaaagaaaactctgatatgcaacacaccaagaagctattagttagctcataatttagtacgttcaaaaaatacaaattaaacacttaaaaccaaaccagtccttaaaaagatactaaaagcataaacatcacccagcttatattgatcttagattactctacttgcatttgactaactcaaaacaagatttaacatgcctaaatccaacgagctgctgctaaatttctctctattacggctctcatttttttcaacgtccatgccacatttttctgtgtttccataatatactcctttagtgataatgccataaccttgagttcttgaacttttttcgtaggagtcattagcagcatcagcttcaccaaaatcattaagatattacagttaataagaaatgatgcaatgatgatagttttgagagtggctaataactcgctgtcaatcatgtcaatataaagtaacaagactttgtgacataaaatgataaaaaaaaatatgtgccaatatagcattttagtagaattgttgggtcaagtagaataaggtgttcagaaaaaaaaacgttaaagtaaagtagtttatttattttttaataaaaattggcaaaaagaaagggctatatttgtaaatagtcctttttagaattaataatccgaagcttcttttttgacagagcaatgcaatctttatcatcttaggttttacagtgtgattagtataattaacactaaagatttaataataatagaagcaagggtttaaggctaatacacacaaaagagcgtcttcaagcgatggccacaatcttcttcttctgcttaagctttccttctcaggcagacccacttgcttgaaactagctcggaacgataacgacaaaattcgccaccataaaccctatttttaatctccgactctgtcgtcacttctccttcaagctgggtagattaagttcgcttatggccatg

SEQ ID NO: 525 - DNA, 2088 bp, Unknown
  misc_feature (1)..( 2088): cDNA_ID_1695097_gDNA_ID_1591653_Annot_ID_151332 3000 nt of promoter + ATG
tggatctcaagaaagacaatcgtagctcgaaattctaatattattggagatcaattgatggtttccaatgaacaaggacttcaaagacttcgtttgagaatacttttctcagtgcttatcaaaagctctttaatattattaatcaaatcaacaaccgaataatacaataggcctaaggtggctatatataataaaagctcaaaaccctaaaaatagaatattctagaataaataactaaaagataacaataatagatatttgaaaatattccaaatatcttgttgcatcaacacgacactggaagtagagcacaacacttagacaataagctatcattataaactatacgaacaacactttgaataatagagaacacaaactacagttagattacaaagtacggttaaattactatttctccctaagttaatttttacgtttattataaagtgggttaagttgaagtttggccacaaaacaaattaaaagcccaacacagtagactgcatcttctccaatctacacaagcacgattccgatcaacatcaccagccatagacaatggcgactaaggccatctccaaaggctacagtttcgcttctacttggaaataggtaatctgagctcggctttgatcaattgaatgatgctcggttttattgaaatatactgaattgtaattagcgtgttgcagagagctcctttgacagagaagcaacaagcaactattgtttctttatcccacgcatttgctgaatggccatttcctcccaatcttgtgagtctgaggatgttttggttaatacgaatcaggttgttattccttctccaatgcttagcacatttgcacatctagcagtaaattaggattattatcgaatcattcagactatgacttgtttttctatgatcatgtttgagtaattttcttgttagggttacagtttctcattagggatttagatgatttagtagattgcctccttgctaggttatctgtaggattcttcatcttgattgttcttaatgctagttctagtgtagctaactagaaattgatcttagataataagtatgaccaccataggtacctgctaccagaactatcatagatgggcctaagtatttaagaaagaacaggtaggctcatagaaggtctctggtttagatactgaggtgaactaatcaaacttgataataatgcatgtttaagtataagatttcaacgctccactggaaatcttagctctaggcatagtgagtttcgtggaacaccactggttattctaatattaaagtttgagtttaagaacggttcgataacaacctagctattactatatctactaatcatttgtttcctgagaataccctaagcctaacgctttttatcttgtcttacaacctcacaatttgttattgcttactttttgtttctttttattttcattattattttacttagcttaattcgataaccattagtttattacgtgatttgagaactttgtgaattcggtccctaagttttgtaactgacctctttatttgagagagtggtctaagaattaatttaacctacatcaaatttggcgccgttgccgaagttctctttgattcaccattagactaggtgtagaatctagactaagtttttatttttctttcttttgttactcacgcattttctttcttctttttcttgtgacaggagagctaaaagatggaatgcaacaaactgctggcagatttcgacgacagtgtcgaacgacaccaacagagtgtcgatcgacaccatctgcaaaccaaaccagctaccataggcgacttcaacgatcgctgatcttttctactcaaatcgatcaacgatccagctacctccttttgcaagagaagaatttgctattcctgcatactataatcttattccacgaggaaagtttcgaagagctcctgatgaatcaccactagatcatctggaagtcttcgaagacttagtgtcctcaatcaaagcagatggtgtacaagctgattatcttctttgaaaagtcctcccccactctctcgcgggcagaggaacatcatg

SEQ ID NO: 526 - DNA, 121 bp, Unknown
  misc_feature (1)..( 121): cDNA_ID_1695124_gDNA_ID_1591660_Annot_ID_151346 3000 nt of promoter + ATG
rttttcttctctttgctcataagaacccactttaatgtatgtwcasstcttcttcttcttcgtcttgttgctctgaagagttggtcctgacttgggatttagggatttcgttttgataatg

SEQ ID NO: 527 - DNA, 521 bp, Unknown
  misc_feature (1)..( 521): cDNA_ID_3056750_gDNA_ID_1591660_Annot_ID_151347 3000 nt of promoter + ATG
tagaataatacttacaacttgaagaactctcttgtagtcttgtgtcattatgatcgtgttggcagtgaaacgcatattttgttgacgttgccaactacttcttcattctcaactctctattagttctattcaagattttaacaccaagtttttgaaagataaagagtatacacaactctcagtactaatggatgcaaactaaatgtaactgatccgaatttaaaccataccaaaattattgatttgataaaaccgaatccaagagaaaataaaccggttctgtttttatttttttccatatcgaaagaaatctaaaacccactaaaagagttagaaggtttcgactactatttacgcaacgcaaccaacctatctgggccaagtccaagcaaaccaggaaatagctaaaaccctaatcctcaaattgatcgacaaaatcgaacactgaagagttgtttcctatcagatcagatcgtgtttattttcagtacactgtctagctcaaatcctctacaacaatg

SEQ ID NO: 528 - DNA, 467 bp, Unknown
  misc_feature (1)..( 467): cDNA_ID_3056765_gDNA_ID_1591662_Annot_ID_151354 3000 nt of promoter + ATG
gcttcctttcattcggtttgaatctttgcatcggcgtattagagaagcttgcctttattgaaatgtggctcttgtgtgattgtttgctttgctttccactttctccagaggaatttctcacagaaatacttgacttacttgagcttgtgtttgtgattctaggtcaagtagttccagagaactgcattgcatattcaccaacatcttaggttcctaattcaattagcccactgggatatgccagagagaattggacactgtaccatttgaacatatgcgtatgggtcaaatataaaactttcttccttgaaattccgaggcaagagagctgtccattacaggggtactcgtgtttttttaaatacctgttgagtaaagaaaggctggattactagattgcatgctttgtcacagttgtctgtgaatggaagccgaaaaggtttgctggtgagttcagattattgatg

SEQ ID NO: 529 - DNA, 1969 bp, Unknown
  misc_feature (1)..( 1969): cDNA_ID_3056776_gDNA_ID_1591665_Annot_ID_151361 3000 nt of promoter + ATG
tcaccccacgcattcccgacgcaaagagtaaagattggtggtttgacatacctgaaattcaaagataaggtaagagttgattgttgcattgataattggtcgttctccccaaaatatgctggatatgaaaactgtctccaagtgcaattttgaatatttgggaaagcagtttaagtatccaagtcttgttatcgatgctattacgggaagaagtaagttgaggaaagagatgaagatcaattaccccatgacatcatagattgcaaaagcctcagtatcatagcccaacttttcaccattctgaaaagggagaagataaattctcttaaaaacagtttgaacgataggtaatgatttctaagcttttagtcattcatttgaaacaaaccacagtttcaattttactattcagtatgcgttcttaatatgatggactacataatggaagcctaccttggttgtcccagtcgagtttatgtaaaggtaaataggcttttcctcgtcttcatactgaaggtaaagaaactccgcaagtatcaactcagtaactgaaggtacgagagacattcccaaatatacaattcggttcttgaacaaatatgatgccaaatcaggaggaggttgttcgtgtgcacttccctttgagaaaggtataacctgttgataagacggaagcacgaagataagaatcatataataacaacaataaacaaaagactatatgtgaagaatatagcagcctccaaattctctatcataatcataatcagagcaattgatgcatattataagtggcacacacaatcaagtgaaacctctgccacataataactcaacttcttccttaccagccaaacacacagcataatttcttccgaaactgcattatttaatcttcatactcaactctctaactaaacatgtaccatttccgatcaattaaacaacagaaatgaatgagccgtctttgctatctaattgcatatatcaatagtaactctaatccattaattcgccgtttaaagctaagtagcaaccgttggtaagattcgacccataaattttccctcaattcaccaccacagaagcataaatctcagctatagaatgaatgagcattactcccccttgcaatctaatagcctatatctagagtcaatctaatccattggttcaaaactaaggaacaccatttctcgacaaatacaatttctgaaaattcactaccacagaagcataaatctcagctatagcaacgaaaacctcaatttcaaaatcctaacagaatagggagctcgttaattaagaaactgaaaaaagtataaattcgagtaccatagtgacaactccgcgtttaggcttggaactggaaaaatttaacggattaagcgattccgcacgaagcttagcgccgcataagtcactagagatgcttcctccggtatacggcgaaagaaagccattcgaaagagaagctctgagagatgaagatgaagaaaatctcggtttagatctcagattacgtgtagaagacgggataatcgctgacgtacgagctcgaagcgttgtgaagctcgtcgcagtcgctgctgctacctccatttcttctttgttgcagagagagagaaagagtgaaagtccctgtgaccccgaaacgataacgatctgtctcaaatcgggcttcataacattatttatgggctcaacaaataggcccaatagttgtagttttttttctctgaaaatattccggtttcgactataatagtaaccaaatcaaaccgaagtaaaaccgggaatttctcatttttcgaaaacgtataatttaatatgaggctaccaaataaataatctactggccactgcagagaatcatctgtcgtgttctgtttgttctcacttctcacttctcagatttttataaacatgaatgaaacctgaattgttccactaactctcagcaaaaatg

SEQ ID NO: 530 - DNA, 3000 bp, Unknown
  misc_feature (1)..( 3000): cDNA_ID_3056773_gDNA_ID_1591665_Annot_ID_151362 3000 nt of promoter + ATG
tggtcgaataaatcttcaggtaaaatcaatgcacagttccaatagaaagttgtattcttgcaaaactttcatggaagagagtagaatttttcatgttgtgtgacaacagtctcttaccattgagggacaaaaggagccatccatatgacatcaccagcctgaactggatacctaatttaaagacaagaagatcacataaaagttataatcatttcttctattctgtggaatatagctgtgtttgcagttttcttttggaacatgcttctgttcactttacatgaccgatgtagaaaactattgttcttggttgtgcatgtggtgtgttgctggaaagttatcaattatattcacaatttcgtttattaataatacagtgttgcgtaccagttatcacccaagcgataaatgccttgcccctccagaagcaacaaaccatgctggttataatgaacttcctgctcacattgcaaaatcattgagaagacgaaatggaaaaggaacagttaaaaaatctgcttatggtgtcaagtcaaactgttatgtaccttaacattcagaaactctccaggctgaaaatccataatctgcagatgacagacacatcagtaattaagctttagaggtctcaaaaagcgaawggattaattcaatcaagtgaagtgcttacatggatgttgaagtcataagcaacggacatcggaagaagtttccgcagttcaaaaacctgtaataataacaaaatatatcttcagagatgactaattttaggaactagaacttgcattacaaatgtaaactgaaatactttcagatgtattctgagaaaagtggagaacttttgcacacttacctcaccaggagtctcgagtagtggttgcttgtctgtggagccaacaataagctctgtggtgtgacttcctagatattcatacctagagatgtagcagtattgggtgactttttaagttaaaacagtagagagaactcaaaattttcttgtcatattaagggaaaggagaaaaacctccgctcgaagacaacaagtgttgcagactcaacacagtccaaggaatggtgaaagtttggaggtaggtacgcatatgaatcaacctacaggaaaaatggattatcagcagaaaatgataaaactaatggagaaatcttgcaaccatttcaccatcaaatctgggcagaacgtgatgtaaccagaagaatactgtggtaaattttcctttgtacaaatcataccgtcaatttttttgaagaactggatgtgttagtgagtgtcacagcaccctcgaccacgaatataagacttgaaaaagattcagaatattgaaaggagttaaaaagcagattatagatcataagtgcaagcatatgttaaagatagagctcatataagtaataataccgctctatgtcttgtggaggcaaacctgaacttgacatttctgcaagagacagtagaatcagctagatgatctccaaattctacgagtagatcatataaaacagcaaatctttaaacccttaatcactcgacttgttctgcgcaaagcaagaacaagtgaatgttctaataatgatgagattggtgtagcagcacactttaggacataaaggtagttcctaaaagattgactctattatcgaaagatagaagaaaataatcccaagaacttgacgttcattacttgtgagaagagattggtttcatacctttcattttcgccaagtacatgacaaaatgggaacccgttgccggtgtgatcaaatacgcccctaatgtgtttgtcctgtaaatttgagcaacagataagtgcaagagcttgccaagtttagacttcttttagctataaaatcaagaaaagtagggaaattataagagagtcatgtaccagtcaggtaaagggctgtatacatgactttccggtgttattaacgcatgatctcgtttgtatacacttcgtgtgaaaccaggcaagtctacaaaacaacagactcataaatatttctgcttaaacacttgatgaagatgcaaatacaaaacccccaattccaaatttgattagaaaactaatctaattatacacagagagagcgaactctcagaaagagactgtatatacagaactgaagttgaatgcttccatggttatgtctaaatctaattgatcaaaagttaagaaatttttgcaagacatgagccagaaaccctctcagattaaacactaattaaagtaatcttaacttttcaataacttaatctcaaaatcaatcatatacaacaagacctcgaacaattgataaaaacagcaatcaaacttaaccagcaaaagtatcaaacttttaataacacgaagctgtaagaaacacttgccttggaggtgtgaaggagagagtgttggattcgtggctttccaataaatgggtttcgtcttctcatccgattcaacaatcgaaggcgctgaacaaaacccatcatcgcttttcgaagctttaacaagacctttgataacaaataagaaagttctgattagtttcacagtatactcaaaagaacttgagaagaatctaaaagattcgtacttactaataacgatgaagacgattaagtaaagtgatcgcatttttgctgagagttagtggaacaattcaggtttcattcatgtttataaaaatctgagaagtgagaagtgagaacaaacagaacacgacagatgattctctgcagtggccagtagattatttatttggtagcctcatattaaattatacgttttcgaaaaatgagaaattcccggttttacttcggtttgatttggttactattatagtcgaaaccggaatattttcagagaaaaaaaactacaactattgggcctatttgttgagcccataaataatgttatgaagcccgatttgagacagatcgttatcgtttcggggtcacagggactttcactctttctctctctctgcaacaaagaagaa

SEQ ID NO: 531 - DNA, 1028 bp, Unknown
  misc_feature (1)..( 1028): cDNA_ID_1695180_gDNA_ID_1591679_Annot_ID_151381 3000 nt of promoter + ATG
  misc_feature (4)..(4): n is a, c, g, or t
  misc_feature (22)..(22): n is a, c, g, or t
  misc_feature (25)..(25): n is a, c, g, or t
aatnaataattaaaaactaatntgnacattttcaagcaaaaaaaaagaagaaattcggaacattttcaagcaaaaaaaaaactaattacaaatatatttaacaaatcatggaacatagataatccttagaatacatattcaaaaaaattcacagcaatagggtaaagtgtaaatatatggtcttaattttgtagaacatatcaaattagaatttctgaaacttttagaacatgtcaattttaaaatgagtagaacatgtacaatgtataaaaatacatgatctaaaatatttagaatttagacaaaaattagagaacatattctaaactttttagaacgaatttcaactatttttaaaaaaaccagttttcgacaaaatcataaattttcttctctaacacttcttcatcattattggtcaacatatgttttctgatctgaacttggcataaatgttaccttctttttcggtgatatattgtgataacctggtattcactaaaaaatgaatgaagcgtatagctctagacattgaagtctcaaaaatgggaaaggatcaacattgctttatcatcacaacgacaagatttttccactacttagcaggatttgcaggacaaaaccaatctctgttttcaagattctactttgattaatataaaaacatagctgttggttatttgttacttaacataaggcgttttactcatttttatatatatgagaatgtcaatgatctatccaaataatcaaacaaacaaaactctatttacatcatctagatgaattagcaaatgatcaaataaacaacattcacatgctggatgcaaataccaaatgcaagcgaataggcccttaaaacaattcaagtataccaaatgatcaaacaaatagacccttaaaataattaaagtgagtccatttaggtttgggccctccactaaattatcggaacagtgaagtcctctggtccctctgtattcaccaccacaggctcattgacagaaagagagtgggagagagacatg

SEQ ID NO: 532 - DNA, 1666 bp, Unknown
  misc_feature (1)..( 1666): cDNA_ID_3056812_gDNA_ID_1591696_Annot_ID_151407 3000 nt of promoter + ATG
ctaatattatcaatttatcataataatatattgtatttttttcttttaatagtaatatattatatttattttggttattttttatttaattactatcgcacccgctggtttatcattcataaaactcccgcaaacgcactcattatcaaacgcttaaccagttgttcaaaacgcttgattaacgcttgaaactgcaaccgcccgtttccgcaaactcccgcaaccgcaaccacacccgctgcgtttaaaccagtcaagccctaaaaactagggttttgaataatatcattaaaataaaatagaaagaactagggttttggcgtcatacaccgcctcattcaattattaacaaagctgagtcttcttcacggagaaatcacggcggagctaggtctcatataccttacatcaatatcttgggcctttacttggatcggagatacatcaaacataaaatacttctcggttttattttctctttcattatgtatatatgtgaatgcctttaaaaattttgattgcctttttctcgttttggaatagtcatgagaagctgagaacctatatataccaaaaaggaattatttctcacctttgcaactagctagatggagcttatggatgcaaaattcgttttaaaacacattatattcggatgatgtcaaaatatttcacattctatagccaaattcatgtttatatattccgatataaagtttaaatattaaaacttatatgctgtagattcatatccgggtgaaaacacgaaaggacttatgatggaaccattatatggaacgacgtcatgtggaatatcaagttatttaacttctcgcaagttaagactataaaaagtaataaaataattagtaactaacaatatcagataacgataggcagatgatttggtaatactattttagtatcattagatcacaataaatcataatagcatatgcgatatacaaattaataaattatcgtgcttaaaataaaaaacctattatcaaccaataatttcttcgcattagtggcgacaattttttcagccccagaatgattctttgaagaatagtcaacaaagattcctaatttcaacaattctattcaaggaaaagtacgaaacaaattctactagtagctagattctctcatgtatatctaaattctactagtagtaattaagatctttgaaatcatggcaactgctacatttattttctcttgaaaatcccaactacctattgtctatttctttgcaatgaataaaatgtagttccacaacaaagtactcaagaaaattaagaatttagactttagagttcaaaccttgaatttagagttattatgttttaaattttgacagttttgataattttcttcatttttaaataattttatattttccgtaattttttctatatttcatgtattaaaaaataagtaatggattagtagctaaacacaggaagtgtgacaagacccgacaatttaatacgagacgcgttgaccttgagcttgacttttcgtcagcacaaaaccaacctctgtttcacgttatctaatatctacggtagtcactgagagagaacaaaacatcaaatttgtttcatatatcactcaaagcttgatgagaagatacacagatcaagaaagaccaattatg

SEQ ID NO: 533 - DNA, 481 bp, Unknown
  misc_feature (1)..( 481): cDNA_ID_3056846_gDNA_ID_1591719_Annot_ID_151436 3000 nt of promoter + ATG
  misc_feature (190)..(190): n is a, c, g, or t
  misc_feature (201)..(201): n is a, c, g, or t
catcatggttgggtcaactggaaccagattcattaaccaattggactgatacaaagaatgcattcatgaatcacttcttcgatgaatccgtgacagaggaaattcgtttgcaaatctcttctttcactcaggctccagccgagtcccttagagcatcttggctccgtttcaggtcttatcagcgtgaatntccccaacatnggcttctaagaaaggccaactcatcaacctattctacaaagaaatagacaagcgataccggaatcaacttgatgcagcgagctactataacttcatgacaagaactactagtgaagcattactcctcatcaccaatgctttaacttgtctttcaacgcagggatttgacaaagaacgaagaattttagctgagatagccaccgcgagcaaagagactcctatttcaacaatttctgctcctatccaagccctccctccaccctcatcagagactagaatg

SEQ ID NO: 534 - DNA, 3000 bp, Unknown
  misc_feature (1)..( 3000): cDNA_ID_2708714_gDNA_ID_1591721_Annot_ID_151437 3000 nt of promoter + ATG
cgactacagctccatgagacattctgatggaccttacggcgagaatatcgccgcgggatgggtccaacctaaggaccaaatgagcggtccgatagcggcaaagtattggttgacggagaagccaaactacgatcatgcgaccaacaaatgcaaagatgtttgcggacactacactcagatggtggccaatcaatcgttaagtctcggatgtggctcgttcaggtgtcatgagaatgagttgatttatattgtatgtaactattatcctatgccagtgggtgatgagaatacccgtccttattgattatattgatgcaaagaaatgatccatatggtaatgtgatttgacaattattaatatgttaagttactgatcaatatatatgtataagaatataaaaccaagtttatgatatacattggtttgtataagttgctgctgtgaaatgattcagaataaaatgtgatgttcaattggttaaacaaattgtgattacatatatttgatataataatatatgaactttttgttatagatgatttataatattttcgtaaattatattcggagttattttcctttgtatttagtccgttggtatctagagcaattgtgaaaatgagtagctaagacatgaaaaattgtgcatttagataatgatggtttatgtttctttttgaagagcatgcccaatcaatatacaaatagacacagctctactgctctagcagaaaatatggagcaaatttctgtcttggggagctttatgctgcggttaaagcggctatgagactctaagcatcctagtagagtagataacgaattctatagactatatagcgtgtggacatcaacatgtctttaactttaaaatgattaaaagttgtctaatgggtcggtttaatagcttatcatcttccttattttaacttctaagtactagagttaaaggaatcaaatgatgcgtatgctttaacttttcaagaaacacaatgatgcatagttttaagacactgtaactgtaagtgcaaatgaaccaaaaatgatgctttaacacgacgttgagttttggggaatcatttcatctgacatatatgggaggacatgttttgtttgtatatcgaaattcggaaaatgtatggctaagtgggaatattggatatcacataacttattagaatcagaagagattgcaaatttgtccaagaagcatatatcaagacactgtaagcgcaactctgaaaatttcattgttgatcaaaaatacaatatagtatgtggcaactggcaagtcatacaatcacatttgatcgtactagtgagcagagccatgccaaggttaatggttgacggaggcggtcaaaattttttttccccaactaaaaaaaacgatgcttataataatagaagtaaaaatgtctacaaagataaattgtcatatgacgaaaatacgaaaaaaaacaaaacataaaaatagttctaaagcgtaattcttcttcctttcttcccaacaaaatcattagccaaacgttcaaagtcaacttctctaaccaatgctctttcgatagataagatcgccaagtcacttaaccttttttgtgacatactcgaacgaagataagattttatcaatttcagctttgaaaaacttctttccgcagatgcaaccgaaactggaattgtcaacaatacttgataagcaatccatgaattaggataacaaccttcaactttttgcaagaagtctaacacttcaataggcctcctaacttccttgggtaaagcttctcttagaatttttagttcataaaagagatcactagcaagaatatctgaatgtgttccatgagttaaagcatctttaaggttggtacaagatgccatcaaactatcatcactcgccgactgcaactttttcaaatcaaacaaaaacccaaatatttgttcatacctttggaattgttcgaatcttgtctcaagcgagtaaagagcttgatccatgatttggatgaagtagtcaattctgtaaatttcgaacataagtgttacaaaatttctgattctaatttgggggaaaactacaacatgtataattaagaattacatcaaaccataggatagaacaaggataaataaagtatcaaacttactctaacgagtcaatgttaatacgttcaaggctcaagagtaacaggattagaaaaagtcttgtggaaagagacggcgattaaaaaataaaggaagaggattctctaacctaacttaataatgctttgttctgtttgtttccttattctttggatttttttttatttttattttattttcttattatttagataaatgcaaatgatctgtaatattggtctattaaactaagagtatcttatagaaaaatatgcttctaagttttttttcaaaaattttggacgtaagcgaaggtttctttcttatgccttgaggcacggctctgctagtgagttatagtttcaatgaccaaggagttccatgcgatacacaatgcaccaaatttggtgtgaagaagtaaacgtaacttatcaattgttcgaatttctgtggattttatgcaatcagtattcgtaaagtaacttggttttataagtctgttctcaatttccatggcatcaaaagaaaacgtttagtctgtttacttcgttatctcataatccaaattcaacggccacgatcagctagactactgtaaatcaggtggtcgtgacagcacaagatcaacgatctgagttcttccttcttcgctcatatgctaaattctgattgaaacatctgkcgaattcgttcttcccctttctaatttgattctccttggaacaaacaagctctgttacagagatcagagtcgaatccgtaacaccattgttgattctctaaagcatctactgatttcaatcgtgaaattagccggtggtgcatggaagctcctttagcggagagttagtttcaattttgattcatcaatg

SEQ ID NO: 535 - DNA, 206 bp, Unknown
  misc_feature (1)..( 206): cDNA_ID_3056855_gDNA_ID_1591722_Annot_ID_151441 3000 nt of promoter + ATG
  misc_feature (1)..(2): n is a, c, g, or t
nncatcatgtaatgccgtccagtttgaataaaatcaattaatttcgaaggtagacaacatgaatctcgtgtttacctatctaacaatgtaacgaatttattttcttgggagaaactctttaccaagttttgttactgaatcgggtcaaagaaatacaaattttggaaattaacgacccaatttcagacggcccatgaaatatcatg

SEQ ID NO: 536 - DNA, 175 bp, Unknown
  misc_feature (1)..( 175): cDNA_ID_3098254_gDNA_ID_1591745_Annot_ID_151460 3000 nt of promoter + ATG
atcccgaatatataatgctaagatgtgactcgtgttggtcttgctaccaccaaatctcacaaccatctaatcaaatccctatcacactcacttgctttataatgaaaccaacatcggaaagatttcaagaacgcaaagtagtgagatcaagagagaaaaaaggggagttacaatg

SEQ ID NO: 537 - DNA, 1011 bp, Unknown
  misc_feature (1)..( 1011): cDNA_ID_1009364_gDNA_ID_1591752_Annot_ID_151470 3000 nt of promoter + ATG
  misc_feature (886)..(886): n is a, c, g, or t
tttatttatttacttgtttttaaacaaaaataataatacgtgttccataatcattggaccatgtaatgatatgtgaagtgaaagtagctttggatgggcaacaaatacactgaaccaatcgtataattatataactaaaaacgtatatatgaatttctgtttttatttatttatttacgattttatgaatattttttattcactggatatgagtcatgtgaccttgattttatttttatttttgagatatacgtagacgcatgcaatttctttaaagttaattcattttttttaggatctctcgcagctgtcagataaagtaaaatatctttcgatataaaataaaaaacaaaaccagctcatattgtatagtatactatgtgtcacatattttgagatgatcagttgctacacggatctgttaaaacttaaaaggtagtattgaataaagtggcggtcacatagaagtacaactaatatctatttgttaaattttgtcaatatgatatcaaatacaaaatgataataagaaaattatataaaattggaccatattcttaaatttttatacataaagctaaaacatctaaacttcattacaaggtaagagaaatttgacgaatctggaagttattactgagttattttcgctcgaaatagtaagttaccaacttaccatttttgtgaagctgcaaaaatagtgagacgtgaatcacctattggactgggctaggcccatcgattctctgataaactttcattaaataaacgtttgacttttgccaccacaccgcatgtttgattttttgttgtcgttgaaacaattatatttttcgagacaatacgaaattgattttcccagtgattatgtggctgagtggctcangttttgtttttctccttaattttcttggccaataaagaaaataaaaaacatgaaatcattactttaaagacaaaaaaaaactcttgctcctgtgttgagagcctaatccaagattctcttccatg

SEQ ID NO: 538 - DNA, 17 bp, Unknown
  misc_feature (1)..( 17): cDNA_ID_1695405_gDNA_ID_1591755_Annot_ID_151471 3000 nt of promoter + ATG
attattatcagaaaatg

SEQ ID NO: 539 - DNA, 498 bp, Unknown
  misc_feature (1)..( 498): cDNA_ID_1695417_gDNA_ID_1591762_Annot_ID_151476 3000 nt of promoter + ATG
  misc_feature (32)..(32): n is a, c, g, or t
aataataatataaacaaatgcgaaaagaaaanaaaatcatagcaagcaaaatttctgcttcagcgctctcgttctgttttggtatttggattttcaatcatggattgagcgattgttctctttttacttgattgatttcttcgataaactctggatcttttgtgtgggttttcataatttctttttttccgatcaatctaatccaatccagagattctgagtctcaaagttttgcttttttgagtctgttttccaaagacatgtagggctggattctaagcttgcaacgtatccatttccctggtctttcttggtgatccggaactgaagtgaaggctctctggattgcttcatttagatcaatatagaggtttatctgacttaggttcttgatgagtttatgttctgtatcagagtagatatatgtggaggagatagttttagttttaaagattagattttgctgtccattttatacaggaattgaagtgaggcatg

SEQ ID NO: 540 - DNA, 211 bp, Unknown
  misc_feature (1)..( 211): cDNA_ID_2187151_gDNA_ID_1591768_Annot_ID_151485 3000 nt of promoter + ATG
tcaagtcctgtgatggaaatggaatcatggaaattgagggattcagggaggattgattgattagaatttcatatttatgagagaataagagaactgatgtgtgtttcttttcctacttcttaaagttgtgctctttcctatttctataagctcttgtggataacaacagttgattaacgttcttatgcttgtttagggtacaacaagaatg

SEQ ID NO: 541 - DNA, 3000 bp, Unknown
  misc_feature (1)..( 3000): cDNA_ID_3056900_gDNA_ID_1591774_Annot_ID_151490 3000 nt of promoter + ATG
catcaggcacttgtatatatgaacacctaggaaaaggaggcggcacggagagcaataatgggtagaatttatgcccatcacgcatacagagcctctttttgctctcaaattcatatctgcgtttccagacttcaagtgcgaagttatactacaaatccgcgtttcgcccgccgctatgattttgaggttattttccattgtacctttgcaattgaaatttccgtctaggcttattgattgattcttacaaattgttgtttatacataacaggaaaagttgtcgcctgatgttactgagtcacaggaaaagttgttgtcacctgatgttagtgactcttcgacaaggtattcaattcattttacctctcgatcggctttgaattagcgacgaggttgttgctcatatgtgttagtgtttttcacctgactcagcgtagctaagcagtttcaatcaagttcaaagatgcgattcctccacaagcacaaagcttttaaaatgaagaagaagaagaagatgctcgtgaagccaccatcacctaaaaaaaacttgcaatgctttattaagacttgaaaccttttattttatttttttatgtaatgagattttcccttgagaaatctttgtctccccttgttcttcaagatatgtaacttaaacctgctatgcttagcttaagtatgacttaacaatccttttatttcttatctttgtctcactctattattgctaagacatttctcgaagagcattctccaacttgatctatctacttgtgctattcaacttagaaacatgaataaaatagcatgcataatttgttatgcttccatgagatagctagtttgtaatcacaaagaagacaaaaccctctgccttgccaaatctccgttcagctttgcttacttgtgcagctgccagtttcatctatacctctttgttttgtagttgcaacacttagactcacttatcatcatgtacatatacgcttaagagcaagaagcatttgtacacacgaaacactaatgatgccattacatgcattcaagtatccatgaggatttcgtcggattttttgtcatgtaaaataaatcaaagataggtgatgttattattgggcccatcaaaacaagtctcgttttgcaagcaaagtagttgatttgtcgtatccttacttgtgcaacaagatgaacttggatgaagaattaaaaaatggtcttggagttgctgcattttgattgtctgattcagattaacgagaaccttatatggttggccatgaaggtctcgctgcttcgatcttcaccttttcgattcgttgctctgctactgtaatccaagatttcggatttccagagcttttatttataaatgccgtacctgtgtaaccaccgtctcggcaatccatggcctttttaatgacacatagtttcttgcctcggcatagttcagtgtctgtcttactctcattagcttgtaaaaggattccattttttttgcaactagcataagtaatgatgtgttcatctcttgacctatggaattcacctgatcactcgctgaacctctgattacaagtaatgcattgatctacctctttctagataaacacttgccaaggtatagcggaatcttctgagttaaccaaaactgcttcttctttactttcatcttccttcttaaccgaagaatcttcactttctctagaccatttttggtgttgcatccccaaattgaaacaacaaaactacagcacttaggcgaagatagtctaacataccgtttgtaccattctattaaatcatttttcgtgatcaagcttagctccttcttttcttcggagtagaaatcaaatatgcaactgaaaataaatcaaacatagataagttagcgacttcaaacattgtcatgttgcatgatttcgcatatagaaactatagtatcaaagtttgactaatataatccagggaagttaactctaaatttatgaaaaatattcaaatcattctcgagcgatgaattcattacctttctcgaacaatctcactccattttgtcttcccactatcatgtggcaacttcgaacttacaccatttttgaaatctttaaacattttgtcagacaaaccttcctataaatataggaccaaataagtgaaatagaaccaagctaaagaaacttaccaacaacattcatgaaattatagacaaacttaccaagcgaattccattcatgaacttgtagattcgccttaccaaatgacaaggattgtaatctgaagaaacaacgcatacatagaaaccaactccatgtatcaagcgagtttcacattcaactaagtaaccaagcttttcttcgatcctagtagcaaaatagatttgaaactctgtgagtttcagtgcccagcagttgcaagctagcataagtacaaattagactaaaacaaaataaactatttgctttcaacattaccttagcttattatagacgctatcacttataatggagacaaagagatttaacaatgcagtttgccttgcttcttgggctttttcacacttgattcgaaagtatacctacataacaatgaatttcataagcatataattcatttgtatctttaacaggccaatagcagacaagtttatgttcgtacctttgctagagagttagattcgaacttattttttacctttacatatgttttacgtttggcacaaagaaatacttccctttctctcaagctcatcggagatattggcagacgctgaaagtcatgggtatcacaaaataatattagagtactaaatccaggaaaagaacaatgctcccaggcgactttcccgaggctacagtttgcaattcgaattttgaatcgtagatctggttttcggcttggtttcgaagctccgacgggtattccggcgcttctgtaccctctttcggcgctcctccccttattccccttcgtctgaggggtcccagaacctctttgtttgtt

SEQ ID NO: 542 - DNA, 360 bp, Unknown
  misc_feature (1)..( 360): cDNA_ID_3056917_gDNA_ID_1591790_Annot_ID_151508 3000 nt of promoter + ATG
actttaggcaaacaacagatttgctctgtaggaatgatgcaatcatttacgtttgctttttatttatttatagattcctgcatttggagcatacaaagcttctggtcttagtaagggattattgtcacacggttcagaggtgatcaaaattgtaagttgcatgcacttggatagtaccatcagaataaaatgaaaacttcggttctcattatacatgagaaattcaaaaacgtatcaaccgaaccggattaaaatcaacgattaatgtataaccggactcgagtcgattcaatttgaaatgaaaggataactcattagacacagagacgagctttttagtttgagctctctctcactatg

SEQ ID NO: 543 - DNA, 18 bp, Unknown
  misc_feature (1)..( 18): cDNA_ID_1695476_gDNA_ID_1591793_Annot_ID_151514 3000 nt of promoter + ATG
gtcatcaagaaagaaatg

SEQ ID NO: 544 - DNA, 83 bp, Unknown
  misc_feature (1)..( 83): cDNA_ID_1695517_gDNA_ID_1591805_Annot_ID_151531 3000 nt of promoter + ATG
cgccatcaccatctgccatgaccgcgagctgccaactcgacttgtccctgatttcctcactggggacagtgatgttcaagatg

SEQ ID NO: 545 - DNA, 347 bp, Unknown
  misc_feature (1)..( 347): cDNA_ID_2730313_gDNA_ID_1591814_Annot_ID_151541 3000 nt of promoter + ATG
cccccaaaaaaaaaaaagacaatttagttctagcctcgataaaaatcaggcatgcccaattgcccatcatgtcagaccaaaataatgtcggataaaaaagcccatcctagaaattgggtaaaatatgaaaagactgtcaagttaaaaaagttatttttcgtttgaccaatccaaaaagaaaaacttgagtctgacgacaagacagtagtagtagtgcgctgttctgttaagtaactgtaaggttagtgtttgacttcgagaaatagtaaatgtgtctgtaaaacctccaaatcgtgaggaaatccagagttccatcagatctaactctcttagatctgattatcatg

SEQ ID NO: 546 - DNA, 76 bp, Unknown
  misc_feature (1)..( 76): cDNA_ID_1695594_gDNA_ID_1591833_Annot_ID_151567 3000 nt of promoter + ATG
aggctaakaatatctaagttttgaagaattcaaacacagaaagaaaaagagagaaaataaatctgaaagaagaatg

SEQ ID NO: 547 - DNA, 325 bp, Unknown
  misc_feature (1)..( 325): cDNA_ID_1695678_gDNA_ID_1591854_Annot_ID_151606 3000 nt of promoter + ATG
aaagttctcgggtatgaagagccacgattgtcatgtcttcatgcaacggttacttccatttgtatttcttgagctgttgccggcaaatgttcatgacgccattgaaggtctgataatttaattactcagttcttttattatacgtatattaaccaataattaggttaacaattataaattctatttgtaggcataggggcatttttcagggacctctgcacaagaacattaacaaccgacggcatacaacagttagacgagaataatcccgatgttactttgtaatttggagaaagtctttccgcctactttttttgaagtgatg

SEQ ID NO: 548 - DNA, 343 bp, Unknown
  misc_feature (1)..( 343): cDNA_ID_1695701_gDNA_ID_1591858_Annot_ID_151612 3000 nt of promoter + ATG
  misc_feature (6)..(6): n is a, c, g, or t
  misc_feature (82)..(82): n is a, c, g, or t
acgttncaggtacgtgagacgcgtgcatcataggttaatagtgttgaatggtgtggatttgatggggaatataataaataancggtcctgctttgtaataaatatggttgtgctgagttcggtaattctgcctaaacctctctacctagttagatgttattgttaatatggcctttgaccaagaacaacttcagccgtgttaaaaaacattgaaaccaaaatcaatggttatataagattaacttgcactactaggatttgatcacagaagaaagaaaggggtttattaatttggttactgtatcttactctttttactttcggataacttcaattggcaatg

SEQ ID NO: 549 - DNA, 524 bp, Unknown
  misc_feature (1)..( 524): cDNA_ID_3057010_gDNA_ID_1591860_Annot_ID_151618 3000 nt of promoter + ATG
  misc_feature (1)..(2): n is a, c, g, or t
nnccttagccctgcaacactcttggaatctcctgttttcctttctaacccattggtaagctacaagttggtttgctttctttcgatgttattatggagctattttttctgaatatctcggtgaccttgcaggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaacgctccaatctttatgggattgaaactgacaatcaaaacgagcagaacaagacatctgatgtcactacaaacaccagtcttgaaaccgtggatcatcaagaggaagaagaagagcaaagacgcggtgattcgatg

SEQ ID NO: 550 - DNA, 173 bp, Unknown
  misc_feature (1)..( 173): cDNA_ID_1695743_gDNA_ID_1591866_Annot_ID_151626 3000 nt of promoter + ATG
cgaacaacagccaaatcaaagtgttaaccatgagattcttgttaaccaaaagagcattcagaatcttcaacccacgtttccagagactgtggttgacttcttctccattctcctcaacctcagattccggcggattttccggcgattccgagccggaatcatggagaactatg

SEQ ID NO: 551 - DNA, 97 bp, Unknown
  misc_feature (1)..( 97): cDNA_ID_3057058_gDNA_ID_1591893_Annot_ID_151662 3000 nt of promoter + ATG
cccatatgctcgactggaacttaaacgcctttactgaaaatctacttgaaacgataaatcgccgtagtttgtgtttcgatcggacgacgaacaaatg

SEQ ID NO: 552 - DNA, 3 bp, Unknown
  misc_feature (1)..( 3): cDNA_ID_2183387_gDNA_ID_1591899_Annot_ID_151669 3000 nt of promoter + ATG
  misc_feature (1)..(2): n is a, c, g, or t
nna

SEQ ID NO: 553 - DNA, 2630 bp, Unknown
  misc_feature (1)..( 2630): cDNA_ID_1028866_gDNA_ID_1591913_Annot_ID_151683 3000 nt of promoter + ATG
ttctagaatacgcatggrgccwtgcagtgatctctgatcatctttacgactccgcaaaacataactgcgacttcaagtcttcgaactggtcagagccatgcaacgttgctatgaacacagtgttcacaaaatacaaagagattgatatttataacatatatgctcccaagtgcatatctaatagctcatcaggagcttcctacttaggtttcggagtcaataataagtctccggcggttaaagactggttcaagagagtgagatggtttgaaggatacgatccttgttactctaattacgctgaagaatatttcaatagagtcgatgttcgattgtctcttcatgctactacacgaaatgtagcaaggtggaaagtttgcaagtaagttttatgtagaatatatctaagtttcttaattctgtatattaaaaaggttaaaatgttaatctttttttggtttttttctttttttctttttttgtgattaacagtgattcgatattgcaaacgtaccattttacagtctcctcaatgttgcctacttatagtaagctcatcaaagctggcctcaagatatgggtttataggtatactcgacacttctatctagataattggtgttccttttctttcagatatatctttcagatatatagaatgttccaataaccatacatacaaaaaaaactcagtttcgtgattgattgtcgaagaacttttttttgacgttaatatcattagaatttagaaaaaggaaaatgtttggctgttacaaagtagagcctttggctttgaatctttggcaaataataataagatgtttggctgttacaaagatttttttttcaaaaaaagaggctgttagaaagatgaatgatagacatataaccacgagattcacaaagtaaacccaccgaagatattatgataactattattcacccaccaaactcttgtacgtatgtctcttttggatttacatgatctcgttacatataagtaaatatttgaatgattaattagctgtcaaatgaataacctaccgatgtaacccagtgtttgttcattgattttgtatttgacagatactgtcttcatagtctcgaattagttggacggtttagatatccggaaaaccaatgctagatcttttaaaggaaaaataactagtagagtaacaatatctgattttattttccttagaaagttgaaaattgattagttataaatacttattattgtctaacagtggagatgccgacgggagagtcccggtgatcggaagtcggtattgtgttgaagctttagggatttccgtcaaatcggagtggcgttcttggttccacaatcatcaggttagggtttattgtgaaattagctagaaatgtgtgatattttagccaaataagtttatattagtacggttaaagctaattaaagtcttttttgtgtgtgtgtgtattgtgaaggtgggagggagaataacggagtacgagggagggttaacgttcgtaacggtgagaggagctggacacttggttcctctcaataaacctgaagaagctctcgcgcttttccggtccttccttaacggccaagaacttccgtcaagcccctagatactaccactatatcatatagctagtctcttctctctatctttttaccgagtataaaagatacatgcataaataataagtccaatacataatcacatattagttgttactgtctacccaactatgtgagaaatttacaatatataatggttgttttgtttagtgtataaggttggtgaaaaagagagtgagtttgtaatttgtttaagaacaagaatatttctctagtcgtagggatcacaaattttttggtcttggacttgttaattcgtgtgtcttttactttctctctacaacttctcttcctttcttactgcgtgctagacgaagaagcaggaaacactaaaataaaacttctcaaaccatacaaattataagttcaagactttgttagtccaagaactcacaagtcaacgaatcatttgtaaataaaattttagtgggcatttcagtgttacaacttgctgtgttatttcagagtgaagatgaagcaacgatggagatatggttaactagtaagattgatgaagccaatgacgacgacgtcccgtggagaaagttctttacagtgaaatgtaattatacgttttcattttcgatgagtttcatggtggatgaggagaacaaagtggcaatgtgttgtgacacatacatgagaaaagatggtaaaaccaatgtttacttcttgagaaatctgcataccaaccaattagttttgatggggtgttccaagttcggttcaaatcttgtaaaagaatgtgattagtctttatggaaacagaggttgcttacaatattttagtttgactctatatgaatacaaaacaaagggtcttttttgatctattgaaactgtaccgggcgatttgggaacatataaataacaataggggtcaaaatgatattttaataaaagttttcttatccaaaacccaaaaatgtctttgctcttctgctaaaaccctctctccccttcttcttacttcacttcactcgtgctttctccaatg

SEQ ID NO: 554 - DNA, 3000 bp, Unknown
  misc_feature (1)..( 3000): cDNA_ID_1443346_gDNA_ID_1591920_Annot_ID_151694 3000 nt of promoter + ATG
  misc_feature (2504)..(2504): n is a, c, g, or t
ccagcttgtagttggttgataatggagactcctctgataagtccaagctgtttcgtggcgccaccaagcctacaagtttcagtagcataacattcctcactcactgtcttgcaaaaagctcccaagtcctttatctatagagagatagagaaagcacgtacctttacgagttctggagggagaatcaatactaggttggtggtgatgatgatgacgtgaaggaaagtaaaaatggtggaaatgaaaaaagtggtaaagtgcagtgacgcagccattagcttcattggagtttttcttgcttttagaggaacaagtggatcttcctccattgtaccactctcttcccatttctgttaagagaaaagcctgtctctaacgtataatattgacaagtggaaggcgaaaaatggactgacaaaagaagaaagaagaggttgaagaacaaaatctttttttgcaccagcaaaaaagccaaatttgaaattttatgtttttggttcctgacccgagagagctatcggaagctgcagcactgcaactttatctctatattgcattgataatcgagcagagggtggtgacagaaaataattttaaaacgtgacagtaataattaaaaagataaactgtactacaagtaaataaatgcatggtgagatgatgatatttagccacgcattttctttgaaaacagacagcttgagtattacagtatgattccaaccacaccattttctttggggttttcaagtttttgaactttacaaattaagagagaacttaaggttgtctagattttctcttggggattacaattactagaagaatattcttatgaatcgtgagttagtagcttagaaagttacagcttggccattcatgaagggtaagctctacatccacttcacagtggagttcccggactcgttgagcccagatcagaccaaagcactggaagctgttctacctaagccgtcaacagctcagttgagtgacatggagatagatgaatgcgaggagaccacgctccacgatgtcaacattgaggatgagatgaggaggaaggcacaagctcaaagagaggcttatgatgatgacgatgaagatgatgaccatccgggtggtgctcaaagggtgcaatgtgcccagcagtaagtaactccttagagagactttgacccacatgggtttgggctccaaccaatttgtctcttgctttttcattctaagtgtattggagtctttatgggagtttggtacggtttaagaatttgcccacttcggtggaacatcgaaacttgttttctctttttcctctgactttaaaaattaaggccttattacaattttgtgttttttctttatgattaaatttgtagtaatttaatgtctaagaacatatatactgtgtgttttctatattgatatggatttaaaattcaataatttttgtgttcatgcagaacaaatgctgctatatagtctaagatgttcatatttatcctttttgttgtatatgtcaccatgttttgggtgttaactccgatgacatgtacgtacgaactacagtaaaaactctataaattagtaaaaactctataaattagtaaaaaatgtattaataatgttcggacgacgcaattttattaatttatagtgatattaatttattttataaactaatatttattaatttatcttataagttaataaaatattaatttatagaaatatttacgtaaaatataatattatattttttaaaaatgtttcttaatttaattttctatatgctttgttgtttgcatatataattatgtcagctttttatttttctttgacttctttaatttattttttggcaatatcttgtgactgtatatttacgaaattaacgtgaatgtaaacgtaaacataaacatgaaagtttaatccaatttctctttacacaaatcttagcaatgctttctcaaataaaagattttataaaatcaactatgacggatcaaatacgcaaatagttatgtgagtacaatagagatcataccagttgtattttaaaaagagttgtaattgtagcttgaacaaaaattttatataaaattagttttaaaattagcaaaaaaattgtaccaaaccaaaccaaaaattagaaaataaaataaccgaattaatactaaattttataatcaaaagaaccgaactaaatcgataccgaatcaaaatattttgggtaatcgaaaataacagaaataaaaatattttttataactattagttatttctaaactaaataattaaaaatatttaaaaatatatataatagtaaaaatattaaaaataataaaaaatatccgatatatctaaaataaccaaaaatatctaaaatattcaaaaataatcaaaatatctgaaaatattcaaaattaaatagtcgaatgtatattaaatttaaaaccgaaagaatcaaaattaaactgtaaccgaaccaaaatttcaaaatnaatcgaatagatattaaactttagaaaaaaaccccgataatccaatggtttcaaactgaaactgaatagataacatattaccttgcgaaacttccgtaggtcaaatgggcttaagcccatagaaccatagccacacaactgatgtggtggactggttaatgccgcgtagtcagagtcttttctggttttcgtttgaaaaaaacatcatgtaatttagaacgaatagagatagagaagcaacatggagccctggtgctggaagcagctacagctagtttagtgatgagacacgtgcacctaattctaataaataaataaatcaattcccaataagtcaaaacgactaaataaaaaacattttctctgtaaaaaaatctagaaccgttagattgttagatgtgttcagagaccgttggattccatttctttgtcaaaagactcaaaactacccaaaactcttccatcttcaccaaattctctcaatcactcatcaatg

SEQ ID NO: 555 - DNA, 3 bp, Unknown
  misc_feature (1)..( 3): cDNA_ID_3057113_gDNA_ID_1591927_Annot_ID_151709 3000 nt of promoter + ATG
ggg

SEQ ID NO: 556 - DNA, 1898 bp, Unknown
  misc_feature (1)..( 1898): cDNA_ID_1695917_gDNA_ID_1591930_Annot_ID_151716 3000 nt of promoter + ATG
  misc_feature (186)..(186): n is a, c, g, or t
  misc_feature (195)..(195): n is a, c, g, or t
gccccgaaactggagaaagtattggaagaaacacaaagatcacctttcacggcacgcatttcagaagttcgcgtccgacacataacgaaggttaagctggttccctacaacggtctcaccgacccgaagatttttctaaagtctgttagcctcgcaatcaaccgcaatcatttctctccgaagaancgacgcggncagctgccagatattcgtagaaaatctgatcgacgacgcgttaaactggttttcgcgacttgaggccaatatgattgacaactatcaccaacttatggtcgtcttcttgcagcaccattcgatatttatgattaagggtgcctctaatgctgacttgtgactatgtcccaaaaagacaaggagccgttgcgagagttcaacgaacgattcaacaaggttgtttccaatattgctataaccaatgatgccgcaatcgatgccctgcagaacgctgtgtcatacgaatcgcgattcagggaagacttggtaatcacccaaccggcaacactagaggatgccctacatcgcgctaaccgatttatcaaagtcgaagaagaaaaagccgtgatggcaagacgccaacccaaagcctcgcattcaaaggacaaatcatacgacgaacactacgaacctcgtcagcattatgataaggattatagtaaatgagataagggcaagaaagcagcaacttacgcaattggtagttcagaagggcaaccttctaaaccgtggaacaagtattatcgggaaactgataccaaacgtaacccggcctactgcgagttccataaaatctccggtcattcgactgatgattgtcgacaacttcagctcctactcctctcaaaattcaagaaaggcgacctcgatgttgagtacgaacgacgtcaggtagcaacgcacaaggacaacatgtatcacttagttcagagagatgattataaccaacgtaacgagcgtcagcggacagaagagcctcggcaaaacgaatgtgcccgagatgatgattggcgaactaataccccgaaacgaaaccgcgacgagcaacggaatgataacgcccccatccctcagaacaagatccacatgatcatgggtggactaacgacttgccgcgattccgtcagatccatcagaaattatcgccgacaagctgaagtaacacgggattggctcgccaacagtactccaacttttgataacactgaaccgataatcttcactgaagccgacgcagaaggcttgacaggcccgcataatgatccgttagttgtcgagttgataatcgctgaaagcacagtcaccaaagtcctcattgacactggtagctcagtcaacgtcatcttcaaggacgttctgatgcaaatggtggtcgacttgcgctcaaccgaacacaacgttcaacctttaacggggtcgacggcgatattgttatgaccgttggaacaataatgctgtcaatctacgtcggcagaacaatgcattatttcaatttcgccgtcgtcgataaaccgatcgtttataacgttattctcgggaccccttggttacataaaatgaaagcagttgcgtctacctaccatcagtgtgtgaaattccctacaacgcatggaatttatactctaagaggcgacccgcttgttgctcgtatgtgtttcatagtcgagcgtcaactcagaaatgctaaagcttttatgataactgaacccactccttcacttgatgaacgcatagtaccaaggactgaatcggtaatccaagttaacattgacgcaattaaccctcttcgatgtgttggtattcgcgctgatttaccgcaacaattgaaggacgagctcgtacagtttttaagtcagaatgtcatgaccttcgcatagtcaatg

SEQ ID NO: 557 - DNA, 3000 bp, Unknown
  misc_feature (1)..( 3000): cDNA_ID_1695956_gDNA_ID_1591939_Annot_ID_151733 3000 nt of promoter + ATG
ataagatggataagaaacccagcaagatcatgtgggatgtgccttgggaggaacttatggcgttggaattggcaaaggcaggtagccaaaggccctcgcatctcatactgcatctgaagagttttcggaagtcagagagttttgctcaggttataaaatgcagcgtgccagaagacttaaatggactagaacctcaagctgtccgaatctgttcagtagtgcgcaaaatgtggaaagcatatcagtctaacatgaaaaatcttgtgctcaaggttattgctatcactattctcattatagttatagaattgataatttggctatgattcaagtgaaatttacatttgaaattactactcccaagatgctttggtcttctattttatagtaaaaatataatgagaaaacatgttttaagttttctggtttatattccacataacttactaaccagtgtaaattatgcatatattgaagctcataccagtgcaacacacctaatgaattttctttcttctcattgcaggttccttcaagccagagacatgtgtattttgcttggaatgaggctgatggaagagactcaaaaacatacaaaaacaaagctattattaaatcgagagaactttcttcttcaagctctgtctcagatgataaaaagcttgtcaaacatagtatcaacttctcaaaaatctggagtagtgagcgagaatccaaaggtcgatgttctttgtgtaaaaagcaggtaagttcctttccatcgcaatctatatctttgagcttagaaaggggtttccctgttagtacagaaaatttctgattttcttgccttctagattttatttcttttgatgacactcgaaaattttgggttctagcctaagctaagaggtggagaccaggatcaaaatcttaaacccttgtcatcaatacatgtcaataagaatccttgatttataactttatgagacgaaacatgtataattcaccccccacatcaaccgttttgaggttttctttacaattatttcctttttggctttcaggattctgaagatggaggagtttgcactatctggagacccagttgtccagcggggtaagtatagccaaaagagatttaaaattccaaaaatctagtttattatttcttaacttggttatttagtaccctaatggtgatgctgtagctgcattgagccgttgaaacttaagcagtttcgtcattgttgtttgccagattcgtgtcagtgggtgatgtagctcacgttggtagccatcccccaaatgttgctgctgtctacaataacaccaatggagtgtttgcacttcctgtgggttatgaccttgtaagtatctctctaacattttatttcaaccgtaatccgttgcatttaaccgcacagtattttcaaccttgaactcatcgtatgcattaagtgctcagcatccaaattttgagcaaacgcaaactctatcaaacctgagtttgtgagttttagcatgatacatatatgtttattcacttgtcaggtgtggaggaattgcttagatgattacataagtcctgtatcgatctggcatccacgggctcctgagggattcgtctctcctggatgtgttgcagtggctggtttcatcgagccagagctcaacacagtgtattgcatgccaacgtctttggccgagcagactgagtttgaagaacagaaggtttggtctgcacctgactcgtacccatgggcttgtcacatttaccaagttcgaagtgatgcactccactttatggctctgcgacagaccaaagaggactctgattggaaagcaattagagttcgagatgattacaggtccatagaatctgaatcgggaaagaatttgcgtttagaatgaaacttttcacttctttttttttgggcttttgggaaactattacttcatgcaacgaagtagacttgcacacaaagagagtgtttttttgttggttttttgtttggcgtgaaaagagagcttttatgttgatattttttgtacatttgtggataaaattacttgtgctttctaggaaggatgtatctgtacaagttattattattacagaaatttgtcttagtcttaataataataagattgttagaagattttaatttataattaagaaaacagaagactatttctaatttctttttattgttttggtatattttagctcacatctttttttaatcattatatgtaaaaaagcttgaaccaagactagttggtaacattcagagctctctactgattgagtaatttcgattactgaacagaagtatcaatatcgtgtggtgctctacacaacacaattgcgtctaatattataagattgttaggttgatttttaattattacatgttgattgttgataaagtttaaaagcctttagttgtggcgggaacgtgcaaagcttaatacacgaccaatgcactactagagcttaacgcgctactttggcgagtcaattacatcgctcaaatttacatcttgagagtaaacggcccgcgtggacggaattttaggatcaagatttacagagacgagtcttatgattcattgagtcaactctcttgcatctaaaatgagaaaacaatattttagattttgtttttgattatagaaagcaggttgatcactatgtatatatatttctctatattaccctccactaaaataactgaaaagaataatcaattttggccataaccttctttttttaactaaaatttacgaatcaactattatttgtcggtaggagcgaaaaaccgttatgagagcatagtgctactagtggatcggtaaacaataaatgccgtaataaagaaatctaaacgtcacgcgcgtgatgaaaaaacaggaagtaaatcgtcgacgtcgttattcaactaccatttctggatcacaactcccacacactcttttaaatcaaaacaaaatatctctttcctgttagagacaatg

SEQ ID NO: 558 - DNA, 234 bp, Unknown
  misc_feature (1)..( 234): cDNA_ID_1695975_gDNA_ID_1591948_Annot_ID_151741 3000 nt of promoter + ATG
gattcagctrtaataaatgaacgggcatagatcatctttcatctaaaaattggaaaaatttttcttggtaaaaaaaaaacaaccgaaagtgaaaaaaaaagagaaaaacccagaagtcaaataacgataaactagtggtgactactaaaactcatattatagcttcggatcaaatcccagatctcttctcttcttcttccacatttacacaaaaaccctagatccacaacaatg

SEQ ID NO: 559 - DNA, 492 bp, Unknown
  misc_feature (1)..( 492): cDNA_ID_3057138_gDNA_ID_1591950_Annot_ID_151744 3000 nt of promoter + ATG
tctctgcaaaaaaaaaatccttgggaacaccaaacgacatcaaaaagctgtcgtttcatatcctctcagatccttaaattctcttccactccaaattctctggggaaaggtcaaacttttggaattctctctgtctccgacttttgttcttcctctccaaattcatctgtaagtttctttactgtaataaaatccagatcgatcacttgtgtaatgatacggacattcatgtacgaactactgttttgataaatgcttttaggtcagatcatctttgttattgcaaagtcttagattttttcttattacacgttaattgtggtttagctttgcattatcttaattaatcagttgttattgttaaaattaaagaatcatttaattgttcttgattttgattttctctctttgaatttgttatactttcttctttaacagattggattgaagtaagttagtgatgcaaattctgagtttttcgagtttagtatg

SEQ ID NO: 560 - DNA, 1721 bp, Unknown
  misc_feature (1)..( 1721): cDNA_ID_3410213_gDNA_ID_1591956_Annot_ID_151750 3000 nt of promoter + ATG
aaaaaaaaatcacaatctctatgaaacaaatctcatctttcgaagaagataatgttacaaaagacattcaaacagaaatatttgtaatccttctaaaaaactgacattcattgtaatttcttattactgtggatttattcatattctgtcgattagtgactagtgtttacataattatgaaatacgtgactaaaaataatatagttaagagagactacacaaaagtacactaaagtaaaaaaacgacaccaagtcttatgtactgtaaactgcacgccgttttcagctatcttaaacgacataaagttttgccttaaaccctaccatcgtcactcactctgtcctcgataggtttagagaagaaatagattttgatcgatccttacaacaaaaatgaatttccgtaatctgattgcttccggttctcgcctcggcaagaggttctgtgcaacggtatttgctccggcgtcggcgactggcatcgtcgaagcctctgtttcttctccagcggcggcgaatgtcgtcgaagcctctgtttcttctccggcggcggagaatggcgtcagaacctctgttgctgctccgacggtggcttcaaggcagcgagagttgtacaagaaactttctatgcttagtgtgacgggaggaacagtggcagagacgttaaatcagttcatcatggagggtattactgtcagaaaagacgatctctttcgctgtgctaaaacccttcgcaaattccgtcgacctcaacacgcttttgaggtccctcttcatatctcttaagcaagtatctgattttaacattgaaattggagatatttcattatctatggaaaattactcttaaaggggctggctttagatttagggtttagtgatttcactagttttagggtgtaattagggtcatgctcgttgttgaatgaaatttcacttttttcgaatggatagagattaaaaatggcatttttaagtttgttagagtttgattgagtccattgttgatgaaatttcagatctttgattggatggagaagaggaaaatgacattttctgtgtctgatcatgcaatttgtttggatctaattggaaagactaaaggtttagaagcagctgagaactactttaacaacttagatccttctgcaaagaatcatcagtcgacttatggggcgctcatgaactgttactgtgttgaacttgaggaagagaaagcaaaggctcattttgagataatggatgagcttaactttgttaacaattcgttaccgtttaataacatgatgtctatgtacatgcggttgagtcaaccggagaaggtacctgtgttggttgatgcgatgaaacagaggggtatatctccttgtggtgtcacttactctatatggatgcagagctgtggaagtttgaatgacttagatggattagagaagattatagatgagatggggaaagacagtgaagctaaaaccacttggaatactttctctaatctggctgcaatctacactaaagctggtctttacgagaaggcggattctgcactgaaatctatggaggagaaaatgaatcctaacaaccgtgattcccaccattttctcatgagtttgtacgctggaatctcgaaaggtcctgaggtttatagggtttgggaatcgctgaagaaggctcgtcctgaggtcaacaacttgagctatctagtcatgttacaagcgatg

SEQ ID NO: 561 - DNA, 514 bp, Unknown
  misc_feature (1)..( 514): cDNA_ID_1695999_gDNA_ID_1591960_Annot_ID_151757 3000 nt of promoter + ATG
aaawatytytcmcagctcaaaaaaaaaacagtagtttacaaaatactgtatgcggttctcaaaaattgatatataaaaggacaaaaaataatgtgttacacgaatatattttgttttgctctagagcgaattgtactatactaaaaaaaaacacataagtatgctagaattattaaaaagggtccaatctagtttttgtttgcttcgtacaaggtcccagaatgttttaggaccgagtgaccgaccaagatggattcaaggacagtattacatggctttatgagatataaacatcattacatcaaccaaaagttgagaaataatatagtattatttcaactttgaaattgtatgattcacatttaacacacacaccaaatacttttgttttgttatatacacggagagctcacgtacctctgattcaacaaaatacattacggagcacacacgtctgtgtagctctttctttcaacattttctaccttcttgtcaaagaaagagagacacaatg

SEQ ID NO: 562 - DNA, 1008 bp, Unknown
  misc_feature (1)..( 1008): cDNA_ID_2178651_gDNA_ID_1591961_Annot_ID_151760 3000 nt of promoter + ATG
  misc_feature (9)..(9): n is a, c, g, or t
  misc_feature (18)..(18): n is a, c, g, or t
agaaggaanctgtttcanaaggtagacagttgagaagcagtggtaagaggaaaagacgaggtaataatgtttcaaatctatttacctcttgactcttgtaataatatctgttcgataagataaaactaaatttgttgattgatgtgtgcaggaagaaagtagagtttgaaggtttaaatgggacttctagttctatggaaggagtgggaagatgaactaaaacttagcataacagctttttgcgagttttttggctgaacagtgaagttgtgcaatgaggggattgtttttgtgtcttgttatggagacaaacatggaacgttacggctaaatattttgattttggtaactacgattatttcatgatattttatgatttggataagggaaagagaaacaaactttaagaaaaaggttgaaagagaagtcccaccaaaccaaaaaataaatcgtaatcacacaaaaaccaaaaaactttataaccgaactaaaccaaactaaaccagataactaaatggccacctacagatttgtgtagtggaatttaagccattaaaaataaacagttttaaaattatgttgataaaccctggcttgatataataagataagggattgaagacataattcgttgagaattgacgcatttaccccttaatttatgatgtgatcaactaactaattagagcccaattaggattgagaaccggtttttgagtaaccggtacaataatagatccggttaaggaagaaagaatagaaagagacggcacttattcctccacacggtaaagcaaaagcccgtaggacgaagacgacgacgacgaaagtctactcaacttttttgcttccttctgattctctctctctccgcaatccaatcacgagaaaccttcacgtcaccatcccttagaaaaaccctaaaatctcatcaaatcccaaaatcagggtcttcgactagagattctctaatcccgcaggggaagggaacaacaaacaaacaagatg

SEQ ID NO: 563 - DNA, 3 bp, Unknown
  misc_feature (1)..( 3): cDNA_ID_3447798_gDNA_ID_1591976_Annot_ID_151782 3000 nt of promoter + ATG
car

SEQ ID NO: 564 - DNA, 335 bp, Unknown
  misc_feature (1)..( 335): cDNA_ID_1696097_gDNA_ID_1591979_Annot_ID_151789 3000 nt of promoter + ATG
tggaatcaacattggatagatcaatcaatcaagaacaaaatattcaaacagatacttactttcccaaatggggttttaagctccagaaaccaaaagaaccaaaaataaattaacatccagttaaaaaaaaaagaagctttaggtgagtttgcttcaacatgaaacaatggatgcccaaaaaaaaagcctaacattgcttgttaaagcaaccaaattttctatgtttgttttttctaatatatttacttcaccaatcaccaccacaacttccctcactcttcttccaagtgaagttattaaccaaaattacagataggaagaagagtgctgcaatg

SEQ ID NO: 565 - DNA, 292 bp, Unknown
  misc_feature (1)..( 292): cDNA_ID_2187093_gDNA_ID_1591980_Annot_ID_151792 3000 nt of promoter + ATG
atttggtacttactacataaataatagtgtagtgccaaattaacagggctaaaatggtaattagtcactgccttcttcgtcttccttattagctttatcatcttctccaaacaaaaaaaactgccccacacgaattacacacacacaactttattatctgtacacgtatatgtgtgtgtatatatatatacatactcatccacaaaaactcgactgattgatttctccatgaacaacgtcctcctttgatttcacctttttttgttgtcttcttctttcgaaatcaatcatg

SEQ ID NO: 566 - DNA, 2640 bp, Unknown
  misc_feature (1)..( 2640): cDNA_ID_1696171_gDNA_ID_1591995_Annot_ID_151814 3000 nt of promoter + ATG
  misc_feature (99)..(99): n is a, c, g, or t
cttctggawcgttcagcatgaaaccgatmttaagggtttcgtccttaaacctcacctccgactcactttcttccgtactatcaatctcttctcaaaggncccattttttttttttttattctgcgcgcttcttctctcttgttatgcttctactgaatttcccaatttcgtctcctttaatccttttttggcattggctaaaaaagttccttttttctgtggattacgggtttttttgaattttttaggttttcgcttgattgaaaaatcttgatttttttctatggagatgattgtaatgcggtttagggttttgcagtttggagcgtacccggtttttgtggttgatggaacaccatcacctttgaaatctcaggcgagaatctccaggtttttccgttcttctggaattgatacttgtaatctacctgtgattaaagatggtgtctcggttgagagaaacaagctgttttctgaatgggttagggaatgtgtggtataagatggctttcccttcaaaccttaatgcttgttttgtttcacattgttttcttatgactttttttggttctctaggagctactcgaattgctcggtattccggtgctgaaagctaatggtgaggctgaagctctctgtgcacagttaaacagccaaggttttgtggatgcttgcattactcctgatagtgatgctttcctttttggtgctatgtgcgtgatcaaagacatcaagcctaattcaagagtaagtattcatttgtaactgagtattaccctgactcacttatcgtctctttaccatcttaatttccttgtgtgcaggaaccttttgaatgctaccatatgtcacatatcgagtctggcctcggtttgaagcggaaacacttgattgctatttctctattggtgggaaacgattatgattcaggcggtgttcttgggattggtgtggataaagcactgcgcattgttcgtgagttttctgaagaccaagtacttgaaaggttataatccataagctttttgtctctgctttttggtgactggtcattttcttgaatgtgttgggatatatattttcgtgcagactacaggacattggaaatgggttgcaacctgcagttcctggtggaatcaaatccggggatgatggtgaagaattccgctcagagatgaaaaaaagatctcctcactgttcccgttgtggacacctgggcagcaagagaactcattttaagtcctcttgtgagcactgcggttgtgatagtggttgcattaaaaaaccattagggtttagatgtgaatgctccttttgttccaaggatcgagatttaagggaacaaaagaaaaccaatgattggtggatcaaagtctgcgataagattgctctagcgccagagtttcccaacagaaagattattgaactttatctatccgatggtttgatgacaggtttgcactgactttatgacttcgtgtccgtattgcatgatcattgttctgaatcctaatgtttatgcacctctgaagcaggagatggatcgtcaatgtcttggggaactcctgatactggaatgctagtggatctcatggttttcaaactgcactgggacccatcttatgttagaaaaatgttgcttccgatgctgtcgaccatttatctgagagaaaaggcaagaaacaacacaggatacgctttgttgtgtgatcaatacgaatttcattcaatcaagtgcataaaaactagatatgggcatcagtcctttgtaataaggtggagaaaacccaaatctacaagtggttatagtcatagtcacagcgagccagaagaatcaattgttgtattggaagaagaagaagaagtggtggaagaagaagagtctgttgatccgttggatggtttaaatgaacctcaggtgcaaaatgataatggtgactgcttcttgctaactgatgaatgcataggacttgttcagtctgctttccctgatgaaacagagcattttctacatgagaaggtaatacattggatctctcagtctctcgctatctctatgagatgccttttcttcccttagccttgactgtttatgtttgttaaaactctcagaaactgagagagtcgaaaaagaagaatgtttctgaagaagaaacagcaacaccaagagcaacaacaatgggtgtacaaagaagcattaccgatttctaccgttcagcgaagaaagcagcagcaggtcaaagtatagagacaggcgggagttcaaaagcttctgcggaaaagaagagacaggcaacttctactagtagtagtaaccttacaaagtcggtcaggcgtcgtctcttgtttggatagaacaatcattcttgagtaaatcataccaattttttggtctgtatataaaaaagaaaaaaggaagtttgcatttttcttattaaaaaattgcaaaaaacaattggtgctgcccaggatcgaactggagaccttttgcgtgtaaggcaaacgtgataaccactacaccacagcaccttgtggcattatctatagagatacgtaatataacgttactgttattctaaaacaaaaactgattccattagtagagagagcagaagaagtttattggtcttatcggaaatg

SEQ ID NO: 567 - DNA, 286 bp, Unknown
  misc_feature (1)..( 286): cDNA_ID_1696175_gDNA_ID_1591995_Annot_ID_151815 3000 nt of promoter + ATG
  misc_feature (99)..(99): n is a, c, g, or t
cttctggawcgttcagcatgaaaccgatmttaagggtttcgtccttaaacctcacctccgactcactttcttccgtactatcaatctcttctcaaaggncccattttttttttttttattctgcgcgcttcttctctcttgttatgcttctactgaatttcccaatttcgtctcctttaatccttttttggcattggctaaaaaagttccttttttctgtggattacgggtttttttgaattttttaggttttcgcttgattgaaaaatcttgatttttttctatg

SEQ ID NO: 568 - DNA, 291 bp, Unknown
  misc_feature (1)..( 291): cDNA_ID_3038039_gDNA_ID_1592000_Annot_ID_151825 3000 nt of promoter + ATG
gtcagacactcaagtttgattctggaatatttccgtagaacaacttgtttgtccccatgatgctcgggttgttttgttagtttgtcttcgtattgtagtttacatcattaaaaaagtaggcaattcatgtatattcctccactctcagtgtatacctgaacaaaagactcttgacgacgaaaattacgttgttttctgttataagcagattgatttcatggcatattgggtgttagagtttacagcttaatgctagagtttgtttgcaggaatacaggtgagttcatgatg

SEQ ID NO: 569 - DNA, 1887 bp, Unknown
  misc_feature (1)..( 1887): cDNA_ID_3057206_gDNA_ID_1592003_Annot_ID_151830 3000 nt of promoter + ATG
taaggacatgaaaccgaaagacttaactgaaccagagctggtttagtagtagttaagmggtttaagtctttgtttaagacaacaagaaatattaaggcttatatgaatttaatcttttaccaaaaataaaaagaggcttatatgagccttgccatgttcatgttgtgatcattagagatagatatcttgatcgtgaatctccaaatatgttagcgctcgaaaaatcttaaatcttgagatagtgaattgctggattccgttctcgctgagatataggatcaatcacaccgattgaccttaactcgtaaacatcgtgcgccatcatcgtctttctttattctgtttcttcgtttatgttctgttcctgatctcgagtgacttgattctcttcgatcttctgtgacaatacttgatcaaagactttttcccatagaagatcaacctccagttcacaaacggaagaaagaagtgatgatgaagaaccagtcaatgatcaagtccaaatgtatcaatggtaatgggattgtgggaatagtagtcacaagaaaaatcataatagatataactggaataattatcaattttcttctgctcaaactccttacaaactctctagaaagcataaaaaattaaagataaaaacctaaatttttttaaaagaactacttagaagttttagatattttttattttttttttgtctgcaggaggccccacagaactggttttactctatttgaaggtggtggagctgttgatttgagaactgcatttttattctcttcttttttttactaatatggttaagtaagtacaaggtgccatgaaagtcaaacgttgaattatggggactcctaataacacatgcatttccaccaatttccctgaaaaaaatacattagatatgtaattttataatatgcagcatgtcgtagagttttgtttattctttatgcaacaggtagtagagctttgtcttctattctttttatgcaacatgtcatagtgttttgtttactattctttttatgcaacatgtcaaagacttttaaaaaaaaacacatattttcacaagtgcaaatggcatctatcgagattgctattattattagatttttgactttatagagttaattgtatatttttgaagatgcatggtaaactactaaacttataaaaaaaagatggcttaaatatcaacttattaaaaggtttattttcatagtaagttgatatttaataactaaagagcaagcctttgacgaacctttgacgaagaaaaaactaaagagcaagcctgtgtcttcttcctaaaggcgacaacgagagagtttcttggcgccttcaagaggtaagtcacttttcctttttcgtctttccttttgctcatattaatttctttgtttttggtgaaagatatctctatttttctctcgatctccggagtcttgctagttaaactgtgttcatagtctggatctagaaagagatacagattctgggtacgcttgaagatatagtgtcaatatttattaaagaaagttaattataattgtgtttagagatgatttctagctattcgattagatcgcactagtattataacatcctaacaaaaatttattgctgtcttgatgctattgtcaatttgtaaaccctcactatgaatacacatatataaaggagttcagagttcaatattgtttgtattattgatcacgatgaaatgcgtacaacatcttttaaaatttaatcgaatcatgaaactccaatattgattagttttacctcttcgaacttatattatttacttcttgcgataataacatgtttttcaatagtaaacttaagtcctattatcataatatttaagcaggagccagtatg

SEQ ID NO: 570 - DNA, 23 bp, Unknown
  misc_feature (1)..( 23): cDNA_ID_3057218_gDNA_ID_1592007_Annot_ID_151839 3000 nt of promoter + ATG
gtctggtcaaatgatcgaggatg

SEQ ID NO: 571 - DNA, 284 bp, Unknown
  misc_feature (1)..( 284): cDNA_ID_3599763_gDNA_ID_1592018_Annot_ID_151852 3000 nt of promoter + ATG
aaaaaaaatgttctgtggcaatgtcgttggttcttgaaaaaatgggcttacgacacaacacagttaaacttaatgggctttcgtggtttcaagtcattttaagattttaataatataatactttaatggaaataatgtcagccgttggatcgaatcctgaacttgatcaattgaacaacaccgcctttggaaatttgtttctctcttcaatgcgataattctctcttcctcttcgaattttgtgagtttcttcgagagttgaggaagagagactcgagaatatg

SEQ ID NO: 572 - DNA, 1747 bp, Unknown
  misc_feature (1)..( 1747): cDNA_ID_1696402_gDNA_ID_1592038_Annot_ID_151886 3000 nt of promoter + ATG
gtgagactttgtgtcattaggttaatcggttaattcatacctatagaatttcattatgtttaattcatacacactttatacgactctgctaaatcatactttcactcaatagaaatttaaattacatacttgatcttgtatttttgtgcttgaatgtatttacaaactaacactgttactttgccgtcaaacgacgatgacgtggaatccacttatctatgtcttccatgtctattaaaagtctgtgtatgcaatggtcatcgtagttttaatgagatcgtaatgaaataacctcattattaagagatgtttgagattacaagtttaagcctaatatccagaattgacaagataattagaagcctaaaccaaaaaaactttaaaaccatcttcaagcactaaaattcccaaaaagttttatacagcaaaaacttttataacataaattgaaaccataatcaacaacagtcacaatcacagaacaacaaatcgaataagaaaacttatcatgatcaaacaacttatcatgaagagacaacttaaattgaacacaatgctaaagacatagtaagcattaagcaacttacactatctccgaaacaaaaattaacataacaagaacagtgacaacaactttaacaaaacgacaatagtggcaacaacttcaacaaaaccaaaacagtcacagtaaattaatcaaaaccaaaacattcatacattttacaatcaaagaatcacagccacattagaggactaacctgtcgtctgagtacaacaaagccaagcttcagttccaaaatatttcaatcaccaacacttgccaaaaaaaatgcagaatcagtataagacaatacaatgtagctttaaaaaaaaatgggttaacaaatcgattatgagaaatctaaatcacaaaacaagatctttgtgaacagaatgtggattaaaatggtaaacggacatcaaaatcgtagaagttttctctttaccctaaatttcaaacaaatcaaagaaccgtaatttcaaactaatcgaagaaccctaatttcaaaatgaaaaacaaatccgattatccttacaaatctactgaactaggtcgaaattagagacaatctcaaccaaaattcaataaaaatagaacttatggaaacgaggaaagacatgcctcgattttagctcactgacagctgttgcgcatgagaatcggactacgacagagtacaaatccgacctttatacgacttagaggtttgagtatgagctttgaggttagagatttgagctaaatttgtgataaatctgagttttgtcgaatagaaattttgagagaagggttttggttagtgtagttgagactgaagaaatttgtggttagaaaaatttctcgagacttaagaaggaaatgaattactgttgtcgtgctaaatggtttttttggttaagtgttggcagattaagtcattttagattcccgctcattaaattcctatcatagcgtttattaaccacctatgactcaatcaccacctaggatgattgcaagaaggcttttctatcaaagttcttctccaatgccagaactgcaagactcagaaatgagatttctggtttctcacagaagactggtgaaagcttctgtgaagcatgggagcgtttcaagggttacaccaaccaatgccctcatcatggctttactaaagcctctctgctcagaactctttacagaggagtcctaccacgcatcaaaatg

SEQ ID NO: 573 - DNA, 204 bp, Unknown
  misc_feature (1)..( 204): cDNA_ID_1696416_gDNA_ID_1592044_Annot_ID_151891 3000 nt of promoter + ATG
gttgatttactaccttttccattcatttaattcattaaaaattactaagtctctttatcaaaatacatctttatacaaacacttttttattgaaactttaattgccatctcattatttaagtaagacaacacgagctctatctacctcatcatctagacaacaaaaaacaagaacatacagaaatttcacttgttcgaaaaatg

SEQ ID NO: 574 - DNA, 285 bp, Unknown
  misc_feature (1)..( 285): cDNA_ID_1696434_gDNA_ID_1592049_Annot_ID_151899 3000 nt of promoter + ATG
cttctcaaatttccatttttttcttaatctctcccactcccacccataaaattagtttkgtctttctttccccaaaaatctttacttaaaatctttttcacccttttgctttaacttttgtttgctcctcctctggatcgtatcagtaaactggaagaagaaattgtgagaaaaaatggagaaaaccaagatgattacgtctatgacctgttgaagaaaccctactcagaataagagtaaaactctgtgatttttctgactaacagagagagagacacctaaatg

SEQ ID NO: 575 - DNA, 44 bp, Unknown
  misc_feature (1)..( 44): cDNA_ID_1696439_gDNA_ID_1592050_Annot_ID_151901 3000 nt of promoter + ATG
cttttccaggtggacccaagtttgaacctttgtaccgtgatatg

SEQ ID NO: 576 - DNA, 41 bp, Unknown
  misc_feature (1)..( 41): cDNA_ID_1033422_gDNA_ID_1592082_Annot_ID_151932 3000 nt of promoter + ATG
attggcatctgaagaagaagaagaagaagaaaggagccatg

SEQ ID NO: 577 - DNA, 1775 bp, Unknown
  misc_feature (1)..( 1775): cDNA_ID_1696594_gDNA_ID_1592089_Annot_ID_151948 3000 nt of promoter + ATG
gccgccatctaacagaggagtgtaggaggcaggttcgtcaatagaatcttccaagatttcgtcagaacgtgaacgttgcttagctatagcaggagcctgtaagaagctatttcgtaattctggatcacgtgaacgttgcctagctaaaagaggaggttctaagaagctattccgtaaatctgaatctgattgacggggaaatggagagtctataatagaagctcccagcctatagatctgaaaccataacagagaggacgatagcctcacaacgaacccagcaatttccatagccagggtgagtttcacagagaagatgtaaaagacttgatacatatcagatgaaatgttcctgcattaacaattaaatcttttgtcagttataggcagcagatgaatactggctcaacagaatctaaacacgacatagcaaagatttgcaaaaaaaaaggtttaaagatcaatcagttcaaaaagatgatgagccaatcaagagaaattcaggacagtttacaatatgtgatgcaatgaaaattaaacaagacagagcaaactcttaaaccaaatatttgatcatgatcacaagcacggctgttccaaggatagtgacataccaaatctctttggagaagagaatgaaccatgagacatcaagaagaatggcgcagaaaagaagaaccgcataggttctgccaagactttggctattactctcgattgctactaacccaaataacgcaatcgccaaatttatcagcacgactccattgtacaatgcccctagtgaaccgatcaacgcgcaccctatctgaaacaaatgattcatcaatatgagtttcttgcacttctaaccacaattaaaagaataacaaacaaatatcgacagagaaatcgtagaaccctaatcccaaacagatacgaacaattcacgagaaaaaaacgtgaaatcggaggaaatgaaacaactacaaagcgattacggatttacctgagcatagataagaatcaaaacgacagattggagcctaacgtagtcgcgaagccaattatgtattcgatttcgtaacgaaacacaaagcatcgtaaaatctcaacctcgcagctctcgttacttgttacttcaatggactttcataatacaaaatggctcgacgattctgatgctaaattgcaattttccggcgaacgaaatcggtgaatcaagagagaacgacgatttgagaattttcgtgagggagaaagtaaagagtgtctttggcgggatcgcgttgcagaagaggcaacaaaataaaaaaatgaggaaacgaaatattccgttcaatcgtgacgaagttattataagatttaaggaggtttccgtttcttgtccagagtgacggacgcttaacggagtcacgaaattttgggccgtattggaaaatctttaaaagcctaatcaagcccaaaacctcagaccggttaatatctgaacataaccgaaaccggttatttcggttagcgattttcgtttcaaaaacgacgccgttaattccttacatgtcgactactcatatgtgtcgcccagatttgaagatcggagatatgaatctcttctttctctggatttgaaagttcgataaaaatctactgatacatcgacttctggaagcgatctcgatctctctaggtttgtgattatctttgaatttgctgattgtttcgttaggcgtgaggaattgttcgattgatttttttttccttttgtctccggtagaattgtttcgacgacgaagatg

SEQ ID NO: 578 - DNA, 651 bp, Unknown
  misc_feature (1)..( 651): cDNA_ID_1689767_gDNA_ID_1592093_Annot_ID_151958 3000 nt of promoter + ATG
  misc_feature (17)..(17): n is a, c, g, or t
  misc_feature (27)..(27): n is a, c, g, or t
  misc_feature (33)..(33): n is a, c, g, or t
atcgatgtttatttcanatttataaanattgtnttaaaaaaaaaattattggccgtctcggcggcaagcagagagagagagactcaacgttttcgtaacaacaaaactttgagtagcagaaaattatccaaaaaaaaacgtgaaacgcaaatggaaaaaattgagaaaagtaacgcgagtccagtgccacgtatgaaaaaaagagcttaggaccagatacgttaatcagaaaaagaccaggtacgtacgttaattaatgtttttttaaaaaggccaagcacgttagtccagcccacgtggtatttcttatcttaacaacaaaactaattttttaatttaataatcggacgttgcagaggtaatcagatcaacggtagagattacgacacgttatatcactctgcgaaactccaccgctttctggaattaaaaaaatcagagtgtataaataaaagagcagaggtaaaagctatctccagagtttaatataagtgtagacagagagagagagagcttctttcttcttctcttcgtcgctaagagatgatcttcgaatataaatctctgtaaggtttgcgaagaccggagtagtgaatctcggaattgttgaagaagacggtacaccggaatcaattgcgattttgatttatg

SEQ ID NO: 579 - DNA, 98 bp, Unknown
  misc_feature (1)..( 98): cDNA_ID_1689783_gDNA_ID_1592099_Annot_ID_151966 3000 nt of promoter + ATG
ccaccggttcgtctctgacattttgtgcttgatttggccgttacaaaattctgattgctagttcatgagattcctttttgacaggtgacataaagatg

SEQ ID NO: 580 - DNA, 136 bp, Unknown
  misc_feature (1)..( 136): cDNA_ID_2918666_gDNA_ID_1592100_Annot_ID_151967 3000 nt of promoter + ATG
cactagacggtgaagatttgaagtgagagctctctttgcattgctcacccaccaatggatctacctacccttcttcttcttctcctccttttaaaccctaaaagtttctctttccttcaacaacgccacaatcatg

SEQ ID NO: 581 - DNA, 44 bp, Unknown
  misc_feature (1)..( 44): cDNA_ID_1689794_gDNA_ID_1592101_Annot_ID_151970 3000 nt of promoter + ATG
gcaatgcaaattctgtaaaagaacttgtcaataacgaagccatg

SEQ ID NO: 582 - DNA, 912 bp, Unknown
  misc_feature (1)..( 912): cDNA_ID_3052886_gDNA_ID_1592113_Annot_ID_151985 3000 nt of promoter + ATG
  misc_feature (1)..(1): n is a, c, g, or t
ngaagattaggaaatgacactagttataggacgattccaaccttgagcagtggggcgggagttgtagtaacctgtcaaccgcaatatatagcctggtgctcaaaatgagacttgaactaatactaataaggggaatttggatgttcaaaggacttaaccacgattgatgactaaacaaagcagtggttagctgaattactaactaactagagctagctgcctaggctagtcgaaagaacaattctccgttttgagttgaccataaaataataatattcaacaatattggaggaaacatgtttatatgttcttgtaataataatattatagcaaatagccgaagatacgacgaagcgtatatgtgtgaaatgagtatattctacagcctaaaccctcggagataccaaatcaacacgacaacagcgacgggacacctgtatggttctaattcaacttcttgtccacatcttcttcttcttcttcttctttttttaatagatatattaagaaaacaaaacagaaaatctcccacgtctttacaaagaaaataaagaagaagaaaataaggaaaaagaatctgatagtaattgacaaaaataccctcatctcctacctcaagacagtaatatatatgtaacaactcgatacagagcatggcttatctcttatccgaatcctcccaatttgtctgtctctcttttgttttctctgctaacagatctctctaaatatctgttacttttgttcatatctttttacttttcaaactactaattttcctttcgcttcttctattaataacaacactctctctctcagacttcttttcttttttttctacggcgttgattcattcgcaatgacctcagtttctgtgtaccataattgacctagcagattctgtttttaatg

SEQ ID NO: 583 - DNA, 2157 bp, Unknown
  misc_feature (1)..( 2157): cDNA_ID_1689853_gDNA_ID_1592122_Annot_ID_151995 3000 nt of promoter + ATG
  misc_feature (1428)..(1428): n is a, c, g, or t
  misc_feature (1570)..(1571): n is a, c, g, or t
cctcatcaacaagggtatatattgctcaacttgcttcgtttgtgtaaagtggattcgtttcgtgtcagattttagtttcacttcagaatattcacgtaacatttacagactcatagggtaaaattttaagaaagctaattcatatgccattgtagaccagcgcgaagaaaacaatttaataaaacaaataacatgatatgatattatataatattcatctagatcttcatattctacatgaaatatgtggttaggtagactcgataacaaaagaaattgaaataaaagacacttttttcaaatattttaatgggagaacaaaatatcatgttatgggttgtttttggcacaaagcaagaaagttgcatcctcaataaaaacagatctcagacattttgggttcacatgatcctctcacatgcttcctctcacgcatttgaacactcttgactctaccaaataacccactccaatggcatgttaatattttatgaatcacaaccaaacatatatcgactttaaaaacaaattagtatcttactttaatgttagaaagaaaaacttttcatataagagatacacttttttcttttcgtattaaagataaaagtagagacgtatatcaaataccaaacccaccactcatacacattaaagtgattttggtataaaaactgttatcagcttctttgtaatatagctctttgttggttgtaaaatgtcctagaagagtttcataaaaatgtaaggcattggagtgagacactttaatagtttaattgcccacgtcaaaagaaaacttttatttccgtcgatgtggagaaaaatgttgccgtcactaggaagagtctaaaaagtctttaagatcacataacccaaaccgcaagttatggtaaaattcaaagtcttaaagtcaggtccgaaagcaaatacttatttaaaaataccctcttttcctgcaaattactgtgaaaaaaatatatataaaaattctatctcacgtaactcttgaaggcaacctacaataacactactcatgtgatagaaaaacgcaatccatgtgaaaataatcatgtcctaaattcaacctatatcagtaaaaaatttggtcaaaattaagaaaataaacgctattttctttaatcaaacaaacgccacacatccaacattagttactgataggttgtagtggcgattgttaaacttgtaatggcgattgaattagatattcaggtgaattgtatagactatagacacaaaacaatgcatgattgatagaaactaatacaaacttatggcaaaatacacaaacccatagtaaaaaaacaaaacacatgactctcgaataataatggtccaatcaatgtagcagcgtcccgattaaaggaccacgtggctacagaagatacagccacaagagacaccganacggaagggagggacgccaccaccacgttaagtttatttagatccatcgagtcgagtcccctagtgggacccacttgtactcaatgtgcataatcaaattaattgaatcttaatttttaaacaaccatgctttaacagaatnntaaccaaatcattaattgtcaataaaaatctttatatttttattttaccattttaatttttaaaaattaatttctttatcttctctcagatttcttcctatataaacccaatacattaccagtttaatacctaacaattactcaattagtacaagttgttatacaactaaatcttcatttgttaaatcatctttactcaaattgaatagtagtgtgcgtgtgaaaacaagaaaagtggaaaaggacaaaagagagagtaaaggacgcctcctaataaagcactcttcttccttttcactttcctcattgaagagagagccaaattcagcttaaagccccataagcgtaagcgtaagcgtaagcgtaagcgtaagcgtaagcgtaagcgtaagcgtaagcgtaagcgtaagcgtaagcgcggggataaatctctctcttcctcacctgcgttttcgtggagcatcttcttcaacaatggctgcttctccgatctgatcatatcctgatttgaattttgctatctctcatgcctcgaactcgttttgtcgacgtagcatcctagtgactgaggaagaagaagaagatg

SEQ ID NO: 584 - DNA, 1320 bp, Unknown
  misc_feature (1)..( 1320): cDNA_ID_3057383_gDNA_ID_1592123_Annot_ID_151997 3000 nt of promoter + ATG
  misc_feature (1)..(1): n is a, c, g, or t
ntgtccagattaattaatatacaaaataatcccaagacaaacactactatggtcgtactcggtgaattcgtcatgtattatgttagacgaaagaaatatgatcatagaaatgatttcgattagcatcataatggaagtccaaaatcgtatatgatgaaaagagaaagatgatcgttgtaataaagcatgcaaaaggataatttaacataaagatcatggaaggagttaaattttgtcaacaattggaacattttcatttatgttctttcactaaaaccaaacgtaggtcatcctcactcatcacgttaaaaactgtggtagacaaatcaattcataaacatgtgagataagtaattgagcaccgttttgttatatggttccatatggtatctataaaacatagccactaagtaatcaaccagatacaaacaaacgaatttatttcaaataattcacaattattaacaatttcaattaaaaatttgtaaatgataacatggtattcgattcgatcataagcattatttgagttaaacaatcatatgctcttaaatgttaaacttttttcaagtaaacttaagatatcccccgccggtgattcaaataagaaaatcaccgtacattcaaaaagagtgtatagctgttgtaatgactaatttagtgattaaaaatataatatggttatttaggaacagacaaacggcacgcgtggcgatgcttcaacggtggtctgaataaaactgggtccccactccacagcctgtgttcaccttttgcctaaactatcttctaaatcaagtttgtgtttgtagttttgacacaaacaagttattcatgttttgttaataacattaactagatctagttaattaagactactattttgatttgaaagcaatcatactagtagttaattaagactagatctagttaatttagccatccaatcccgcaaaatttgtccaaatagtctcattttacattcatttttgtatgattgcattaaatgacttagtaaaatggcacacaattaactgtttatttggaaacaaaatataggcaattaacacttttctctgactaattgacattgacccttaattttatactccaaatattatctctcactaactccttcctatttagacaacaccttacacgcaaacaaaaaaattaacacaaacttataaatagcgtttcccatctcacttctattcaaagatcgcatcaccaatcgcagtcaaaagaaacgcaaacgcgatctctctctcttaaaaactctgattcattctctcccgcagcagcttttcctaatcgatg

SEQ ID NO: 585 - DNA, 3 bp, Unknown
  misc_feature (1)..( 3): cDNA_ID_1584578_gDNA_ID_1592135_Annot_ID_152012 3000 nt of promoter + ATG
ctg

SEQ ID NO: 586 - DNA, 1169 bp, Unknown
  misc_feature (1)..( 1169): cDNA_ID_1689901_gDNA_ID_1592139_Annot_ID_152019 3000 nt of promoter + ATG
tagatcgattttttgagctctgtagggaagtagccaacaaaagaacagcttcagctgttatcatcaacacggtgagctgtctagagagctcgtctctgtcatggctggaacaaaaagtaggaatttcagtgtttccattaggccctcttcacatgacagcttcaccaccttctagtttacttgaagaggacaggagctgcattgaatggctgaacaagcagaaaccaaggtcagtcatatacataagcatagggacacttggtcaattggaaaccaaggaagttttggagatggcttgggggttgtgtaatagcaaccaaccattcctatgggttatccgagtgggttctatccttggcactaacggaatagagtcattgccagaggatgtcaataaaatggtctctgaaagaggatacattgtgaaacgagcaccccagatagaagtacttggccatcctgcagtgggaggcttctggagccactgtggatggaactcaatactcgagagcattggagaaggagttccaatgatttgcaagccctttcatggcgagcaaaagttgaatgcaatgtatatagaaagtgtttggagaatagggtttcaggtggaaggtaaagtggatagaggagaggttgagagagctgtgaagaggttgatcgtggatgacgaaggtgcggggatgcgagagagagcccttgttctgaaagagaagatcaaagcctctgtcagtagtggaggcgcctcatacaacgcattggaagatattgtcaattacttgaagacaaagcaaagatgttgaacttcatgtaatattaattgaattgttgcaaaatttgcaaagtgtggtttcttttgtatcactcttggtggcagtttgctcaatatagaattgttgcatcacaataaccatcttttcttttgtctttgattactactctctctaacaaaataaagagatgtaactagatgcgtacaccatcgaaccacatgcttcacatgtgcgcaaagagagctaacaaaacatttatacggatgaattagtgtccacaagcgagaatctgatatttctatatataaaacattcaaagaagatgagaagcagagtaatctataagcccggagcttagagagctacttattagttttcttgtaggttttggaaatg

SEQ ID NO: 587 - DNA, 230 bp, Unknown
  misc_feature (1)..( 230): cDNA_ID_1689924_gDNA_ID_1592142_Annot_ID_152025 3000 nt of promoter + ATG
  misc_feature (5)..(5): n is a, c, g, or t
agtgnccgtacataaaaaaaaaaaaacgtcattgatatttgtgaaaagctaagttaaataattcaatgagtgtgtccccaaattctctctttttttcctgagacttttccttgaatcctcttccctcctccttcttctctctctctcgtttctcaactaccgtctctctgcttcttctgttcccaaaaccggaaactttattcgttgaattttcccttgtttctgaaatg

SEQ ID NO: 588 - DNA, 1019 bp, Unknown
  misc_feature (1)..( 1019): cDNA_ID_1689953_gDNA_ID_1592150_Annot_ID_152032 3000 nt of promoter + ATG
  misc_feature (47)..(47): n is a, c, g, or t
  misc_feature (142)..(142): n is a, c, g, or t
gctgacacgtggcacttatagagctgacacctgtcctcatatttttntacaacccttttttgtctctgattttaaaattataaagtttgtaacgtaaaatctttttttttgcatttgtttcgtacttgagagtgtatatttntttaatgcattcatgtgtgattgattgtataataaaatcaaattagtaaacaataccttaatatacattccaaacggactgaattaatggactgaattaatttagcaaatcatatataagaagggtttctctaaaaaaacatgcttccacaagctgacacgtggcacttatagagctgacacctgtcctcatatttttctacaacccttttttgtctctgattttaaaattataaagtttgtaacgtaaaatctttttttttgcatttgtttcgtacttgagagtgtatatttctttaatgcattcatgtgtgattgattgtataataaaatcaaattagtaaacaataccttaatatacatttccaaacggactgaattaatggactgaattaatttagcaaatcattatgaattccatatatgttatcattatgaaatgaatgcattaaatcgaattctaaatcctccaaatactgaatgccaaaatcgtgtttacttccaaatatttcttgcattaaatcaattccaaatcgaccaaatatttaatgctaaatcgtgtaaacgtgtttactactctccaaaaacgtaactcttccaaaaacgtatctcgccttaatataacgaaaataaaaaattaactccaaaacattatggggttttaatgtgattaaagtcatattttccataactgtcaatttcgaattatatcattagtctcgcctcttcctttaaactcgcgtgtattaaattccctaatgatcgcaactctgtttttaatacgattaatgtcatatttcctctgctatagaaccaattgtcttcggaacaatccaaattatttcttatttctcttaaaaacactaaagcagataatg

SEQ ID NO: 589 - DNA, 245 bp, Unknown
  misc_feature (1)..( 245): cDNA_ID_1021259_gDNA_ID_1592151_Annot_ID_152035 3000 nt of promoter + ATG
taataagatgcactaaaacatagtgataatattattttagcattttttaaatgagagtgatagaattattatcctcttaaaagctaaattctaacattcattttgtgtatgttaactctcatgctttttgccttggacaaacaaaagctagacgtctaaaaatagttagaaaataaaacagatataagatgaactaaacactttgggggaaaaaaaaattatgaacttaattagggttctatatg

SEQ ID NO: 590 - DNA, 604 bp, Unknown
  misc_feature (1)..( 604): cDNA_ID_1690001_gDNA_ID_1592168_Annot_ID_152049 3000 nt of promoter + ATG
aattttttattttcgttatattaaggcgagatacgtttttggagagtagtaaacacgtttacacgatttagcattaaatatttggtcgatttggaattgatttaatgcaagaaatatttggaagtaaacacgattttggcattcagtatttggaggatttagaattcgatttaatgcattcatttcataatgataacatatatggaattcataatgatttgctaaattaattcagtccattaattcagtccgtttggaatgtatatattaaggtattgtttactaatttgattttattatacaatcaatcacacatgaatgcattaaagaaatatacactctcaagtacgaaacaaatgcaaaaagaaagattttacgttacaaactttataattttaaaatcagagacaaaaaagggttgtagaaaaatatgaggacaggtgtcagctctataagtgctacgtgtcagcttgtggaagcatgttttttagagaaacccttctttattatataagatataaacacattaccataaacttatactctcttttgatcaatctattgattttgattctctgttttatccggaagtctaaattggatg

SEQ ID NO: 591 - DNA, 59 bp, Unknown
  misc_feature (1)..( 59): cDNA_ID_1690007_gDNA_ID_1592169_Annot_ID_152051 3000 nt of promoter + ATG
gaattagaattagaagttgattcgttttggttcgattcaatttgttttggagagaaatg

SEQ ID NO: 592 - DNA, 3000 bp, Unknown
  misc_feature (1)..( 3000): cDNA_ID_1690084_gDNA_ID_1592188_Annot_ID_152078 3000 nt of promoter + ATG
taaaatccagtggcagccattgtaaataagtcacaactacagaatttatttcacaaaataactgcaaaaatgtatatatagatacctttaaattaagtgaacgagttacagaattttagtactcgatcaaaaacaatactaatacatattgaacattgcattaaattttgttttatccctaccaaaataaataaattagtttcattgttacttgaaaaatgcccaacctaacgttaaaacacgtagtagtgattattgtttacaacatttgtccaattattaaagtcaaacaatccataaactgtttacgctaaaacttgtgattttgacggttgcgggattctagatgatcattggtcaccttgtacccaaagaaatcttattatattattttgggaagtacatttggaatgtaaccttaatttttgtaattaattacatgacaatgatattagaaaaatttaattaaaaacaaaatcttttaatgacgttattaaggttaccaaaattcatttaacgacaatattcatttcttaattatagggcttattggatctaaagacgggtcatcaaagattttctaaactgaatcaaaatataccgagtattcaaatatctatctcttaccaaatataaacaaataagttcgtaaaacaatttaatattttatatacgaaatcaattgaatcttaattacataaaaataaaaattagcacaaaaaaaaagtattcaacaattaaatttttatcaaatctctctgttatataagttttgataatatattcgaataaagtgtaatataacttttcaatttgtactctttaactaatttaagctaactaatatatttgttaatcttatacctatcaaaaccgactatcgtttcttatctctatagtatttttgcaagacttttttggtggattttggtaaaagtgcattcgggtcatatggtacattctcctattaaataaatatggtgcactcctatattattaggtaaaatgtttagattataattagagtcatatcataaataaaattaatattattaaataaatggctttttggcaagacagatttggagagatggggttttgaatcaacaataataaaaaggtaaaatataattaattcaccgtttcaatacgggttaaatctttaatttattatttcttaataccactaatattaaacatatcaaatcatcctaatttagaaaaggttatataaaaccaaaaatattatgtggtatgtataatgttattatatataaaattaaactataaaatataaatgtattagagaatgatgcaatttataaaaataataaataattcttaaattttaaaaattactactttaaaaaaaaatcacgggacgggtaaagaaattacagaacgggttttattttggaattgggttatatggtggatgtatttgaatcaatatttataaaattttaaaatattattaatatactgttttaagaaaggttaaaacttcagttttttaacaattgtctcgtggattcgtggtatagcgttacttaataacaattataaactgtaaaatataaatattttataaaaataaaatttgtaagttttaatatatattacctttaaaaaataaatcgtcccgcggtatatcgcgggttaaaatctagtgattatatattatgaataaaataatttagataaagttagagatcaaatcctattacatccagaaaaataccagtctatatatttgtgatttttattgttgtaacaattgtggtgattagtttacgattttaaacatatcaacaacaaaaataattcagaaaagaaaacgcactcaattaatatagtttttttatagaatgaaacttgaacctttttacacgtataaaatgctttttagtgtaacggttaagacttcatcttcagataaatattttaggaccttaatatataatggtaactttaaaattgttctagacgacggtattattaatattatcaaatacttagtacaacgaatcaaattgactggaactataggaatgttcgaaatggaacatgatccaacaaatatcatacgtggtggattaacttgcttcacatataatttgtgctgaagtccaaataataatatacatggattctggaagtattatagttgggtataaagtcttgttgcatttgcatttatttcttgtacgcaatgcggctaagcaactttcattatcttaccataaaaagaacaaaaacaatcgtatcatattctcactctgcacgaaaagtcaagtcacgtaaattgttaaaagattggggatttgaatattgtatcagaaaaatgttatttaatctacaattttaaactatattaaaacacataattaactaagaaatcctttgtaatctcttaaagtcactaaaaatctaatgcttaaaatatttccaatckcaatgaattttaaagttttttttaccaaatcaattgttctatattactatattttataactttttaaaactctatggttgaataacataatattttgttttaacacaaatcattttaaatggtagattgaatacacttccttagttttgaaaaaatacactaaaagtatgaaatgatgttttttttttaattacaaaacgataactcgaaaacgatggtttaatgaaattatttgatgaaataaagttatcataaacatccttaatctcttcttatacatgtcaactttgaccatgacatgaatggatcgcattcccaatttactaacacaaaaaaaaatgaggaaatacgaaaacagtagtataaaaatagagcaaagccggtgagaaaaaacaagaaacacagaaacagaacataaattaaagaagagtcacattcaagaatctctctcttctcctcctctcattctctcagcggcttcttcttcttcctttttctttcacatcacacaacacaaccactgtgatcttgatttgttaccaatg

SEQ ID NO: 593 - DNA, 22 bp, Unknown
  misc_feature (1)..( 22): cDNA_ID_2183469_gDNA_ID_1592193_Annot_ID_152087 3000 nt of promoter + ATG
tggaccaaagtaccggaatatg

SEQ ID NO: 594 - DNA, 1297 bp, Unknown
  misc_feature (1)..( 1297): cDNA_ID_1690145_gDNA_ID_1592197_Annot_ID_152094 3000 nt of promoter + ATG
  misc_feature (512)..(513): n is a, c, g, or t
ccaccatagaaacaaccattacgctgtcatctctaccaccatcaccattattgcggccgcaattgacacacgaccactgcaaccaccaacacaaatattactacgacctacaccatacacaccatacacaccaccaccaccttaatcacttcttcctctcttccattgcttgtttcatctctctcgcctctcatctttttttttctactttaacttaattaaaacagaaccgaactatagttttctattttactttcaattttgtaccattctatttgctagttagaacgaagaaaaatgaaaacaaagactcacaagatcttattgaatattttctggtttgatcaatatctaaaattgaaaattcctaacacaaatttaaacccaaaatcgaatcgatttcaattcgcttaaggaaaggagaaaagagattaaaagtatataaacatgattttgtcagatttctaaaaattgaaacttgagatgatttcatttagtttaattatttttgnntgggttctatatatagtatcttagggtttagttttcttaaatcaatagatgtttttaaattagaatgaattgatataaaaaaagttaaattttctggaaattttctgttggattggagagaagagaagaagcaacgaagaagatgatgaatgaaaaaggtttgttaaaaaaacattacctttagatcaatatctgattcacaatccattacctttagaacatatggaatattacctttaaatcaatatctgatcaacaaaacgaagaagatgatgagtcatggcaaattggaaaatagggaaataatgcaggaatagacttgtaattagttagagtttttggttacttgctgaattacgtaaattatatagttataatcttaattttttgtcgaaatatggctacacagctaattcacccaaataaatatccacgcgtcatcaaaactatttattgttgacagaaaaaaaacaaacaacagacctttttgtcggtgaaattaattaataaaaaaatgatatatgtgtgtatgaaatgtaagtaacgtcttgcaaagtgtggacctttccgtctgagtaagagtattctgagttttgctcttctttgaaagaccttccagaaatccagactttttgttgtgacttgacgttatctctatgactctccattctttctcaccaaccccatttccccattgagacttttgttgacctaattcctccaaaatctcaccttcacattgctcgatttcagtcctctgaaaaaatctccctgctttgctatg

SEQ ID NO: 595 - DNA, 3000 bp, Unknown
  misc_feature (1)..( 3000): cDNA_ID_1690169_gDNA_ID_1592205_Annot_ID_152105 3000 nt of promoter + ATG
gttcaacactttcttgtaacttagtgaatttcttgctataggtgtgctatacttattcttgtttgtaatcataatcaagtgcgtttgattggaaagtaacgattttgtttcaagactaatctctatggggatgaaattttctcacctttctactttgcatactttttagctagtctctaacatattttcacaatgtacatactgtatatagctctaacgtgggaactcgaagaatgggtaccccctgtagagaagtgtatattcaagttcaattcaaaagaagaccttaagacatggcacctatactctgattctgaatatggaggtacttaaatcacacaagttcaggcatctgcccataatcatgttacagaacctattattgcctgtttacatagtttcttttactttcattccttgttggttcatgttatgaaataatatttctgatatgcagtgcataacaattcttcatgtgatatgctcattatagtgtggatattttactttataggattatcttcggcttcgttggaaattaaagatggaggaaatcgatcagattgcaatggttagtatattgtggaacaagtgtgccttgctttttctttctgttactttttcgcttgggtctgatacaattagtttgtgcaagccagattttcgaattaggctgggaaagttaggccatcgatgcttctttgacttaaatatactgtgatgattttctcatatctagaggcatagaaacgttattgagcatgctctaacgtctaagccaataaattataaaatgatttctcttgaaatttctggaactacagttttcctggtttagctgtttaggctctcttaatcgagcctcaggcgaaagtatgaagtttcttgcttctcataccatttacctctcttcatcatgtttttttctgcaattgggtggtgaccgttttcaccttatgtctcctttaggtgttttctctgggaacctctctacggatatgagggaaggttcaaaatggaatatcaatcggagtggtttctgtggaatgcggtcaaagaaggttaaaatcataggttttgtttttctttactaatcatcacatcatcaatcaaaaccaaagatttgcatgagtttatgcacaacttacttaactaaaaccccctcccatttttgtagtttgatggctttattgatctcgaagggtatgattccatagccctgaggctcaaaggagatggaaggtgctatatttctactgtgagtctcatgctcaacattcatgtctttttgctccagatgaaacacaaggttcaaggagcataacttttttactaaaaactaaaccgcagttccaattcagatatatactgagaactgggtgaactcgccaggacaagcagaagacaactcatggcaggcttttgtttttgctccaaagggaaactggtatacagctaaggcaagtctcgtacttctacaaagcaactagtgttaaaaggggttttgctgtaacttgttaactcaagtgtgacatctttcttcttcaggttcctcttactcgctacttaccaacatggaaaggaaacgtgatagatgcagaaatggagatgaatccaggtcatgttgttggtatgtctctatccgttaacgcacaaggaggtggtttcattggagctaaatcaggcgcaggcgatttccaagtcgaaattgactggatcaaagcagtgaggatgccatgaacgatgatgaaaaaagctttctgatgaacaaattgagaaccataaaaaagattgttgttctctgggtttaattgtaaaaccgggatttgggttaaccggatccaagttgatgaacaaaaacgcttatgaattgacttaaagcaagttgatggacagcaacttgaaaagaaaaatgggccagaatggcaagttgctcaatttatttaccttaaagtgaccataaagtaaaattatctaattcttgaaaaggtaatattacaagttttttgcttttgaaaaaaaagttttcaagataataaccttattaagtttcgttatacaaatcctttatttgaatttcagcaagactaggttataaaattctgctaaagtagaagcacatataaaaatatgtaaattctatggaaattgacataaatagctctaaaattctacaacgttcctacattatatatcaaaaatgtctatgctgacaaaacaagaagaatgcatccagactattacaaaataaatttgatgctctagagtcgttgctcaaatatttattttttgtattcctgccaaactattttttttcttctaaaacatgagtactcgatcggattttgctatactcgactaattttagggtttagtagatttgttacatatacattttgtaacctacatagaaatcaaatgaccaaaattacaaaaaaattcacggttttgatcttaccagtatacggatcattatttttactcagtaaaaaaataattgataaatgatttcttaacctttttctagaaaagtgagtttaatcttccattcatttaagtcttaaaaagctaaaacatttacaaataaaagatgtagccttgttcaaaattggttgcgtatactcacaattcataaactagaaagaaaaaaaacactaaaattaaagtagtaaaataatacactacttttagttttaaaagatgttgtctaaaaaacgaggataaacataaacaactagttcaagtggctagtttctcgatcattctttgttaccccagtctcgtatatataaatagtattatatacaatacaaaagcacgatacccaaaatatcaaactcttcttcttttcccttctcttctcttcttctcttcttccacgtttacgcgtatacacatctctatacatacattaatcttgatccttctttatctctttgcttccaataaactccaaagaacagctctttctttttctcattcttactatcatcattaatg

SEQ ID NO: 596 - DNA, 462 bp, Unknown
  misc_feature (1)..( 462): cDNA_ID_1690173_gDNA_ID_1592205_Annot_ID_152106 3000 nt of promoter + ATG
caggtgaagtgaaaccaaactcatcctttgtcttgacgatttgatttctcttgtttttgtttgtgcaattccctatggattcttctttggtcgttggtcttttttgtttttgtctgtgggtcgatgtgattttatcaattcttgtctttcaagtgtttgttgaaatgcctcaatgggaaaatgtaaggtttttcagggaatccattaatgggttctgctcaacccaaggattcaagtaaccctataacttcagctccgaatagggctgcagtaaaattgcttaagtctctcttcattgggttatgcgttgtgctagagtttccaaagagatgatctttcatttctcttttgcaacctcttgttatcaatctatgggatattaaggttattctccattttcattccggaaagaaattaaccagttagtgttgttcccattgatccagcaacttcagaactatg

SEQ ID NO: 597 - DNA, 1816 bp, Unknown
  misc_feature (1)..( 1816): cDNA_ID_1690192_gDNA_ID_1592211_Annot_ID_152115 3000 nt of promoter + ATG
  misc_feature (12)..(12): n is a, c, g, or t
  misc_feature (802)..(802): n is a, c, g, or t
caatccgaaatntaaatttaccgattagagagttagatcgggcgatgaagggatcgacggaacgatcgcaatccgcaaaggaacaccgttcgcttaagggttaaggttggccggaggagacaagtttcatcgagagaaagatattttcagaatattaatattttgtattaaacctgttttgttttatttaattacccgcgaattgacgtgtcttttggactggtcccccaattccacgtgggaacatgtgtgcacgtgacggagaactagtggctgtttcaagtcaacaatatcgtcttaaccgttggattggttgataacgagagataatgtaacaactaacaaatctaatggatgttgatgaatataaataatagtatcaacgtacgactttaatggcggtcaaaatgtgacattgagacggtttcattaagtcagtttcagtgccagccagattcgacccgactcggtacggatacttgctcgacgatttatcattcgtttatcgactaatccaacgtttactactccttattcttcgtttgtttttaatgttcttcatgaacttaattattgagacaaagtgaggaaaatatggagagtgtgcttttgttcatgaacatgttctgatttggtcggtgataaatcttctgtatcaagaagatgtttacattaacttttcaaatgacaacatatgcgagaaacaaaacacacgtatcactcttttaacgtacgtaactgctccaacagatctatcttattctttatatacgtttgcttcttcctcaaaacctcatccgantaggtgctggtgcaggtgacgagatcatctttatttagaataattggtgaggacctaaaacgaaataagcgttatcgattgattttatttttgtctctgaatccattttctctgctttgatggaggaagaaaaaactaagcaggtacttatctatattcacaattgggtagttacgtaataaacaagacaccagtgatggaacgaatttagtagagtaagcgagcccgtgatagaacgagtctaaatgtgattcatcgactcattcggagttatggtttgtgggacagtaaatatatatgctgagaaatccactaatctttaagaacttaactataaactctgtatcggatcattctttttattaaggtttgtgctaaagataatcgattctcttggacgattagtagaagggaaaaaatacgcaatggcgcgagagtgtgcgatcgtatgagagttgtaatcccacacgtgcggtctcccacgtttcaaaaaataacgggaaaaattatataaatcacgtagcatgttaataattaggacattatattaaattaacgttttcaaaaaaggaaatatagtgttattgaaaaacacatgtatgacatttatttgggagcattttgcaaagtaaatgttgctacctgacacgtcatatttgccaatttatacatctcttgtagattttcttaattacataaaaagataaactttcatatttgctaacaaaatatgagggaaaaaaatcagcttattgaacggaagatctatttaatattatgaaagttgatttttatgtaattaagaaaaataatcacataaattaataaaagtaaaaacaatatatgatgtgtcactttatggtaagtagtatccaaaataataagctaaagttgattttttttcttgttctgaaaagaagagagaaaacgctttaaatagaggatcctcaccatcaacttcctccactcatcatcattcacagcttcaaattttcaatactcaaattaacaatg

SEQ ID NO: 598 - DNA, 3 bp, Unknown
  misc_feature (1)..( 3): cDNA_ID_1690227_gDNA_ID_1592228_Annot_ID_152134 3000 nt of promoter + ATG
gaa

SEQ ID NO: 599 - DNA, 3 bp, Unknown
  misc_feature (1)..( 3): cDNA_ID_2990735_gDNA_ID_1592230_Annot_ID_152137 3000 nt of promoter + ATG
gga

SEQ ID NO: 600 - DNA, 464 bp, Unknown
  misc_feature (1)..( 464): cDNA_ID_2994202_gDNA_ID_1592239_Annot_ID_152150 3000 nt of promoter + ATG
cttgagagagatgttaatatacaaaagaaaaaaggcacagttggtgtgtgtacatatgaccaaaaacgtcgtggagaaggctaaagaaacagtcgtgaaaagccatttgttgtagtagagagagagagatttgagttaggcaatactgtcactgatttaggcatttgatattttgtaaacaaaattttttggtttatttttggggagtggtggtaaacacactaatatgcatttctgtcacctggagagatgagatgtctctaaaaaatggtcaaagaggcgattaattagttaaatagcaaatggaaaaaacaattagggatgggtttgtttgttaccaaggaattaacataacagctgtaatgctgctgcgagataaaatgaacaatgaagaagcggagacctgttgacttcaaataattttaattagtttcttctgtgcgatagagatcgatcgagagatg

SEQ ID NO: 601 - DNA, 577 bp, Unknown
  misc_feature (1)..( 577): cDNA_ID_1534688_gDNA_ID_1592240_Annot_ID_152153 3000 nt of promoter + ATG
  misc_feature (83)..(83): n is a, c, g, or t
  misc_feature (92)..(92): n is a, c, g, or t
  misc_feature (95)..(95): n is a, c, g, or t
tggcctcgcacgcactcaacaatttggtgggaggtctgttgtggcgatatagttccaagatcaagtcattggagtgaaataancaaaatttncancagggttgaattaaaaaagtatacaattttaatgggtgggtttgtgaaatctctctatagtatagggtggttatgtcaaaaatctataatagagggtggttattgtaattttaatgtaccaacatgtcacaaaggacaaacaagtatgaaaaatctataattatagaagtgaaaagtgaaaaaccaatcataattgaagaattgttaccggaaaaaggaagtgtcttctggtcaaaaaagtcagagaagaagagagaaacgtgaacaatgaagagacagagacgtctcttctcttatgcgaaagtgtgaatcttttaaagctttttgtttcaacatcgataaatgaagtttcttttattgaatttatagaaatttgcacactttaccttgacattaaagcaacaagctttgaaaccaaataaaatctcaaaaacccagaaagcgagtggagaagagagagctgatatgctacaatagaaatg

SEQ ID NO: 602 - DNA, 391 bp, Unknown
  misc_feature (1)..( 391): cDNA_ID_1690266_gDNA_ID_1592244_Annot_ID_152158 3000 nt of promoter + ATG
aattggagacaacttcatgtggtttgaatcgtatatttcagatagattagacatctagtcttctttgatgtgcggtgaggatcttaagtcgctataacgttgtgaaaaaagaaaagaaaaagtcactataacatagatcgcaactaaacaaataaaggacactatacatgtacgtaataatattcatttattttcaacgacaatgttccctagggtggtaacccaagtatttttcatagatattatacttctagcgaaaagccatcaattgagaaaaaaggcctccacgtttgacccgttttgcctataaaaggattctttaagatatggaccttactcatcttctccgttaaacccatttaaatagttttcattgtccttgtgaaaaatg

SEQ ID NO: 603 - DNA, 442 bp, Unknown
  misc_feature (1)..( 442): cDNA_ID_1690312_gDNA_ID_1592255_Annot_ID_152176 3000 nt of promoter + ATG
  misc_feature (17)..(17): n is a, c, g, or t
ctgtgtatatggttcgncattgcattcagtcgtggatattgtagtatcttaggtcattaagcaagatctctttgttagcatatgtagcaaaaaaaagattttgttttgttctttatgttgtttggtgctaatatatttcacaaattctcattgctttctctcatgagtctctaaattgatgttactctctttggatttctttaatctgtttccatggatgattacgtttagctactttaattgtatttctacattgaatttataatgatttggttatatgattaatagttttccttctaataatgacttataattttctctatttcagtttactattgacaatatacttagcttcaattgagctactaggagaccgagttttggtaagaccaaagagacagagaaaaagacttgacttttgaatatagagaattgagagatg

SEQ ID NO: 604 - DNA, 37 bp, Unknown
  misc_feature (1)..( 37): cDNA_ID_2178924_gDNA_ID_1592268_Annot_ID_152188 3000 nt of promoter + ATG
ttacaaaacaaccgacctcaatctacccattgaaatg

SEQ ID NO: 605 - DNA, 1836 bp, Unknown
  misc_feature (1)..( 1836): cDNA_ID_3057552_gDNA_ID_1592275_Annot_ID_152195 3000 nt of promoter + ATG
  misc_feature (23)..(23): n is a, c, g, or t
  misc_feature (97)..(97): n is a, c, g, or t
  misc_feature (151)..(151): n is a, c, g, or t
gggaaaaaaaaaaaaaaactggnacattttgtatgcatttttgcggttataaactttggaattgtaaagaatgaactagattttaatccgcggtacnccgcagagacaatttattttttaaaattagtatatataaaattttgcaaattanatctatttataaaatatttttattttatagtttataattgttattaagtaacgtccttctaaacccgttccaccaaactcgtcctgtaaaaaaaaaacgcggtaccccgctaatttaaatttataattaaaataaatattttacgggattgcaattgtgttttagtttgtcaaacaaaattttgttttaaatagttgtcgaaatctagttcaaattttggagacataagatttagtgaatagataagaaatgtatttagttgcgtttcgctcattttaagggattgcaattgtcttttgggttgtcaaacattttttgttttaaatagttgttgaaatctatttcaaattttggaaaaatctgcgtgatatatgagattggaatatatttggaatgttttttcatttgttaatcaatttattgctgaaaaagacaataattaaaagccaatggcaaccattataaataagttcctccaggatttattttacaaaatgactgcaataatgtatatatagattctatttttatgaatataattccctttatatttggagactatttcctttgaatgatgacttgtctgaatacaaatcttttcgtaagtccttaaaggatatttggtttcccacgaatcaagccaatacaagtttgtgtatgtcatttatgtttaaatgagtttagttggcaaagtaatcaaaatatttcatttcgagaagaacatatagcttacacgcctcataagttagttacctacagaaacttatatggtggggtgatatactttcggattctaggtaagatatagtatatgtgcgttactattgctcatactataaaaatcaccttttggttttgagttatcattttgaaatctacacatgattgcgtgtactcattatttaaagtcggcatagatttctccatatatatgtcatgattccatgaatgttcttttaacatcttaatgcgataacactttacattaaaatattcaagaaaaaaccaagctgttttctaaataaatttagtttgtccacggttaataaaatttaaaattagcgaaatacgtaaataatcaaatgatataaccaaaatgcctattatttttaaaacaacattttattttctctaatctcataaaatactctaataaaatctagttgtaagtgaaaataacactaagcttcaaacacacacgtacatgaatgtttgtttttttctttcaaaaaagctgaacaatgacattttaagtccaaatgaaaacgatggtatcatcttggacttccaattttccattgcccatattttctcttttcttttgtttttatccaattggtatcgaatcattcatataaaattataaatcatgaagtcaaatttttcaatagtaacacttgagtaatagtggtcctaccaactttttaccaagacagatatattttttttaatacactttttaccttttactgtgtttgcctcaaatgagtgtttttaccagtttctgtgtatataaatctgcactccactctcagtttatcttcatccacaagacagttctttaacaaagtcattaaacatttcccttaccttctaaagatcaactctttcaaacacttactctgcatgtaacttcatagattgaacgaagaaccaaaacaacagagcaaaacaaacaaaagatg

SEQ ID NO: 606 - DNA, 220 bp, Unknown
  misc_feature (1)..( 220): cDNA_ID_1594517_gDNA_ID_1592285_Annot_ID_152199 3000 nt of promoter + ATG
  misc_feature (35)..(35): n is a, c, g, or t
tcttcttcttcttcttcttcttcttcttcttcttnttcttcttcttcttcttcttcttcttcttcttcttcttcttcttaaccctaaatcgatccgtctttcaccaacaaaccctaatacatcgatccatctcgattctctcttcttcgattctctcttcttcgccaaactctcccttgcctcttcgatccatctcgattctctcatctccaagaggatg

SEQ ID NO: 607 - DNA, 2819 bp, Unknown
  misc_feature (1)..( 2819): cDNA_ID_1662883_gDNA_ID_1592299_Annot_ID_152217 3000 nt of promoter + ATG
  misc_feature (103)..(103): n is a, c, g, or t
  misc_feature (113)..(113): n is a, c, g, or t
  misc_feature (130)..(130): n is a, c, g, or t
  misc_feature (416)..(416): n is a, c, g, or t
  misc_feature (562)..(562): n is a, c, g, or t
tgattctataaataaaacccataacaccttattaatcggggattttaagtggaacaataggaaactgcaatcgaatcctgacattcaaatgccattttctagnctgaaccaantatgataaaagttgaancaacaaggatcaaatcccacgcaaaatgtctcaccatacatgaaaaatagcatcaacactcgatccaataaccttcacttccagtttcttgttaagcagccgactttacaagaacaaatagcgacgtctctcctagtttctcctttccctacaaaaccattgcagcccacatatctctttataagcaaatcagtgtaagagattggaagcagatagtaaaacagagataaataagctaaaccttaagctctggtaactcaattacgcaagcacattcaacaatctncactcctactcgttctgcaaaaccaaccaattgtgggagtgagaaatagtcaagtttaactgaactgcatatgctgcattatcaaatcttggacttaccaagtagtcggattgcagcagcgagagtcccacccgtggcaatgaggncatcaataataatagcacgctcaccaggctctactgcacctacgtgcatctcaatcgtatctggtccatactccaacgaatactcctccgaaataaccttccctgttaaaggaaccaaatgcagaggcagtttagaaattaacgtccatggataaacaaggaatgcgacaattatttgacactgctcataagtttccaaatggcttaatacatttcttgtaactggtcaagatacacaactaagtccattgatatgtaacagaaaaaataacaaccacttaagttactgcaagttaccacaaagaaaaatgatctagcaaatgagtagcatcatattgatcaaagacactgcaagataaaagtcaccttgctaatgttcgagataatgataaagtgtagacttgggagcaagaagccatttaaactaacaacttcctaattgagacctttcatgtaacttaatgtcaaaatcacaagcaactagaggaagaaataaaaatgtaccaggtagcttcttgggcgtcctcatgggaacaaatttggcaccaatagccaacgcaataggagggccaaaaatgaaacctctagcttcaacacctgcatttaccacaacatcaatttaggcagaaccaaaaatcatccaccaattcatttcaacttttcagtttaagctaaagcactcagtatctaaaaaggccaaaagaaactaaatccacaagctgttaatcgattgaagtaccaaacagaaccatacgagttgttacctgcaacaacagatatgcctttatctttgtatctatcaacaaacaaagcaatagtatccttaaaggcctcagtgtcgagaagaagcgtcgttatgtcctgaaacatgattcctgccaagtatccaaattaaaaccttaagatcccaacgcagatcaagactagagacgatattaatcggtataaatggaaaaaatggagacctggtttagggaagtcggggatgactctaatggaagaggcaatcttagcgattctgggatcttgcacatcttcagtcgccatttcactgtcccgactggctgctgctttagcaaaatactcggcgtcagatttgcaaacacagagagaccctaaagactcaatagagagacacagtgatgaaaaaatgaccaatttatcccgaatggtaacgctttgacggaattgccccacgcaagcaaaatatctttttcaaaaggaaacaaaaagtttaaaagggaaatagaaggtggtggggtctaccggcggaggagaagaggcggagtgaggtggttgaacggtggtttgagaggcggatcgaaggaggagcacggtggtggttgttgagaagacggttgcaaggaacagcacgagcaagacagagacgatgagaaacaagtggagaaattattattgtttgcattgtctttggactgagagatcttaaaagagaatgtaaattactttaaacacggaataatggacaaaagccgtgatcaatgacttttcaagtcttaaccaaacctataactcatccattgtttgttttttctacatatttcttcacataaaattggatgatttagaatctttcagagtgttcacactccaacagattattatccacaatgttatggttacatttagagatatataacaatgttcatttcatcgttgctaatgacataaaacgatcaaaaactgaatcatagtacttcttttacagtgatctcaaatatataaatcgctaatcaatgaattatgtcacctataattgtcgtattaccaacaactataaaacatatatataaaaaattgttgtcgttaactagttgttgatagtggccactctaaaacgatcatgacctactacggaagttataactagtcaacgttggacgttagcaaggcccaatggacattaactcagcccataatagcacgcgccttgtgatgtgcaccagtttccgtctttggtcgttgaattcaaggaaaaaaaaagtacatcacaagcaatttcttacttatctgtgacttgaagctatttctccaatttcgttttccatcgacactctatttcattttcaccattcacgtcttccttctgaataaaataaaccctaaaacctaataccgaagtaaactcgtcaaccactgcgcccatgacctcccaacgatactcttcccttatattcttcctcttccttcttcctttctgcgatccaaaccttcaaacacatctccggtagatatg

SEQ ID NO: 608 - DNA, 35 bp, Unknown
  misc_feature (1)..( 35): cDNA_ID_1597137_gDNA_ID_1592312_Annot_ID_152242 3000 nt of promoter + ATG
  misc_feature (6)..(6): n is a, c, g, or t
gggccnttttttttttctcttggaacatatagatg

SEQ ID NO: 609 - DNA, 3 bp, Unknown
  misc_feature (1)..( 3): cDNA_ID_4282969_gDNA_ID_1592314_Annot_ID_152243 3000 nt of promoter + ATG
cgg

SEQ ID NO: 610 - DNA, 1867 bp, Unknown
  misc_feature (1)..( 1867): cDNA_ID_1597200_gDNA_ID_1592316_Annot_ID_152249 3000 nt of promoter + ATG
tttttttccaaaaacaatttttgctttgatgaaattaaaactattaatacccaaaaaaaaaatgttcacttttacttttaggcgatggcgagaggatgtcagtaattgggttactcaatcggaatactgttattggagtcgttcgttgtgtttttacggtcaatttggttctattcagatatggttatctccggttttggatttgaaatctcagatacagcggcggattcacagagttccccgagtgctgctgcgactgatggttttggagccgatttcctagcatgtatgaatatgtcctgggacaagttcgagacggacaaataaacgagaccatatgtttgctgcagctgacaagtctcactcagctttcttgttgattgatgagatataagagcagatgggattagctggatatgtgcaggaaactgagatggtatgcatataagttaaacaaatcgttggagcatataagcagacacaaacaatcagttgtagccgcagaggcattcctttgctcattgtgagatttggcagatctggagcactaaccattcgtagtctattgacaatcacacctgattcttatcccaggtgatttatcttccaagttaatagctttacttgaaaaacgattccttactgatattcaaagcataacacgtctaggttcatggatgcactctataatttacttgacggttctattgacgacaatacaaagtttgaagatgagtgccgagctatttttggagcacagtcatatgttcttttcacattggacaagctagttcagaagtttgttaagcatgtaagcaaaactagtgtcttgtcttcttgactctctacttccattctctctctttcatctgatcactgggatggtttttggaaatgcttcagctccatgcagttgcatctgatgaaacagacaccaagcttctgcaactacatgcgtatgagaactacagaaaactttgggaagatgatttgatctagtgtatcatgagaatgcatgtgccatcctccatgaggcaaagatataccaaagagcaacactccaatcgttacattggttaaccgctggagcgttttggagcccgagaatgccagctcatccactttagagccaattggtcagatagaagcgagcaattcaaaaataataaaaatgaaaattaccgaacgacgtcgtattgataaatgggggctgtttggtagtacgtgtaatgttgttctaaatacgagtagggaagaggcgtaagataacaagatgcgtaggagaaaggaaaggattattgtcacttgcctgcgcaaattagggcttctccttcgcaagactctcttcgccagcttaaatcagtgtactctctctttctctgtctctatctcttgcaacttctctgtttctaatctcttcacgcatttgtgtatcaaggagtcattttttaacagaatatgaacatatttgataattcgaatcatgcgagttttattgaaagcttatgttcttgtgatgatttcaaacttttcgaaaacagcgactttcaaatttcttcagaaactatgaaaaccccatcttgtaattgccattatcggcatccaaaatgtgcttagctcggaaaattcgaattgaattagcttcgaaagctcctaattacattagaaaattcaatctttatacgaaatttttgaattctgaatctttctagcttcgtactcatgagtttaaaagcttgttacagattatgtagcacttcattggagattatctggttattgtagatagtaatgttacagagtctcataagtgctgttgttatgtgcttgtcaggcaaagtgctgaatataccttaggagctaaatg

SEQ ID NO: 611 - DNA, 838 bp, Unknown
  misc_feature (1)..( 838): cDNA_ID_3057630_gDNA_ID_1592320_Annot_ID_152258 3000 nt of promoter + ATG
acaccgatagccttctctatgacgaagagtttaccaagtacctaaaagaccatccagacaactttaggttcgacaaggcattgagcagagaggagaagaacaagaaaggtggaaagatgtacgtgcaggacaagattgaagaatatagtgatgagatcttcaagcttttggacaatggagctcatatttacttctgtgggcttaaaggaatgatgcctgggattcaagatacacttaagagagttgcagaagagagaggtgagagctgggacttgaagctttctcagctcaggaagaacaagcagtggcacgttgaagtctattgagctctttatttgtatttgctgtttttgatttttgatttaagaatcgtaataaatttgaatttggtgtttttctacttttcaaacatgatatgatgataatatctgaaatttgttggttttgagaagagaatattctcagagaataatcaatatatcatttatgtagtgacatgagccatcaagaaaacgacgaaaaggtatatactattaaagttgagaataatcttatcttacatgtgctgccataaacccaaccaaaggttatagaatattgcataaaatattcgaatcgcctaacgtcattttaatgaaaattttagagagtttataaatcaataaatcataataatcatcggtttaccaaaacataagtattttgaattttcggcttttgttcggttatgtagctgaacaattcgaattagtgtcatagattcataccgaaccgagattactctcttgtctgatgtctctagaattcaaacaaatacgaaccggtttcgctatcgatg

SEQ ID NO: 612 - DNA, 588 bp, Unknown
  misc_feature (1)..( 588): cDNA_ID_3057644_gDNA_ID_1592323_Annot_ID_152261 3000 nt of promoter + ATG
agttttgcagagataatggcgtctctaaagcggctacagaaacctgtaacaggttctaacatcccaagaccagtccccagttcctcttcattaccaactgaacatgaacaaaaggattgataacagaagaagacgaccaaagtggcaaacacatttttgacgaattcaatctgtttgaaggaaaaaaaagctacaaatgttccttctctgctactttttgcctcagcttcagtgtttgacacagcttgtgaattgtgaaaaagaaagattcatggaagatgacgattgaagaaggtgaaggattgtgctcgtgtgttttgttgtctttgcttgcaagcgatgttcatgttcatgcgtaatttcctctattttgttttccaatattgaaactgtacaaagagagaaagaaaaaacaattgacaaactcgttgaaacgttgaccgaaaacatatattaaaaaaaatcatcgagctctgtctttattcatcacacgaacaagataaggctgatctttattattgggatatatgaatcaaaataatataatattttaaaaaactttgcttttacgaaaaatctttgacaatg

SEQ ID NO: 613 - DNA, 3000 bp, Unknown
  misc_feature (1)..( 3000): cDNA_ID_1689328_gDNA_ID_1592327_Annot_ID_152271 3000 nt of promoter + ATG
tctcctatatgtgccatgtttaatggtttttttcttttgcctctctactcttctaatgaatgtcttgatgaacggtacagatcatacggtgcccatagatgatcaacgatacaaggcttccttgaatctagtcttaaccatggcttcccttttccactccagtgaagaagacttatcggtcccggatgcaacgttctacatcttccttcgaaattatcacctcctagaccatgctggttccacctatgattaaccgcttttatatcaccggcgaatatcagcagaaacggaggtaatgatcccaaatggtatatcctcttctgcttctgaattgtcatccactcttctaccttctgtgtatacattcctttcctccatttgtttacatccacaaccatcacccctgtgttgaaataacacggacgttttccttcaagaactttgaccaataccgggtctgaccagaaagttcttgtgaaataatgggtgaagtttgcgtggcagtactcgggagcagccaccactttaccttccatctccacatgccacagcttctctatgtcgtctaccacaacgaggtctgagtctaagtagatgatcctgtcaacgctgctagggatgatatccgcgaggtagattcttgcgtagttaagaggctgatcaagggcttgcctgatggatttcgatatcttgctgcggacgaggtttggatcaaactgataaatcttgaagtttaggtaaggaaaggttgatttgatgctggtgaaaaggtcgttttcgaaatgaggaagggacaggaaatgaaaagagaggttttcagggcaagtggaatgttgaaggagagacaaaacggcagccattgtgccacggaggtagtttgtgtcgagtgtcatggcgatatgaatctgatcagcctcacgagtcccgcattgatcaccgtttcgaaaagccggggcttctctgaaaacaggaagagttggagcagaaggcttatgaagaatgactccaacacgaaccgccatagtggtggttgtgaccaagaggaggataaaggacaggaggcctaggagttgtgtataggaaaggctccttgaggccatcctgaacctaattttcaagtaaactcttttattattattttckcttttttttttaattttttttttaaaaaggtttaaacattacaaattaaaaagattgattagttaatagagccattgttagggaaaggctagaataaaggatttggggagaggcttgttttatgagcagtctaaatgtggggaagagattgaacttcggactgtttctcacacaaatctttgtctccaaaaaaaatccatttcctatgaaataggaacaagacaagtctgttgtccaatgaaatcggagtgaatttttagattttgtttcttcttctttagattcttagaaactggtttatgtttttttttggaaacaaaaattattgtttatttttaggacaaaattggtctgatcaatttgctttgctgtcatttctttttackcttgawtgsgtcggcgggtttttttttttcctttttggaagtaccaaaattagaatactgtaacaaactcccctaaaatgtattaatgcatgcttttcatgcaagaaaataatgatttttatgtgatcaaatccctgataacatcatacgatctcatcatatatatagtggtactggtaaaatctgtaattccaaaagttaagtaaaatagtaagaaactaacttaagaaagtgtgtgttactccacgtttcaagaaaagaaaaatgtcttatatactccaatcttcatgcatggctactaagacagtcgcgtgtcaatcggtcattctcatgcctaatactaatccatatatataaataatatatgaaccagagagaagatctcttgaaactctttcgattacaaatatttgagttcaaacttattctttcaccaatactagccatttgcagataagacaaatagaaatcgagtcgaatctttcttgcttgagtggtagaagatttctttctctagttccatgtaattggtctaaatcagtgaactcataatttcatgtacacaaaaaaaaagactgtttcataaacagtggatatatggattggactcaccatgtcatacatggtctcgaggtaaattacacttactaagtaatcctttatattttacattttttaccatgttgtatggtaatgtgatagctacctaattcacagggccttaggcccattaggttttcaatattttcatggattatcgggtcgagaaaatgttatgatacccgacccgaaacggggagaaaataaacgagaaaagtaaggaattatctcgaggaaaagaaagcatcgataatctcaaaaagtttttggtttgatttgggaactcgtgcgcggctgtggcagaggccaaacccacccgtgtactccatccgtcggatccaccaaaccaatattctttcatctctctctctctctctctcttcttcttcgtcttcttctctttttattctttcttcaggaacaaattcctctgctttggcattttagggtttctcaaatttttgacgctttctcttaaaagggttgacgaaataaccctttaagggaaaaaacaaaggttgaggaagaccaccaaggtgaaaaaagaaagaagaattcgaacaacagcagcaacaagataaagttacgaatttttcctcttttgtaacctttgtttctcttcttcctcttcctccatttttttccattaaagattctgcctttgggttccaatttcgtctttcctttttcgattttgccgcgtttaacatgacattcgcaaaaccctacacttttctggacgccattgttgaatcccacgaatttcgtttccctagagattgcttgttctagccccagcttgaagctaaagatttttcaaggaaagcacgtttttttgtttgtgcaatcgaatctgtttttctgcgttatg

SEQ ID NO: 614 - DNA, 248 bp, Unknown
  misc_feature (1)..( 248): cDNA_ID_1689354_gDNA_ID_1592329_Annot_ID_152283 3000 nt of promoter + ATG
ktatatgatactactttgataaagctacctaacttgaatataatatgacgtataacccaaaaataatatatcctattgcccaccagatacgtatttaatcattgaatttctctttgtatcctactaattagtcatgatctcacgtaattttcaggctttactctgaaaagtcttctcttataatgtcaatgcaagttctgctttaaatcaagaaaaaatacatgatatctatacacagtggggatatg

SEQ ID NO: 615 - DNA, 1142 bp, Unknown
  misc_feature (1)..( 1142): cDNA_ID_1689439_gDNA_ID_1592352_Annot_ID_152322 3000 nt of promoter + ATG
  misc_feature (1)..(2): n is a, c, g, or t
  misc_feature (27)..(27): n is a, c, g, or t
  misc_feature (51)..(51): n is a, c, g, or t
  misc_feature (177)..(177): n is a, c, g, or t
nnaatgatgatggagcctccgcctacnaaggagattgctttggcccctgtntatgtgtattgggacatgaagaggtgtccggtccagatgactatgatgctcgtcgggttggtccgtgtatgaaacggattttaaggaaattaggctacaatggtcctgtcaccatcactgctgttngctcactagcaaaggtccctcgtgacatccttgaagcggtttcttccactggaatctctcttcatcacgagttctacagtaagcatttctcatccttattccctttttattccctttattggataaagagagtctctctaagtatatagtttctgaaacaggtcgtaaaagcatggtttcgtgtttccttggccatggtatattgaatccacgtccatctactatgacggtcatatcccgtccaccagtgtacattcctccacgcttctattctaatattagccgccgacgtgaaaatagatacaactccattttcccgtttccacttgagtctcctcgagaagcctcctccaccctctggaaaaactttcttttagctgatccagggccacttgatgaggaggatagctgcagtgaaacgcctggacctgcctcctggctttgctctgtgtgccgtcgtattggttgtggtccaggtattgctggtcaaggcgttgataattttatcacgcatatctctactcgagaacatgaactcaatgtaagctaagcatccttgccactagtttaactatattccctttctcagttgttcttttctttgcccaataactccagattgaaagagagagatatgtgtaaagaagaacataagaaaatgatataatgagaacaattctttttaatccgtaatgtgtgtgactgccaaatattctcaaatgttccaccattttcatgattttttggctgttagaaataaaacgtttagaatttgtaccaaaatacggggatggatttaaacaatcaattgtacgttaagttcaacacatttgaaaatgatttatacgcatgcatcatgagcattattgtattattgtttattttatataggtcccttttatatattataaaagagtgcaataaatttggttacgactttgaaactcatcgagctttcaacaatg

SEQ ID NO: 616 - DNA, 3000 bp, Unknown
  misc_feature (1)..( 3000): cDNA_ID_1689470_gDNA_ID_1592358_Annot_ID_152339 3000 nt of promoter + ATG
tgttcattccaatgaccaaccaattctcatcaacaaagacatgttgaccaacaatcaactatccgaaccagtcgaagatcaaaacctccatggtttagccgaaatatcgactcttcagagatgtggaggtacagaggaaattaccagaccgggtcaagaccaagactataagagtcaggagcagacttgctccgtgttctgtgagatcgaggtgatagcagagaggttggaagagtccacaggagacagttggttaatatcgttaagagacaagctcgatcaagcacatagagacgacgacacaacgatctggggagagctctgcatctacaaagttccacattacctgaaaaagaaggacaacaagttgtattcccctcagaccgtttcagttggtccttaccaccatggtgaggagcgtctctggtctatggagtgccacaagtggcgtgcggtttataaggttttgaaacgtaataagaatcaccgcatagaaatgtatactgatgccatgagagagctcgaggagaaggctcgtgcttgctacgaaggtcccattagtttgagcagtaatgagttcacagaaatgcttgttcttgatggctgttttgttcttgagctcttcaggggaaccgttgaaggattttccaaaatcgggtaagcgtaattgcatttgctggtttttccggttatcccatttaatttcttaaccggtattattgataatttttgttttctgtgctaagtagatatgcacaaaacgaccccgttttcgcgatgcgaggattgatgcattcatttcaccgtgacatggtaatgttggaaaatcaacttcctctgttcattctcgaccggttattagagttacagctcggtacacataaccaaaccggaatggtggcacacctagcgattaagttcttcaacccactattgccaatgatggagacgttgaccgaagttgaccaaccaaaactcatgaacgggcaagaaaaatcattggacatacttgacgataagggcaaattgcactgtctggatgtatttcgtcagagtctgctccagtctaatcctacaccgaatcaaagatctagactaatgaggttgactaagaatacgtatgtggtggacaagcgattgcaacaactggtagattgcgtgacagagctaagaggagctggtgtaaagttcaggagaaggaatactgaccggttttgggatattgaattcaaaaatggttatctagaaatacccaaactactaatccatgatggtaagctaaaaagttttcatttctttcctactttttattcattactcacatatgtttgtataaaatctaattttatctgtagaaccactaattcctaaaacttacaaatcccctcatgtttattgtaggtaccaagtctctcttctcaaatcttatagcttttgagcagtgccatatcgagtcgagcaacgacataacatcctacataattttcatggataatctaataaagtctaacgaagatgttagctacttgctctatcgtggtatcatcgagcactggcttgggagtgattctgaagttgcggatttgttcaagcagctatgtcaagaagtagtttttgatctccaaaatagtcatctatctcgactgtctactgatatagactgtttttctaaccgtaggtggaatgtttttaagagaatcttgatatacaagtaccaggtgaaccttaataatccgtgggcatatttttcattttttgctgcagttgctctgctacttctcacattatgtgagagtttcttttctatttatgcttattataagccaaacccttaattttgttttttgttttgttatatagtttttactaatatggaatgttaagtttttctgtttttttttccatcattttctattttcttcttttcaaaattggtattgtaatttttgggttttggaatgttgttgaaaaacaatactaaaaacgttgatttggtgggtaagcataactaacatctcagaataatcaagtcttagactatgaatgagaccagtggaaccggtggtttatgttggtgcatgaattagcaccttcgacaataccgacttaaaccagagagattgtgaataaatcgagaaagagaagacttccatttaaaaagaggaggatctcacgaaaaatagaaggaatgaagattcaatctttagataattaaaagtttagcatatccttaaactgtctaaatattgtataaatagagggatttgtcctctattcaaatcatctgcaacttaatatagaaaccctatttttcttacattgttctgaagcaaaagccctaccttcgttcttaagcaaccatgttcttcttttcatctagtctttggttactttagagcgaaagaaagaagtgaatttatctaattctttaatataaattcattatttgattttcagaattaatagtttaaaagtggtttgataattatattaccattcaacaacattttgcaaagtgtagtacacaaaataacttgataacaaatttataaaatagtaatatgttctaacaatacttaactacaaatgtttcttattttttaggaaacgcggcacacggcacaatgagatgcttttatagaaaaactacaaaagtgaaagaaacacctcaacattttttcttataagactattttcttgtagtctttctttaagactttctttcttgtagtctttctataagagcacctcaacattttttcttttttaataagagtaattgtttctatcaagagtagttgaagaaaagtcaaagaaacatcgctcgcctaggcattcattatccaatacgtttaacgattatttaacacattttaagtataagtatgattagatgtcaatattggtagttgtcattacagaaaaacaagtccaataatataagcgaccagtcactctcaaagtctcaatctcctaaaatacttcaacaaaacaaaaatg

SEQ ID NO: 617 - DNA, 961 bp, Unknown
  misc_feature (1)..( 961): cDNA_ID_1533420_gDNA_ID_1592380_Annot_ID_152372 3000 nt of promoter + ATG
aatggtgaggagactatgcaggaggagattcttgagacgattgatgaaacagcaagagaaatcagaagcagtaggaggacacttgaagaaggtttggcaaaatggaagcagaagaaggaaattggtggtggacagaacagaggaggagatcatcatgttcggctaagttcaagaaccctccttatatgatggatgtaaaaggtctgaatatgatgatgaatggtgatgggacatcatcctcagttgctgtcttgaaaccaacaatgtctattgggcagatacttagtaggaaactacttcttgctgatgagtcagcgatgatgatgaatgggagagtttcgttgggtcagattcttggaaagactaactttggagatagagagaaggaaaaaaggttcaatgggaagaggaagcggttcggattcgcaaacttgtctgtgatgttgaataaagagagtaagaagaagaataagaagaagaagatagctttgaacttaagttgttaaaagagtgattgaaatggtctaatctttacattaggacttgttgtttgtgtgttatctatttgttttcgatgtgtttattggtgtatgctaaatattgawatgagatgtgatttgttatatctttatgcttattccaaagtccaaactaattgcatattcgaagataatagccacatgtatgagatgacgtggttggataatagcttgtagtgttaaaatacctcatttgacctttcgacattcatacgcaatcgactcattccacggatctgcttactcattgattctcgataaattgttcttctcccacagacaccagattctamcaaatcatttgctcgaaaaggtaaaatctttctctacaatttcggttgaatcttttgataactcgatatatctcttgtaaagactcttgcttgaatcttctgatctttttttctttatcaggaatcatg

SEQ ID NO: 618 - DNA, 2623 bp, Unknown
  misc_feature (1)..( 2623): cDNA_ID_1020940_gDNA_ID_1592381_Annot_ID_152376 3000 nt of promoter + ATG
aaacccgaatgatccaacacaacagacacagggcacaaaagaagcaaagaagaagattcatggaaaagatttatggctttgcctttggtctcctctgtttcttacatcaaatcctcaaaccaattccattgttctttctctctgagaaaaggttagtctgatgtttctcaccattgaagcaaaactagtttacccaaattgacaatgacattgttgttcatgtgtttgctttcgaaatctgggtttctctaaagcttatgatactaattcttgtcttctttacataaaattttagtaatcaaaggtttaatttcatttgggttttggatatattgcagaaaaatttgagctttcaagtttcttcattgtgctttgttctcacttcagctatgttgatactgcagaaagattagaacttgatagattactattgtggagctctcatcagaagataagatttagtaaaagaacgttttctcagagaattgttgtgaaaatgtctgcttcaactttgcctatgaatcttggcaaagcaaagaaggtttggatatggactatgtgcaaagaagtcatgaccgttgcggtggaacgaggctggaacacatttatattctcatcggataatcgaaaactatccaatgagtggtcatgtaacaatgcagccctccatttgacgtgtttttatatatctatgttcttagttttacagtatgctcaatggatttttttgcagctattgcattgatggatacattgtttattgaagagaagaaagttattgatggtacggggaacgttgtagcttcggtctttgaggtttcaacacccgaggagcttcggagtttgaatatcgaaaacgagcagatagagaatattgttcttgatttcttagactggaaggtaataactttctgagcttgaagccttgaacttgaactcactgtgtggactatttagtaacacttgaagtttcgtttcgcagtcaatcccagcggaaaatctagtggcggctcttcaaggaagtgagaaaacagtatttgcagtttcaaatactccctcagaggctaaactattcctagaggttgtgttagtttctgatgttgaattttagttttcaagagatgtttattcttagtgttatgcttggctctctaggctttagagcatggtctcggtggaatcattcttaaatccgaggatgttaaagctgttcttgatctaaaggttactatctccacaagcgtcctttcattttgtttaaaaacatggtctcttatagttactgttttgaaaaactattaggaatactttgacaagagaaacgaagaaagtgatacattaagcttaacggaagctactataactcgggttcaaatggtcggtatgggagaccgagtctgtgttgatctttgtagcctaatgagacccggtgaaggtcttcttgtatgtttgcctgtatatacactctttctccaacataaagtactaatttttactattcttataagcattgaagtatcaatctttactcttcttacaaggttggatcttttgctagaggactcttcttggttcactcagaatgcttggagtctaattacattgaaagcagaccatttagagttaacgctgtgcgtttttttttctttcatttttcacttgctggatctattccttttatagatatcattcactaaaaatctcaatgtacaggggccggtgcacgcttatgtcgctgtaccaggtggaaagacgtgttacctctcggagttaaggacgggaagagaggtaattgttgttgatcagaaaggaaaacagcggacagcagtcgttgggcgagtgaaaatagagaagcgtccacttattgttgtggaggctaaggttcataaatcacattctttactacactctagcaaactgttaattaggattcaatttgagttaacagcttcatcttttccagcttagcacaaaggaggaggaaacagtgtatagtatcatcttgcagaacgcagaaacagttgcattagtcactcctcatcaaggttcttggtcttgagtctcaccctcattgcagtatgctactagttattagttaacatctaatagttactttttgcagtaaactcatcaggacgaaccgctgttcccgtgacctcgctgaaacccggggatcaagttttgatcagattacagggcggtgcacgccataccggtatagagattcaggaattcattgtcgagaactgatcaaaaactttcgggtaacattgaaacatattaaataaaatgtgtctatcaaataaaatgtgtctatcaaataaaataggttatgacatgtattctatttataagactagctagataggttatgacttgttggcacattatttctttttatcattcaacaaaatagattgaccaggaaaaaaaattaagtgaacagccatgaatctctctgtattgtgtggtattgtctgttcttgtaactattattaggatagttgaaaatgtatatatacccttcaaaggcctcaatccaaagacgcacttccttcattttcctttctagttttatatttcaagttcctttttttttaaccttgccatcaatacaaccatg

SEQ ID NO: 619 - DNA, 312 bp, Unknown
  misc_feature (1)..( 312): cDNA_ID_3057789_gDNA_ID_1592405_Annot_ID_152410 3000 nt of promoter + ATG
aacacaacactagtctgcataaataacgtgtctagtgataccatttgcttgattctcatttttgatgaatgagacaagaagtagatagatgtactaggtggggttttctttatagtcaaaatctgaacggtctcttaatgatacgcagtgtttaattagttttctattgttgacctcttcttttacctttgtcaatctctttgtagtgtgcaagtttcggtgtcttaccactttgtagtctacagtatataaggtgaaagtatatgtgttaaagttcttactggctggtgtacccctttcttttcagaaatg

SEQ ID NO: 620 - DNA, 403 bp, Unknown
  misc_feature (1)..( 403): cDNA_ID_1399307_gDNA_ID_1592442_Annot_ID_152473 3000 nt of promoter + ATG
gaaaaaagtcgccagtatttcgctatcgaaaatcgtttatttatatatttgatgattatccattagagaacccttcaaaaaactctccactcaactctctctggtcagctgtctcttccccattctctagggttttcaagctcaacctcaagctccactacgatctcttcttcttctctaatctcaggtctgaatctctccttcttcactatctctgatgctttttactgaatctgattgaggaaactttccattttaggatttgttgatcaaatacactcggtttaagaattaggatcattctcttttcgatctagtttcattagactcgttcttttagctcttgattttatagatctcgttttgaggaactgattatttggttgttgacagttgaaagatg

SEQ ID NO: 621 - DNA, 1309 bp, Unknown
  misc_feature (1)..( 1309): cDNA_ID_1588390_gDNA_ID_1592445_Annot_ID_152477 3000 nt of promoter + ATG
  misc_feature (1)..(1): n is a, c, g, or t
  misc_feature (41)..(42): n is a, c, g, or t
ngggcttagggacatgttggaggactggacggaggcaacannggatagcagcgtggagagagaggacgcatatgaaagaacagaagaggatgatgagaaggaggaacgcgttggcagcaaagtcattggaatgagagtaaggcttccagccgcaactatgagaggtacatgtagacgtaagttcgggttggggatcagatgatagcagcagccgcattggaactcagacaagttcccaaaaacctttcatgtcttgttgtgtttataaagaaagaacaaaagagagcattaaagagaagatgacagacaccaaatggtggcttaatttggtcttacttgtgatgaaggagacgtggatgggtcgagagaaagggaccacttgagttatgaagatggattggtggtgaacagatacatctgtccatttcccattcttgtagaccagattcttcatgataatgctttcccctcctgccaaggcaactctacagttcccttttttctttaaattttatatgctcatttagtttctatcttatcctaaacaattgtcttcgacgatattgtgagagttaaagatttgaacttctcatacacatgcatactagtccagttacgtgttctattcacattacaactcttattaactgatataattccttactactactcttccatttccttttctaccaatgacaattcagcgtttcatgtatgtaagggcttagtgtacggttattaggctttgggttctacaatatggaccaaagccaacttcattattcattccatcttttcctttatgcctgcctcaatcaacgccaacttcttcgctattatttactgtccacaaaaatacaaaatgctcgtccataaaccccccaaaaaaggaacatgaaagtctcttcactttgtatatgtcattttacagtaaagaaaaaagaagaagtaacaaaagtccaaattagaaaggaaaaaaatgcacaaaaatgaaagaaagctaaaagtgtagatatgtgctggttctaattttctagagcaaatgattaattatctcattagtgattagttatttgaataaacagaataacaaaattcaaataaacacaaaagtgccgttaaacttttaaagcccatagttaggcccaatacagatgaaaagtccgttttagaacagagagaatacgaaatttgaaaagaagagagtgggacattggaaacagaaaaaaccaaattccctctgcttcatcttcttcctcattttcaaattcacagatcctaatcttttttgaaccttccatcaataatg

SEQ ID NO: 622 - DNA, 709 bp, Unknown
  misc_feature (1)..( 709): cDNA_ID_3057848_gDNA_ID_1592449_Annot_ID_152484 3000 nt of promoter + ATG
  misc_feature (3)..(3): n is a, c, g, or t
  misc_feature (6)..(6): n is a, c, g, or t
ganttngcattttcagtgacatttttctttaaaagctaaattctgttttagcgaatcgaagcttaattctgttgagtttctatccaaagtccctgacgagacattttgacaaaaaagtttggttgtgacttgtaagtagtctagtggtcttagagtaatgttttgcaccctagtttgaaccttatttgtaaaagatgtacgaagcttttaatagaggatagtttacaagttgaccccgaactgaggaagaagattacgatttacgaacctagaacttcctcccgtgaaccctcgctcgatagccacaaaacaaattggtcgcctggtcgggaccattatgctctctattactgtttttttctttctttaataattattattgattgattttgtaagtcggtcaagagtctaatttacctttttgcccatttctgacacaaacactctggacatttcaatcaaatgtgacataaaaatggtccaatcacgaaattctcttttatttgccgatcccagtttatgtttcttttgggatataaaccattcctcatatttattcggatccatgttgttgtgtttttgttaaccctgcagaaaatactatatacacataatactataaatgaacatctataagtactagaccacttttttatatgagcgttgaatcaaaaaatttgggcaattttgtaatttcaacgcagggatg

SEQ ID NO: 623 - DNA, 1843 bp, Unknown
  misc_feature (1)..( 1843): cDNA_ID_3057852_gDNA_ID_1592452_Annot_ID_152488 3000 nt of promoter + ATG
ctttccacgctttaattcttgttccttactcctgtgtatttaggaaaaaaaacatagctggtgagattgtgctattttgtttcattaacatatcgtttcattctttgcaatttgactccttttgcgaactcagtagtaaatgatttcacaggttgaaaatcttacacggaaggcacaacttcaagaagttgaactggaaagaacaaccaaacagctaaaggaggcactagcaattgctagtgaagaatcagcgagatgcaaggcagcaaaagaagtgatcaaatcacttaccgctcaagtaaattccaaagtttcctctctgctgttaaaatgaatgaaaatgctctatgcaacttactgattttctcaataaaacatgcagttgaaagacatggctgaaagactacctgttggatcagctcggactgtcaagtctccgtctctcaattcatttggttccagtcctgattacgctgccccttcttctaacaccttaaaccgtccaaacagtcgagaaactgattctgatagcctaaccaccgtcccaatgttttcaaatgggaccagcacacctgttttcgatagtggaagttaccgacagcaagctaatcatgctgctgaagcgataaatagaatcagcacacgatcaaaagaaagtgaaccccgtaacgaaaatgaatgggttgaacaagatgaacctggtgtgtacatcactctcacagccttagctggaggtgcaagggatctcaaacgtgtccgtttcaggtaccagaatgctttttttttgttttatagtcttagctggaatgtttggatgctcctttttattggttatgaaatgagcttaatccgaggatgtctttgatggcagccggaagcggtttagtgagaaacaagcagaagaatggtgggcagagaacagaggaagagtttacgaacaatacaatgtacgcatagtagttgataaatccagtgtgggtgtaggaagtgaagacttgggtcattaatattcttcgctaacccctgataacacagaaaaccctgagtttcccactcatctattcttttttagtttctgtctacgggtttcataggtttatttggggattataaccaagagagaaaatagttttcatcatagtttgggtgtttttcatatgtaaattcttttgtaaattccacaagcatacattgtttcgttctttgtctcgataaatgttattatttgatgttgaaattcaaacagcattaatggtatggtgtcagtgcgagcttatacattttagatgtctatgggcaaatttaaatgatatgcttcttaacatcataatactgtatttttttaataggcttctttttttaacaaaatcatttaatgcccctttggtatatacaaattattacgaatgctatcttaaatgcaattaattttgtatcaaaatctattttcagattcattcttttgacatcatgaatttctcatgacggaatacaattagcatgttgataccattggaaagtacattttagtaatgaatttaacacgttacctttttgtttgatacaccaatactctttattcctggtcaaccactaataccgtttacatatatgtaagataaatttatcttatacgataaactcagcaaaatcaaacaattaatgaccaaccaaaaagaattagatacacaggttttgaagagttgcaccaacctctgcctaccacattaaacacttgtttcttttgttggtcgaccaattctgaaaaaaaagttttactcatacataaaaagcattagtagacctttttgatatgaagaagaacaacaatactcataccatg

SEQ ID NO: 624 - DNA, 394 bp, Unknown
  misc_feature (1)..( 394): cDNA_ID_3630006_gDNA_ID_1592452_Annot_ID_152489 3000 nt of promoter + ATG
ctttccacgctttaattcttgttccttactcctgtgtatttaggaaaaaaaacatagctggtgagattgtgctattttgtttcattaacatatcgtttcattctttgcaatttgactccttttgcgaactcagtagtaaatgatttcacaggttgaaaatcttacacggaaggcacaacttcaagaagttgaactggaaagaacaaccaaacagctaaaggaggcactagcaattgctagtgaagaatcagcgagatgcaaggcagcaaaagaagtgatcaaatcacttaccgctcaagtaaattccaaagtttcctctctgctgttaaaatgaatgaaaatgctctatgcaacttactgattttctcaataaaacatgcagttgaaagacatg

SEQ ID NO: 625 - DNA, 2129 bp, Unknown
  misc_feature (1)..( 2129): cDNA_ID_3057865_gDNA_ID_1592457_Annot_ID_152498 3000 nt of promoter + ATG
aactgagtactctacacccccaactcctagcttcaaaagatgagtcaaagttatgcagattgcacttgaatccatggaataagataatggcgaaaagtttggagttgatgtgctcaaaattttgggcattgtagctcctatgtaagttatgtggatatgtatgattctaaggtcttttatagatgtgtgcaatcagagagggataatcacttagagtctagagttagagataattggaagcgattgaaacttatgttatgtggtttgacacatgactaagtatagcttatctccgattgttgtggtgaagaaaatgattagtctgtagcatagaaagttattctaccactaaattctagttgggtcttgattcttgactaatatgttagatgaataattgaataatggaattttgaaatagtcaaatgatcgaataagggatgtctgagttttgtaaaatagacataaaacgttcaagaactggttgtagttagtttataatgcttcgttttatctagttataatattagttcattcattgcggtaatcaattttagaaaatgtgaagatttgagtatttttttcactttggtatctatgtactatgttgttggaataagattatacaaattgagaattctccctccctctatgcgtatgtgtgtcctgtaatctgtatgcatgtatagttgttgacgttttttattgatatgatgactcacgtatttgttaaaaggatatggatgtatattttgtattcttgtataattgttcaaaggactgaaactagaacactatgtaccttttggaatgtcatgttatgaaaaaagtattgtctgtctttgtctccaattgtgtacattgtgatacactacacaaacccataagccctgccacttaccatttcttcatctcgtttcatttaatttctgttttcatctccttcatttaatctcgtatatttactctttctgtgtcagcttattgcaaactcgttacgtagtaacccatttaggcatttaatgtcaagattagtcttaataggtatagtggaaattgcaagttttggagtattcgattatcaaagagatttattattacatacgttattcaactcgtcttgtcactttaggttgctcgttaattatataaaccaacttcttttgttcattaattagtattactaaaaattttgtatccgcagatcagttatacagtaataaatcatctttggatgcgtcacaaaacggcactgttaattagaaacgccgcgcgtgcacatgacttcaaaaagaacattgtcgataattatgagaattgagtctttttttggttggttccgtaggtactaagtgataaccatgaatttgtctcatcaatcagacaatcactatcgcaagaaacacataaacatataccattagtgcgaagatgtatcactaagccaattcacttctttagaaattaaaccaggaacgaaacgagtctagctgtctaggctatggtaattaaattgccaaaagaaagaaaggttctgatgtgtttggaacacaaagatagcccacacacgcataaaactcatgccctagaatgtagaagaacctagacctagtagtagaaaaatggtgaaaaaagtgacagagtctttcgatacacatagcaataaaaaagttaacgattgtccctaattaatctgtaagcaaaactaagggcgacaacttatatatgtgacatttttgttacaaattgttacgtgggaaaaaatacatatgtttacgaatattgagaaacaattttgtacaaattttatatctaacttttaaatgtggaagaaattaaataagttgctaccgatttatcgacagcaaatggtggttcaccagtcagtcaccatatgttaaattgttatcccgataaggatttttacttgattttaccaacgcagcaaaacaaaaaaaacgaacggctgagatgtaattagagaacatagataacccaacacatgcgccgcagaggatctcaccgagaatgtagaaccgggcacgagaaatagcgtcagattacaaagagcgaaaagaaggagggcttcttcttccaatttgtgatcggtgctgatcgatttctccatg

SEQ ID NO: 626 - DNA, 310 bp, Unknown
  misc_feature (1)..( 310): cDNA_ID_3057878_gDNA_ID_1592462_Annot_ID_152504 3000 nt of promoter + ATG
aataagatccgagttgtgtgctcgwtagagaaatcgggagtcctaaggaccagcgagcgagagagattcaaaaatagaaattttacgtaaagagaattakaggtgcagcgtgaaaagaggcaacaattccgtgcataccgaggtaccttcacctgcataaataggtattcacaacatcaccaaaagattcgtcaagagcaagagaacatagtttcttcttgcttttgagaaaaaataattatatatttttatataggaaagggttaatttattaataaaaaaaataaaaagaagcagaaaagagataatg

SEQ ID NO: 627 - DNA, 180 bp, Unknown
  misc_feature (1)..( 180): cDNA_ID_1691030_gDNA_ID_1592466_Annot_ID_152508 3000 nt of promoter + ATG
tgtatttattgaccgattataaattttaactaacaatacatgtgttcatcattatattccttttttgattttttattgaatgaataatctaacaatsttttatataataattatatgtctcttaaccatttttcaaaagttgatatacatcttacatagaaatttatgtattmagtgatg

SEQ ID NO: 628 - DNA, 784 bp, Unknown
  misc_feature (1)..( 784): cDNA_ID_1691109_gDNA_ID_1592492_Annot_ID_152550 3000 nt of promoter + ATG
gaggatatatcacttagaccgttagacgtcacgtgtaatcgtgtattaatgcttgcaaaatgtggttcaatcaaatacccaattaagggataggagaactaatacaaaaatgtggttcccgtaaacaatgcatgagcaagcacatgactgacatgagagatagaccagcgaataaaggtttagtattgacgcaccatgcaaagcgtaacggtgaactggagctctactggctgagataattcacaaggtgaaggtgagatatattttaggagagccagaaaggtagaaccccgagacgagagagaccaagtgagttttggactagtgtttttcaaagaatgggtctagaactatttattaagtgccaaaaaaaaagacaaataaaagmacgatttttctatataggactactcgattaatrttaacaaaaaggcgaataagaagaaaacatatatgtttgttttttttaaaacaaaaaccgtggaaatcaaaacaccagaaaaatgtggtagtgaagaaaattacaagagagycagtaaaaaaaaaatgaaccaaaaaggcaaaaattgaatacgtggcttcaatgtagacccagatgatgaacgtcgcatcatcttccttacgggggaaatctcacattttgaaattacagaaaactccaaagaacccaagattgaatattgaatattgaaaattgaaaaaatctctctttgaagaattgaaatctctctttgaagacgaacgaacctcgttgattcctccattcctcttcggctcgtccatg

SEQ ID NO: 629 - DNA, 174 bp, Unknown
  misc_feature (1)..( 174): cDNA_ID_1691153_gDNA_ID_1592509_Annot_ID_152572 3000 nt of promoter + ATG
aaaccccgtcaccgaatcaacatccsacgcaaatcacaagaaggctaagttgggacgagccgaagaaaaagcaatctccgagcagttatagcaactaaagatccgggaatcaacgagaccagtttttgacccaataatatacgtttgtcttgatgaggagaacctcgaacaatg

SEQ ID NO: 630 - DNA, 1085 bp, Unknown
  misc_feature (1)..( 1085): cDNA_ID_3058135_gDNA_ID_1620302_Annot_ID_152651 3000 nt of promoter + ATG
gatcttcaccaccgagtcttgagccagatcaatatcgctcacagaagaacaacaacgataaatcaaagaagcattaaaagacgaaccaccacgaagaagggaaagagaatacaaaaatagatgaaccggagtgctcgtggagttgctgaacctagccacaatatgatgttcttgttaagtactatgtttacttgtattaacgatacataagatatatcatttacttgattactcatattttcgatccataataattacactacttccttttcctctagatttaaacttgctaacaaatatttttaaagattttaatggaaattgttaacattttatacaaggcttttatataatcaaatgaaactatagattttggtaacacataattaatctgttgtgctctctcttttattttactatgggaaaggtccaatgggcttaggcccaattatttaaacaaaaaaagattctaactttcttctaatggaaaagaaaatttgcgatcaagcaattactctctctctctctctttcttctgccatcgccaaaaacttgtcttttgcttctgggttttgcttcttatttttggtaagattgaatttttctttcaccccatttattatttcgtgcttttagatcgttgattgatctgtatcctgcagtgatcattctttaatttacgaaattgttttttgtgtgtgtgtgtgtgtgtgtgtgtgtgtgattgataatgttgttggggactttaggtgccatttttgtcgattttgtggtttaatttacctattgtatattgtgattgaatcgattgggagggtattgagaggtggttgtttcaatctaacaaaatcaagtgcaaatccattttatagccacttatcttctgctagtagatctacttgagttttaagagatgtgtcttctttaataccattgtggttccttttttaatttcatggcttaagtgaatgttttttggcttctttggttgctatagcttatctctgatttgattaagtagaatcctttgtactgaagtgactttttttgtatggatctaatgtagaatatagtcattggagatg

SEQ ID NO: 631 - DNA, 3000 bp, Unknown
  misc_feature (1)..( 3000): cDNA_ID_3058107_gDNA_ID_1620302_Annot_ID_152667 3000 nt of promoter + ATG
atcaaatctaaatgaataagtaacttttttataccaaaaagtagaaaaccaaacaaatgcaccactggcttccaaattggggtatatgcgaaacgatttagtagcttaagtttctaacttagcaaatttgaagcagaaaagaggaactgagagttccatgataaaaccaattgtgaaatgagtcatttcaaatgagagctgagaattagatgttgcaaagctcttcacaagcacaatctagaggaacaaaccaattgtgtactgcatcatcataactaaagtctttggcgttcactttcaagccatatccagcgtataaatgtaaaagaaaagaaaaaatcaaatcaaagcaccaagatcaaactctaaccatacttataagctgagaaagaaaaacatcaaagctagttatagatactagacatgacacatttgaataagtgcttaaagcacatcattatcataccactggttctcttaactaatatcaaatgtttggtattacgtgtatctatcagattgattgaaatagaaggttgaaacataaagcaaggtaatgtctctcagaaacgattccacgttattatcaaaatcaatctctatcaatcaaaagcaagaggcaatcacaacaaaaggaggaaaagaaaacctacgcactagtgatttgaagtaaaacaaacatgagaacgacatttttgtgattctaatccttgaccagtcacattcaacagcgaagaaacaagtcccagaaaaaataggccaaattcacataaagaacaaacacaaattcccttaattaaaaagcaacctagctaataatctcgatagatcaccaaaccatggattcgcacaaagaaagcttaccgatttataatggatcaagtgatcagaagaaagctaaacccttttcaaatttcaaaacttttagaactccaccatgtaattgatctaattggattaaggaacagcattgaacatttaggtctacaagaggggaaaataaaaatcaaaactttggtcttttgattggttttgaaatctgagtttccttgttggggcgtgatgaattaagcagcgactagtcaacgttccttgtttacagtgtagagtagattgctccaatcatttttattggactcggaggtaataatgtttcactttttttacgaacaggaagaaaaatatgcaaattatactgaaagccctaaacttttgagtttatcacatttttaacctaaagttatcagttgtatcaaaatgatgtagttatattgaaactctcttcaccagttagaggctttaaagacttgccgacaaaatgtagaagtaggtgtatatctccggccatttcagtaactagttctgttcttggatgtcgtgtgttttgtctaagggagaagcgagaagagattaaaagattagaccttttcgcattcatggattcgaagttgagaaattttgtgatgggtctgtttgtgatgactgcgatcttgaataattctggtgttggcgcgtggactggagagattcgtggtagagttgtgtgtgatgtctgtgctgattcttcaattggaccagaagatcatgttcttgaaggttagtatctctgtccctcttctttatgtcttctctttagtcagttttagatgttcgattgctgggaagaagaacaattgtctgattttgagaaattctttggatttaactgtgtagaactctggattcacttttaagtagtgcttcttcagaaagagtgttgctttgctaatgttctgatggatttcttcagagtgattactgttcaattcagtagtagttgtttctcactcatcaaattggtgtgaatttcttcagagtagtttattagcccgaagcttgttggtactgtttgttcttatttcttgagcaaatggtgcatatcttggtgagtgtgtgtctacagtttttgcagattcttatttttcttttttaataacataaatcaaagttagaggggattttgtttagtatcatctctggtctctctgcgacataaaaatctgttatgttcattttccttatgtttttagctgcgcttttgtatatatcctatagtgtcaaatgttttttgcagattatgttatacttctatgcgaaatcttttcaagttttctgattcatatttggttctctgaattccatgaatcaaatttaggagagcttatggcttggatcatctcttgtctctccggaacttagtaattagtttgttcatccttgtgtttccagctagttttatgtattatccgatagtgttaatgatttttccacactgcttcatattccaaatagtcttgttgataactcaaaaccgggattgcttagaagccactcggttttatgtgtttaccattctgctagtgaaatgatctctttggcacttttaaccgtgttatgtgatccagtcacttcatatcattgacgtatcaatcacatttgcgagctgttattgttcaatctttacaggagctgaggttgcggttctgtgcataaccaaatctggagaagttgtgaactaccaagctttcacaaactcaaaaggtgtctacacagttgcagagacaatgccagagagcgaacgttgggacgcttgccttgcaagacccatcagcagcttccacacaccttgcaatcgcctacaccaaaccaataccggaatcaaattcacttataaccgcccttccggtttctttcatgccgtgaaaccatttgtgtatcgacctcaatatgcaccttcttattgctgattcaaagacaccttgtaaaagtccttgtaagttgtaatactaactagtttggatttgtgaaatgctaatatggatcaagcttaaagtgttttgatgtaaggataagagaagtttgtttatataaaagtctttagtcaaaagtcaaagggagactagtctcacaaggcggtgacgggggaggtaaagaacaattaattttgaatgggtcctacag

SEQ ID NO: 632 - DNA, 3000 bp, Unknown
  misc_feature (1)..( 3000): cDNA_ID_2990421_gDNA_ID_1620302_Annot_ID_152671 3000 nt of promoter + ATG
gaaactttgggttggtgagtcaggaaatgaaaatgataaggtaacaacaacacttcaaagtgctgccctaaagttaagttgcaagattttttttgatgaagtttttttttttcttgtcatagggagaagatgtaatagcaatcttaccatgggaggagtggtgggcatttgaacaaacaaaggatgactcgaatcctcagattgcactgctacctttgcatcccgatgttcgtgctaaatttgatgttgctgctgcttggaaatatgctcgcagcatggagggtaaaccatatggttatcacaacttgatttttagttggattgataccgttagtgaaaactacccgcctcctctagatgcccatcttgtaagtttttgtttttcatttctcacaatatagttcttgatgaatgaatacactttcaaatcgttttaacttcgggcttctctttctttcaggttgcatctttcatgactgtttggagccaaatgcagcctgagtatgctgctaacatgtggaatgaagccttgaacaagcgactgggaacagaggtattaacatcttcatgattcatagatgatttttttaattaatgcttatccttattagagatggtcctaatatctgattcttctgtactatcgtatccttcatgttgtatacgattctacatttttctctgctcttatagtttgactctgttccttgttcttcgttttttttctcttcttctctaacatggttaaaattgcagggtcttgatctttctgatgtactggtagaagtagagaagcgtggatcctcatttgacaaattactggcagtacctgaactagacgattggatatacagcgatggtaaatcaacctcatgcatcgctttcattctcgaaatgtacaaagaagctggcctattcggtccacttgctagttctattcaagtcacggaattcacggtaagaatttgtacacagtctctgcttcccttcatgcacgcaagctcatgtgaccattttcatttcttaatctcttgaatctgcagataaaagatgcttacatgctcaactttttcgagaacaacgcaagtcgtcttcctacatggtgcaatgacaatgacagtgtgaagcttccttactgtcagatacttgggaaatacagaatggaacttcctggttacaacactatggaaccatactcgcacatgaacgaacaatgtccaactctgcctccaaagtacaacagaccagataactgctaaaagaattctcctccgatgtctgtttgattttaggaaaaaagttcaaatgtattaccgttgaaaactcaacaattactttatctgtttgtatataactatatatatatcattcaggtttgtagcaactgctcatcatgtaaactgtgtttggatatgatacacacaaatagaaattacaagtttcatcttttggttatgtttcgtcttccggtttagtttggtttatctggattaaaccggtctcatcttcatcgtaaagaaagaaagtagaagcaaagcttgaagcttttggatttctaatgtgtgtgaatcgtgatgttgtcatcaggacagatgatgggccatgtcgtggcccgaactcagatgatcttgtctcgaagtaacttcgccgattgtatacggtgtcagggcgtgagagtttcaaaaaccctaaaaatggggacaaagcgacccacttgcccttcttgcgataaacctagccagctctgtctctgcaagaagatgagatctccatgttttgataatcaggtgagtattactattcttcagcatagtctcgagagaaaacacgcgctaaattctactcgaatcgctagattagggcttaagaatgttggtgtgactactgttttcgatgttcatgatgaggcagagttcttaatcagggttattggatcgggttgcagcaagattgacacgaatcatttggattctgagtatagggtagagaatgttgcttctttggaacttgatgatagctttaagttaggtagtagtggcaatgtggagaacttagaatctgagaagaatgtggtgcttgttgatcatggaagcttggaaattgctgaaagtttgaatctttctcaacatttgagtgaaatttcttatcgggattcgcgggttagggataagataggttcttatgaagaagatttgataaaaatctgtatgaagaaacatggtgtcatcagcaatgtctcacactctttgatgcttgaaaccaatgtgaaggttcttagttttgatcatatattggcttctcctgcagccatggatgtcttggcaaaaggttttatggtaacaaagttttcagaaggaaagcaagagtttgagctcgaggttcctcctggatcagctttgttgttcccgagcgaagaatcggtaaagatcaattatcttaaagagaaagaagagttaaaagtaaggaatctgattgttcttgatgggacttggtcgaaggctagaagaatataccttgagaatccatggctaaagcttttacgttgccatgtgaagctagaaatagaaggtacaagtttatacaaagaagtacgacggcagccaagagcgggatgtttatccacgatagagagtattgtatacgcgatgaaggagatcggtgaagatcctgaaggtttagataatatgttgaatgtttttgaatccatggttgaagatcaacgaagatgtaaagatgagaactttaacaagattatctgaaagacaaaattactctgctgttgtaacttgtaagctgaatgaattagattcttcaattttgataattatgccgaaagttggagtcgtttttggcaatttattaaaacaattgaagatataaatgttggggtgtgaacaagaaaaattcatagttctgggccaatatgtaaattaggaaatataagttttgttgagtaagacttttgttaattttgaactcagagtgtgttttcgtttccga

SEQ ID NO: 633 - DNA, 3000 bp, Unknown
  misc_feature (1)..( 3000): cDNA_ID_2044638_gDNA_ID_1620302_Annot_ID_152673 3000 nt of promoter + ATG
aataaaggttcccaaaaaatgtgatatattaaaagagagagagaatagaagatgcctcatttgtggttgaatacttacatgttggggaaaatgagatccaccaccagcatttccagtagccaaattagtgtacggaacaaacttggaaggtgaagatgcatgagacaagaaagggctgattccaatttctggttgaacagcttctggaactggtaacataggagtattgcttggcacataacccatattcgcaacaacaggcgtcataccggcatgagctgatgtaagacgttttgcaagagatggggaaaaagtctttgctcctggattcagtttaaactcctgaattcaaaaacgagtaacaaataaagtaagatgaaacaatgcacaagtcatcaagctgccataaccaagaaacgagcatctcaaactaacatatattctgaatatgagaaaccaatacgaattctttatcaccttagccttcttgtcagggtctgttgcctgcgtaggtggtaagctatttgtagataccaccaaaaccagactcacttctgagttttcatccacagtagtgctctgtgatgaagaattttcagttgacgagggtctctccgtagcatcgtgaaaaccattactagaaggttccggcattttctcttgttctatcggctttacacgttcagacatgttgtccactgtcattataacacgtgatgagacacatgtcaggaaacattttcttgtcaaaaaggaagcagaaaagagttcatcatggttctgtaagtaaaataaaaaagtttttcccaaaaaggaactcacagctacaacttgagcttctggcttcaacctgcaataggtaaatataataataagcagctgctgagcaatatcttgaaaaacagaatgaaccaattatgtgcaagactaacgttatcctcctgatgaacatcagtaatttttttgctattcttcaaaatgcggactcctgcctgtctgtcagcaaaagaatatacaagaatcagagagttacctactgagcacagagaggtttattgtagccagaaaactagatagctaaaactgatatataagtagaagtttggttacatattggcaaatattaagacggagataaagattttaacaggacactaattatataccaaaaacagtatacttatgatccataccgttgatggttcagtgagctaggatgatatttgttctgcaaaagaggaaattggaaaaggaatcaagagagtgaaaaccaagaaagggactcagactgtgaaagctgaattaaacaacatgacaagatgttaactaatgactctaggcaaggcatctattttaaagtcaacccattacagaaaccgaaaaccaagtcatctactttaatgtcaacccattacatcctactaaatggaggctggctttaacttccatcttggggagacacaagggcccatggaccttgtgagctagacatcaactctatcaccagttcccacaacaataggagaattacttagttaaattccacaatacaaacaagacaaagctacctgtaaaataccaacctcatctcttctccctggctctttcatggcacctgcggtctccccagatgtcaaggttcttgctttactttccaaacaattttcacgtttcgcggaattcctatttcataaattaaagagattaaaaaaaaaaatcataaagccatagaacaaatcgacacaaaactaaaagacaagagactgcgaggagcaaaacaagattcataatccttaaccttctaacttttctatctaaatatgaacttataacaacattaactacaaaggttaccttctacgattagtgccccttctgttcttgccagaattgaaggaagaaactgccacggccgacacgacattttcaccctcaatctcccctgcaacattggacgaaagcgagactccctatgaaaataaaaataagaaagtcacacaatctggctttaaacgaatctctacaagtaaaatcaccatagaaaaaaagaccaacctctgcaacaatttgaacaatattggaagacaaaatcacaagtgtctccacaatcttcccactttctacattcgatttacttcttcccttcttagtaagttttgcattcttcaacacaatacctaaattcagaatcaaaccagtaaaattcagaaacagtcaaacagaccaaaatgctacacaaatcgaaaaaaaactagcaatgttacaatgaatgattcacaccaccaattaagtaatgagcataatttcgtaagatcctaatcaaatctctgtgatctccgacacaaattcaaagaccaatttcatcaacgaaaacacaaattaccaaatcaaaaccacattaaaccaaaaggaaacgtactgaattcattctcaagagagacagtgtagaatatcccagaaaacacagagccatcgttgatatgcacatggacttgtaagccgatgatacacatagtagagattaacagagcttcgttcagcgatgatgatgatgacgaaggagaagagcgtgagatctcattttccaatttcttcgcgattgccatattcaaatcaaatcaattcgttccaaaatttcacagtccggtgtactcgcatctatatatatatgtatcgcaagttcacaacaaaagaagacgaagacaaatagggattcgagaatcagaagagatccagagaagatagacgagggaagcgaaaaaaaaaatgctttgttattgggcctttgtgtatccttattgggcctagattagtttttttggtaattaaaaaaagcatcgtcactcatcgttaaacccttcaattggctgcttcaacatcttcttgtgtatctatcaaatcttaaaaccctaacttttgtctgctcttttgcaaattctagcctctcaagtcgtaagctttccatatctggagctctaacttcgtgtttgtgtcaagatg

SEQ ID NO: 634 - DNA, 3000 bp, Unknown
  misc_feature (1)..( 3000): cDNA_ID_3058099_gDNA_ID_1620302_Annot_ID_152672 3000 nt of promoter + ATG
aatgtggtgcttgttgatcatggaagcttggaaattgctgaaagtttgaatctttctcaacatttgagtgaaatttcttatcgggattcgcgggttagggataagataggttcttatgaagaagatttgataaaaatctgtatgaagaaacatggtgtcatcagcaatgtctcacactctttgatgcttgaaaccaatgtgaaggttcttagttttgatcatatattggcttctcctgcagccatggatgtcttggcaaaaggttttatggtaacaaagttttcagaaggaaagcaagagtttgagctcgaggttcctcctggatcagctttgttgttcccgagcgaagaatcggtaaagatcaattatcttaaagagaaagaagagttaaaagtaaggaatctgattgttcttgatgggacttggtcgaaggctagaagaatataccttgagaatccatggctaaagcttttacgttgccatgtgaagctagaaatagaaggtacaagtttatacaaagaagtacgacggcagccaagagcgggatgtttatccacgatagagagtattgtatacgcgatgaaggagatcggtgaagatcctgaaggtttagataatatgttgaatgtttttgaatccatggttgaagatcaacgaagatgtaaagatgagaactttaacaagattatctgaaagacaaaattactctgctgttgtaacttgtaagctgaatgaattagattcttcaattttgataattatgccgaaagttggagtcgtttttggcaatttattaaaacaattgaagatataaatgttggggtgtgaacaagaaaaattcatagttctgggccaatatgtaaattaggaaatataagttttgttgagtaagacttttgttaattttgaactcagagtgtgttttcgtttccgaatgctttcaattcgcagaagcttaactctagcaaaagagccaaaagatttgtttttgtttttgtgtaatctccgagctcgatgtgtatctacagatgactatgatccaccattttcgcctctctctaaacccactaaacctccaaaagagaagaagaagcagaagacgaagaagcaagaccagtcgtcggagctggtaaatgacctgaagattccagtgatttcagacctccctttcgattttaggtattcgtattcagaaactaacccggaaattgaaccgattggattccgtgaaccgaaacggttctctccatttggaccgggtcgattggaccggaaatggactgggactaccgcactggcgtcgccggagattgatcagagtcaatgggtggaggagagagcaagagttctcggcgagactttgacagaggatgaagttacagagcttattgaacggtatcggcatagtgactgtacacgacagattaatctcggtacaattttgaatcttttgcctaagttttttagctttgaaattagtttgcttgatcaaatcgaatcgtcttcaaagttaagagctttcgtcatcgttgatgttgcagattcactagtggtagaaacttctttgtgttgacatcacttgtagatttgtggtcttgatgatgatcatgttgtgatataatcaaattatgtgattggtctcttcttataaactttgtgatgttatcagggaaaggtggtgtgactcacaatatgatagatgatattcataaccattggaagaaagctgaggcagtgaggatcaaatgcttgggagtaccaactcttgacatggacaacatatgtttccacctcgaggtgtctattattagatctccagaacacggctctgtttttctttcggttgatcttactatagttgtgttcttgataggaaaaatccggtggaaagattgtatacagaaacataaacattctagttttgtaccggggaaggaattatgatccgaagagtcgtcccatcattccactcatgttatggaagcctcatccgccaatatacccaagacttgtaaagaatgtggctgatgggttagaatttgaagagaccaaggagatgagaaatcgtgggcttcattctcctgccttaatgaaacttagtaagtagtatatacatcgtcaagttctttgtcatttttctagtatttcctcgtttttgattggcggattgtattgtgattcagctaggaatggtgtttatgttaatgtcgttggaagagtgagggaagagtttgaaacagaagagattgtgagactagattgcactcatgttgggatgagtgactgcaaacgaattggtgtgaaactaaaggtataataaactgtaaatggtttgcttgtcttatattgtctgtcagattctctagaattgatctatcttgatgctgtgatcaaaattgcaggagatggttccatgtgttcccatattgttcaaagatgagcagatcatactctggagagggaagaggactggtgaagaagagcttgttactctatgaatctttgatctagaatcatgatcatgtgagtgatgtgacctgaacaaatccaactgtagaccaaaacttcttcatcgatacaacagatactaaagtttcacatgtctcagaagtagtcatagatacaacaatcttggttgatttgtatattcgattatgtacttcggtttgatttattgaactaaaattggatcagtccaaaattgttctttatgaaattgactaattttattttatttttttgattaagttcataatttgatttttagagtaatccaatttactgttctgttgtcatcattcttaccttagaacactaaccatgttcaattactcaatatcatggcccggttcaaaaccaaaccggtcaatggtagaacaactaatgggctgatataaaaattgggcctataaaaaagcctacaactgtatatcataactataaaaatgctttattttcgaagcgaaagtttaggttttggtttttttgtccgtcgtagtg

SEQ ID NO: 635 - DNA, 3000 bp, Unknown
  misc_feature (1)..( 3000): cDNA_ID_3058083_gDNA_ID_1620302_Annot_ID_152682 3000 nt of promoter + ATG
ccttcaaagttttatttaactctcttcattgtcaaatccttcatctttactactttttcaatatctccccattatgtataaatttaatgcatcaagtactacaactattccacatgtgcattgataaatcaacctcaaaatagaggtaaaagagagagagaaccacttttttgaaaggagtggaattgttctcgtatcacgagattacataaacgtgagtcgtccaaactactagattcgaataaaccaaccaaatcacaaattgtttcttttaaaataatgaaacatgatgtgaaaacacaactcgtagcctatttgatattgttttcgttcatgttttgtcgacgtagacccatatatcttagtaggttttgaaataaaccaaactgagccccaactaaagctactaaaccacggtcgatagaaccaaaccgacgtaaattcaaagctataaactcaaaccgaattataaaatatgaagttatgtttgattttgatatttttctcactgaatcaaacctaaacttaaaccaaaatggcgaaatctgaaaacccaatgtaaatgcagactccctatggtcgattaattttgttgttgcagaattctttagaagtatgatgtgacatcaccttgactaatgctaatgtcatcacttaatgtaaagaacgtactaatatttagcaacgattttaaaaataataagcatctcaatacttaagattatctcaagtaaaactaataatccaaagccatgatgattcatatgaagcccactgcccaccaaggcaagccaaatgtcgatctctctcgctaccagcaaccaccgcacttgcctcgtccatgtcacttccacaaccataaatttttttggtgccactcgaaataaaataaaaatataaaatttatcaaaatcattaacgatttaaagcaaaattctaactttaataagataaagctacaatccggagatggtgaaaaaactttaatccatattcacattgtaagtttttctatggaaaatcacttcttctttttttccacgcggtttcaaaggttaatcataaaaagagtagaagttaaaggaacttttttgtatctattatagtttgtttttatatgtattgtgaccacaaacacatatatctacatatttattttatatataaagagatagataatctaactgagaaatccacttgaagctattcaacaatttttatagctttcttcctctccaaaaccacaccaaaaaaaaaaaaaaaaaatttgattttcagatccaatcaaccagagatgagagataacaacaataacaacacaagagaagaagagagaagcagttcttcaaagcagcaacaaccacaagctcctatgtctttgaagatcatagattcatgtctcagactaagtgtggttcctctcagtgttgcaaccatctggttaactgtcactaaccacgaatccaacccggactacggcaatttagagtacaactccatcatgggtctcaagtaaacatatactctttactttctttcaactttttagtaagtattttataattattaattaattagttataatttgtaggtatatggttggtgtgagtgccatatctgctatttatgctctgctctctactgtttcttcatgggtcacatgtttagtctccaaagcttggctcttctttattcctgaccaggttttttaaaattatcttctcaatcatttatcaaatatctagtatgcaatttcttatgttagttaataatgtttttatatttttttgggtgtatgaaggttttagcttatgtgatgacaacatcagtagcaggagcaacagagatagtgtatctacttaacaaaggagacaaaatagtgacatggagtgaaatgtgttcttcttatccacattattgttcaaaactcacaattgctttgggacttcatgtctttgttcttttctttttcttatttctctctgtcatttctgcttatagagcttttagtccctttgatcctccttgtgattctcaaaccaataatgatgcttaaattagtcagttttggattcaactttatcaaaatgttgcagcagtttatggtgttttaactttcttctcaaaatattacaaaatatttttttttatgccgccaactgttgttgtaggcaccatactcctacaaagaacaagcgggttaggcagccgtttagaaataccaatttattttatgttttttaaggctaccaaattattattttactttttaatgttaatatataggtgtatcttaaaatttttgtttaataaattttttaacacaaattttgcatgattttaaactaattttgaataagggatagaaagagcgctacaaaaaaaatcttgactcggaccatcatttttgttggaccggcacatcctgtagatgtataaataacttattttgcggaaaaaaatagatgtttacatgattttacctaaatactaccatttatgtaaatctataaatatcagtttatagcaagttataaatccttacatggattaacaggtgtacaaaattttacaaaataataaatacaaaagcattgaaatagtgtttttaaccaaaagaaaaaaaagatactgtaatctatagaaagaatcaaagtgaagttgcagaaataaagaccaaatcaaatgaataatttattaaattgataaggtggcaaccaacaaatatattgcacttaatatagtaaaaaatcatacattgctgtcagtgagtagtaaaccaagtagtcacccatatataaatttcttgaaaatatgaaactcctaatcctacatgacttaaaccttttttagataatttcattatcaaatggctattctttcaattcacccttatatctttgcacaacaatagagagagaaaaagaagttcaaaaaaaacataagatctaattaagagaggtttttggtctagttcctctggttcataccacaccaacc

SEQ ID NO: 636 - DNA, 3000 bp, Unknown
  misc_feature (1)..( 3000): cDNA_ID_2044619_gDNA_ID_1620302_Annot_ID_152681 3000 nt of promoter + ATG
gtaaaacaacggtggctaaagtaatcaaacggtggtatgaaataggcggctaataagatatttttagccgcagatatttatgtgtctctgagattgacacgtgtccttatatagttggatattggagaacaagttagaaagttcacgttgagaatagttgtgagtccgcagagaataattgctctcatgcgcagcccacaagggcatcataggacccgattggatataggatccgacccggttcgtgtcaataccacgtgactcaaaaagaaactcccgctcttggcgacttttcgaaaccctaaagagactcgtatttcccccctaacgccgattttcccgccgctctcactcaattacaaaaatccgtagatccccaatctccaatcacatatctcccacaatctctttctcgctctctcgatcatcagattcttcaatctctttcaccaagcttaaccaaatcgttaccatgaaggatatctctaaatctccggcgagaagaagcgacggattccaccgctacttaaaaccaggagcgcttgctcagatccgaaactcgagaatcaacgctagatctactacatctctcgtatctcgctcctccctctcgcagctagtagatccgatttcaccatctgagaactcggttgatgaagcagcagcggcttcgcggaatctgacgatagatcaggtaccacatcttctaagaaagatctatggtccttacagttatcagaggaagaaattagccgctgctagatctgtctcgtcgatgatgatgatgaatatcaatcctcctataaactcagttcttgttgaacccagtagtgatgttattgctcattgagttaaactagtttctaccaaatctgtaatctgatgatacaattcgggtaaaatgtttaatactatcataagactcactatatgaatcattaaattatcaataaattgtgtgttttcaattgatgagtttatctttgttaatttaatgtttgtgttgatttgatatcttacgatttggatttgactatagattccttcactacatattaatgaacacttacatgagtatcattttgggattcttaatgatgtatatgtaactcttaagtgttgtaactgttttgaaagattagccaaacacttaaagattcgaagagtaatgatataagactacatatatttttctcaaatttgttatcatcttgttagattgtaattgacataggctatgttacctcagtcaattctctgctttgcttaatctaaacatctcaaatctataggttttgattatctctctgtttgttgtgatgggtaaaaatgtttgccttctgctattatcagacgctattgtctcagaccaaatggttacctatgtttgtcgatgggtgttaacagatttcatttgcttggtggtattaccgcatatggaacattggtcttggtttatttagtctcatcattcgatgttaataagttttatctatatgctttctttcatttgttctaatgggtaatgatggttatctatatgttgcctttagcaaacgtcgctgcccatatggttgaacttgaatcctgatccaactgaacctctttaccctctgattatgcaatcggttattaattgatgttgatatccccaagtacatatgtatgttatatgtaagagaccattcataactttcactttctacccttcaaagttttatttaactctcttcattgtcaaatccttcatctttactactttttcaatatctccccattatgtataaatttaatgcatcaagtactacaactattccacatgtgcattgataaatcaacctcaaaatagaggtaaaagagagagagaaccacttttttgaaaggagtggaattgttctcgtatcacgagattacataaacgtgagtcgtccaaactactagattcgaataaaccaaccaaatcacaaattgtttcttttaaaataatgaaacatgatgtgaaaacacaactcgtagcctatttgatattgttttcgttcatgttttgtcgacgtagacccatatatcttagtaggttttgaaataaaccaaactgagccccaactaaagctactaaaccacggtcgatagaaccaaaccgacgtaaattcaaagctataaactcaaaccgaattataaaatatgaagttatgtttgattttgatatttttctcactgaatcaaacctaaacttaaaccaaaatggcgaaatctgaaaacccaatgtaaatgcagactccctatggtcgattaattttgttgttgcagaattctttagaagtatgatgtgacatcaccttgactaatgctaatgtcatcacttaatgtaaagaacgtactaatatttagcaacgattttaaaaataataagcatctcaatacttaagattatctcaagtaaaactaataatccaaagccatgatgattcatatgaagcccactgcccaccaaggcaagccaaatgtcgatctctctcgctaccagcaaccaccgcacttgcctcgtccatgtcacttccacaaccataaatttttttggtgccactcgaaataaaataaaaatataaaatttatcaaaatcattaacgatttaaagcaaaattctaactttaataagataaagctacaatccggagatggtgaaaaaactttaatccatattcacattgtaagtttttctatggaaaatcacttcttctttttttccacgcggtttcaaaggttaatcataaaaagagtagaagttaaaggaacttttttgtatctattatagtttgtttttatatgtattgtgaccacaaacacatatatctacatatttattttatatataaagagatagataatctaactgagaaatccacttgaagctattcaacaatttttatagctttcttcctctccaaaaccacaccaaaaaaaaaaaaaaaaaatttgattttcagatccaatcaaccagag

SEQ ID NO: 637 - DNA, 3000 bp, Unknown
  misc_feature (1)..( 3000): cDNA_ID_3058103_gDNA_ID_1620302_Annot_ID_152669 3000 nt of promoter + ATG
gcgtttaagcaaccgatcattttgaggtaatgcaggctctcttaattagtcgctttcgaaatttttcttcaagtgttgctttctcatttacttttctctggttttacagacctatggcatggtttttcattgcacatatcactgtgccaaatctctctaccgtcatgttctattaccaaaccgaggtcttgcaattagacgctgctttcctaggaactgcccgtgttgttggttggttaggtctcatgtttggaacctttatctacaatcgctatctgcaagatatgactctacgcaagtctctcctgtaagcctaaatatctcccacatacacgtcattgctttctcaatatatccttcttttaagtgatctaaccaacaaaacatcatcacaggtttgctcacatcgggctgtctgtaacgatactcctagatatggttctagtatcaagagctaatgtgggctacggagtttcagacaagacaatggtgctcttcggatcagctctaggtgatgccatcaatcaactcaagtaagttgcttttacttgtttatttcctctggtacatttcttccaagaattgcaactcaataatcattctttgtcgcagattcatgccgttcctgatcttgtctggtcgtctatgtccacctgggattgaaggaacactgtttgcgctgtttatgtcgataaacaacctaggaaacacagttggatcgttcatgggagcaggattggcttcacttctgggaatatcgtcagggtcgtttgacaatatgtttatgggcttagccattcaagtgttttgcacttatatacccgttttgtttcttttcttgattcccaaagaagctacaggagtatcagcatcatagggcagagagcaaagagcaaaggtagtttctcatagaacagttttagatcagaatttttggataacttttttggcatcagtttttgactttctttaaacgcttggaattgactacacatcagacagacactcggtggagatttgttatatatactaaatatatactgcctcatttttctcttgtcaaccttacagtcttaattcactccaaaatatgcataatgaacatacaaaaactaatcattcaattcgatttaattgttctatatttcaatgataaatggtgcaaaaaccaaaaagaaaaagaaaattctaactgttaattgtattgatactcttaatatattaatctcgaaagattttatggtttgagtctgaaatgtaataaagtgttttacagttcatttcgtccaattttcaacttggggaggagaaagtgatatgtatgccggcaaaaaaaaaaaaaaaagtgaaatgtattggacgaaattagataactagtgttaaaaatagtaatgaagctgaagcttaattgggccttgtgggttatattaaatgggctatgaagttgggaacaaaaaaaaaaaaaaaaaaaaaaaattatcagagccaggtttcgatcctgggacctgtgggttatgggcccaccacgcttccgctgcgccactctgattttttgttaatcatcatacaaatcatttaattaaccaaataataaatccgtttgaaagaggattttccgctgggactcgcacggtgaataaaaagttcgacgatgaaaatgatgagacgacgataaacaagaatcggaggattacaaaacgctgcttcttaaatccggtaaaaaaatggttcttgatgcttatgtaaagttttttttttttttttttttttggtatcaatgttaagtaaattgtttgcgtctatgcttatgtagtagagactcatgagataataaagttttttgcttttgaaggtaaagctagaggtgggcatttcaaaattcggtttggttctggtaatatgttatataccaaattagaacttaataaattacataaatttggttcggttaggggaaagggtagtgaataagtaattgaaacctacgaagtttctaatttgttatggtgtcggaccatgtacataacgttaattgaagatttgatttgttgctttgaaaactcgcattttacaaatttgggagtattatgtaaattggaagaaacggcgacgtattcttttaaatctgcacgccattgaaacatacttcaagtatgtacacgttagttcattgatgacgcaacgtaactagatgataacattgagataaaggaactaaaatgacaaaaattctgttaattttctgtgttgtggtatacgctaaattatctatcgtgaatctgtgtataatgtgttgtatagaactatagctcatgtaattatcgttgccgtcgaaattttatacaattttagaatactttgatgatctgatcttacttttgtcactatattttgggtgatgttttttttttacgtaaacgtaatatttgtgatgaaatctaaaccaatctcataatcgttgtaaaatcttttaaagaatagtaaaaaactatttgtgtccaaacgtagacacatcaaaaagataaaaaaaataataattcagtccactatccatccaacctttaaatcacatacacatatcatcttcatgatatttttttaaaaatttacaaatactttagagaaatctttttccttgctgattctaaactttctgagattaattacctaagttagagaatttgtgattcttggtcttggatgatatttttacaaaacactcaattattcaaacacaatagcaatatatcatagaacaacatatgcattcattaaacacgaaattgtttttaagaaacacctaaattacttaatacaagtcacattttgataattagaatattacagatttagttacaaaataatcaaacttaccactttaatacggaagttattttttttttttttcttttttttccagcgatttatttattctgtttttttttccctgaatataaataaaatagagttaataacgtggagagacccaaaaacagaaac

SEQ ID NO: 638 - DNA, 3000 bp, Unknown
  misc_feature (1)..( 3000): cDNA_ID_2044667_gDNA_ID_1620302_Annot_ID_152663 3000 nt of promoter + ATG
atccataaaaataggagcaacaggaacagtcgctactctaatgacacgagagctagactccatgaaacaaacttcgcctaagactcccacaacaagacccattagaacaacaatccctgtctcagtagactgtggcacatcttcttcaactccaagaagaacaaaaccaagaaaatcatcagacgaagctagcagcagcagcaatgttaacaatgttagaacaccaaagggccacaatgccaaaaccacccatcagctttcaatgcttggctctgataatgttagaacatcaaagggtcacaatgccaaaagcattcatcagctttcaatgctcggctctgataatgttagaacaccaaagggtcatcacaataccaaaagcactcatcagcttccaatgcttggctctgaaaatgtatcgttgcaaggaaccccgagaagagagaagagaatgaacattgtggagattgtggacgtgaaatgtgggaatccagatcgagcttgggctaatccgataactagtagactcaagaagcttggattctctaaactcaacgagagcattggttaagagctctgcaaaactttcctgtatactctgtgacacatctggtttgtacatcgagtatgaaccggttaaaccaaatcacaatgtaatctttctttgtcaaaccaaaaagctttggtcaattacattcattttgtattttggcatctatctttatcaacaggctaatttacctagattgacatgactataatgggcggatacatgaataaacgcactaatgtgtgttttgtatatatatttgaaaagacgagtagatgaaactgagctttcgagagagagactgtgcagagaattagtttgacaagtagaagtcatattggcattctctttgttcttcttcttgacaattccgaatttggtaagtgaaaaaaaaacaagaaattaaatagatatggttagttaggaccagcgacatcattgaacttgaatgttcggtaacaaacacctatcatcatgagtttcccataagttgatcaagtctcttttgatccgcatccacgtggtccaacacatcaattggttccttcgtattttgtattttatatcgtgattttttgagtttttataggctaatataaatactcatttatttgtggatagtttgaactgtttatagtgattagtgaacgattattattgaaaagaatcataattaaaatgttagaatttttaaatacgtatcaaggtaattgatagatgaacttttagtaaagtcatgtttcagtggattttagtttattttatttgtctaaacatatcattaatatatcatatatttggttaagacaaagatcaaattattaacaagtgttgagattaaatatttatgtgatgttagactccaccaacaaagaaatagtaatctattatcatcaaccaactccagttacaataaacatatactctaggaaaaaaatatgtgttgtattgtgattcgtaatcaaaaatataataacttgggtggttctagtggttggttagaccatcatctgtatgtatacgtacacctgtggcctgtatatatattgaaccatgcatgactaaacgatataatttttataaactatatcatctagacgaagtttctgattgaagaaaaagattccatgacaacaaacacgttatctagattcgttctacatttccaaacaaaattaacgtgtgggaaaaccatcagatatatctaattgttttactaaaaccgtccaagatacaaaagctttaatatgtcatggtttcgaaatatgcattgacgtataataaacatgaaacaaaaaatggtcttaaatatagttattgctaaagaataactaaattcaacaagtgttataaaagaagaagcgagagggacaagccaacaaattcttcttttgtgcgtgtgtttgaaatgtcctatttaggaactacaaagttatgccattaatactttttgtaaatgattaaattttagattctctattgattttgaaagtctataattttcttacaaattgttatttgttcataaatggagatgcatttaaacataaatgttaaccagattggaagtaaatagaaaaaaaattcttaataaatagttttctttttgttagatggaatatctattattttttaaaaaaaaacaatgaacactttcgtgagattaataaataaaaagtaatgaatgtgacatagatccaagcaacagtaactgcatcgatggtcgaccacaaatgtttctttacttaccattctttaagaaactactttatttgttgctcatttttaaaagaaaatatcaaaaataacaaaattgtttccttcaacaaaacgcttctcaagattctcgtgctttgtgtttcaaatggagttactataacaactgataacatatttgattatcattcatttctcagtactaaggaataatatattacatagtcaaattcatattgaaatactaaggaataatcaaatcacaatacattgtaggaacaataatcattctttttataaacaacacgaataaataatattcaaataagaacaaactataggagaacgctatcaatgaagattaaatttagacgaataatcaaatgttgacaaaagaacaaaagctgaacaatcaaatgatataactagtgagcagtgacacgtacactttgggtttactatacttcatggaaagataattagttctaaattgactatattacccttccataacaacacgcgaagagcttaaaactaaaaaccaaaaggaacacacgcatcaactaggggtaatatagatattttctaagacgacgggtcaactaccaatccatataaaccgattactaccaattagccagtaacaaaagaaaaacataaaaggaaaggcaaaaagaagatgtgagcttgtgaatgccaaaagatcacataactttctctctgtttcatcaatg

SEQ ID NO: 639 - DNA, 3000 bp, Unknown
  misc_feature (1)..( 3000): cDNA_ID_2990548_gDNA_ID_1620302_Annot_ID_152653 3000 nt of promoter + ATG
atgtgacaagagttaatcgtatcacaatgtctcaaatcgtgtaataaatagatcaattcagtgagatcagagtgtgttttttctttcgatatctccaatattttttagtttacctcatgaagaaataagacaaaataaaataacattaaggtgtcgtcatatgattggttcagataaatctgacgtggacatcattggttattaaaaatgattataaatctctttgtcttaatattttctcaccgtcgagaaaacaaaacacaagttgcagactttatccaaatttagggttttctctttttttcttacttagttatcatcagatcttcaaaaccccaaaatttgcaaatcaggtaataactttctccgtatgtatctcttcgatcaccgattgtctgtttctttgtttgcttttctcgatccgttattgaatttttgagttcgtcgttaaattttgattacatcaatttttcttttcgattcgattcagagagattgaattgcaaattatgtgccagatcttcgtgttctgtatctgattccggatcttggttattagttttttttttgttgttggaatgaattcaacaacgatgattttgatttggtcaattgattttttaatgctatagttttaaccttataggaatgtaattgaactggatcagctttacttgaattgtttggatctagattattcagacaacatctttttaactaaattgaaacatatttgtgtttgtgttcttgatgatcatgtgaatttggtagcataattttcttgttgagatgatttctgagatgggtttttgtagtttaattttcttactcgatgaaccatctcgtgcaccttgcaaaatcttttgttctatatctcattgttcgatatcaaactaatgaggttaacgttttttggtgagacgaccagttatgtaacatgttgttaactatcttcatgtttgaatcgattttgattggatgttttcatgttctatcatattctgcggttttgaatcttctgaattctaacgtgaggttatccttcttgtgcagatctcagcttcccggttagtactaccctcaaatcaactaagtttcatgtctgaacttgactcccaggttcccactgcctttggtatgtttctactctaccaaaacttgagattgtattagtcactgatcttcttctacttgttttagatacttgaacatgttatcatttgtaaatacatgttaatcaaagcatcattttttgtttgattatgctgtttatcttacatgggaatctgtttatctctctcaatttgctgttgcttgtttcagatccgtttgctgatgcgaatgttgaggactcaggtgccggaacaaaagaatacgttcatatccgtgtccagcagcgaaatggtaggaaaagcttgacaaccgtccagggcctgaagaaagagtacagctataccaagatacttaaggacctcaagaaagagttttgctgcaacggcactgtggttcaggattcagaactcggacaggtaggttttatcaaaacactctattgatccatgtagtggaaagtggatgataatatttctgtcgttagtgcctgcttgaacaaaccagaatgatttggcctcttatctgaacatttgagcttctctgttttagttttgtttatggtttgtgttgatttgtaggttatacagcttcaaggtgaccaacgtaagaacgtctccacattccttgtccaggtaaatatcaataactctacgagtctctttactgctaaaacatacaaactgtgtaagatgattgtctgatctcactgtttctctgtaatcacaggctggtttggtgaagaaggataacatcaagatccatggtttctaagctatctagtggatcatattattaataaaaccatatctttttctttcatctcttgttgcgaatttcgggtttgattcatcaaaatcgtcttcttcctagtgttcttcttctgtttggtattcgaattttaatggcttatgttcaccatacttcttcccctgttttcgtgttactctgtttcacatcttacttatcttataatatcagtttgttaagataattctgctctaacttgttataatttttctctacaatggttcatagttttaaaattatataaggaccaaccggaagtttatacggtcgatactttccaagtataccaaattgcaggttttagtttggaccacaaaaaagttcaatgatcaaaaaggctgatgtatcttctcactagtaataataattcataagcacacaaataatgataaatgaactgtctctgtcactagtaaagtccaaatgccgtctctatcgtacaaagatatttcaccttcttgttgttcgtgtcaccacacactcactgcaactggctacagatgttcccagataaaagcttcgagatatttttttatacatttattttgatccatatcacaatattaattgcaaagttttttcccttttcttcaagaaatagagcaatccgattcagtcaattctttgaagttataacagtaatcaattcgccattaattttatacatttaatcaatgtataatataagtatttttctttcataaatgggggaaaaaaatagagatagtttttgaccaaaaaaaaaataaaaaaaaatagacatagtcattggagatggttttactaaatttgggcttgttcaagagaagtgtcttttcttcattcaatcagaaccgtgaagaaaggagatcgttactttccattgatggctaaaaattaaaataatcacgataaatattaataatacaaaaaacaattaaaataacaaaaaaagatcaaaaattctctaacccttcattccttatctctgacgtggccatcaatcttcagattttcttcttcttctaatttaaatactcaacaaccactcttcacttcaccatcagcatcactaaactcgaaccctaaagaaaaacaaaa

SEQ ID NO: 640 - DNA, 3000 bp, Unknown
  misc_feature (1)..( 3000): cDNA_ID_3058128_gDNA_ID_1620302_Annot_ID_152654 3000 nt of promoter + ATG
gattataaataataatccttacattcttttggtttcctatatcattttttgttcattttagaatatttaatatttggtagattttttttcagtcatatgttatatatgttattcacttaattgttgagatacgcttgtgtaacaaattacatatagcatgtgagttgtatatttattactttatttctttgataaatttatgtatatttattactttatttctttatttatatagatttcatgtctttactattgttacccatgatatttctagtgttttcttttcttttataacttagattatggatatatttaagatataatttgaaatgtctatgagaatattaatgaaaatttagataaagtgttaatttaattaacattaataaaataaaattatattgataaaatactcaaatggatttcacaccaatggagatataaatttaaattaggattctcaaaaacaatttctataaaaatattaatattaatttggtgagatacctacatggtatctcaccaatggggatgctctaagtaagagatacaaacaaaatacattggtctgaattttttctaaagagaattgttagagacattttgctgcttcacacaaacgtatgaaattcttgttaacattttcttgactcaaaattattagttatgatatttcaattcaacagttttccttaagtttcatgaatctttcatatttggattgctaatttctaccggctttctactttcttagcctgtcacacataaataagctttttcaattatgattcactaaatcttgggtatatgacatgctttctactataaactatttcgaattttgtatattaaatataagattctccattggaaagcgtttaatcctaacatggcatgtttatgatatgcatatatatattgaatgtacgtgattaagaactttatatagtttccatttatttgtagaggtaaacctctttattctttttcgtaaaaggtcaatctccttactcgctctataatttaccatttatttagatacaagaggtaatagtaagatatatattattcactagtcgtatctaagtttccatttgtttggtcatcacttatatgaaagttttccttcgaagctaattattattataaaacctcttctttgttattgaatatatgtttctttcggctttcaatacacagtatacagacaaaacgagaagggggaatggagggcttgggactaatggcgtttatagcttattttgccctttttgcattctttatatgtgttttcacctatgcattttatgtatattgggcaactagagaggatcgggcgtaattatattggtgattgtattgtttagttttatttcttctgttatttttttcatcaatatagtttacttcgcttacgttcttcttctttttttttttttgtgatcaaccacatcgcttacatacaattccattattttgtctctgaatagaaacagttattttttcaagtcttggggtggcttagtctacttttgtcgtttggctgaaacgatgagtgacttaaacctttctaacgactaatgtcggagtcgttgaatacgtcaaaacaagacacaacttaattcactcggcgaaaaatctaatgtgggttatgacacctaatttagtttcttccaatgttttccaaacctagttttctagggttttggagaagaacaaacaaataaaaaccgaaccaaatcgaaaatacttaaacagaaagctaattttgtcaccgtgtttagttctaacaaaaattaaatcatccaacacaaattgcatcaaatcggatggagatcgaactaaattatcaaagtatagaaatccggcatagtgagtaaaccgggttcaaacactttttgtaaaagttcgattaaacacaaagactcttagtcctgtagagggtttgaatccggtttaatcactaacccaaaactccaaaccaaaaactgattgactaaaccaaaaactatgtcaacagattgactaaaccagaaactttgtcaaaaaacgcaaccttgtctctcgtttactaaaaacgggaagagaaagataataaaagaaagatcgatgaggttgaccaaacgatcaacaccttcttaattcaccaccattaaaaatgtttgcttctccagagaccactcaacatagttgatgattaattagattactagtaaaataattgcaaccccaaaagaaaagaaaagttctgtctttcatcttttcttttaatctcaaaaactggacccctcttaattagatctctaatttgttttctttcttctccaaaatttgacaaagaaaagaattgatcttttgagagggttccagttttttttctctttcgtcttctccattcttgtttgtagaaaaaaacccattttttatttggatttttcatttgattttcccgggaaagttgtaatttttatttttttgagggagattgaaaaagttcgataaaaatgtggggagccgccgcagaaccagcagattcttattacctgattcgtcctgagtgcactgatgtccccaataccaaattcaagatcaaagtttgttcctttccctgatactttcatctttgttattgacttttattggattttggtcagcattggattcgttatcaatgagattggcgtttgcgattctctctgagctttcagattcttttactgggtttatgttcaaaatgtgttcttttggtgttgcttagattcttcattctaaaattttcagctaatttttagcattatttatattattatcggcgtgatgtctctttggatttggaacttttaccattggtagatatgaacaaataagcgatgagagcatttactagttatgatttaggctatgacatgtttatgtcttatgatgctgatttataatgggattattgatcttagtgctctttctagatttgatattctcatggtttcgtttagagaaatg

SEQ ID NO: 641 - DNA, 3000 bp, Unknown
  misc_feature (1)..( 3000): cDNA_ID_1017693_gDNA_ID_1620302_Annot_ID_152658 3000 nt of promoter + ATG
tcgtgatatttttggttttgatatggaagttttgtaaccaagtaaacggagagagacgtgttgaaaaaaacttccacatatgtcgtaccactgaatcagcgtgaacatagaaagtttactcaaaaaaaggataagaatctataagttagtatttgacagtcagaaacaactgtaaatgaatccagacacataagtttggttgatacaaaatcgataatataaatggaaaatctttgaactctcatcttatagatttcttgccacatcgtcacgacttatcttcgaagatcgatagtgtttggttcagactcaagtggcctcgtcactatcaaattattcctatgttttggtttgattacttttacaccggtttagttcagttttggtttctagtttcgttagcccctaaataatattttattttcaataatcaaagaaactttattatatatatatatatatataacaaaatatatataaaatcttattgatgtccaagtcctcattcttcccgaggctcaagttattcataaatcaaagacgtccaagaacatcactaaatgtttaaacaaaacacactagtgagaagtcttgaatatttcaacttttcaagggttgtgtacaagaacctgtacagcccctgaaatactctgtaacatatcggctccttcatgtgccaacatcctttgactttcccccatacgattatgcatgtaaagctccattgtttccaacatagtcccatccgcatgtccacttctggactgaatcaaaaacttcaatacatttagctcattaaagcgaccactataatttcttaccaccaccgttttaagtgtcttaggaagagacttataggtaaggttcttttgccaacatgttcgtggactgatgccacaatatgacttataatataaacgatgagccttcacattctgggatccgtcttatgggatcttcacattctgggatagccttcaaaaagaaaaatacacatattccgctcaagattaatgtctaacggtcttaaatatacaccaaatttaacgtaatcgattgaaggtattagataaggaaactacattaaaccattcacttttaatcactagactactgaaaagtttcatacctagctagtactattttcttcagttctcaaagatatgttaataatgtaaaatgtattgtaaatatgttaagacttaaatatacctgaaggagataagggcaggcacttaaggtccttgcccctcgaaaactgttaaggaagccagaaagaactgttccgtctaatttggttatttgattcggttcatcgtaatcgccctctgcgcagaagtccaagtagacttgttttagtttcctattcattctcttgacatggaaggagagaattgagcctgatcgtacttaaagatctctacattaggcaggtcaaaggaacaaggctttttagggaagaagtcgcagttatcgaatacgaattctttcatatctcctgcaaagttcttgatatcaatactccagcagtaactaagacttagactcttgagcgtaggagagtttgataacaaagactcggcctctgtgagcttgatccaaccaatagagagctttctaggcaatcccgagtttttgaacttggagggatcaagcccacacgcgtaaatctttagtgattcgagatttgtgtttaaaatccgaattaaaacctaatcaaattaaaactaaaccaaaccaaatacaatccaaaattaaactaattttggttgagtttggttatagttttactaaatccaaattaacagaacataaccaaacccgaagatttttagagtctttagaattttaaggtgattttagataaaagagattaaacacaaatctcgaaaactaaagaaagagtttttgaaaatttttaagtgttttcatgtaaagtggatttctctgtgttttctgcattctgcggattataactcctatgttttttttctccgtcaattatatgtgtttattttctctattttcttttatttttatttttattctctatattagggtttagtttatgaaaactttttgttatctatataggcttgggggatgtatttaaattagaatttaaagtgatttgagttctttgagtttttaaataattttaacgattttaaaaaagttcgtatgatttttgtaaaatctattaaaatctcaccttaaatcatgggatttggatttctgtattttgaactaagaaaatcctctcaaatcctccaaaatcattaaaattcaaatccacaaattgttctgaataacagtgaattttaaggtggattttgaaataattagttcaataacactgaatttcatgagattttttaaaatacatgtttgaataacatatgatttataaattctacacaaatcttttaaaattctaatttcaatacattgtttttgaaagtgttattgactcttgccaatatagtatcccaattcccaacttgtgtttcattttttcatctatctaataaacaattagatgaacacaaaaaaatattggtaggtgatggctcaattggatatgtttttgaaaaccatgtgttaaaaacttaaaatactatccaacttaccccagtcctaccaactttttttttcttctcttggtctgcttacatgtgtctgcttatatctccaaaaggaaatagatatataaaaattcaaatttaaatatttgcgatttgttaaattttaatcaatatttaatttttgtttttttttgtttttttttatgaagacaacaaataaccaaatttatcaaatctgatcaaagcagatttaggattttacaaatatatttttttaatatgaattttgtggtcagattttgaccaattctctttgaaaaaaaaaaaaatctatctataaaaacatgtgttactttgaaaggatatttcaaggagaagaatatatttgactcagagagagattcattcagtaatg

SEQ ID NO: 642 - DNA, 2846 bp, Unknown
  misc_feature (1)..( 2846): cDNA_ID_3058132_gDNA_ID_1620302_Annot_ID_152652 3000 nt of promoter + ATG
gatcttcaccaccgagtcttgagccagatcaatatcgctcacagaagaacaacaacgataaatcaaagaagcattaaaagacgaaccaccacgaagaagggaaagagaatacaaaaatagatgaaccggagtgctcgtggagttgctgaacctagccacaatatgatgttcttgttaagtactatgtttacttgtattaacgatacataagatatatcatttacttgattactcatattttcgatccataataattacactacttccttttcctctagatttaaacttgctaacaaatatttttaaagattttaatggaaattgttaacattttatacaaggcttttatataatcaaatgaaactatagattttggtaacacataattaatctgttgtgctctctcttttattttactatgggaaaggtccaatgggcttaggcccaattatttaaacaaaaaaagattctaactttcttctaatggaaaagaaaatttgcgatcaagcaattactctctctctctctctttcttctgccatcgccaaaaacttgtcttttgcttctgggttttgcttcttatttttggtaagattgaatttttctttcaccccatttattatttcgtgcttttagatcgttgattgatctgtatcctgcagtgatcattctttaatttacgaaattgttttttgtgtgtgtgtgtgtgtgtgtgtgtgtgtgattgataatgttgttggggactttaggtgccatttttgtcgattttgtggtttaatttacctattgtatattgtgattgaatcgattgggagggtattgagaggtggttgtttcaatctaacaaaatcaagtgcaaatccattttatagccacttatcttctgctagtagatctacttgagttttaagagatgtgtcttctttaataccattgtggttccttttttaatttcatggcttaagtgaatgttttttggcttctttggttgctatagcttatctctgatttgattaagtagaatcctttgtactgaagtgactttttttgtatggatctaatgtagaatatagtcattggagatggctccggttggtcctcgatccggtgatgcgatcttctctagcattgatcgtgtggtaagttcagatttcaaagttttcgccttttttatctgttcctctttgactctgatttatagaatttggtatttgatatgctacattaccgatttgcttatctatttcttaggatatgcctttttctatgtatgctttattgcggttggatgtgtttttgtaatttgtaaaggatttgagaagtcaaacttgaagccagttccgaatctttgatagaattttgttatggagatactgtttgatcttgtggaaattgatgatttgtagaatgcggagttgttcacgttgacgtatggtgctattgtgcgtcaattgcttactgacctggaagaagtagaggaagttaacaaacagcttgatcaaatgtattcttcttctacgatttatgtagactctcttccatggttttagttttgtatttttgtcatcttgcatttgtatatttcattcttgtgtttgaattttggttgcattatgtttctggttcttttgttcatatatctttctaataatatgtcatggatgggatgaataaagcattgtactctcaggttcatactgatgagtgttcgattgtttagacctttatcactaattttctgtttattttgcaggggatacaacattggaatccgacttatcgatgagtttctagctaaatctggtgtttccagatgcgttgactttaaggaaactgctgaaatgattgccaaggtttgtaatttccagtgacttgtttagtatcacgacgttacagtttgaagtgtctccgggagtaaaaacaacgaggaattaaactgcaagatatatgaatgtttattccacttgacactatagataaaaccttatatatcaaactagagcataagcttcttaatgtctagtagatatcactcctttggtttcatggtattgagaaagcagtaacagggctttgccttattgcacaggtgggtttcaagatgttcttaggagtcactgcatcagtgacaagctgggactcggacgggacttgctgcagtataatcttagaggacaatcccctagttgatttcgtcgagcttcccgatacttgccaaggtctttactactgcaatgtcttaagtggagtcattagaggagctttggaaatggtcagtctccttctccattatcaagtgcagaacttgtttgtgctcagtgttttatgttcttattttttgtctgcacaatgatcaggtctcaatgaagacagaagtgacatggacgcgtgatgttcttcgaggagatgatgcttatgagttgcaagtaaagctactgaaacaagtcgctgaggaatatccttacaaggatgatgaataaatatcaatctcttatcttccctcttcctcaaagagaaactaattactgttttgtagtctctttctctgcattcttagctttgttttttttctccgcaaacacaaaactataagctatgaaactaaatactgtttaaatccatttcttagtgttctgatgtgacaagagttaatcgtatcacaatgtctcaaatcgtgtaataaatagatcaattcagtgagatcagagtgtgttttttctttcgatatctccaatattttttagtttacctcatgaagaaataagacaaaataaaataacattaaggtgtcgtcatatgattggttcagataaatctgacgtggacatcattggttattaaaaatg

SEQ ID NO: 643 - DNA, 3000 bp, Unknown
  misc_feature (1)..( 3000): cDNA_ID_3058193_gDNA_ID_1620303_Annot_ID_152701 3000 nt of promoter + ATG
tcctccatcagttgttaaatattggtctcgtcttgatcaacttagcttagaatgccgaagcctcaagagattaacatatgtcccgccaagcataactatgctaagcctaagctttagtgatatagagacgattccagattgcgtcatacgtctcactcggttacgaactcttaccatcaaatgctgcagaaaacttgtttcgttgccaggtcttcctccttccctagagttcctatgtgcaaaccattgtcgatcacttgagagagtacattctttccataacccagtcaagttacttatattccacaattgtttaaaactggatgaaaaagcaagaagagcaatcaaacaacaaagggttgaagggtatatatggttacctggcaaaaaagtccctgcggagttcactcacaaagctacaggaaactccataaccatccctctggctccagttgcggggactttctcggtgtcctcaagattcaaggcttgccttctcttttcgccaatcgaagacttcccaactaatgatataacatgtcgtctaagaatcaaaggaggtgtccaaattaacaaattctatcaccgggtagtgattctagagtcgtctaaaattcgaacagaacatctgtttatattttatggtgacttgttttcagaaaaaataggcgtagatgtgagtacaagcgagattctgtttaaattcagctgcagggataagcacaagatcattgagtgtggtgtacagatctttaaggaggaagctgagagtagcagcagcagcagcgaagaggaatactttgatgctgaaagtagcagcaacgaagaggaatattttgattttgagagtagcagcagcagcgaagaggactactttgatgctgagagtagtagccgcgaatgctggagatggagactatgaagcagaagatgaaaacatcaaaagcagtaaatatacaagttgttggacttgtcttaagaagcatggtctggggaggatggaacctgcattacaatttgaaagatctaactatgtttggttttgctacaacctatgatttggaagctgacactaggacaatgaggacaagataattgactgtggtttgcagatatattgacaatttcatacaggtcacaggatttttggtccgggaaacaaaacagaacctccattatatttacggattgttagtgtctttgaatatttctgattatccaaatctgtagagagattggaatacgtgatcctagattcaaatcgttttgaattgtctcctctcttaaatctttacgtgtttgatttcaatgtaatttaataaggaaacattgttatattcaatagatggcttattcagaaccattgtaactctgggataacttctctttttctgtgaaactgactgtagtagccaacacaacaaataaaagacagtaaaacaaaagctgtgaagttctcatccattaaacttttaaaataacccacattctattaggatccatcattcaaaagatgcagcaacacacaacacacaaaaaacaatgaagtaggaataacataaaacatccaaaagcagaaattattttcttgttgaataagtaacatcaaactccagctagcgtttgcaaactttgtaaagaaagtttgtttcttgatgttcaaatttagctcctcaacattcaactccttccattcatcgatgagctctttaattgtttcagctccaagattcttcaagtttggaaacatcaacttcttttgatattcacttaaaccttgaaacaatataacagcctcaagtgcatccttcagagcacacaagtcatcttcctcactcttctccttgtcaccattatcagtctccatattattgtaattcaacagctgcttacatcgggttacgtataagtaaaaaagcatcaaacttttagaccatctccaatgcctaactctattttagaagaaatatagttgattttgctccaatgtatgactctaaaatagagaaaaatatagagtagtcttattttttactctatatatagagagcaatctctacacttttcctctattttagagttaactctattttgaaaatacaatggagcaaaattaactatattttctctaaaatagaatcatctctaaaataaaggaaaaaatagagttaggcattggagatgttcttacataaagaagagaaagagaaggaatacacactcacagttttgatcttgtcgatactctcctcggaagcacattctgtttctgattctaagtctgatattatgatcgttggcattttggacgcttcttcatgcggacgtttttttctacgtcggaattcaaagccacccgtgtaggagtcgtcgctgctggaatcatttccctcattatccattttgacaagggaccaaaagaatcaaacttggcaacgtttgggaaataaaagttccaaaactaaaactgccactattgagagggaagagtgtgaggaacctgtttttaaacaaataccagagagagggaagagcaaacgttgaattggaaaaatgcactctaccttgaattatatattactgtaactttaaaccaagaagtatgaaattatatatgtaaatcgtgtgatatgaaatttcttgtatcttttatgtctacagtcttttttttttcttacagcaatttttatgtctacagtctacttgatgaaatttctcacaaattactgaagtagaaaatgtcctgatttaatatatgaaagactaaagctaaataactttgggtataaaataaattagattgggccatgttagcccattaacatttttttatatcggcccaattagggacacacataaacccttaagacaaacatgttataaaagtggcggcttcagtcgaaattagggtttcgcgttaggagaagaagttaaagcaaaacacatacaaacgcagtcaccttctctatcgcctccttcttcaatctcatcgcaatcatg

SEQ ID NO: 644 - DNA, 3000 bp, Unknown
  misc_feature (1)..( 3000): cDNA_ID_2044782_gDNA_ID_1620303_Annot_ID_152708 3000 nt of promoter + ATG
tttgaattgatgatatgcttaatttctctgttcagaggcattgattttgctatagcgaataatgatattcctaagaaggttgaggagtttccgtggttactcaaacaggttatttctcaattaaaatatggatttttttttttttctggattaatggaggccattgttagtgaactgatgatagtgcttgtgttatgtgacgtagttgtgcagacatggaactgatgtgtacactaagacggcgcttatggtgctgatgatctctgttaaggtaattaagagagtaatctgcagactgcttctgttctgtgaataagcactttttttttgtttagaaaagagaagccttttgtttagatttcatgtcggttggaatgtttgaggtcaaaaggttttcactttgtcaccatctatgatgactcatttggttttgacatataatacttttgatttttgttaaatgtcacagcatgcttgtcatttgggatggttttcggatagcgagagtcaagaacttatcgctctagctgatgaggtttgttttcttccgaatcatggtataaaaccaaaagcaggttatttggatgatgaggatacaaatgttttctttcttattcagataaggacttgttttgggagttctggaagcactagccctggtatcaaaagtcctggcagtacattttcgcagatcatggagaggtaggttttgctttcactgtgtggctttgttgattgacatagattttactctagcagtttattaggagcgtgaatatttccaaacttttatcacaagttagttaagcagtaccaaaaacttcttcaatagaatggtattcactggatacaaatctaagcattggttgaaatttatttctttctgatcccaggttctatccatttgtaaagcttgggcatgttcttgtttcttttgaagtgaaggtgagcctttcttctgttctaaacatctatttctgatattatcatctaagtgtgcttttttggctttccttgcatgacaggctggctatacaatgctggcgcatgatttttatatctcaaagaatatgccacattcactccaagagaaaattgtatgtgtggctcatctgttagtcattcgatatctcagtctggatctctctataataaattctacctttatctgtgcaattaggtggaaaatgtgaatataaccattgcttgcattctatctaacagtccttcatatacatttttgaatctatttcatcttgtagatgtgcccactctctgcaccttttggttagcaaatgatttcttacaccagattcttgtttgctcttcagcggttatttgttgcccagacagacaacatagacacgtctgcctgtatttcaaatcctccagaagtcaggtatgcgaattgtttttgctatttttcctcaccgacacgaaatgtgatccaatttaaccttcctggctttcatatgaaaattgcagcttcttgctaaatggaaagggggttgagaagagagtcaatatcgcaatggtttgtgcagtttgacttttaattggattttgtttctctgcactggttatgtgcatgtttatgtcaatttttttctttccaggatacagggcctcaactccctacaaatgttactgcacagctgaaatatggaactaatcttctccaagtgatggggaattttaaaggtttctattcaattatatatatcttttttgttgtccatgtctatttaattaatatcttattaagatgcttgattgttcaaaggaaattacatcatcataattgcttttacgggactggtagtgccacctgaaaaaccggttcttaaagattaccttcagtccggagtcattgaagcaagtccaggtaattaaagagcataagataggagagaggaacatttttcttgaatgctctatactattccagtttgaatcattcaatgattgcaagcacatacctgtaagattttttttccaatctaatcgctctgtacttttttttacctgtctatagattcagacatcattgaggggccatcacgagtatctctcagttgccctataaggtaccaattctacttttttacgtactactgtgttatcttatggttgtttttttggtcagtgatttagtctttaataaaacagtcgcaagcggatcaagctaccagtcaagggccagttatgtaaacatcttcaggtgatgcaatcaaatatcaagcgatattctctttttttccatccttttaaattggcatacagtgttttaatgtgggtgttaccttatttttctcgtaatatttgttagtgatgtgatactttctgctgcagtgttttgatttctcaaactacgttcacataaatatgaggaacccaacctggcgctgcccgcattgcaatcaacctgtttgctaccctgacattcgtttagatcaaaacatggccaaggcaattagctatctatgttgtaatttgatttctgctacatttttgcgttgcagcttaatactgataactcgtctcatatcatatccttagatattaaaagatgtggaacacaatgctgctgatgtaatcatcgatgctggtggtacatggaaggttacaaaaaatactggcgagaccccggaacctgtgcgtgagatcattcatgatctagaagacccgatgagcttattaaactctggtcctgttgttttcgatcttacgggggatgatgatgctgaactggaagtttttggtgacaacaaggttgaggaccggaagccctgtatgtctgatgctcagggtcaatctaataataacaacacaaataaacatccttcaaacgatgattactcttcgatatttgatatctctgatgtgatcgcacttgacccggagattttatctgctttgggaaacactgcgccacaaccgcatcaagcttcgaatactggaactggtcaacaatattcaaacttatcccaaataccaatg

SEQ ID NO: 645 - DNA, 3000 bp, Unknown
  misc_feature (1)..( 3000): cDNA_ID_3058175_gDNA_ID_1620303_Annot_ID_152709 3000 nt of promoter + ATG
gataaagatggaaactccctcctcctcatgcatcgtaccaaggtaaatatatgtacaaagtatttagaataaacttatttgaatatgttttagaatatggatcattatattcattgtacacatcatccttcaaaattacaatatcacatttattttagattattaagaatcaaacctctactaaatctgtctcacagttgtacttatgaatctgttttgttagcgttgtagttgtaaattagttgtgtagatattagttctaggttgtagttataaaacatccaaatacttgattgatacaaaacaataaatggagcaacaacaaaatgatttataagagttgtgaatttttggtggaatttaccaaaatgatatagaaatactttaaaaattgaaagaagttttcgtcgtccttacggatcactctagcgaagtatcggatcgatttgcttacaaccattagaattgtgatagtttgtaaatagtacttaaggtcggcgatatgttgataataatgaacaatgaatgttgagtattaatttcgctgatagacatgttagccgattttgtagaagacgttttgtttttagccgattgaagatatgtatgaacgaagatattacgaatactatagtatatatattattaagattgagtaggaccaactacactaccgtgacaccgtccacaataggtcacgtcaaaagttcataaatattctgcatgtggacaattgtattggcaagaatttcgtgtaacccgttacattctttgggaatagatttacaaaatttcattcagcataaaagttttgactataaaagtataatcataatttcataacgacgtctagaatctccgagtattatatgtttgacttttagtttcaccaaaatctagctatgcctaatttcgtttaaattgatcaattttgacgtgactacgtacatatggatctagatatttttactcaatgcaattttatagacaagtactagtttgagtttaaaatgttgtgtatattaaaaacgattttcctttgtattgtccagaaaattacgctagtagatagttggggaatctatgaagcaaatgatacaaaaggagaaacaaaaataccaaagtgcccaacctggtacatgaggaagaacttaaagatgaatattctgagcaccaaatccgacattttggcatacgtatattcaggatcgttcgataagaagaattcatacatcatcaaaggatcgtatagatgtaaatcgtgtaaaatagtgcacgtcccattgaacaagacagtggtggagatcaaaaggaaagaggtcagaaccaaaggagtccggttcggttcagatgtttttgatctggttgttaatcccggttttgacaccggtttggcaatggctttggttttgttattagatcaaatgttctcttaattaattagaggtgatcactggagataataaacatcctcttttttgggccaattgtacagtactattttaaaatatttcataaataatcaaacagtatagtataatatacttatatacatgatcttctttgtgagctttctaaatatgctcatcctataaaatgggaaaacaatgccctggtaaaaccgtaagtgtagtagtttttatgatgtttatttgagtaatttgattaacttgatgttctaatctgatgaggtagaaacagtaagttatatctaaataaagtggtttatgaattttagaatgaataacttatttcaggtgcaactacttttcttacttgttatgatggtactgaaaaaatggttaccaaattacctcattttcaataggacaagtcttgtgcagtgacggagctagaattttagtttacagggtcatatataattatatatttttatttaattatttattttaaattaaataaatatgtgtaagaacaactttgaaaataatgtaaagaacaatatatggaatatgtttataaaagtaaatatgtaccacaattttagagatttgtagccatattttagaaaaaaacacaaaacaaaaatgaaaaatgaattaatgcttaataaaaataaacatgtgaggggtcaaattaaagaatcgattatcggcatggggtcattatggaaaatttaaaccaaaacatccataaattattatgagatttaacttaaaaacaaaaaattataaatgttatggggtcaattgacccccttctcccttcactacttccgcccctggtcttgtgagactatacatgacgaagtgtccatttcaagaaggcaatacctatattacaaattaatgcagacaaatagaaacaacataaatgcctacatttatgtggttgcagtatttattttggtaacttgtctcatatggttataacaaactacctaacggtaatcatcgaagatgcattttggagcatatcatcatatcgactatcgatggtaactaactggtaagatccaaaagaacaaaggacaagagctagtttatgaatcaaagtgggtcttcaagctcaagatcattcatacacatgtttttatcatatttcttttatagcctttttaatttaataagtaaactactagacctaaccaagggttcatagtagtggtaataagggaaattattacaaatagtacaaaataagttttgttactaaagttaacacacaatttctaaagtttcaaatttagtaattaaatatttggggatataattcagaaaacctttaaagtgcaagggtaaaaattcaaaaaataattacataaagaacaaattacaaaacaataaagcaaaattaattacatggacttcataaaaacaaattaaaatgaaaaaacagggtcaaagagaattttagggttattgtcgattgagcagagtaatttattccttcttcttcttcttcttcttcaaatcgtgtttctccatttcaaaatccagaaactttgtgattccacggtagttagttccaatctcaatg

SEQ ID NO: 646 - DNA, 3000 bp, Unknown
  misc_feature (1)..( 3000): cDNA_ID_3058173_gDNA_ID_1620303_Annot_ID_152712 3000 nt of promoter + ATG
agagtgatccgtaaggacgacgaaaacttctttcaatttttaaagtatttctatatcattttggtaaattccaccaaaaattcacaactcttataaatcattttgttgttgctccatttattgttttgtatcaatcaagtatttggatgttttataactacaacctagaactaatatctacacaactaatttacaactacaacgctaacaaaacagattcataagtacaactgtgagacagatttagtagaggtttgattcttaataatctaaaataaatgtgatattgtaattttgaaggatgatgtgtacaatgaatataatgatccatattctaaaacatattcaaataagtttattctaaatactttgtacatatatttaccttggtacgatgcatgaggaggagggagtttccatctttatccatgaggatgagttcctcgggtcgggttcgggcataattatcgacccggtaaatcaaatctccattcgaatctatcaccgtgaatccttcacaactcaccagaagcgattttctccacaccgtgagtgtcgtacacgctcctccaatatctgcggcagcgacggagactgtggactctgtagatgacggtgcatcttcaccgtggaccgacctcgaccgttgcttcaagaaagggaacatttttgtagttttggtgttcttggttaactattttaagagagttttacagatctaattaatctcaattctcaatacaaatatggtaaggttaggtatacatatgagatatatatatatagatctaatatatatgtgtgtggatgaaagatattagctttgttatattatatcattgtcttattatattataatttttttcttctttatatcaacttgcaaagtttttaaatatcgctacttgatatttaaatgcgaccacaaataatacttagtgacaaaactgtactattctacaaaatataaaaataagaatttcacctaaaaagctttaaacgttttattaattatgagtcaaaatttttagtgttatttgaaaaataatacaatatgataagatattataccattctataagttaattagaattttttttaagttaatgaatacaggtcattagatttttttttatcacattacaaatacaaatttaacgtacgtaacatttacatttagtggactagaactcaaatcaccctattacagcttgcatatatagtaaattgtttttgttttataagtccaaaaggattagtctaaattacattgtttggttatcaaagaaattaaaataaaaaattagataaaattaatcgaaaatgaaaacttaacatgaaggttgaaatctccaaattatttactcatcctttttaccaaactcaaatatgatatttttttctatacgtaaaactcaaaattgtatatacaagaaatttagctatctaaaaataactatataataagccattatagtaagccacaattttgaccatctacgatcttttcttttgtacgtagtaaggtttggtgcaaacttttgcaagtaattagtatatagctcttatggatatggtatattcctgatatgaactctgattgggtaatgattagcacttagcaaggtagtcagatttttggctttggcacgcatgggtttcactgtttcaggattgaattggaatttttttttgattaattaatgtataatattttatacaatataaaaatatattactgtattaggtaagaactttacgacaaaaaaaaaaaaataggtaagaactttaagattatgcaagggtcttaaaacgagccacgtaatcttcttagacccacgatagtagatttttgaggtctccaagaatctcttatcctttttgtcatcgaatctctctctctttctgaagatatattaagaaacaaatctctctttttcttcgaaaaggttggttaggtgaaggacaattctcatccacacgattagatgcataaaattatatatataagaagaaaatctaattatatgaaatggtggaatttcatgtcacactagacgacgaatcttccatattaaactcacttctaacactgcatgtgtatgtaattatgtatatgaatgaatatccaaatagaataatatatttggactaatcaaattattggaaaagtacataaataaataagtgagctttcattgtcaaacctgattttgttgatctctgggtttgccattactccaaaaaatcttaccttcaagagtgatgtcgacacagtggagcacacgtgttgtaacacgtgtcatgactcagctcaaaattggatcccacggaagaagttagatctcgaggccaagagaccagagtcatcaattcaaaccccacgtgcgtgagagtcactgactattctcctcttatcttccgggtcttcgaaatccaatatctccaaaacgcagcgtcttggttaatttttgagatgtcaatatatataatctgtgaccttgtaatgtttaatcaacaggtgtatgatcatctttcatctaggagcattttcattctatcaacatattctcataacaattttactatgcctaacaattttttatttttactatgaaatggatcagtaataaatgggccttaatactgtaccaacaatcccataaatgggcccaatgctggatcctatccgccgacatctaacgttccactaacggagacgttatcgggaatattcacattaattaacgaccgttagttccacgccaaatatgttacatctgctacaaaataaatagtttgattttccaccgtggacggttacctactcgaggcccagacccgaatcaaacggactggattaaatgttttaaatcaaggggtgggattaaatctgaagcacacgcttttattcgtcacagtctcctcccacactcttcaatcagtaaagagttttaggtttttttttcttcttctcggaggtttgtagaatcaacaaaa

SEQ ID NO: 647 - DNA, 3000 bp, Unknown
  misc_feature (1)..( 3000): cDNA_ID_2044751_gDNA_ID_1620303_Annot_ID_152717 3000 nt of promoter + ATG
ttcagcctgtatctcctgctagttacggaagctctctcgaggtttaaacaattgagtatttgattgtgttttggagatttgtttgtttttttacatatggatgattacggttttgcaggttacgacatacaacaaagcagtaactccaagtagttcattggagttccgaggaagaccgtctagagaacctcactacaatctcaagacatcaaccgaacttcttaaagtactgaaccgtatttggagccttgaggagcagcatgtctccaatatctccttgataaaagctttgaaaaccgaggtggctcattcacgcgttcgaatcaaggagcttcttaggtaccagcaagccgatagacacgagctagacagtgtggtgaagcaactcgctgaagaaaagttgttgagcaagaataaggaagttgagcggatgagctctgctgttcagtccgtgaggaaagcgttagaagatgagcggaaacttagaaaacgttctgagagtttgcataggaaaatggcaagagagctctcggaagtgaagtcttcgttgtctaactgtgtcaaggagcttgagagagggtctaaatcaaataagatgatggagctactctgcgatgagtttgccaaagggatcaagagttacgaagaggagattcacggtttaaagaagaagaatcttgataaggattgggcgggtcgaggtggaggagatcagttggttcttcatattgcggaatcttggcttgacgaaaggatgcagatgagattagaaggtggagatacattgaatggtaagaacagatcagtgctggataagctggaggttgagatcgagacatttcttcaggagaagcggaatgaaataccgagaaaccgccggaattcacttgaatctgttccgtttaacaccttgagtgcaccaccgcgggatgtagactgtgaagaagactctggaggaagcgattctaattgctttgagctcaagaaacctgcagagtcttatggagacgaaactaagaaaccaaaccaacataacaaagacggttcgattgatgaaaagccgaaaagcccgtcgagtttccaagtgaactttgaggatcaaatggcgtgggcgttatcgagtaacggaaagaagaaaaccacccgagctattgaagacgaagaagaagaagaagatgtaaagcctgagaacagcaacaacaataagaaaccagaaaatgagtgtgctactacgaacaagaacgatgtaatgggggaaatgatacgaacacacagaaggttattgtccgaaactcgtgaaatcgatgaagcgtcttgcaatttcccatcttctcgaagacaagcaagtccagttcgacaatggatttcaagaaccgtcgcacctgatcttctaggcccgtcggagattgcgatagctcatggagtaaaggataatactttgaaaactaagctagcaaacagttcaaagtcgcgtcttcggttattcaaaggctaatctatccagagtggttcggtcgaaaacggacaaaaacgagagttcttgttggatacacacagatccctgagtttcattcatattcacgttctttgtaaatcaaacacatctatatatttgtataatcgattgcaaatttttggatcattttgtaaacatagtaagccaaggtgaagtctgttatttttttttctgttggtctgttggagagcgcaatattttaaactgcgacgtttgaattgaggccctatagttaatgtgtttactatctctcattcgataaaattactatctcgataaatcgataatgtacatgttaccggaggaaagaaaaagaagttgggtaaaaatcttataattagggttttctgctttcctcggttaaccattcggtttgagtgaaccgaaccgaaccgagaaccggttacaattatgttgccgatcggtttcacctcaataaccaaacccgaaccgaaacccaaacatttcggttcagctcggttttgattattttggttcggttttatgttccatgcctactttataatatatacacataagtttatcaatttagaaaatggccatttttcaaaaaaaaagtatcaaagagcgaaaaattctaaaaatttctctatttttttaaatctatgatagatatttcgaaagaaaacaatgttatttcgaactttatttcatttaaaatcatttatgttcgtcaactttatttacaaataaatagtttgagctctatttcgcttgatgtaaaagttctcgttggaaaatagtcagccaaaatatttattacaatctaatttgtatgagatattttcaattttttgtgagatattgttaaaataaaaatggttagtgttaaattatttcaatttttcttaaatcaaattattgctaattttttcagtcaatgcaaaatattccataagaaagatttattatatttaggaaataaatctaattaacccccttataaaaaaaaaatattgctttccttataataatatatacctctcctaatttctaaacataattacaaatatattagcttcgtctcctatttttttattgtccttatcttgcaaaaaaaaaacgatgaccttcaaaaaaccatgaaataatcttgagacgaggtatcagtgctttattcggaaaaggtaaaaatctcatatcactgaactctttcaatttcttaagatttgtgttagtgggttgcggataacggtagccggtaggcacagatccgatatcctaaaatttggaatacataaattaggatccattagatccgtcaacatctgcaagtaattatttatattacatgcggatccgacatccgcaacactacgataataatatttaatattttgatttttttaaaaatcacctagttaaagttgaaatttctatagtataatttaaacgtgtttttaacaaactttcaaagttgttttggacctcactgaaagtgttgatatttgtatcagaaaata

SEQ ID NO: 648 - DNA, 3000 bp, Unknown
  misc_feature (1)..( 3000): cDNA_ID_2044755_gDNA_ID_1620303_Annot_ID_152716 3000 nt of promoter + ATG
actcatttaataattcttatggatcctttataatatttactaatgaagttttctttgtcatcaatcaataaaactacaaaagaaattaagttattgataaaccataaaagagttttgctgactcagaagcaaatactaacgatgtttattttttgaaatttaagaaatggttatattgcttctatagaacgagcagaaaactgtacttctttgcatgtgttggggatagttttcactttcaagtgtttgtaaagaaatagatgaaattttttgagtgtttcgtacaaaccaaaaattagtcttgaatatactaaacgtctttttcactacaacaaggtttacttttcatgctcacatgttcatgaatatatatctagattcggatccctcttgctcttataaaacatatacggttggcatttatgtaaacttactagtattaaggaaacgaaacacatatatcccacttgagtattttttttatatatagataatttttgccgcttacaattttggagagttataaaaaatatacttaactgttgttaagatatcaatgacttttttttttctgaaaaaaacacattcatagattttttaatcttcgtattcttatagtagggattttaaatatctaaacgttttattactgaaaacatatttttatgtaaagtaagatttgattgaagagaatgcattttggttttaaaatgcgttgtttgggtttaaatgattgagaagacagtttattgccgaagtctctccgatctacaacggttcacactaagtggaggggcttcttcggcgatggtttgccacccacggccaccaccattcttaaatgctccgttttctattagaatcatcgtgtgagaattgagaagaatttgaaagaaatggttttattgcttctatagaacaagcagacagctgaaaattatacaatgcatgtaattaatgagcagatgataataccataagacgacaatttttgtttttgtgtgtgtaaattatatgtgatttatgtttatatatacatgttatactgtttggattatggctttgattcatatatcgtatcatccataagtcatgttcgaagctattatattgttatttttttgaagccgttagatgtcattataattgtattattcaaatataatcttaatgtcaatcaaccaatgcaaaatctatgaacaagtgatgttacatatatttaaatataaaagtataacaattccatgataattaattaatggttgtgaagtgtatgactatgtttgcgctggagaatattgtgcgacggtcatggattgatcattataggatgaatctacactttacacacgcaatgtgaattgaatcttcgaatattctggttgaaagattatttttcatgatatcatggtagataattcttccgataaaatgcagaacattgaagttaagccaaagtcagagtaaagtttaatctaaattatatggaaaattgtatgaagtatcttctctttttttattgaacgactttgtatgaaagatctatggatctaataatttatgaatggggggctttgtctccgactctccaaccaattaatacactgaacttgggatattctaataggcatttaataatataactaagaacatttgtattcttataatattgaagttttggatgataatgcaaaaagtcttgtgattaacacatctcactattatagtggtttagtaaaattgatgtatggtattgtttaagcactaaggttatgcaacagttcgtaaacaattaagcaatactacttcttcttgacacaattaattatgcaacattaaggttcgttattctcattaatgaacctggactgattacagactttgctaataatgtaaagctaattactggttaactccggtttacacaataccatatatcaattttactaaactactcttatactcactgctcagtctttcatgacttatttttgcactattctcttcctcttgtatatgtcccacttctcttacaatactttctttcattcgactacttatcttctttcgtagagttaacgtcggtagcctgcctataccaacttttgttaatgaaattcattttctcgacctttttcgtcccttctatatgtatgtgctacacaagctttgtcaaaagacatttttcattcaactaaattctgtgaaattatgacactttttcactaattaattactcataaactacaatttctaaactagaatatcatattaactcatccaaaattaccccaaaacaaaaataaaaaactcttgttttttttgtttgggttaattttggaccaattaagtagataataccgatttctcaattcaatattcctaattactttccaagtgttagaaataatattgaatggcaatgcctactattatgtggccgacactacaaagattaagaatgggctctctaagcccattagttgggtaataaagcctgtaatgggtttttggttcgttacttagatctaaccctctaatttatttagtgtctttgacacattaaaaagaaacaacacctcttcgctttggaacttgaatggatgaggcttattgacaaatacaaagaacgaggaaaatgccacaccacaatacaaacacacaaagccaaaaagtaccaagttacggtactgtcggaatattacagcatcccaaaatcccagatttccacgtgttaaaacaatagtacttttttatcaatctcatgctggtgacataattaatagtgatagtgatgtgactcaaacaaactgattgtagccattgaagaagaaaaaatcctttagacggaaacaaaaaagaaaccccacatgaaaagtagccaacgttcaaattacaggtgaaacaaattcaccagaaaatctgagaaattgttaagatttctgtattgaattaaagagaaaaaaggtggaaactttattgctttttggccataaaaag

SEQ ID NO: 649 - DNA, 3000 bp, Unknown
  misc_feature (1)..( 3000): cDNA_ID_2044774_gDNA_ID_1620303_Annot_ID_152710 3000 nt of promoter + ATG
cagttgatcaggcagttatctcatacttaacacttaacatataagggatgttgtaagaacatacttgtggatgaatgtacaagcattagaccacaagaacaatgctgcaagagcaaaaatcgcaaagtgacagagaaaagcgaggagatggtattcgaataactcgaataagacccaagacgcagttacagcacccaagactccaccagataccttcttgttcctccaaaggaatatatcagcagctacatgcaaacaatgaatccagattcaacatagtttctgagtatttcacaagatttaagcgtactttcgagcaaagcagacaattaagcactcaaatacactcaattttagcttcaaattagagcaacattcactagatcgagcaaaatcactatgtaagatacaaaatcgagtaaaatcagagttcaaagtgaagaaatagagatagatccatacgttttccaccaccgagaaccttgtgaacaggtttctcccttccgaaaagtcggtaaatctttgacttgaaggacgacgacgaagacgatgtagatttcttatcgtcgtcggaatcggacagagaagacgagtcaccgtggccatggatcttctcaacaatcttctccaagatcgattcctcgtgcttgtggtcttccaccatttttgttgattctacaaacctccgagaagaagaaaaaaaaacctaaaactctttactgattgaagagtgtgggaggagactgtgacgaataaaagcgtgtgcttcagatttaatcccaccccttgatttaaaacatttaatccagtccgtttgattcgggtctgggcctcgagtaggtaaccgtccacggtggaaaatcaaactatttattttgtagcagatgtaacatatttggcgtggaactaacggtcgttaattaatgtgaatattcccgataacgtctccgttagtggaacgttagatgtcggcggataggatccagcattgggcccatttatgggattgttggtacagtattaaggcccatttattactgatccatttcatagtaaaaataaaaaattgttaggcatagtaaaattgttatgagaatatgttgatagaatgaaaatgctcctagatgaaagatgatcatacacctgttgattaaacattacaaggtcacagattatatatattgacatctcaaaaattaaccaagacgctgcgttttggagatattggatttcgaagacccggaagataagaggagaatagtcagtgactctcacgcacgtggggtttgaattgatgactctggtctcttggcctcgagatctaacttcttccgtgggatccaattttgagctgagtcatgacacgtgttacaacacgtgtgctccactgtgtcgacatcactcttgaaggtaagattttttggagtaatggcaaacccagagatcaacaaaatcaggtttgacaatgaaagctcacttatttatttatgtacttttccaataatttgattagtccaaatatattattctatttggatattcattcatatacataattacatacacatgcagtgttagaagtgagtttaatatggaagattcgtcgtctagtgtgacatgaaattccaccatttcatataattagattttcttcttatatatataattttatgcatctaatcgtgtggatgagaattgtccttcacctaaccaaccttttcgaagaaaaagagagatttgtttcttaatatatcttcagaaagagagagagattcgatgacaaaaaggataagagattcttggagacctcaaaaatctactatcgtgggtctaagaagattacgtggctcgttttaagacccttgcataatcttaaagttcttacctatttttttttttttgtcgtaaagttcttacctaatacagtaatatatttttatattgtataaaatattatacattaattaatcaaaaaaaaattccaattcaatcctgaaacagtgaaacccatgcgtgccaaagccaaaaatctgactaccttgctaagtgctaatcattacccaatcagagttcatatcaggaatataccatatccataagagctatatactaattacttgcaaaagtttgcaccaaaccttactacgtacaaaagaaaagatcgtagatggtcaaaattgtggcttactataatggcttattatatagttatttttagatagctaaatttcttgtatatacaattttgagttttacgtatagaaaaaaatatcatatttgagtttggtaaaaaggatgagtaaataatttggagatttcaaccttcatgttaagttttcattttcgattaattttatctaattttttattttaatttctttgataaccaaacaatgtaatttagactaatccttttggacttataaaacaaaaacaatttactatatatgcaagctgtaatagggtgatttgagttctagtccactaaatgtaaatgttacgtacgttaaatttgtatttgtaatgtgataaaaaaaaatctaatgacctgtattcattaacttaaaaaaaattctaattaacttatagaatggtataatatcttatcatattgtattatttttcaaataacactaaaaattttgactcataattaataaaacgtttaaagctttttaggtgaaattcttatttttatattttgtagaatagtacagttttgtcactaagtattatttgtggtcgcatttaaatatcaagtagcgatatttaaaaactttgcaagttgatataaagaagaaaaaaattataatataataagacaatgatataatataacaaagctaatatctttcatccacacacatatatattagatctatatatatatatctcatatgtatacctaaccttaccatatttgtattgagaattgagattaattagatctgtaaaactctcttaaaatagttaaccaagaacaccaaaactacaaaaatg

SEQ ID NO: 650 - DNA, 3000 bp, Unknown
  misc_feature (1)..( 3000): cDNA_ID_3058185_gDNA_ID_1620303_Annot_ID_152703 3000 nt of promoter + ATG
attccctaacgattcctatttatagtgatgaaaatctcacaagtcttctttggcaatatttggtagggtactggatcagtcataggtatatcatataatacatccaatatcggagaggtttctgtaagtaagggtgcttttgaaggaatgcgtaatctccggttcctaagaatctttaattatttgtttagcggcaaatgtactttgcaaataccagaagatatggagtatttacctcctcttaggttactacattgggatcgctacccaagaaaaagtcttcctacaaaatttcagccggaacgtctcttggaactccatatgccacacagcaatctcgagaagctctggggaggaatccaggttggtatttgatattctttcttgttcttctagtgattcaaactaaataagatattttctcatttgttgtgtttaacatgcagccccttcctaatatcaagagcatagatctgagcttttccattagattgaaagaaatcccaaatctttcgaatgctactaatctcgagacattgaaccttactcactgcaaaactttggtggaacttccctcctctatttcgaatctacacaaactgaaaaagctgaagatgtcagggtgcgaaaagctacgagttattcccaccaacatcaacttagcatctcttgaggtagtcagaatgaattattgctcgcgattgcgacgttttccagatatctcaagtaacatcaagactcttagtgtcggaaatacaaagatagaaaatttccctccatcggttgctggatcttggtctcgtcttgcgcgccttgagattggcagcagaagcctcaagatattaacacatgccccacaaagtataatttcgctaaatcttagcaacagtgatataaggaggattccagattgcgtcataagtctcccgtatctagtagaacttatcgtcgaaaactgcagaaaactcgtgacaattccggctcttcccccttggctcgagtccctaaatgcaaacaaatgtgcatcactcaagagagtatgttgctctttcggcaacccaaccatactcacattctacaactgtttgaaactggatgaagaagcaagaagaggaattatcatgcaacaaccagttgacgagtatatatgcttaccaggtaaagaaatcccagcagagttcagtcacaaagctgtagggaattccataactatccctctggctcccggtactttcctggcttcctcaagatacaaggcttgctttgtgattttgccagttacgggctaccgatgtcatagtataagttgcatcgtaagtagcaaagcggggtttgcaatgcgcatctgcgacttagcacggctttcagattggtctcctgggacggaacatctgtttatatttcacggtcgcttggtttatcaacgaaacatgattttgagcgagattatatttaagttcaactgtgttataaatgagttcagcgatgaccctgacctcgataacatgattattgagtgtggtgtacagatcatgacggaggaagctaagggtagcagcagcagcgacgtggacaactttgaaactaagagtagcagcagcgaattggaaaactttgaaactgagagtagcagcagcgaattggacatctttgaaactgagagtagcagcagcgaagcggactactatgaagatgaaggtttaaagttctctcaagttgaaagcaccaaaaccagtaaacatacaagttgttggagttggtttacgaagcatggtctgagaaagaagaagatgaataaaacaagagcgaattctcgtggaatctcatgagaccaagccagttctagtactttcttagcaccttctccatctcataaataatagatggagatagagattatgagcctgaagctgtccagctctgtgaagaagaaaacatccttggttgttagatttagtttgggaagcttaatctggggtagaagaaggtacaaaaccctgcatcttacgtcgttggaatcggtcagggggtccaagatatatatcttccattatattttcaatttattaaatttttagagagactggatattatatgatcatagatattactagtctgatgttaaaatagttatgtaaaggcttcatggattactaattctggacactagccatagtgatatcgaggttattttttcacatgttttcccttgtttttaacttgctaattgctattgcttgtctagtgatatcgaggctagtgttctaaatatgttattgtgaagaaacatgtttcatttataccctgaagattttttatcttctcatatttttatgaagcctttgtagttataatttcagaaaagtttgataaaagtgtctggttcgttgtgtttgaaattcagcagccactgtcaaatctcaagaaagatatatttgagctgctcctcgtctatcctctctttgactgttaggatagttgtctagtcattaagaatatattttatgcaactattgaaaagacatacattctgattaggttttgttatactagtagaaagagataataaataaccaagtcaattgattaagtctgctatatttcagaaaacccatttgcaagatttataatgttattaatatcaagcactcacaattgtttcatgaatcccatagattgcttttctaagaaacaacagaagaagagaaaagtctgtctctctctctatcatcttttttaatatcgtatcgctgtttcattgtgacttgcaaaagaatatctgataatgtgttttggttttttattatgtgtagtggaggccacggcgatgaggaagttccatcatacgaagacttaaaaaatcaaccaatcagcattcaaatctctaagagagtttctcctcgatctatttagtgtttggataactgcattagaactcctgtcaaagtcaatgcaacgctccgatatattcttcaagttctctttaccctatctctaatg

SEQ ID NO: 651 - DNA, 3000 bp, Unknown
  misc_feature (1)..( 3000): cDNA_ID_3058181_gDNA_ID_1620303_Annot_ID_152704 3000 nt of promoter + ATG
ttttaagtgacttttgtttttgtttttctttcgaacacacatgatatactgtacgatcatatactagtaaaccattgaatcctatcaatttaattgaacttatagtggaaaggtgtagtagacattgcatacatacatcataaaacgtatgttcaggttgaatttagagtcaaaatcaatgtaacttggtaaaatgctaagtagaatgatttagtttccttgttttttttatgtatctcatacaattcaagtggcgtggctctaaatttaatacggataagcgactaattcaacataaacatgttattatggttgtagtggttaagaatcttatttgacccccaaaataaatcaagccttttaactctataaacacgtggaagtttcctttgacctataatgaatgctacatatgtaaaaaaccaacattaatctcactgaaagacatatatgcgaagaagagagtgcatgtgtttttctttcttcctcatctttttcagactctttcttaaggaaaaaaacagtgaaattacacaattgaaagataaatattttcagtttcgatggtcatcgaaggaagatggaattttattaattcatatttatgaatgaaagtgaattgagatcaaaatataaaaaaaaattaatcaatttgactagtctagaaaacaattttggagaatacttacgaaatcaaattcacttatcgattctataaaaatataacactccaacataaaccatccgcagattccataattttattttcactcgcacaaatttgaaaataatttcttaatagattatatcttgaaccgattaactcaaatacgtttactaaaaaaatttcaacacaaattatagaatcaaaaagtgaaccttgttgatataggcacttaattaattttcttgaaatattcctatgaaccataattgtttattcatattttttttttctttttttgtaaataaattgtttctttattcatattcatatataaaaaacagaatctctattgttatttagagaaacattaatttgaagctggttctagaggtaggcccaatgggcccataaaccctttttcgtttctcccttttatatctctcgtctctctctctctctgtctgaagagaaggaaagatcatcaatcacgattccaatggcgtcgattctgggtgatttgccttcctttgatcctcacaatttcagtcaacatcgtccctccgatccttctaatccctctgttagtttcttcccccaaattcaatttttcaattttacggatctgagttaggctttacttggtcgtattggaaaaaaaatgtgtcctttgttgattcaaagagatgtaattcgaatgtgtatctgggttttgctgcttacttggtcagttccaaaaagttccatcttttcaattatcatcgagtttgctgttggatcttgtgaaaaaccaatacaaattagccatttttgtcagattgattgatcttagaatcataattctgattccatttggccataatttagctgctaagtgacgaagacaagtttcaactagcttgtatcagttaaagattagagttttgatctgttatcgaaggtttgagttttttgttcatgttttcttgcagaagatggttcctaccacctatcgtcctactcacaaccgtacacttccaccaccagatcaaggtgaaacaaaaaatcgtgcttttttgaaaaaccttgcgtgttttttcggctagagattttagaatttcgttacattttatatatagtgtcaaagatttgtcttatgaagttgtgatcttgaacttgctttgattgagtgatttagttactgtctttactatgtatcacttcttagaatctctaggcaaattggtgttaatcagattcaacagtctcgagttttcacagatcatgtcttatgtttttactaatttgtatcttgttcgttatggttgtagtgataactacagaagtgaaaaacattcttatacgcagcttctatcaacgagctgaagaaaaggtgaaacagctctcaactctcattcctcatagtttgtgattctttgattcaaatctccgttgtttccctcgtatatatagttcataacacaggatttcgtaggaaaatagacaaaagaaaacgatatagaacaatcttgaacttcttcagataacaaaactgttgattttggttgtgttatccgaaatcttaatttgttttgtcaaatttgtcaattgcagttaagaccaaagagaccggctacagatcatctggcagcggagcacgtgaacaagcatttccgtgctgcgtcttcttcttcatctactcagggtttataaaaaacttaagttcaagcctataacaatggtcatttgtatgagtacctcttattagtgttttcaatgtagaaaaaaaaagataagagcagttcatgagagaaatgtagtgaaaatgtgtgtgtacataacattaatgtttcttttatttcttgacttaaagttgctcactattcactagcgttgaacatgaaaatcaggttacgttaacgaagttacgagcccaatatcaatttgattttaattcttcattttaaaaacaaattaaaactccggtttatgttccaaaccaaattgacaattggattagaatcttcctcttcgtcttcctctttttccaaatttttagtctctgatactctctgagctcatttcaccgaaaaaagtcaagctttgcaaaaaaacaacaaaaaaaagattccaattgtaaaaaaaccattggtcctcgacgactataaaaaaacacactttagtgagttgtcgagtcgacaacttcgtggaatttcacatttataatcctttacaattacgttacgcgtttttttcttcaatacataatcaaaggaacttgctttctcaataagactttcttcgaaccattctacaaatactttttttgaagttgaagcatttgtgatacttttatg

SEQ ID NO: 652 - DNA, 3 bp, Unknown
  misc_feature (1)..( 3): cDNA_ID_2044895_gDNA_ID_1620304_Annot_ID_152738 3000 nt of promoter + ATG
gat

SEQ ID NO: 653 - DNA, 3000 bp, Unknown
  misc_feature (1)..( 3000): cDNA_ID_2044880_gDNA_ID_1620304_Annot_ID_152743 3000 nt of promoter + ATG
catttctcaaaacgtagtaaataggagatttgccaagtgaaaaatatatataatgagacagttattatgaacacaatttacagttattatgaacacaattttggtgatgtttctactgtttatgaaatttgttttttttttacctgccagtcttatctatttaccaccaacatacattagaatctaatgtaattacatcatcaatcatagacctaatgaatatttaataccacacagtttaaacattgctattaaagtttgaaaagattatactttagtaaaataatgttttcaaacttgtattcaattatactacgtaagcagtgatccaattattacgaacataatacttttccaaatcaaaattttgtttttgttcaccttaccatcagtttcataatagaaatattatatatatacaacacaaacaaatgaatgagaaatgtttttctattattatgacttttatttaagattcaaaagaacgaagaagagttatatatatgcttgtttgtttcaggacaaatacaataaataagtggataagaaaaccacaaaccttgaactagcctgaaatgtgtgaaccaagctatacaaactgtacgtgattctgcatcgtggaagtcacaaacagacttctgacttctgctaaagataaaactcactgtttgcaagcaatttagtataaatatgaagcattgacctaccaagatcgacacaatcacacagtttcttcttaattaaacctagctatttttgtctttagcagaagtcagaaagctagttttgtatttttcttatttcttaaatatatggcggccaatgttatgagacggtttatgatttaaagatacacaatggacccacgacgttgccataatacaattattaggctgttaattaacgtgatcgttacgtttgctacaaactagctagttgtgtcttctttattttagtagataagtataagagtctaaaaatattacaacccaataatggttacattcatggtcgacttagaagatgaaagttgatttcttaaaaaaaaaacacgcacaataaataaaccaccaattcacaaatacaagaaatttaataacctcgagcagttaccctatttaaatcccctctagccttgttttccttctcacacctatgaagcaatggaagaagagagagaccacaatgcatctgagtcgtctctcccatctttgagcaagcagttggagagctcgactcttggaggaagcgcggtcgacgttcccgtcgttgatctaagcgtttctgatgaagacttcttggtgcgtgaggtggtgaaagcgagtgaagagtggggagtttttcaggtggttaaccatgggattccaaccgagctgatgcggcagctgcaaatggttggtacgcagtttttcgagctcccggatgctgaaaaggaaaccgtggcgaaagaggaagacttcgaaggatacaagaagaattatctaggaggtataaacaattgggacgaacatctctttcacagactctctccaccctcaattatcaattataaatattggcctaagaatcctcctcaatataggtacgtacctttcctaataaaatcgtatgagttagtaattcatgttttacgttaaatttcatttctttaacaaaatatcaaattttaaacgttggattttcgtccaaatttttgggggtaccagggaggtgacggaggagtatacaaagcatatgaagaggctaacggagaagattcttggttggttatcagagggattagggttacagcgtgagacgttcacgcaaagtataggtggtgacacggcagagtatgtgcttagggtcaatttctatccgccaactcaagatacggaattagtcataggagccgcggcgcacagcgatatgggtgcaatcgcactcctcatcccaaatgaggttcctggacttcaagccttcaaggacgaacaatggttggaccttgactatatcgactccgccgtggttgttatcattggcgatcaactcatggtatggttgacttttttgttgttgttttttttacttgagattcgttaatgtttttggggttgatttgtggattcaaattaattgcagaggatgaccaacgggaggttaaagaacgttcttcacagagcgaagtctgataaggacaaattgaggatttcttggcctgtttttgttgcacctagggctgatatgtccgtcggacctttgccggagtttaccggagacgagaatcctcccaaattcgagactttaatatataatgactatattgaccagaagataagaggctgggcgctcgaagatcttcctgtctactgaaaaccctcaatacctacaataaatgatgatgaattgttcaaggagacaattctttaatagcttccttttgagggtttctatatgtggtacaataaaactatttcaagaatttaaaataatatgtggaaaagctaagcggttagacaaaatattcatctgattgatgctatacattcaaatgtaatcgctcctatcctatgtacgtagtgattaacctcaaaaataatcagcttaagttgctgtattcgtttacgttatcatgtaaagcaacgccaaccttatgaagtcaaaaagagctcttcgtctgtgccaaagtatacgttgacgtgatttgggtcgtcaaaaatttatctacaaaattatcaagtgtttatttttatatgttaaactacaattttattcgagaatttctatttcggtttatctgaaatgttagatatttagattatttgaaatattgaaaagaaaaaacgctagtaattaaaggtgtgatattaatgttctattataattgaaatttgttctagaagaggaataattccactcttataacacctaataatctcaactactcccacatcacatgttcaaatagctcagaacatgtatattggttgaatgattgatcacaaaaaaattagaatcatg

SEQ ID NO: 654 - DNA, 3000 bp, Unknown
  misc_feature (1)..( 3000): cDNA_ID_2044866_gDNA_ID_1620304_Annot_ID_152750 3000 nt of promoter + ATG
atgctgaaaacggcatgtcgttttgtttgtttgaaatgttggaggaaaataatcagcaaacgacgacgtatcccctcgtgttctgaagtatggaaacggcaggtcgttaactcttgcttcaaaaagaagtttccctctttcaatttttttttacttattcattgacttcgcttcttcctctttgtcgttaactcttagataattaacacggaaaaaccataagtaaaaagcaaaacaaatagataaagaaaaagagcatatacttcaaaacaatggaagagatgatgatggggtcaatacgatgtgaggaatcagaagaaagattccagcgactgcgtaccctaaaaggaaccagaaccaccgtccattaatggaagcgagaaacttgcttgcatcccaaagcactttcataaagtggcaaaagagaaggcaagggatcatagtttccatactcaccatcatccacatttactctaagaaatgttgcactcctgggggctgggacaggatgtccatattttgatgcttccgcactagtcttaggctccatcggttttggaaggaagttgaagaacatttagaacaatacactaaactgtaacgtcgtcattttgccaaagagaaaaaaaaatgggccactcgattattatttgtttagacccgttggtaatcgggcttaaacgggtgaaccctattaaattatttattttttaaatggattcgggtaaaaaaaacataacaaatagcccgtttagactcgcgggcttgaggcccattgtaacatcactagagagagaggtgtcttattttattttttttatgagtgtttaggaccaaaattagattatcgggctttcttcacaagccaattatcgtacaaccatgtttgagttccagtgaagaacctttttgacgacggcgtatactcgtatgcttaaatatgaaaacggcaggtcgttctttttcttcgaattgtttggagaaaagaaatttcgaagcgacgacgtatcgtcatgtcctggaatgtggaaacggcaggtctttgtttcataaaagcttagaattcttggaccatatttagttcatgaatttatcatacgtattaatatggttagtgattgttttaattagggtactagatgatttattatgacctaactgatatatccacctaaatagttttgatccgtagcttttcagttgattcacgagaccgaaaatttgaactaaaatggagaatttgtggattataaccaaattacaatatctatatgaaatataacagatactgaattagaatagaaaacatgttgttaaaaaatttaaaataaaaataaaaataaaaatgggcaaaacaacaaataccaaacgtaaacgaagatattagaaaaagaaattctaaaacagtggcgtttttctgtccaaatccaaaactattatgaagggacgtttctgatatatatataaaaaaacccgagattttatcggatgtgtcgtaatgaaaggggtaaaacacgtggcagtcaaccaggctgtcagttgttggtgaaagcagacaagcgcgtgattttaatataatctctctttacccgcgccaacaacactttaccaagacagatctctcatggcggtgctctgatgcttcagcctttgattttttccttttttgacctttttaatctctaattataataatcagtacaaaatcactgttgtttaccattaatttaaggaattaatcctaatctgattttaaggaattaatctctatttgccaaagaagaggcgcaaaggctccgtcttttttcttcttcttgtttctgtgttaccgatctggctctgtcttcttcttcttcttcttcttcttcttcttcttcttcttcttcttcgtttacgtctctgtgaaatgctcaagctgattagggtttatcaactttttctcaactttcttgttatctccttcgttatcctctctgtcttctcaggtgactaatcactcactctatcgttatccacttgattgttttgtttcctgtttgctttttgatttgagatctatttttgggttcagattgttgtcgacagctaaattctttgatgtatttggatcaaagtatccgtttttatttgatttgttccgtcttcttcgtgatcgtgtttgtgtctgtctctctcctagatttgggttttggggatttgggtatgcgttgttgtgatcagaagggacctttatcgtttagtgatctctttgatacagagagacactaaaaatggtgaaaaaatgacaaaacttcttattggatgagggaagaaacgttctaacgtgttccatcttctatcattttcttcttagatattttaagattgactgttttctgaacatttcatgctttaggaagtgttaagttgaaacctttttctcttagctctccaattgctaagtgttttttctgttgtctttcttaattatcttttgggattctcatgggatttgattgaggtagagggaagaagagagagagacaaaaagagctttaggctattgtctagacttgcttaatttggaatatatgtgtgctgagtctagtattttcctctgtgaaatccagctgatataatcatgatagtaacattcagtttcttttgtcctttcattgattgcagcttagcagctattgtgcatttgaagctgtactcggaagaaaagcccatagaagagtcaaatgtaagttctcttactgattcttgagctcccaatcaatgcatagaagctgcgataataacccattaattatgtagaaagtttatatgctcattggtcgaccatacactttattttggctgtttctgatgttctggcttaacatatctgttttctttgctgttcttgtgattagcatgaactaagtttctgactttgaaatcagcaaaaatgtgtcgtggttggtcatgctggaatctttagtgctaattatctctggctcatacagataacaaaaa

SEQ ID NO: 655 - DNA, 3000 bp, Unknown
  misc_feature (1)..( 3000): cDNA_ID_1582835_gDNA_ID_1620304_Annot_ID_152754 3000 nt of promoter + ATG
attcctcatttaatgggcctttgtaacgtttcatctatagttggtttaaggcccatatatttgtctggcctgatgtagtacaataattaacggcacaataattaagtagtcacatgactaccaaaattagtgtggtgagtgggtaaactgtgaagtttcagttcccattgtcccgtagtgagaaagcaccagtccgcacatgactagccctcactttaaccattcccccataagaaattactttttgagaatgattcggatctagttcatggcctattagtaactttcaaaaaaaaaaaaaaaaaatcttgctttagcttatgttattaacttattattggccgaccattgtccctcgttaatttaatattcgactgcactttttttgttttattgtgtgtggtgcaattcatcgtttatactttatccacacatccttgaccatagcatctaactaataaaatacgatggagactagctcttaccatagcatctttttttttttaatactaataaattgtttaaaactcgatgtttagttgagtacactatgtggccccaaaaagaaaccctaacgaaacctacacttgaatctatatatatggagtcatggagaagtagctcttgctccacttacgtttttagcatttaacaagcaatcaatatcattaggattatatatggagaacaagtttttcgctgcattcttcttgcttcttgtcctcttctcatctcgtaagtcttttccttctatatatatgcattggtccatgaccatatttgattgacaataaatatatatatatatgatatatatgtgaagtcagtgttacgtgatctatctccattcttatgtgttgcattttatttgtgtaattaaatagaggagatcattgggggtgaaggaaggacatgccaatcaaagagccaccacttcaaatacatgtgtacgtccaaccacaactgtgccatagtttgccgtaacgagggattttccggtggtcgctgccatggcttccatcgccgttgctactgcacccgcctttgctaactagtttattttccattaatccatttaaatgtactttttctttctttttattttgaatactaataaagttcatcttcttctttttctcgtttgacatctattgttgggtaaatctcgattctagaggaacgaactgagatatatgtattaataaaaatctcacgctgattctgaaacaagcaatgtactagaacgttgtgtcatgtgtgtttattgattaactagagttaaatttgatttaataaaaatgtcatttgatctatgttttgaatcagcactccaataaagattatcaatatcataaagaagtttctcttaattatgagaatatttataacaatatacatttttagttatcattttaacccaaagtccacattttcttttagtcagttattatccaaaaaatcgtttatacttcccggccaaaggtttccttaaagggattttcaacaatcattttccaaaaacatttgaagaagcatatatatacacatttctatggaaaaaagcgttcaagaaatcacatacaacatctaacatttatgcaaactattttttcatataaaatctgataatttttatacacaatattctgtttatttttacacaatgttctgaaatttgccgattttgattgagtttcaaatgaccaaagttaacatttgaccaatttcaagtatggatttatggaaatgtcataactagagcaagagagacataaaagagaaatagtactaagaaaaatggaaaaagtacatcatcaacataagagcaaatgtctcaatgcattattctatatatttttttttatctatcggttctgttataatagtcaagagaagtaaaaataataggagtatgaagaatgcaacaacccacactaagatgtttataacatcatatgtacacgatgaatgccaaatgaactaatttgcggtctaagtcatcatcatctgttaccattgaatcacttcaactttgtgtcaagtccccaaatccggattgttccatcatcacttgctgaggccaccatatagaggttagtcgggtttcaactgacacacttcaccgatcctgagtatcctcgcaatacactacaagattacgtcagtgttcttcgtatgacccatatgtatacctgacacatcaaagaaatattactcggaagactctaaaagagattgataagaactgttttcccccatatctatgtcttttttacgttgtagattaattattcttgatttgggtatcataaatttaaattaaacaatctagttaaaaatgatgagatctatttggagtgaaattaaacaattttaataaaaatgtatgtgttatatgtatatatacatatatagattaagtggagtgaaaattaacttaataaaaatatcattgatatatgttttgaattagcactctaaaggttatcaatatcataaatgagcttctcttacgagaatatatatatgtaagaatatacatttttagttaattcaaaatttcattcgattatttgtttgaacccaaggtgcacatatgttcccgtaagccgatagtcataacatttgaagcattaacacatttctatgggggaaaaacgttcaatcaaccacataattgtaaacaactaacatttatacaaacgatcgtctgaaaaaaattgattcatataaaatctgataactttagtttatagtatacacactgttttgaaatttgcggatttagattgattcaagttcaaaaaatttgaaaatgtccaaagtcaacatttgaccaagaagtcgagtgttgtttttaatattgatggctaatatgattttaaagcccatacataaaagcccaaatacggcccaataaaggaaaagactcctctgggaagaagaactaaaaaagaaactgggattttggaagaagtggtcgagagaaaacaaacgata

SEQ ID NO: 656 - DNA, 3000 bp, Unknown
  misc_feature (1)..( 3000): cDNA_ID_3058245_gDNA_ID_1620304_Annot_ID_152758 3000 nt of promoter + ATG
tattgttctgtaactctctgcatcaagaacaattactatgagtaatggaacctaaaaagaaacttgtaatggaattggtttatgatctcttacaaggtaaccaagaacttcagttttgtaatagctggagagagtgttcctgtgaatccactcgaggcaagatttctacagattgatacaaaacaagtttttcaacatgatgagaaatcttggtaactaaaacttgagaagtgatctttaagagtacttacagagccacaacactctggcctctgcaggtaacataagaccaactatagcaagggctcacaaaatcgcgtgtccattttagacgattgctcgaatcattaagcgaatctctgagctgcaacagagctcctcctagcaaatgaatcaagaagcgagttaatactacaagatcattaatgatttataaacaaaggctaattatatatagaccttcgatatctggttgagttgttgacgaagtgattcccacaaaagctaaggccatgaaacattgtaagatcaatttctgattgttccatctaaagcaatttctttgaatgaatcctcgaagaggatcatggaaactttcaccgttccctgcagtttattaaatcagtcaatctcagtttaaacagcttttcttttctgctgcagaatctatagtctaaattgcagcaaatcgatggagaaagttaacttactatacaagaaacacataacttgtgtgatcaaactatgttaactaaacataagaaagcaaagaaaagaaaagaccgatttgtgggtctaattatgtcttaaaaactaacagctttgattgctttctgatgtgaaacattgtcagatcaatccataactcctctatcagagctcatttgaaccgaaaacattaagaaaaatgaaagcttataagtatcaagaacaacaaaatttataattctgtctttgactctttgctttgatgatcaaaaacctctccgtttcacctaaatatgtaccaaatattttgtaactcgaaactaaaagaaacaataaagttatgtaaaataaacaacaaaaaccaagaaacctaattaatatacaatggagaaagataggcattaaagtataagtaaaacaaagcttttaaatacccgagtgagccatagaggagctgaaaacactctaaacggaagagaacgaaaacatggggttgaagagagaaatggaggatttgtataataatgaagccaataaaagcaacaataatgtaaaatcatctaaagaaagagaagttagtgcttataaaggacccacaaaaggtatttttcatatttttatctctatgatgtaaaaagaagatgaagaaatgctgctttgagagaaagagaatcccactaagttgaaacatctttgatttcttaatggaggtgtatttttccatcttcttttgcttctttattttgggtgagatctcttttgcaagtgtgtaacttgggatgtgattggggctaaaaaggatatcaattttaacaaaaaaggatatagatggcccaaaataaacataaagtaataaagaatgatttaaacgaattagtaatagaaaacaaaccaatgacttaattaagaacttaataatgtttgggaaaatggcttatgctttaggaagagacagaagcatgtgtaagaaggttccacacttccacttgttcgtgttatattactccactattctggacgatgacaatgcaaaagggcgtttttgtatatattcctttcttctctgaccttcaaatcaaaggatatgatacaaactaaaatagttttaacataacctataactatatatatatatatatatatttaactatctgtttttgagtaaataaattcaaacattgagaagtttacatttttaacatttataaggtaagtaattgatcttttgatatccttttaaaaaacaaaaaaaaaaacaaatttagttaccgcctttcaaaaaagacgtagtaaaacatcaatgtttagaaaactttaggttatttcccttaagagctatgttgaaacatcatgtagaaatgtaggcagaagagaaaaaaagatagatatttttaataggaaaattaggtgaagaaaagagaaagagaacataatgtgaggaagaagagactaagaatatatacggaataatgatatcaatactaatatgcttgattagttggacatgttcttatgctcctccctttatatgttgtcatacgattcttcaccttattgagacttttgttcgatctgcaaaaagatctgatgatcatatctcaatctagaacgtatatttcaaaagttaaatttcatcaacattcacaaataaaacaaactcaaatttattttctatttttatcaggaaaaaatgaacttaggtaagtgagaaaaaagccttcagagcaaaaaaaaaagaaagaaagataaatttgaacattgtgaaaccaaatgccagattacttttcttacttattaaaatcttataacttgtaaatgatttgttcataaaaatgttataattagtaaattaattttaacaacaaatatcacttataatccaaaatttaggtaaagacaaaacttggttcgatatcttttgtacttgcgagcattgtacttcccggtcacaaaacgcaatcgctaagtaaaaaaaaaaggtccatctgaacgcaagacttattcaatttacgaaataacccctatgaaactgtgtttaatggacacgtgtcctggatacgataggggtataatagagactttaggaaagtagaggttggcgtttgggtgattggtcaaagcgaatccttaagaatctagtaatactgacacaggtcactcaaacagctatttatttggctaattttcagccttaatatcagaattagagagataagtttttcttcttcttgctctgtcgccactaactaggtcaccgccaagtaacatcggatcgagagagagagagcgatg

SEQ ID NO: 657 - DNA, 3000 bp, Unknown
  misc_feature (1)..( 3000): cDNA_ID_3058235_gDNA_ID_1620304_Annot_ID_152765 3000 nt of promoter + ATG
gtgaagacatggagaaactaatgactgaatcaggtttgaaaccagttgttattgattcgaatcaagatttatctcgtgtatattgtgggatctgctctaatattggtgatgacgattatgatggtgatgctgttgttgttgatggtgatttgatctccacgcctttttgttctcacaagttctgcaaagcttgttggagcaagtatcttaagaaaaatttcttctctgtggagaaaaaccacactgcaatctcttgtcctgatcgagattgtcgagctgctgttggaccggagacggttgagaagctaaccgtacgtgatcaagcgatgtacgagttgtatattctgaaatcttaccgtgagaaatacctgggatggaagctcaaactgtgtcctgcacggggttgcaattacgtgattgagtttcatctggcaagtgaagatgaagagcatagcttaaacattgtgtgtctctgtggtcatatcttctgttggagatgcatgcttgagtcacacagaccagtgacctgcaacaacgcttctgattggttgtctagagacttggagaaattgatagaagaagtagacaagccatcgaccgtctcctggattgatgccaataccaagccttgccctcattgctttattcctgtggagattgatggtgaacgaccatgggcccagttcttgacttgtgtctgcaggtttcactcttatgaaaataacactgttttttgctattcgcagattattagatttctctatcttaattatttgatcatactaatttgtgtgttttcttgattcagcggtcgtttctgttggaagtgttttcggtcaccggaaactcacggaacctcaggatcctgtttggcaccggcgcgttcgagcaatgttggtttcaatcattggaacagagcaaaaccggggatttcgtgtttggatctctggaatgcgagtcaagtgaatctggtgaacgctaaatacgagctagaagctttcgaggaatccataatcaagaaacctagtgacttgaaggagcaagacgttaaggtactaagggaaggactgatgctcattgttcagtgcagacagttcctcaaatggagctgtgcgtacgactatatccacacagagtatgatatggcgaagagagagtacctgcgattcctccaacaaaacgcgtctggcattgtccatagtttctcacagagtataaaggaggaaacagaagccaaagagcttacttgcggtaagctattgagcgagacaaccaacattgggaacttcttttatcatttcatcaagactttacgagaaggtttgcccgaggtacaggcggagtcgtacgacaactatggtggtccttactggttgtgcgatcgctgcacatatggaaactcttggttccagagggcctgtaagatgtgctgtgatcctactgcgtctaagatggacgagctaagtgattgatcgcttaactaggtttcttaaagataaaacaaaaggttctaggagacagagtaaccttgcaactctttaagttctgtttttttttttgctttctttctttctttctttctgcagttttatattggactaccaactttcaatgtcgaattgactttttctttctttcctgatagttcacagttacaatgctttgtgacaagcaacgtttggctctgatgttctcagactccataagaaaatatgtggtcctgttgttgtcttttttcatccctcgctctactactgtagttttgctctcaggaactaaaagccctgaagatggactaaaacagaagatgaagagcactgcttttacatctgaagatcccaaatttcttgtcaactgataaagaactttgttctttagacttataaattgtgttttcaaatgttcattagtcatcagaataatttctatctttttatttacttgctcttggtaaaataaattatcatagtcgaaattagagccccttggccttttttaatacactcttgatcaatcaaaaccatgtagttagtagaaaacgtctggtttaacagggatttcatttacctcttcatatcatggattaggttcctcaatcaattccacagactcagcccacaacaaaaatcaattgtttatttaaggctcaagacttagctttctaaaacctcaaacacacaacaaaattagtaactgattcgaggagtgtaaaactgagacagaaagtgatgctgagacagatcaagttgttgatgaaaaattccaccaaaagatcaagttgttctgatagttcagaaagaacacagagatgaagagtttattgaaataatcagtggattctctgaagagaaactgaaggagacatatgtaggaaattgtaggggatgtcttaagttcatatacttcaagaaagtgtaagtgttatgcattaagcataagtttatgattcttatgttctcagtcctctgactccacaagaaaatatgtggttctgttgtcgtccctttttccatctctcactcgactagttttgttctcaaaaactgaaacctcagaagattactatataaaccgaattgggcccaaaaagacaaaacaagaagtgctaatgggccatatttattgattagacgattgtttagcttagatgaaggtccaatggtccaattaaaaacttatcaggcaatttagcaaaaacagatagttttttacttgttttttttttgttggtcaatagttttgtttacttataaaactcgatatttcccataagcgagtgagaaaaggtaaaaccctaaaaagttgaaacagaaatcatctagagacgattaagagaaaactaagaacgataactctcgccttcgattctttttgttgattgaggcgcaagctacctgtaagccttaaccctattccttataagtgtatccatcgatcgatctctttgttatgattcattgatttgtttttctgatttttgtcaatcttaggcacacaatg

SEQ ID NO: 658 - DNA, 3000 bp, Unknown
  misc_feature (1)..( 3000): cDNA_ID_3058227_gDNA_ID_1620304_Annot_ID_152767 3000 nt of promoter + ATG
agcacatcttacaggccctctggaaccaagagtttccatatgtgcagcgatcgcacaaccagtaaggaccaccatagttgtcgtacgactccgcctgtacctcgggcaaaccttctcgtaaagtcttgatgaaatgataaaagaagttcccaatgttggttgtctcgctcaatagcttaccgcaagtaagctctttggcttctgtttcctcctttatactctgtgagaaactatggacaatgccagacgcgttttgttggaggaatcgcaggtactctctcttcgccatatcatactctgtgtggatatagtcgtacgcacagctccatttgaggaactgtctgcactgaacaatgagcatcagtccttcccttagtaccttaacgtcttgctccttcaagtcactaggtttcttgattatggattcctcgaaagcttctagctcgtatttagcgttcaccagattcacttgactcgcattccagagatccaaacacgaaatccccggttttgctctgttccaatgattgaaaccaacattgctcgaacgcgccggtgccaaacaggatcctgaggttccgtgagtttccggtgaccgaaaacacttccaacagaaacgaccgctgaatcaagaaaacacacaaattagtatgatcaaataattaagatagagaaatctaataatctgcgaatagcaaaaaacagtgttattttcataagagtgaaacctgcagacacaagtcaagaactgggcccatggtcgttcaccatcaatctccacaggaataaagcaatgagggcaaggcttggtattggcatcaatccaggagacggtcgatggcttgtctacttcttctatcaatttctccaagtctctagacaaccaatcagaagcgttgttgcaggtcactggtctgtgtgactcaagcatgcatctccaacagaagatatgaccacagagacacacaatgtttaagctatgctcttcatcttcacttgccagatgaaactcaatcacgtaattgcaaccccgtgcaggacacagtttgagcttccatcccaggtatttctcacggtaagatttcagaatatacaactcgtacatcgcttgatcacgtacggttagcttctcaaccgtctccggtccaacagcagctcgacaatctcgatcaggacaagagattgcagtgtggtttttctccacagagaagaaatttttcttaagatacttgctccaacaagctttgcagaacttgtgagaacaaaaaggcgtggagatcaaatcaccatcaacaacaacagcatcaccatcataatcgtcatcaccaatattagagcagatcccacaatatacacgagataaatcttgattcgaatcaataacaactggtttcaaacctgattcagtcattagtttctccatgtcttcacccaaacgctccaaaacccgattcgagtcccatcggaatcaagattgactccgaaggtaaacagaggaaagctttaacagacgagagttttcttgtatctactgttctagggttttccttttttttttgctttggagatatcgattgcttctctacaaattgtttttttaatcattattaattggaccctaatcattctaaatatttgtgatttatataagattacaacagccaattatggtttacattgattttttttttaaaaagcctataaatagtttttttttattaactcaacattatgattctttattatttatcaatttaataacaaaagttgacaaacaaaaataaatctaaaaaaaaagatctgtactaaatgtgattaaacttgttaagaaatgttactgaaagcaaaaggcaaaccaaatctaaagtcaataaagaaaatatccacctccatgattcaataagccccctaaatggctaaatcaatcaaaaataggaaacaaacatagacccaaaagtatatttaagtaatatatttgactttcagctaattttattatctttggtcaaaaaaaaataaaaaaaaattttgtttatgttttgacttggtgaacactaaatctagtgcatgtggttaccaactcacaaactaataagcaatgcgattggttctttatcatgcaagtgacgtcacaagagttgagtgaagggtataatagtaaaatcagtaagaagaggcaacgccgacgaacccgtggcccgcacgtcgtgagaagagaagagagtctgtgtgagcagaacagagcgaggaaaggcgcgtttgttgcgttttggccccaaaggccaaagcccgccttttgcttttcacctttcgttataaaaagcgtttcctctccttctctttccatttctctctctctcctctctcgctcgctggcttcgaggagaaaaaagaaaaattggagaaataatttaactggttctcggagaatctagggttctttttagccacgccttgctgatctccttcgtgaattcgattccgattctcacctggtacggttttttatatttactcttggttagaattcgcgtcagatctggaatttttgtcatactttttttttctttcgatatcgattcctatgatgacctcttctgtgtcatatttttgtgcattaggcttgatttgtgtgttgttgtttcgccgaattgcttgatctcgtttagttttggtggtcttagacgatttgtggcttagactgtccaatgtggaattgaacagagtttgatgtctagctttagaaatacagtaatctcctaattgttcaggatttggtttaggaattatgagattgtgctatctctggcacgatagaaagggaaaaaactaggtcactagctttgttgaagcggaattgttgagccattattgaatctgtgattattgaggttatctcttcttacggagacttatctggcaggtcttttgtggcctaaagctcataagtttatgctagtgcaagaagttatataggaatgacatattagatttacaatg

SEQ ID NO: 659 - DNA, 3000 bp, Unknown
  misc_feature (1)..( 3000): cDNA_ID_3058231_gDNA_ID_1620304_Annot_ID_152766 3000 nt of promoter + ATG
catcaactactgaaatacctcttccccactgcaaaactctagataaatcatttcctgtgcctaaaggaagaatagcgacaggtggaggggattcgaaattgcgcttctcaatagcatcaagcacccatgcaactgttccatctcctccacacaccaaaactctaaaatacttcactttgctacataggtctaaaccagcgtctggcccttgacaagagccaagttcaaagacctgtaaattcaccaaagcaattatcaatcagtgatataaattcaatatgtttaaaagcagacaaacttctaaacgtacctgtactggattcaatagcatattaagtctcctgtgaagaaaaggaccgagttgacctccgcttttggcgttaataaagactaaaagcggtcttgcatctgggggcaaatcaaccaaggaaaacttcttcataaaatttaaagcggcacttttatttcgtttgtgcccgcctataccattttgcaaccctttggcattaggcatgtccgagacttgctttaagcaatctatgctcctatctctgcgtagtttcttcactacaagcccattaactacggtttttactggatcgctgactgaatcctccagtagcttaccatttaaagattggccattcccattttttcccctgtggcgctttcttctcacatgccctcgtatagatgctaactcgtttttaatagtagtcagtactccatcgacaccatttgcttcattgagttttacatgtactggagagaggattactcttctgagagagccaagatcacaagcatcaccagattccttggacataatcatgtgacacttaacatgtatgaggcgctggcaccaaagacagtgccacataggagaagcttcaatgaaaggaataccacaaggttcatcacagtagaagcaaaaggcagtcatgtcagcattatcatccatgttaacccatcgctcagaccagtgatgtcggacatggtcagacccagcctgtgcaacacatttgcagtcttttgctgcagagcttgagcaataaaagtgagctgctacaccgcatacagcacatcggtggacgggaatactcagagatgctttattagaaacattttgacctggaacaagggagtagagacaaacacagcaagtggatggctgttgcccataaccataatcatcagtccattgatgatgagaaagtggaactctcagtcttttccataccttcttcttctctctagcagcagctttaacccaatttaaagaagtttttttctgccatttaagaaatgtgtagataacagccagaaggccaacagatccagttacaagccatccaaatataaacggactgtcagcaccagaactgatcaaccactgaataagagagaaccccacttccatcattgtaaatctaatatgtcattcctatataacttcttgcactagcataaacttatgagctttaggccacaaaagacctgccagataagtctccgtaagaagagataacctcaataatcacagattcaataatggctcaacaattccgcttcaacaaagctagtgacctagttttttccctttctatcgtgccagagatagcacaatctcataattcctaaaccaaatcctgaacaattaggagattactgtatttctaaagctagacatcaaactctgttcaattccacattggacagtctaagccacaaatcgtctaagaccaccaaaactaaacgagatcaagcaattcggcgaaacaacaacacacaaatcaagcctaatgcacaaaaatatgacacagaagaggtcatcataggaatcgatatcgaaagaaaaaaaaagtatgacaaaaattccagatctgacgcgaattctaaccaagagtaaatataaaaaaccgtaccaggtgagaatcggaatcgaattcacgaaggagatcagcaaggcgtggctaaaaagaaccctagattctccgagaaccagttaaattatttctccaatttttcttttttctcctcgaagccagcgagcgagagaggagagagagagaaatggaaagagaaggagaggaaacgctttttataacgaaaggtgaaaagcaaaaggcgggctttggcctttggggccaaaacgcaacaaacgcgcctttcctcgctctgttctgctcacacagactctcttctcttctcacgacgtgcgggccacgggttcgtcggcgttgcctcttcttactgattttactattatacccttcactcaactcttgtgacgtcacttgcatgataaagaaccaatcgcattgcttattagtttgtgagttggtaaccacatgcactagatttagtgttcaccaagtcaaaacataaacaaaatttttttttatttttttttgaccaaagataataaaattagctgaaagtcaaatatattacttaaatatacttttgggtctatgtttgtttcctatttttgattgatttagccatttagggggcttattgaatcatggaggtggatattttctttattgactttagatttggtttgccttttgctttcagtaacatttcttaacaagtttaatcacatttagtacagatctttttttttagatttatttttgtttgtcaacttttgttattaaattgataaataataaagaatcataatgttgagttaataaaaaaaaactatttataggctttttaaaaaaaaaatcaatgtaaaccataattggctgttgtaatcttatataaatcacaaatatttagaatgattagggtccaattaataatgattaaaaaaacaatttgtagagaagcaatcgatatctccaaagcaaaaaaaaaaggaaaaccctagaacagtagatacaagaaaactctcgtctgttaaagctttcctctgtttaccttcggagtcaatcttgattccgatgggactcgaatcgggttttggagcgtttgggtgaagacatg

SEQ ID NO: 660 - DNA, 3000 bp, Unknown
  misc_feature (1)..( 3000): cDNA_ID_2990616_gDNA_ID_1620304_Annot_ID_152771 3000 nt of promoter + ATG
aaaaacccagaaattaaaaatcagaaaagcttactcttaagttgttcttcttgttggtagaagcagatcgatcgacattagcgagacgatactcgtgcataatccaattcgttttaatccctttcggagcttttcctgcgtagaagacgagtgctttcttaatccctaacgtcttcggttttccgatcggtttatcagctccagtcgctttccaataaccggttccagctgcccggtttggtctcgacccgtttgggtatttccggtctctatgcgagaagaagtaccattctttctcaccgtacaacgccatttctggaaacaaaaattcgaattctcttcaaaatctcaaagtcaattcacaaaaccatatgtcaatcttgtcgtggactgaagttttacctggaagctcccatggattgaatttgtacaagtcaatctctgcgataaccggaacgttaatcggttctgacgcacatctccggcaaagatagaacttgacaagctcttcgtccgtcggatgaaatcggaatcccgccggcaaattcaactccgccttcatttttggaaaagtaccttgttgttttcttgtggataagattcgattttgagtttttataaaccttcgaatcggaggatctttgtggtttatctcaaagattgaaatcgaggagaagagagcaaagtccatggagcttttataaacgaaggggaggttcatgaaccacacgtgtgtagttttctttcggacacgtgtgataaaaaccaacctttttctttttcaacgttgaccgcgcagccagctgaggtttacacgtggcttggactaattggatgatcgacatacagagtatgtgatgatgtcattgcttccgtcagccgcacgaaccttttcgtggttgtaatctggtacttcacggtgtagcagcttgtgcacgatgttctctggctgatatttatattgtgacttgtaagtggactggtcagagtattactgtgagcttctccgcagcggatttcttctctgttcatgtaattgcatacgtcattgagaatagatgacttcatcttagtcacacgccggcttatatgtatacgtaaagtctgaaagatgcgataatcgaccagtttcgtggaccaaattttccacataaacgacagttactatttaaaatgaaatgtattatagtttgcttattcttttccctaatattttataaaatgttgtttagtaacaagtactaagaccatcttcattggtaatctttaagagtttctaagcacaaatccttatgaaaaaagtttaaaaataattcaaaaatgtgaaattaagcaaggtatgcaccttagcttaggtattctttggtttctaagaaacttatatgtggcagtttttcattgactggagaagaatacaaaacaaaacataaaatctttcacattttttttatatcttctgaagataaatttgaaaataaatctaattgcttttggtttcttttaattgaatagatagcaaaaatattatctgagtcaaatttaaatttaatcgttattccaattttttatttgtctttttatatgtttttatgtcatatatgtttatgatttaagaatttttaataattattatgctttatcaaatcgaaatacttatgatttttcattttaaaactaactttttttctttaaagaaacccacttaaggattccaccattggacaataaaaatagtaaagactcaacaaaatctctaaacttcaaaataatcaaaatttattcttaaaaaaattaaaggattccacattaggactccaccaatgggggtgctctaatgaatgtaagtaaactgatcttatatgttataatttatattggggtatgtttgacaactgtgacaattagaaaaatgggctttttgagaagaaaaagaatgtaaaactcaatggaagatataaaaatggctcccaaaatcataaaacatacgaaaaatatttatgtgtgtttagaaacatatatcatgtttaataaccaaaaaagaagaagaagaagatatttataaactagaaaagaaaaggtaatgcttagctagagcatcaagattgtaaaagcccatatggggcttaactataacttcccttttaaaggcccattttatctttacgtgaaggctgtgttgggtccaagtcttgtcttccaagttccagttgcaatgtcgtatacgcaaaacctcaacacctaggtttcaactttttcccaaattttgcttagacaagtgtatatgcaaaatgaagaactttaatcgaataacttttcttgtcaataatttttttttttttttttgctttaaggttttaattaacctatttaaaatacaatttgatatgttgaaatttaaaacatatattgtaaaaataaatttacaagaaatctttacaaaacaagattggaccattttgttgttttgaaaaatattcaacttgctcatttttagcattgacttgaacttattcaacataagtatcacttaatcactttactaattcaactgatcaaaacttcttttttggtgggatattcaactgatcaaaacagtaaaggttgattattagtttgccttagaagttgaagatcatatagatgctagtcaaattagaaggggcattttggtaattcagttgtagaatcgtaagacaaaggtgaaaagcataatgctattttcaggattatataacacatcaacagaggatccaaacttttcccaattattgcaagtcaatcgatttgtttatctatataaagctcccaaatctcaaatctcaaatctcaaattttttattaaacgcctacatatattactcacacttgttttcagatcataaagttttttcttggatttatatataatgcactaatacatacacacccacatgcttacacacatgttcgaactgtaatcagtaaaagaaacatcagagaggaagagaaggagaagaaaag

SEQ ID NO: 661 - DNA, 3000 bp, Unknown
  misc_feature (1)..( 3000): cDNA_ID_2026708_gDNA_ID_1620304_Annot_ID_152770 3000 nt of promoter + ATG
gtagtatatagatgtacattacatcatatatatcaattaggtcgactacgatacatagttttgcagcaatatctagcatatgattttagatcttatcaacaaaacattgctttcatatatatccaaaattatactcctgattttgtcatatacgtatagttttgttttttgatagcttagttttgtcatattacatcaatagttgatatgacacaagtttatggtccaaccataattatttacgtttgccaaaaatgtttaccattttaatttgataaaaggttcatttgccaaaaatgtttgggttaaagaggtttgccgaaatgttattatcacattaaatcacatctagtttatgtatgatggaaacatttacctcgggtgtgctgcgaggatagtggatggaaccggagaagagaagcttcctctgtccatcgattatcaaagaccgtccgtcgtacgttactcccttcgccgccgtagcaccgccggagaattcaagaaacgtacccacaataagaatcaaacacaacccgaagaccagacgacccatctccatcttttcttctccttctcttcctctctgatgtttcttttactgattacagttcgaacatgtgtgtaagcatgtgggtgtgtatgtattagtgcattatatataaatccaagaaaaaactttatgatctgaaaacaagtgtgagtaatatatgtaggcgtttaataaaaaatttgagatttgagatttgagatttgggagctttatatagataaacaaatcgattgacttgcaataattgggaaaagtttggatcctctgttgatgtgttatataatcctgaaaatagcattatgcttttcacctttgtcttacgattctacaactgaattaccaaaatgccccttctaatttgactagcatctatatgatcttcaacttctaaggcaaactaataatcaacctttactgttttgatcagttgaatatcccaccaaaaaagaagttttgatcagttgaattagtaaagtgattaagtgatacttatgttgaataagttcaagtcaatgctaaaaatgagcaagttgaatatttttcaaaacaacaaaatggtccaatcttgttttgtaaagatttcttgtaaatttatttttacaatatatgttttaaatttcaacatatcaaattgtattttaaataggttaattaaaaccttaaagcaaaaaaaaaaaaaaaaattattgacaagaaaagttattcgattaaagttcttcattttgcatatacacttgtctaagcaaaatttgggaaaaagttgaaacctaggtgttgaggttttgcgtatacgacattgcaactggaacttggaagacaagacttggacccaacacagccttcacgtaaagataaaatgggcctttaaaagggaagttatagttaagccccatatgggcttttacaatcttgatgctctagctaagcattaccttttcttttctagtttataaatatcttcttcttcttcttttttggttattaaacatgatatatgtttctaaacacacataaatatttttcgtatgttttatgattttgggagccatttttatatcttccattgagttttacattctttttcttctcaaaaagcccatttttctaattgtcacagttgtcaaacataccccaatataaattataacatataagatcagtttacttacattcattagagcacccccattggtggagtcctaatgtggaatcctttaatttttttaagaataaattttgattattttgaagtttagagattttgttgagtctttactatttttattgtccaatggtggaatccttaagtgggtttctttaaagaaaaaaagttagttttaaaatgaaaaatcataagtatttcgatttgataaagcataataattattaaaaattcttaaatcataaacatatatgacataaaaacatataaaaagacaaataaaaaattggaataacgattaaatttaaatttgactcagataatatttttgctatctattcaattaaaagaaaccaaaagcaattagatttattttcaaatttatcttcagaagatataaaaaaaatgtgaaagattttatgttttgttttgtattcttctccagtcaatgaaaaactgccacatataagtttcttagaaaccaaagaatacctaagctaaggtgcataccttgcttaatttcacatttttgaattatttttaaacttttttcataaggatttgtgcttagaaactcttaaagattaccaatgaagatggtcttagtacttgttactaaacaacattttataaaatattagggaaaagaataagcaaactataatacatttcattttaaatagtaactgtcgtttatgtggaaaatttggtccacgaaactggtcgattatcgcatctttcagactttacgtatacatataagccggcgtgtgactaagatgaagtcatctattctcaatgacgtatgcaattacatgaacagagaagaaatccgctgcggagaagctcacagtaatactctgaccagtccacttacaagtcacaatataaatatcagccagagaacatcgtgcacaagctgctacaccgtgaagtaccagattacaaccacgaaaaggttcgtgcggctgacggaagcaatgacatcatcacatactctgtatgtcgatcatccaattagtccaagccacgtgtaaacctcagctggctgcgcggtcaacgttgaaaaagaaaaaggttggtttttatcacacgtgtccgaaagaaaactacacacgtgtggttcatgaacctccccttcgtttataaaagctccatggactttgctctcttctcctcgatttcaatctttgagataaaccacaaagatcctccgattcgaaggtttataaaaactcaaaatcgaatcttatccacaagaaaacaacaaggtacttttccaaaaatg

SEQ ID NO: 662 - DNA, 3000 bp, Unknown
  misc_feature (1)..( 3000): cDNA_ID_2044819_gDNA_ID_1620304_Annot_ID_152769 3000 nt of
ttgagacaaattgtacattacattgaaagtagagctgaagaaactcactgtaccatgtaattgatgatgttctaagggttggtttgtgtatgcaggtgtttatgctaagaagagcatcggatgaaccacgagggcatgccgcagccataatgaatgaagtgttactcgatgcagaatgcaaaggagtcataaatgcatctcaaaagaaagtactactacagcaaatggctctccatctctcgtagtaaaaaaacaaaaacagatcatcctctcaccaaattttggtaacaagaagagttaacttacaatcttgtcttacccactagaaagccagtcccgggtacgagattttttgtctatttaaccttaatttttgtttcaattttgttttgttttggtgtttgtgaagagtgccatatgtatagatagtgtgcccatacgaaagccactgagattggcgtcaaaaagtgtcaagtagagaaagtttgattatatacatcatacagtgatcggttttagggtaatacaaaggctctattacccatgagttttctgatattcgttttttgttacttaacattatttacgcaattacgctccatgtgtcataagatccaactacgtgtattgccagacccaccgcctaaaaagcagacccttgacctctctctatatacagaagcttgacttgctgagaaacttcgatttctcattttacattgtttcctaaaaataccatgatgttatatttgtggaatcattttataccaaacacggaatattttgttcaagggaatcaatgatattttggctaataagtacttactaaagtttatctatcatttaattaccttactagttttgttatttccttaaatattgggcttatccagagcaattagtcttttgtatcattaacagaattgggtgcaacactctgattctttaggtagtgtcatcccttatctcactgctataagcctataaaacaaatacctttaatcgtaggatctcatgcattaatgctagtacaattgcattgcacttagtagtagtttatcatatacacaatacataatctttttttttggtaagtggataaataaaacagcttctttccatccatcatgcgacctccaaagaaaatatctacagaaagaaacagaataatttcaaaattcagagcaaaataatatcaagaaaaaattagaaccaaaaagagacatgtcatttgattttagggatattatattatccggatgggaatttcatttattatttgatttgctcaataaaaatgtatgatgcttggatctagtttaagaaaattaaatctaatttctaattctgctagattatattggactatttagtcaacaaatgataattatattatcaaaagatataattttgaatacgacaattaaattacttatttcaactatttgaaaaagaaaaaaaaaacggttatatcttctacatgaagtcaagatttttttcccccaaaatcaacaaaatcataaattcaaaaaataatatttcaatccaaaaatttatacatcatttattattacttatcattatctttttcctttggtttatatatattgtgaaatctgtacagtttttttttcatctttataaaaaaacgttatatatagtgaaaaagaagaagaaaataaaaagaatctaaaaccactcagctctccgcaccatgtgaaaggttggtgtagtggcaagaactctttcgaatctgaacgccttaagctctgagagacgagcattttccagaaaattcccattacctaatccccaggattcgatgaacccagaaatgatggttttcgaaaggctctagctttctcaaatccagattttgctgaggtttgtttactctaaaccctatagattcgttttccttttcttctacgtttatgaaaattcgtttgctttctttccaaaattcattgacgcataatgttctcagattcgcacatgcttgatctctcattttacagatcgtttaaatcttgatctcgtgatttttgtctctgtttttagtcggtgacccatgagttcatgagagaacgaaattgtttgattttgtcttttaatgagttcatgttttatcagaatctgtgtggtgggaatttggtggagtgcttaaaaataaattgaattaattagttgcttaattttgcttgtgttaaaaaaaattaagagtaatggctgctttaatctgcttctggttaaaaaatttggagtgatggctacttaatttgcttatggttaataaaatttggtgtaatggctgctttcatctgcttagatatgtatattttatacactttttagtggtttcttgtgtttggatttggtgaaaaatctttcctgctcagttacaacctgaagcatgatcttattgctttcagacatcattttgttcactttcttttgttttgatcgatctcagcatgtttttgactcttctgacatctgaaaggttgagtgggatctatgatctaattgtttataaatgatacattcttttcacattcatactactataagccttttttataactagatcacagaatccagatttagcttgcttcatcaccattagtttatgtatagtcccttttacatgtaagcttaggttccgtttatatatattgttttgttaaaagtggtatgttaccgtatgctttcatgttgagagtcttgtgtttatgatatctttattgttttcgctgcaggagctcgttgaaagaatgcaaaatagaccatctctctcttgtcctttgtctttcagatcgtttctctttcaacgtgatattagagtacaatactagataccgtgaggtcctttgtattattggaccttgagttgtcttgtctaagtgggataacctttctagtgaacattttcttggtcagttcatctagtgaactttttttggtctcgtgaagaaatagaagttttctttttcgggcttg

SEQ ID NO: 663 - DNA, 3000 bp, Unknown
  misc_feature (1)..( 3000): cDNA_ID_2044831_gDNA_ID_1620304_Annot_ID_152763 3000 nt of promoter + ATG
ttatttcgcttctacgtaagatatgtcaaaaccagcgtagattacaaaaaaaatattttactaaatatgtttggctagttgcatgatttcagttaactcagcgacatttagttatttagatgaaccttggcaaaattataaagcactaaaatgagtattttaaattttcatatttttgttttatcatacactaacatacacttttagtttcgcaaagacaaatcttaagaactagtttctcccgtgcatagctcagaacatcaactaatttatctttaagaaatcaaaagacgatcatatttcaagttaaaccaacaaaaagtcattacatgtaaatgttacatttttatatgagatctcgaagagggagtacatgtaaatgttacatatatattgatataatctccttacatcaaattgaaagtttttaaaaaacattattctactctttaactaatgctattttgaattaatctactaatctctctatttcgcgcgcacacatctcgggttatcatttaattacttttataagttattgatccaataccatcatattttgaatgattttagtataaaattcagtaagactagatttgagaagattattaaatcataagttccataataagggatttgacattaaaaaaaaaaactctttttgaaatcttagtgaaatatgtcctctatgttttcttgaagataaacaaaagatttaggaaacattaaaggttttagccttttaggctttgattacaattcttttgtcctcttattttctttacactcttttaagattagttttcttcatgttcttgaatttgttttggacaaatattgtcttttacctaacttaatttgtgccatctgttgggaaacataatggtgaattaaataaacttctatataggttgtcccccaaaagaaaagaaaaatcaacctagattggatattgtatagttaatacaaatcaccattttgtagcaagattaagatcaaatgggacaattttattaattagaaaactggattatcaaactataaatatagcacaaacagaacaagtttgtatctcgatatatcccaatagagaagggaaaatctcccttcaccttcgactcaattttgttgtttgaggcgtaagctactagtaaaagccttaactctattctttacaagtttatatttctctcttttggtagtttatcgattaatcaatctgatattttgttaatttgaagaaaacaatggagaacgatcaacaaggatcgtacttgagagatgaggataaggaagagatggagaaaaggatcagaaccgttgtcattgattcgaatctagttttatctaattcaacttgtggtatttgccgtacggctgaagatgaatatattaaggtttatgatgatcataacaatgatggtgagggtgatggtgatggtgatggtgatggtgatgaggatgaggatgaggatgcggatgcggatgaggacgaggacgaggacgaggacgaggatgatgatgatgatgatgatgatgatgatgatgatgatgctgatgatgctgatgatgatgaagatgatgatgacgaggatgacgatgaagatgaggatgatgatgatgatgatgatgatgaaaatgatgaagagtgcgatgatgaatatgatagtcatcgtttaatctccacaccctattgtactcacaagttctgcaaaacttgttggagggagtacctagagacaaatttctactctctggaggaaaacttaaccgtaatctcatgtcctgatcaagattgtggagcttcggttagactaaaaacgattgagaaactaggagtacatgatcaagacatgtacttgagttatgttatgagagtttacattgagaatgagagcaaacagctccctgcaccggatgacaactaggccattatatttgaccaaatttgaatttactcaaaaggaaaatttggttcttcttttatgaaatgcatttattccatttttttattttatttttaaattatcgaggatgtcgagctgatcagtgtaatagtctttcaaaacttatatatatgaaacatcatgttcttgccattaaaaacattatttacagtcaaatgattgaatctttttatgattaagactcgaaaatcttttctcttattaccatgataagtttttaaccatacattatagttttgtttttactttgtcatagatttaaattctatatataacaaaaacaaaattcgcgccacaaatctatttcgtcccatatatctatttcgtgccaaaaaatttcaaataaaaattgtgattcttttctactttgtataaatttaatgttactaaataatttttaaatatatataaaaatttcacattttgtgactatacctattttgcgccatttatatttatgccaattattgaatttagtccaaatagtagaaggaagactctagtctctagatatggtcttctaaaactatgataagttttcaaccacttaagtaccataattgattattgacatatcgtataaatttaattaatattactaaatagtaaataattaagtatataaaaatttaaattttgctccaatatatatttagtgatgaataacaatataataaatgattttggtcatattttatttaattatgtaacaacgtaaaatttcttaattaaaaagatatcattatcaaactttatgctgtcaaaaatcttttttatcaaacattatgtaatagcgaaaacataataattttgtagcttgacgatatccccaattcccccgttggagagtgaaaaatggcaaaccctagacgataattagctatctccaccttcgattcaatcttgttgtttctggcgcaagctactagtaagccttaaccctatttctttacaagtttatcttctctagctctttactaatttatcgatttgtctttctgatttttgttttgtcattttcaagaaaacaatg

SEQ ID NO: 664 - DNA, 3000 bp, Unknown
  misc_feature (1)..( 3000): cDNA_ID_3058252_gDNA_ID_1620304_Annot_ID_152756 3000 nt of promoter + ATG
ataaatgagcttctcttacgagaatatatatatgtaagaatatacatttttagttaattcaaaatttcattcgattatttgtttgaacccaaggtgcacatatgttcccgtaagccgatagtcataacatttgaagcattaacacatttctatgggggaaaaacgttcaatcaaccacataattgtaaacaactaacatttatacaaacgatcgtctgaaaaaaattgattcatataaaatctgataactttagtttatagtatacacactgttttgaaatttgcggatttagattgattcaagttcaaaaaatttgaaaatgtccaaagtcaacatttgaccaagaagtcgagtgttgtttttaatattgatggctaatatgattttaaagcccatacataaaagcccaaatacggcccaataaaggaaaagactcctctgggaagaagaactaaaaaagaaactgggattttggaagaagtggtcgagagaaaacaaacgataatgggaagcgcaccagctcagattccgactagcttcggccatgagcttagggcttgtcttcgttgccgactcgtcaagacctatgaccaggtttttctttactcttctttcactgtttcttccttcttttagggttttggtgtttgatttgcctttctataagctgggtttttttttttttttggttcaaacagtttagagacgctggttgcgagaattgtcctttcttcaagatggaagaggatcatgagcgtatcgtggaggtcactacccctaatttcaatgggtatgtatttcatcaattctaaacctttactttaggcttctttggtaggaaagtctttgcgttgatgggtactgtttcaaattacttcttttagggtttcataagatttacttagctgtatagtaatggaaagttctcaactttagagtgattttgcgtcaggatgcttcgtggtttctaagatctctttgaacttggattctttgttggattagtgatttagcttttaagagtaatttttagaaagttcagtgttagagcttattagtgggtttgtgttctttttgttagttgatatcttgatattcctagctactgatatcaagattgttttgcagtataatctctgtgatggatccaagtagaagctgggcggctaggtggttaagaatcggtatgttgatcgcttcccttaactatcgacttgcttattccatcaatgtgttcttattatcccatcattatactctatttactaaggagattactgttacatttattaacacatctctgtattaaagaacgaccatgagatctccaatgaaagattacattacaagatttgtgtgattctctgtttctagaggcctaaaatctgatataaattggaatgtggctttagatctgaagattttcaagatactttgcctccttgtttggtttattgattgcataatgttgctaaatttgtgcagggaagtttgctcctggttgctacacacttgctgtctcagagccactccctgaggaaatgcaggtaaacgattagcaggacaatattttatcttcgtggtttgaaattgtactcagtaacacattagccttcttcttcaaaattagatcatattttgttcacttgtctgattttgtgtgtttcattcggtggtgatttaatgtagcacttatgccaagaggagcgtgtacaatatgttctgccgaaacgcatgtgaagaaatctatcacgatgaaggctagtagggaagaccaagtattccactttttcattaaaagcttcttgaaacattattaggtgctttatttgaatcttcaatcttgtggaatggtcgatgttaatgaagtcagagactccttaacactcttctatgtaaggcgttagtccgaaaagaaaaaaaaaagaaaaaaaaaatctgtgtctgaacaaaaaagtcttctcttatctaaggtttagactttagttaaccaatcggaccctaactaaaaatattaatgagagtaggaagaataaatttgtgtggactctaaagatcaagacaagacaattataattcttcataaagtcatgcaattaataataataataaaaaaataataattttcttgattaattgctcaaagtgaaagtcaatctaaaatttgttcggtttttcaattctacaatttttatttgaaaatatataaaataaaaaaaaatggttaataaagaattgcttagagtttcctctttttctagaacaaacaaaaatgcttagaccttctcgaaagaatagcacatcacgttatatccaaaagcatattcttttgttagattaatcgtagtcatatggtcataagtcatacataacatgtaacatgttagttcgatcattattaactttcaattaagtattttcgtaagacgtaattttcaacaataaacaacaaatccgcgatatacggtttttgaaagggcaggcaattgtttttttaaattattaatactataaaacaattttcttattggctataaactaatatttaattccacgtggaagttactgttcgtcgatataaaactttcttcgttaccattttgagtctccggcggctttcacactccagaaaaaaaacacagaagctacgtttttcaggtaatatgaaattctctccgatcacctcttcttcgtctggcagtatctctgtctcaaattttgttagatccattcgaaaatccgtttatcgaatcactcttagtctcttaccattcgtcgaatctaaaaatcccgtctttttcgctagtttggtggactgataagctgtgatttgtatgaagaatcgatataaagtctctgcttttttgtgtgggttttgtcgcttctttggtaaaatggatctctctgtgagaaagtgacgatcatgatcttaggtttttgattcttatatcgattgttcatttgcaggactttgattaggtttttggagatttacaaaa

SEQ ID NO: 665 - DNA, 3000 bp, Unknown
  misc_feature (1)..( 3000): cDNA_ID_3058256_gDNA_ID_1620304_Annot_ID_152751 3000 nt of promoter + ATG
tttggccgggaagtataaacgattttttggataataactgactaaaagaaaatgtggactttgggttaaaatgataactaaaaatgtatattgttataaatattctcataattaagagaaacttctttatgatattgataatctttattggagtgctgattcaaaacatagatcaaatgacatttttattaaatcaaatttaactctagttaatcaataaacacacatgacacaacgttctagtacattgcttgtttcagaatcagcgtgagatttttattaatacatatatctcagttcgttcctctagaatcgagatttacccaacaatagatgtcaaacgagaaaaagaagaagatgaactttattagtattcaaaataaaaagaaagaaaaagtacatttaaatggattaatggaaaataaactagttagcaaaggcgggtgcagtagcaacggcgatggaagccatggcagcgaccaccggaaaatccctcgttacggcaaactatggcacagttgtggttggacgtacacatgtatttgaagtggtggctctttgattggcatgtccttccttcacccccaatgatctcctctatttaattacacaaataaaatgcaacacataagaatggagatagatcacgtaacactgacttcacatatatatcatatatatatatatttattgtcaatcaaatatggtcatggaccaatgcatatatatagaaggaaaagacttacgagatgagaagaggacaagaagcaagaagaatgcagcgaaaaacttgttctccatatataatcctaatgatattgattgcttgttaaatgctaaaaacgtaagtggagcaagagctacttctccatgactccatatatatagattcaagtgtaggtttcgttagggtttctttttggggccacatagtgtactcaactaaacatcgagttttaaacaatttattagtattaaaaaaaaaaagatgctatggtaagagctagtctccatcgtattttattagttagatgctatggtcaaggatgtgtggataaagtataaacgatgaattgcaccacacacaataaaacaaaaaaagtgcagtcgaatattaaattaacgagggacaatggtcggccaataataagttaataacataagctaaagcaagattttttttttttttttttgaaagttactaataggccatgaactagatccgaatcattctcaaaaagtaatttcttatgggggaatggttaaagtgagggctagtcatgtgcggactggtgctttctcactacgggacaatgggaactgaaacttcacagtttacccactcaccacactaattttggtagtcatgtgactacttaattattgtgccgttaattattgtactacatcaggccagacaaatatatgggccttaaaccaactatagatgaaacgttacaaaggcccattaaatgaggaatgtaaaaactaagaaactcaaatttggccctaaaattacaaacacaaaaatacaattgttgcaataactaatttctacttgatgcgttacaaaccattattgattacagtttgcaatatactctctttagataaatgatgagtgtaccaactacaaaaaatagatctgaccattttttaaatagacagttgaatttgtagttgtaataatcggatcaagacgacttaatctacaataattgtaagatattcaaaagaaatcatagaaaattgaatattctagcatctagttttcaaagtcttaagaaaaaaaaaatactcatgatatataatttaagaggaaagaaaacaatattatccacaagtaattattgaccattctcttgaacttatgtatgagaaagtatgtagcaaccccacgtggtttgacaatagatttggcccatagtaacggaaaacaagttcacatgagatgtatctttatgggtcattcatacataaaatcttcatcaaaaaccttaaatttatatgacacattattattatgatatacggtttgacaattgagccatgcatatttattgcaacatgaagaatggttatgatttgtgattcaagaagtattatcatgtgatggccggcttgacttgctccaaatgtaaaacttattgatataaaaatacaaacttagtgtaattagtaacgtacttagttcgttatggtcggttgatacacacatgcatattgcagtaatttattatactaatcgaaagtaatcaatgaagtttgtctcttttaaaccgacctccaccatgccacatcttgcggttacattagatggactcaaatttagtactgaacatactaaattcggatctactgatgtgcataagaatagaaatctatggtttacgtaacgtaatagttatacacatcaaaatgaaggaaaccttgaaaattagtcaaacctcttcatagtgtaattgtttctcagttataacacaatgaaggtataattaagtacaaatcattacattattacatgtcttaatcatttagactaatatgaatggtggcaaaaaaattaatcatattactaaccaacttatttattttgaaccttagtaaataattattggcataatctaacgagtgagaataattaattagtacttagtatccaattaaagagaataattaataaccgttggattgaagtgaaggtggtcatcggaactcgagcaacctcttcacgtgcttaacttccatacccatctcctccgtttactcctccatcatcgatatatacaccgatacatacaccgacacatacgcatgagtgtaagtatacgctcaagtgtgggagcaatctcagatccctccatgaaaacaacgctttataagatgactcattttctgaaacgaactcaactccaagtgtgacacattctcaacgagagatcgtgatcgtacttatatacacacacgcacacttgcaaagcttgggaggaagaagtgatg

SEQ ID NO: 666 - DNA, 3000 bp, Unknown
  misc_feature (1)..( 3000): cDNA_ID_3058261_gDNA_ID_1620304_Annot_ID_152748 3000 nt of promoter + ATG
gcttatgaatattctctccaatattattcatcaacatctctagcaactgcaagaacaagcaaaacaacagttttaagttaccaaaacgttcaaaagtatgacattctcataaagcatgattctactgtatacgatagatctggaccacaacctacctggacagcatataattgagtatttgggttcttgcttcccaagcgttttttgatagccttgataacatcttttgcttgcctgttcaccatagataaactcattatcagaaaaaaagtatgtccaagatgaagcaaaagtaaagtgtttatatatctcaatcattaaggatgataaaatttaaacatcatagcaacatctgcaagcttgaaattctctggctaaaaagaatttataagttggtaaaaaaatatcactttctacaaagaaaaaagcagtctggctctgcatacctttcatctcgagcagctaattcacagatctcaatgtttttggcccagtccacatctgcaagcttctcacttgttgcagaacttacaagctccgcagccattttttgttatctgtatgagccagagataattagcactaaagattccagcatgaccaaccacgacacatttttgctgatttcaaagtcagaaacttagttcatgctaatcacaagaacagcaaagaaaacagatatgttaagccagaacatcagaaacagccaaaataaagtgtatggtcgaccaatgagcatataaactttctacataattaatgggttattatcgcagcttctatgcattgattgggagctcaagaatcagtaagagaacttacatttgactcttctatgggcttttcttccgagtacagcttcaaatgcacaatagctgctaagctgcaatcaatgaaaggacaaaagaaactgaatgttactatcatgattatatcagctggatttcacagaggaaaatactagactcagcacacatatattccaaattaagcaagtctagacaatagcctaaagctctttttgtctctctctcttcttccctctacctcaatcaaatcccatgagaatcccaaaagataattaagaaagacaacagaaaaaacacttagcaattggagagctaagagaaaaaggtttcaacttaacacttcctaaagcatgaaatgttcagaaaacagtcaatcttaaaatatctaagaagaaaatgatagaagatggaacacgttagaacgtttcttccctcatccaataagaagttttgtcattttttcaccatttttagtgtctctctgtatcaaagagatcactaaacgataaaggtcccttctgatcacaacaacgcatacccaaatccccaaaacccaaatctaggagagagacagacacaaacacgatcacgaagaagacggaacaaatcaaataaaaacggatactttgatccaaatacatcaaagaatttagctgtcgacaacaatctgaacccaaaaatagatctcaaatcaaaaagcaaacaggaaacaaaacaatcaagtggataacgatagagtgagtgattagtcacctgagaagacagagaggataacgaaggagataacaagaaagttgagaaaaagttgataaaccctaatcagcttgagcatttcacagagacgtaaacgaagaagaagaagaagaagaagaagaagaagaagaagaagaagaagacagagccagatcggtaacacagaaacaagaagaagaaaaaagacggagcctttgcgcctcttctttggcaaatagagattaattccttaaaatcagattaggattaattccttaaattaatggtaaacaacagtgattttgtactgattattataattagagattaaaaaggtcaaaaaaggaaaaaatcaaaggctgaagcatcagagcaccgccatgagagatctgtcttggtaaagtgttgttggcgcgggtaaagagagattatattaaaatcacgcgcttgtctgctttcaccaacaactgacagcctggttgactgccacgtgttttacccctttcattacgacacatccgataaaatctcgggtttttttatatatatatcagaaacgtcccttcataatagttttggatttggacagaaaaacgccactgttttagaatttctttttctaatatcttcgtttacgtttggtatttgttgttttgcccatttttatttttatttttattttaaattttttaacaacatgttttctattctaattcagtatctgttatatttcatatagatattgtaatttggttataatccacaaattctccattttagttcaaattttcggtctcgtgaatcaactgaaaagctacggatcaaaactatttaggtggatatatcagttaggtcataataaatcatctagtaccctaattaaaacaatcactaaccatattaatacgtatgataaattcatgaactaaatatggtccaagaattctaagcttttatgaaacaaagacctgccgtttccacattccaggacatgacgatacgtcgtcgcttcgaaatttcttttctccaaacaattcgaagaaaaagaacgacctgccgttttcatatttaagcatacgagtatacgccgtcgtcaaaaaggttcttcactggaactcaaacatggttgtacgataattggcttgtgaagaaagcccgataatctaattttggtcctaaacactcataaaaaaaataaaataagacacctctctctctagtgatgttacaatgggcctcaagcccgcgagtctaaacgggctatttgttatgttttttttacccgaatccatttaaaaaataaataatttaatagggttcacccgtttaagcccgattaccaacgggtctaaacaaataataatcgagtggcccatttttttttctctttggcaaaatgacgacgttacagtttagtgtattgttctaaatgttcttcaacttccttccaaaaccgatg

SEQ ID NO: 667 - DNA, 3000 bp, Unknown
  misc_feature (1)..( 3000): cDNA_ID_2044887_gDNA_ID_1620304_Annot_ID_152741 3000 nt of promoter + ATG
gaaaagcaccaaatttaaacgtatcataaatcaatttaacccaatattttaaaataaattaaaatatttgacttgactttcgtattcgggtcggatccacccggatttgacaaataaaaacccggtggttggccatcgccttatcttgttgactcttcttcaatcataagcccacccacttcgattaccaactccgaccgccagagacagcgagtttcagatcaaagatgtcggcgacgcttacaggatcgggaactgctttggggttttcgtgttcctcgaagatctcgaaaagagtttcttcttcaccagcttctaaccgatgctgcatcaagatgtctgtttccgtcgacgagaagaagaaaagtttcagtcttcagaaatctgaggaagctttcaatgctgctaaggtaaattgatttcgtcccaccgatactttttgattctggttgaaaattttcggaaaagatcagattttgatggacttgactgaatcatgcctctgttttgcgcatagaaatgtgattctgaatgttgaacaaatggtgtctttttcatgatagaatctaatgcctggaggtgtgaattcccctgttcgagcattcaaatccgttggtggacaacctgttttgattgattctgttaaaggctcaaaaatgtgggacattgatggaaatgagtatattgactacgttggctcttggggacctgctattattggccatgctgatgacgaggttcttgcggctctagctgagacgatgaagaaaggaacaagctttggtgctccttgtctcttggagaatgttttagctgagatggttatatcagctgttcccagcattgaaatggttcggtttgttaattctggtactgaagcgtgtatgggtgtgcttcgtcttgccagagctttcactaacaaagagaagttcattaagtttgaagggtgttatcacggtcatgctaacgccttccttgttaaagctggtagtggtgttgccactttggggctaccggactctccaggtgtccctaaagcagctacttcagatactttaacagctccgtacaatgatcttgaagctgttgagaagctctttgctgcgcataaaggggagatttctgcggtaattctcgaacctgttgttggtaactccggattcatccctcctactccggaattcatcaacggtttacgccagcttactaaagacaatggtgttcttctcatcttcgatgaagtcatgactggatttcgtctagcctatggtggagcccaagaatactttggaatcacgcctgatctaactactcttggtaaaattattggtgggggtcttcccgtgggagcatacggtggtagacgtgatattatggagatggtaagatctggctctagacctttaacaagcttcaaaactaggggtggccatgtaccaatgttgctattctttttttttttttgtaggttgctcccgctggaccaatgtaccaagccgggactctaagtggtaatccgctggcaatgactgcagggattcacacgctgaagcggctaaagcaggcaggaacatatgagtatttagacaagatcacgaaggaactaaccaacggaatcttagaagccggaaagaaaaccgggcatccaatgtgcgggggttacataagcggtatgtttggattctttttcgcagaaggaccggtttacaactttgcagactcaaagaagagcgacacagagaagtttggtaggtttttcaggggaatgttggaagaaggtgtttactttgcaccgtctcagtttgaggccgggtttacgagcttggctcacactcccgaggatatacagttaacaattgctgcggctgagagggtactgagtaggatctagaatgttcccaaccctgagtctagtttcacaatcttcatgttttggggacgatgtgtatggtttgatgagcggatggaataattcttgtgtagtgagttgaattttgtttcatcagtagagcttgagattttttgtattttaagatcatctgttaatgtaatggttttatgttatctcctaaagaaatattgcttttaataccaaaccgatttgcctttccgattatttctgagtactatgaagaattcagaaatgcatatagatggatgaaaatcgcattgctactcaaatcgacatatcgcagcaatgttttggaatgagttttggatgtctttagcttgctgaaactaaatatatttgagagcgtcaaggtggtgtagctattgcaggatattgattggacctaaatctctctgttgaaaccaaacaatttccttagagaacaagaaagaagaagtggatgataaggattgggttttaagaattcaggagtaaaattgtaatctaatctctccatttttgttagttttgtacattttaagtagtcatgctatatgttggaaaaaaggagtagccatgctatatacctaatttatacaaacaattgtgctacaactattaagcacagtttttgtagaaatatgtgttattattaatgaatgattcaaacatgatttttcaacatgtgattgatgtaacctttttttgttggcagccttgtgattgaggtaaccgttgacaaaaaagctcaattacctaatcttatcaagaatagaatgataatttcaaaggagaaaaagggctattcgaaaatcaaaagcacaatgacacaaacgttttttttttttgtaatatttgataaagggatcggatctgaatacgggagtatgtgtttactttggtggtggtgatgttttgagtatactatttgttttttgtttttttttgataggaacagtttaccctattcagacaagacatgtgacaaatacacaatcaacaacaacgttgtaaaccgggactagccgtgtccactcattacaatctttatattcactactctagctcacaattaaaccttattgtcaccattatttccagcgaccatt

SEQ ID NO: 668 - DNA, 3000 bp, Unknown
  misc_feature (1)..( 3000): cDNA_ID_3058275_gDNA_ID_1620304_Annot_ID_152742 3000 nt of promoter + ATG
tgttatcattggcgatcaactcatggtatggttgacttttttgttgttgttttttttacttgagattcgttaatgtttttggggttgatttgtggattcaaattaattgcagaggatgaccaacgggaggttaaagaacgttcttcacagagcgaagtctgataaggacaaattgaggatttcttggcctgtttttgttgcacctagggctgatatgtccgtcggacctttgccggagtttaccggagacgagaatcctcccaaattcgagactttaatatataatgactatattgaccagaagataagaggctgggcgctcgaagatcttcctgtctactgaaaaccctcaatacctacaataaatgatgatgaattgttcaaggagacaattctttaatagcttccttttgagggtttctatatgtggtacaataaaactatttcaagaatttaaaataatatgtggaaaagctaagcggttagacaaaatattcatctgattgatgctatacattcaaatgtaatcgctcctatcctatgtacgtagtgattaacctcaaaaataatcagcttaagttgctgtattcgtttacgttatcatgtaaagcaacgccaaccttatgaagtcaaaaagagctcttcgtctgtgccaaagtatacgttgacgtgatttgggtcgtcaaaaatttatctacaaaattatcaagtgtttatttttatatgttaaactacaattttattcgagaatttctatttcggtttatctgaaatgttagatatttagattatttgaaatattgaaaagaaaaaacgctagtaattaaaggtgtgatattaatgttctattataattgaaatttgttctagaagaggaataattccactcttataacacctaataatctcaactactcccacatcacatgttcaaatagctcagaacatgtatattggttgaatgattgatcacaaaaaaattagaatcatggaggtcgagagagaccagcacaagcctccgttgtctctacaaaacaacaaaatcccatcatcacaaaacttcccagtcgtcgacctaagcaacaccaatggggagctcgtggcgcgtaaagtggcaaaggcgagcgaagagtggggaatttttcaggtagttaaccacgggatcccaaccgaactaatccggaggttgcacaaggtggatacacagttctttgagctcccagagtccaagaaagaagccgtggccaaaccagcgaactccaaagagatacaaggatatgagatggatgatgtacaaggtagaaggagtcatatcttccataatctatatccatcatcgtcagtcaattatgcattctggcctaagaatcctcctgaatacaggttatatatatatatatatatatatatatacagatggatcaaacattttttttttttttataatttaccgtttaatttgtgctatgatatatggaaatcatgtacgtatttcatttatgcatttacccaaattaaacaacgtgctaactaaaaacattaaccgctgcgattttgggtcagagaggtgactgaggagtttgcaaagcatgcaaagcagctagcggaagagatcctcggtttgctatccgaagggttagctaggtttacaacgtgagatgttgaagttagcattcggggacgatagtgctggttatcttatgaagatcaactattaccggccgtgtccagagccagattgggtcatgggaataaaagcccacactgatttcaatggactcacacttctcattcccaatgaaattttcggacttcaagtgttcaaggaagaccgctggctcgatgtagattatatatatcccgcggttattatcatcatcggagatcagatcatggtaagtcatatgagttattataggtttcatttttcttttctttttttccaaaaataatgtttatagtttgactaaaaattttagatgagatttgttttgggatttgtagaagatgagcaacggaaggtacaacaatgtgttgcatagagccttgatggataaaaagaaaacgaggatgtcgtcggtggttcatatcaagcctccttatgatatggttgtgagccatttcccgaactcaccagcggcgataatcctcccaagttcgagcctttaacttaccaggattacatagacattgaagtccccaagctttctcgactgatcaagaattgacttctttgtcgttgtatgtatgttgtttgttgttgctctgtttcatttggccgtttggcattgttgtaaccggtttctattaattgaagttcaaacaaaaaaaatttgacttctttgatgaaataattgatttttttttttattttttttttgaaattatgatcggtgtgtgtgtgtctttgtttatttttatttttttccctttgtgtgtctttgttcagtgttctgtttattaaatattactcaaaatttaatggtttttcaaaagtaaaacttattcagtaaccgacagtattgatatatataattcgagtattgtgataacctaaataattctttctttttgtctccaacctaaacaattcagttcaaataattcgacactattatataattttggtgtacccaatgcactattatagtgtttactataattttatgacagtaggaccaaaaatcatgctatttttattttctttctaccgtgccaacgagaaacacaacgttgtaataatcattcatattattggaaagttggttagaatttaatatcgagggaagtgccaagcttttagaaaaaataaaataagttgagaagaaacgtgattagagaaagtaggtcatctgactgtttaaattcaaatgtaacaacagacaacccctaacatcatcagttcatcaccttaccctatttaatattcatatcgcaacttctctcctccgatcaatagatccgtactcgaagcaggaacgagtgaaactgaaaaccatg

SEQ ID NO: 669 - DNA, 3000 bp, Unknown
  misc_feature (1)..( 3000): cDNA_ID_3082046_gDNA_ID_1620305_Annot_ID_152788 3000 nt of promoter + ATG
agttgcctttgtccgtgggtactcctgtcattatttattcttttcatttttggttagggtgttccatttcatctattgatcggtttaataaagaaaggaacataaaattgccgattcagaattattgtaaatgacgaaagcaagaaaagaatagtgacaaatgtgagtgaaataagcaaagtccaactgtaagaacccatgtggtatttggtccttatacattatgtttacttgcatggtactgcatgttactttgctggctgcatgcaacatatgtagtgctattttattttctccaattatttattatttattagtttattctctctttttttcattattatacctctgcacacattttttttattacggtttaagttaccatgataatatataggtacaaacgtaactcatgtgtcatcatacatacttgtttcacattcaaagaaatcaaagccaatgaaaaatataaaattttattttctgttaaagaatggtaatctgaaactgaaagtttgaaacaaacaatgatagtgaagagtggtaatttggtatcttttttaatatatgctatgagtttaatgaaatactcgtatatgtaatagttaactcacgtttgtctagaagatcaacaaattaaatcctgtctattatgttggataattgtctcggtatgtgttctcacatgacatgccaactaaatacagactttaatttgtcaatttactgacttaataactgattaaaacaggaaatatcctatcacaattaagtgcgaaaaaataatctaagtttcaaagattccaaactattttaaaattttggtactggaccgacagaaaatgaatcattcgtatgaagtttacaaactgaaatgtttgtttaaggtgttgtaatgtgagtgatggcttaagtatccgcaaaaatagttaattatttaactaactttcaatacataaaattaagttaaaattcaaattaattttataaatagttactttcaagtttgaatccaattagaccaaacgaatatgcatcaccaagagaagcaacgaaatgtttggatcacatggatccttttcctttaacccaaaactaatgaccgtataagagtcaacttcagccgttgagcagtccttattttccagctatgtgtttcattttatcatcgttttaaaaatgatcgagatccatttacttttttagtcaacattatttcctttaaattgcgatttgaatatattaacttaaaagattacgaagtaaaaatgattgatgaacgaagtcgaaacgtgcttcgaagtttatgaaataattgactttttgtatacttaaaaaaatttgactttaaacaaacagaaaactttttatttatggtacttaattagaatataacaaactggaccgtcggtgggatttgaagcatcatggcaaatgtgcgttgttttaaaatgtcttgaatattcattttctcctttggagagcttctgttcgattttgattggtcgaaatatatgacataacatatttccactgaattgtaaataatgtattaggtatagtggcatataactcaatgctaaaaacatatatcaatttactggatttcacaaaattgtaactcaatgttactctatatatggaccactgcatgatatccatgtcttgtactaaggattcgatcattcgattatcctcatcagagatgttcgctatcttgtcaatagatgaggacaaacaatatgagacgatatattttcctcgagaaatgaaccattagaatcactctacttttggaattaaccggttatgcaagtccatatgatttgtataaatactgatatacataatgctcatctataatgcatagttttttcattcagctctaaaatattataagtaatgttattgagcctcgattgattgattgacaaaaaaaaaaaatgttattgagccttcgattctttttttgagcctttaattggtagttctatattagattacatattatatcaactgattaatcttcgatttcttgagcttaaaaataaaataaaataataaacgctggctagcaaattgttttgactgagatggtcctatagttttggacgcctagacggctataaactatcgagttttaaccttatacataattcatagttgttacgaattataattaggcaattacacatttgtattatattatacatctatgtcacctcgagaagattgaagcattttttttaacaatgacatttttattttttaagaaaattattttatcagaaacttaaaataacaatttgttttgtatcttcgcctggacgtcattaatgtttgtgtcgttcaataatgtttggtagttatatatagaaagagcaaatttatggttgattgatggtgcaaaaaaattcatttctctatattctagagaaataaaataaaagaataatggaatattaaatagagtctaaaacaatatacacaaggacagagcctttatatataaagacattgatctctctctgatttctcacacacacacacacacacaacactgtgtcttctctccctctgtttctgtttttagatctctcttctctcttctttctttccaaaaatcatcttctccttctccacctttcattatctttcttctcttaccaaaaccctttaaatacaaaaaaaaactaaaacacataaaaaaaatattgaattctcctttttcccgacaatctgagtttctcaggcagagaagacagagattttcaccgtaagggcaaaaaacgaaaaactctgtctctctgtttctgtttcgtccttccttggctttgatttcttacaccaaaagagacatctttaaagaatctcacattgttccctattgcttgtctcacaagagaatccttgatctagggttcttgcttccctcccctgtttttttctttaaattcctcctctgttttctttttgttctcgtcggagtaagaagagatg

SEQ ID NO: 670 - DNA, 3000 bp, Unknown
  misc_feature (1)..( 3000): cDNA_ID_3058308_gDNA_ID_1620305_Annot_ID_152794 3000 nt of promoter + ATG
ccggatttttttcttaatccatcgtatcggttcggattgactgtaaacccgatctctgttctttccaaatcaaagcccactttacccaattggggcctgaaccggaaaaagtggtcatgcaacagtaacccaacagctaaggtttggtgttaatggctttgagaagtcagtgtgtgtattcaaagattactgtaataatattcacatggtcaaaaccagttttactgctcatattttgaataatgtagctctcatcaactcgtttaatatactatgacaaattaatttttaatacttttatcctatctatatgctgatgcttagagacgatcaatcttaattattggttgtcatattgatcaataatatataaagtgcactttactctgtttatataaattcatatttactttatagttgtgagttgtaaaaataacgaaaaaatggagcttagcaacttattatgtttataacgaaacaatagatctataaaccaaaaaacttgaaagcatattaatggataaccgaaaaaaaaggataaccgaattcagtctatatactcgacgtaagcaaattagaattttggtttcattaattaggtctagacaaaaaggagatgacgtaggacgagtctcaagaaagaaaacaataaaggtttgttgaatttaggaagtaaaagttaagtgaaacttagtttcattcacatgttttagcatgtgatctctttgtatatcgtttgactaaacccaacgaatgataaactgtttaacaaaaaaaaaaaaaaaaaaaacctatttaacaaatgagtcccgaaatagttataaaaccaaaaaaaaaaaaatcctttaatttgtttgttgtgattgcatgaaaaatgtgagaggtgtcgtatgtcctcttgtggatgaattgcgtgttaaggtctaccatctttaaattccaatacgacgttactaccgaagcatgcaagcttcaaacaaatgaatgtaatttccttaatctatcttcctttaaaaccctatctcttcactcactcctatctctatcttttactacattatttcaaacagaaaatgaagatgtttattataatgttgatgaccttttcggttatcgcctgtttctacgccggcgttgggaccggtgagccacttgtaccggctctaatcataatgggagattcagttgtcgatgccggcaacaacaaccgcctcaataccctcatcaaagccaattttcctccctatggacgtgacttcttagcccacaatgccactggccgtttctctaacggaaaacttgccacagactttaccggttcgaaccagcctaattcactatttacgttatagtacgtaccatctatatatatcatttcatttaatttccttaggcttttgtttgttgttgagcagctgagagtttagggttcacttcttacccggtgccgtatcttagccaagaagctaatgggacaaatctgttaaccggagccaatttcgcctctggtgcttccggttatgacgacggaactgccatattttacgtaactaattaactcctcctcaaccatgtttaatccggctattaagttagtcaaaccggaatacttaataacattttatggtttcatcatattattgtagaatgcaataacattgaaccaacagctgaaaaactacaaagagtaccaaaacaaggtgacaaacattgttggaagcgaaagagcaaataaaatattctcaggcgcgattcatcttctaagcacgggatcaagcgattttcttcaaagctattacatcaacccgatccttaaccggatattcacgcctgatcaatactcagatcgtctcatgaaaccctattccacctttgtccaagtaacttaaccaacaccacaccgtacctatctttaacttttccggtttactctaaaccgatggtccaatcctttttttgttttggcagaatttgtatgatttaggagctagaaagattggagtgacgacgttaccgccattgggttgtttaccggcggcgataaccttgtttggtgaaaccgggaacaataatacctgcgtggaaagactaaaccaggatgcggtttccttcaataccaaactcaacaacacgtctatgaacttaaccaacaatcttcccggtctgaaattggtcgtctttgacatctataatcctctcttaaacatggccatgaaccctgtcgagaatggtacgatttctatcaaaccgcaactttatttaacgactaacaccgacactttaatttctcgttttaaatatttcaattttttatatttttgaacgtagggttttttgaatcaagaagagcatgttgtggaaccggaacagtggaaacgtcgtttctatgtaatgcaagatcggtgggtacatgttcgaatgctacgaattacgtgttttgggatggttttcatccatccgaagcagccaatcgtgttatcgcaaataatcttcttgtccaaggaatacccctcatctcttaaacctaagtttattccaaaacattgattcagatagttaagatgttatatgatcaaacaaaacacagaaaaaagatataatgaaaactattcttgatataaacaaacaaagataagggaaagttagtttctttcacatgatttagcatgtgatctcttcgtgtcgcgtttgactaaacccaacgaattaatgataatctaattaacaaatgagtcccgaaatagtaaaaagaaaaatcttttgtttcttgttattgcatgaatagtgtgagaggtaacgtatgtcatctttaaattcgaatacgacgacgttactaccgaagcatggcttcaaacaaactaaaagtttatcttctttttcaagcaacttcctttaatctctcttcctataaaaccctaatcattcacgacttcttcgtactcagtcctctcaaaatcttttactgcattcaaacagaaaatgaagatgtttattacaatg

SEQ ID NO: 671 - DNA, 3000 bp, Unknown
  misc_feature (1)..( 3000): cDNA_ID_3058301_gDNA_ID_1620305_Annot_ID_152798 3000 nt of promoter + ATG
tcttgtcgattttggcctttacttcttccacaactacgccaaatttagacagactcaaggttccggtttcggtccattcttctatctccccaaaatggaacattctaggtaccttcctggttcggtcatcaaattgatgtttttcggtctagggttaattaggttacttggtttcttgtcagggaagcaaagatatggaacagtgtttttgagcgtgctgagaagatggctgggatagagagaggaagcattagagcaactgtgcttatcgagaccctcccggctgtcttccagatgaatgagatactctatgaactacgtgatcactcagtcggtttaaactgtggaagatgggattatatcttcagctatgtcaaaaccttccaagctcaccctgaccggctcttaccagaccgtgtcctagttggcatgggccagcatttcatgagaagttactctgatcttctcatccgtacttgtcataagcgcggtgtccacgccatgggtggcatggttagtcccctcttaacactagttcactatatgtctctttcaaactacatgaatgctctgtgaaaacattataaataaagttgaaaatgttttgatttgttcggtggtatgatgatcaggcggctcagattccgataagagatgacccaaaagcgaatgagatggcattggatctagtgaggaaagacaagctgagagaggtaagagcagggcatgatggaacatgggcggctcatccaggactcatcccaatctgcatggaagcattcactggtcacatgggaaaaagtccaaaccaaatcaaatcagtgaagcgcgaggacgcagccgcaataacagaggaagatctgcttcaaataccgcgaggagtgcgtacactcgagggtttaaggctgaacacacgtgtaggaattcaatacttagccgcatggttaacaggatcaggatctgtcccactctataacctaatggaagatgctgctacggctgagataagccgtgtccagaattggcaatggattaggtatggagtggaacttgatggagacgggcttggagttcgagtgagtaaagagttgtttgggagagttgtcgaagaagagatggaaagaattgagaaagaagttgggaaagacaagtttaagaatggaatgtataaggaagcttgcaagatgtttacaaagcagtgtactgcacctgagcttgatgattttcttacacttgctgtttataatcacattgtagctcactaccctatcaatgtctcaaggctctgaaagaaagaagatgaagaaggaaaggggagagaggggttgagatatgagtttgtgcttttgtttctttgtgtctgtttctcaaaatgttattgttctttctgtattttggtatattgtaataagcaaaacttgttcttttatttccagtaagaaataaatgttctatatcatccttaatgtgttgtttagacattgtagatacaccaaaagcagagcatttgattacatataacagtttggtaggagagaagaagtcctcatatgcttgtggagtcattgtacactaaagatatggggatgagaagctgtcggctggaacattggggtgatcaatccaagtctgcaaaatccataaactaatttctcattccaagtgaaatgcttgttcctacaaaagtgaagcttacaactttgtagagacaagactctccattttctttcctaaggagatttttcagccgtttggagcagagtctattagtggaggacgagagctggtttcaaagctccgatggtttgcagccttacatgagtgtgacagagtctgcaagggcaaaagatgagatcactgagcacaccaaggcaacgtgtagggctcatggattctttgtttgataactacaagaaggatgggctctggtcttcttttgtctgtgaaaatagtaagatcaacaacgctaaaaagtcgtccctgactacatattaacataatttgttaaatctcgtcactttctttctttggttttctcttttgttttgttttttgggacacatatctcatgttctttatagataatgtttatgaagactttttggtgtttgcttctgttcattctgttgttgaggtattgtggaagcatctttatcaatgtgattttatttgttcaaaccatgaaaaaatctttaagactgctatactttggttctgttcttcttagccctgttctgcaaaacaatagatcaacgtgatcaaaatgagaagcaatgcgttagtagtaatacaatcaaaatacaatttataggagcgtatcagctagtaaatggaaatttttaatccgtataacggctagattatatatcacggaaccaaaggttggtctggacttcctaagtgaaaggggaaaaaggaaacttgagtctagcggctagattatcaccaaacctctaaggtttaacccgaaccgtgtataacggctagattgattatcaccgaacctaaggttggtgtttgctctggagtctggacttaaacaaaccctaagtgaaaaggaaaaaaggaaactttgggaagaaaaaaagggaacttgagtctcaattcttaaacatataagttttataaatatacctcgtttcctgttatctcctcgagtctaaagacgcaatttctctgatttcaattctcttcttcgagatgatgatgccctggttctttcttctcccttcgtttaaaaagaatcattcgttggtctggcccaagaaaaactcatcatatatacaacggctctctgttctcttaaaaagctatgaataagacgagagagatcatacacacacaagcatcacgtcgtctcatataaacgtcagagagacattcttaatttgtttgcctgtgatgatctcaccgtagaaacagagagaaacggaggcgattcgaaggagttagcggcttcaggagtcatgatgttggaggttctctccggagacggagatg

SEQ ID NO: 672 - DNA, 3000 bp, Unknown
  misc_feature (1)..( 3000): cDNA_ID_3083344_gDNA_ID_1620305_Annot_ID_152801 3000 nt of promoter + ATG
gctgttgcctgcttctaccaagttttaaacgctcagataatcttgatttaagtttatatatatgtttcttgtcaaatatcagagggtatatatctacatgaaacaattttttttaatgtttcattaaataagtctatatgaaatgaaaatagcgttgataatttgaaagaaaaataaaggaaaagttagaattttttgcttaatattgattagttttaatgctaatcatgattatttattcccatctgacttgatccaaaaaaccagaaatagattaccaagttgatatgaatatattttcaaaccgaccaagtttttcttttgtgtggaaattttatttacgaaatttatatttttcatttatagtatatattcatgaattgctttttacgaatttagtgacaaccaattcgaaacctaaaagaaaataaaaaattaaacggttgtaatatttggagtcgatatgttttcatttggatttatattgtaatatctggagtatatgtttttcgtttggatttttgttgtatttactttcttactttttggcttattcaagacatgcgattgtgttagtctttactctttatatacttagtgatcgttccattttgacattcactttcttacaaattttttcaagtttcaggactactaataggaaaattctcttaatcatcttcaaaattggggattcgaccattttttacataattttgttatatattgccataatttgagattttgttattgaattttatttaattccaatatttatgaaatgtcttgaatcaagctttgtttttcgactaagttatttgcttcttttttggggggttttggtaaaaactttgtttacttttcgacttattttgcttcttttgtgctgtgttttaagttttatttagtgtttcgactaacattataatattttttagtgtggtttttatttagtgtttcgactggcattttaaggtgtttcgaatgacattttcgtgtttttgtcatttaatggtttattctccttctttttttggggctttgataaaaaatttatttactgtttttcgacttattttactgtttttcgatttatttagtgtttcgaaactaacatttttgtttctttccttttttgttactaaaaaatttgtttactgtttttcgacttattttgctgtttttgtgctgcgatttaagatttatttagtgtttcgtttgttttccttttttgttactaaaaaatttgtttactgtttttagacttattttgctgtttttgtgcttttaagatttatttaatgtttcgactaccatttttgttactaaaaaactttctttattcttttagttgtgtgtgtaagttttatttcgagtatttcggattcacgtttttcgtgtttagttatttaaaataaactaagatttcgggtcaggttcaaattcattaaataggggcttcgggtacctgtcatttgggcgactgtcattccaaggtttgtttgtttttgttattttagagtggttgttattttcttgtgtgtgtctagcgatttgttgtaggttgctgtaggaactacactagtcacgcattgggcgctatgctcactcacacgcccatctatacaacctatacatacaactatacaatctccccctatttatacatctatacaatcacaccctaataatacatctatactatcacaccctaacatacatctaaaccatcgcaccctaaacattcatctatttatacattcacaccctaaacatacatctatatactcacaccctatcatacatctacacattcacaccctaaacattatcattcacatctacatacatacatgtatctttatccggaaagaaagaggaaaatacaaaatattgcacagtcttgtcaacttcaaaggctggcacagcagaaaatggaaaatactggatatagtcccaaggcttcgttttcccttcttcaaccttctgcaaaattaattaatcaaaatcagtatttcgttttttccgttgcacatgcatttacatacaaatcaaacatttcagtcaaaaattaaaacccattcttcctatgttttacataaaaactaaaatcttcattctatgttttcctagacagaacataaatatatctagcttaatttcaacagcaacaaaaagaacatatatctagatataaaatttcagtttatttaagacacatatgtagctaaaaatcagtgtatgtcatagttcatagatgaagtcaagacagcaatgtatataaaacagaacattaatttaaattccaagttcaactccataaaagatgttaaaaagatgaagaacatatctataagctaacaagaaccgtttatatgattaaaaaaaaaactagaataactaagacaagagtatttttaccttgtaagagaggatgcttatgtttgtttctctcggctaatgagcaatgtagacaagtttgactacgagaactcctaaagtagaagaacggaattttttaaaaaaaaagactgtattcgacatttgtaagaaaataaccaagtaaagaggattcagatttctgattcaagaaaggagtatttatagagaggcattatctgaatctctttccaataaaatattataatttcaaacgggaagaaaaatgttaccgtttcacaacgttcatattttttccactgtcaacaagtcaaatcaaactatacgttagaacaatagtaaaaatcgtaaacgcacttaagactctttgatccgtttactgagtaaaaaatctctgaaagcttaaggcccaaaattaaggcccattatatgttaccgtttcacaacgctcatattttttcactccaacaagtcaagagcaaaatattggaaacctaaattatgactcttaaggcccaaaagtaaggcccattaagtgtgatataacgacgttaaaataaatgaattgccaaaaacaaattagaagaagaaaaatcgatg

SEQ ID NO: 673 - DNA, 3000 bp, Unknown
  misc_feature (1)..( 3000): cDNA_ID_3058295_gDNA_ID_1620305_Annot_ID_152805 3000 nt of promoter + ATG
gctcttaatcttttgttgttgtttctcctaattttcgtatgtcaatcttgttcttggatataaaaaattagtttcaattttaaagaataagaaaaactgttctcgctataacataacttcctaggttagacatactgatgacatgcatatgattttttttttctaccattaaatttggagtttgtcgaatatttttaattcgaaaattcctacaatattctcaattaagccagagtaatcaaccaatgtgcttagtttcatctgaactagtcaacctcttcggtttcatagaaacctaactcccctcgccaattcgatttgcagtcgatttgattgattttataaaatttggttattttaaaagtgtatccccacaaaatctagtggacctttggacatgggacaagcatggtgagttgccactagtaaggttttttatatataatatctcagtgtaaagaataaacatatatatctaaatgtacaatgaccacatacaaattatgtaaatgtaatttaactattgcaaaacgtctttagaaattagattaaagaagagtatgtgaataatctatctaaaaaccaattgtctgaatcattaacgaatacttaggacttggtcaaagttttccaaaacaaattccaccgattgagaaatgtaaacaatttttctgccaccaccactataagagagctaggaaacgcattcaatgccctacgttagtaaggaaaattcaatgtcatgcactgtatcacaaagtcataaacatttaattgaaaccctatacctagctagatagttcttatatacccacccattaccagtttttatttattaatttattatttaatagattgtgatgaccatacctatacctttcatcttttagttttaacttttacctctatgttcgttgtcacactcatcttttaaagtcacattcactttctcgtctcgagttattagtaaattaaatcgaattacgtttcttgagatcatggatattaataaaattgattttgtctcatacaaatttatttgtgaaatcatatgaaaatatagaacgaaaaaataatatagactgcattatacgttcgtctttaaaattaaaaattaagagggcataacgcgttacgcgtgcatacgtagtatttgtatatgtaagattttaatgtataataagctcatgttgcatcttagtatgggcatgcaattgcaagtgtatccataatgtttttaatttgtccgtggagtattgaacatgatctctaatttaaagggatacgttttttatttttgacgaatgaatatcaatttatatagtaaattacacatgacatgaatttttttggatttgatttcgaaccaaataatttcttcaagtatatgtatactaggaataataaatatcttgcatgggatcattatatcaaaggcgacacaacttggaatcgtgatgatactaagctcacacagtcgtaaatcgtaatattaaatacgatcatcatgtacacttgcaccgccaactcatgatcatgtaaaggatacattgagtaatgaacaaaatgcaccaccccgaccacaccaccccacccactataatatattgaaggaaaaggagagaaaaatcaaagcaggtcccacttgataaaatggcactaacgaaatcccaaaaaactcttataaatatacaatttgtataatacaaacacaaatctccaagcaaagaacaatagataaacgaaaaagaaaaaagtaagaaaagaagaggaagaagaggaagaagaggaagaagaggaagaggaacgaatatggggaactgtttagtaatggagaagaaagtgataaagatagtgagagatgatggtaaggtacttgaatatagagaaccaattagtgttcatcacatccttactcaattctctggtcactccatctctcacaacaacactcatctcctgcctgatgctaagcttctctctggccgtctctattatctcctgcctacaacaatgaccaagaagaaggtcaacaagaaagtgacctttgcgaatccggaggtggaaggcgacgaaagattacttagagaagaagaagattctagtgaaagcaacagcaatatcgatggtgatgacaccaagaacgtaactgttgtaagaatgaagatcgttgtgcataagcaagagttggagaagctacttcaaggagggtcggtccatgagatgatgtaccagactcttgagaaacaacttttacttacttcgtctgatgatgatgatcttgaatgtaatagcggctggagacctgcgttagatagcatacccgaatctgaaagtctcagaagaacataacagatagctcatatatactcaaaaaacagtttgagctttgttcaaggaaaaacttgtttttaggttttgtttgtaaataaagctttaagctgttataggaaaagactgtgtgatattgatgataacactaagactttttgagtcaagctttttgttttccaagtaaatttaaatgaaaatttcatccatgtttttccatggattgagaagaactcaataggaaaagtaacaaccatgtattagatttaatataacatgaacaaacatttatatgcacttattatttatcatatgtttcagaaccagccttagtttcttgctcatgtctcttcaaatctcttcatcagtataagattaagttaattttgttcatagtcaacaaagaaactaatgtgttttggtaaagtaacgaccactctatgttgaaccgtttccggtttaagatattctaaccggatgattgagagtcgtaccgattggtttgaatcggttttggattttgctgctctatcgtcgtgggagagagataatcatcaatttttccaggcaaaaagcttcgattttgaaccatataaatcatctcccatggcggaaatcgaagtctttaactaaagaagaagaagaagataaagctttgtaatttataga

SEQ ID NO: 674 - DNA, 3000 bp, Unknown
  misc_feature (1)..( 3000): cDNA_ID_2122823_gDNA_ID_1620305_Annot_ID_152799 3000 nt of promoter + ATG
gcttgcttccaacaattttatcaaaatatttcaacaaattttacgtataagtttatacaataaagaattaagaatggtcaacttttgtaattgaaatatataaattcataaggacaggtaaaattggaaagcgtttaacgttcgcttaacgtacaataatagaccgttgcagtctgcaattgaaagaatctaggacaaagaaataaaagagtcacagggtcaaaactaaacaaacaaatactttagggagaaaaatgaaataaatcaggagttttaagtactaccatcagaggtccaatcataacattttaaggatatattcgattaaaacgtaataaaacataaagatcagggacttccgacaaaaatctttcgatccacttacacttccacaacgtccgttcgaaaaatatgaccgttgaaagtaattaaattgttttaaaaacaaaaacaaaataactcctctcttcttcttcttcaatctctctgttcttcccaaaaataaaaactttcctcagtaaaaaaaaaacaagagacagagagagagagagagaaagatgggttgtgtttcttcgaaactaggcaagaagaaactcataagagagattagagtcaacaatggcggcgatcacattgtctctcttacttcaactacttatggtcatctcgatctcgatgaacgagcagagacctctcctaagtcactggaagttactaaaggcgaagtctttgaatctgaaatcataccgagaagatctattaagagagatgatccggagattatcaatacttgggagcttatggaagatcttgaagattcaatgcacgtttctaatccacagaagattagtcccaaatctcgtggtattttcggtaaatcatggaagactccggtgaaatcggttgttgaatctccgaagagaggaagtagtaagagatttggagggaaagagaataattcgagaggtgtgagtccgaatcagattctgaagccgaagaacattcttgaaacaccgaagagaggtgtaatgcgtttgagttttcctcttaaatctgaagaatcttcggtgacggttacgcagaggaggaagagttatagtccaatgtttgatccagatcttgtggcttcttacgaaagagagttgtctcaagagaaagaacagatcaagatggtgatttctccggtggtgcacgagagcagaaaaacagagaaaacagagagaattcttgagaagttcccagagaaatgtccaccgggaggagagcactctgtggtgatctacataacaactcttagagggatacggaagacgtttgaggattgtaatgtggtaagatcgatattagattcacacgaagttcgattctcagagcgagatgtgtcgatgcactcggtttttaaggaagagatcaggggcattatgggaacgaaacatgtgaagatacctgcggtattcgttaaagggaggatggtaggaagtgttgaggaagtgatgaggttagaagaggagggcaaattgggaatattacttgaaggtattccggcggcgaggcttggaggcagttgctgccgtggatgtggaggaatgagatttatgatgtgtgttgtttgcaacggaagctgcaaggttagggaggaagagaagaagagtatggttaagtgtttgaagtgtaatgagaatggtttggttctatgtccaatttgttcttaaaaaagagaatcagttttgccctaattctggaggctgacttttgaagggttgattttggtttgtaatgatttggtgagagagagtttctaaagccgtgtttagtgctcttggtgtgtactactactagtttaatggaatttgtttctaatgtttgtaaacctttttcatttttaagattcaattcaaatcaatgggtatcattcattaagaatttgtcaccagatttgtttaatttagattctcattaggtgtttagcttcgtgactgaataattaagataatatcaatgattttaaggactttgggctacgattattttgttagtgcacttgtctctcaagatatctaaaactgatggatgaaatagcttttgacttattaaaccggtatagtatataacttggcaaccttgttcagttgttcatgatagttttatacttttatatttagtcaaggatggagaaatattaggagagtcatacttggtttctttatctttgtgaagtttagttttccccttaataggttaatatgatcgttatcatgcagtcaaaaaataagaattaagaataatgaccgttgtctttacaagaattaattttatctgaatcaatcagttattaattttcctagatttggtgaacaccagtacaccaccaacccagtagaactaatttataaatgggctaatataaagttatagaggatgggtaattccaaggcccaagcacacctacaagtccgattgattccagatcttacagcatgttgataaaaattaaacttctcccattcatgtatctcaatatctcatattgggatattaagagtttaagaccactttaacaaaaaaaaaaaaaaaaaaagagtttaagaccaaatttcaaaacatttggattgaacccaaaacagtgcctcgattttatctgaatcaatccgttaacaaggatgttttggtctcatcatccaatagaagcaatcagtaaactaatttgcatgacaactaaaactgttttaggttttatgcagagccagaggtattggatgatgaaaacgatatggtgacgaaaaggatattattataaatagaaaatttgtgataatcctatcctaaccgatatagtgacgaaaatcatacagaacttggcacactttcccaaggaggcacacatgtcaatgcgtttcaccgattatacctatccatttccacctttataattcatattacacgatcacatttatatatcactatatcacgttacaaaatttagacaaaaaaataaatatg

SEQ ID NO: 675 - DNA, 3000 bp, Unknown
  misc_feature (1)..( 3000): cDNA_ID_3083360_gDNA_ID_1620305_Annot_ID_152795 3000 nt of promoter + ATG
agctgaatctttaagaagaagagatgttcattattgttcgtcaatgagagacttcaacttctttctgaattcaggaatcttttgtgtctccacgaccagcactgacaattcttcaactactagattcgccaatcgccattataaccaaagattacaaacctgaaacacttgaatcaaatttttgtgattccagggaaagtatgttggcattaaagagataacttacctcttgagatgtaacaagctgcgagtacataggtaatatgaatgaccaagagctaagctgcaatacattttgtaacacatgtttagggtataactttttttgctaacagacgggaagtcgagtaggtaatgtgagaataagtacctcgagaaaaatttcatcttcaggcttaagttatattgttcctcgttctcttcttcaccacgacattgttgaaacaagaaagagaattcgagaaccggaaaaaataaccttaccagaacacttaccttgtagatcttagcgattagaatatatgacttgaagcggaatgaccctcgaagctcttctgtaggctgtaaacagaaacttacaaattgataaatttcgaagatctttaatttgctcataagaaaagaatttgcctaaacttaactttgaaagatcaaacctcgtcttcagtggcccatgagacttcgtcgaacaatccatcatatagtggaggaaggagttgtagaggaagattcatcactctttgagagaccaataaaccaacatctttggcctttttctctaagagtagttctagatcactcgctacattcttctccgaacaaactttaagaagaaactcttttagctctctaaagcacttattctcctgaacacacaaaaaaagatcattcggttgttaatagattgctcaccataagcataatagcaaatacgaataaacacctttgaacatcatttaatacttcaacaagcttaacaagcaaatgaaatcatatacacagcacatgatcaagtcgatcattaagcatatataaatgtaaagttcacttaatagaggtgagtctacatgacttgccttgtatcttgccaagttaagagcagtgataagagcaaataatgcctcatcctcatcatctgctacttttaccacagttcctaacgctgtttgattcagtatcaaatccacaaaacctgcttggacatctcccttcaaagatcaaacaacgaattaaaacgtaacaaaaagataaaagaaatcaatagcagagtaacttcacgaaatcggttacctgagagtcttcttcatcagaggattccaacgatgatttctctttccctttcttagacaaattatggaacttttcatctacaaagttaagaatgagacatactcatcaagtcgctacgatgttctgtctagagaaagtctcaatctttgaggttactactaaccaaaagacatatccggaagaggcaatttacgtctagccgttgaagcaaaggcaagagaacgtataaacgatgaaaatgctaaaggtttatactttgacaatcttcttctccctgatggccttctaggcatctattcaattacttcaattcgaaaactaaacaacatttcaggctaattcaccaaaacctatgcaaagtgtgtccctaatctatgaattgaagatagtaatcttagttcataagagaacagagtatgaatagcaaaactgattcactggactagttctacgagaatcgaaattgatttggaattggattgagattggaaaccttatttggttctcgtggaacttaccgacggtggagcgagttgacaccggtaagagagaatcggcgacgactggggatagacgagagaagtgaactaaggaaacgggacgaaaccgaatggttcagttaaatcagtccataccggatttttttcttaatccatcgtatcggttcggattgactgtaaacccgatctctgttctttccaaatcaaagcccactttacccaattggggcctgaaccggaaaaagtggtcatgcaacagtaacccaacagctaaggtttggtgttaatggctttgagaagtcagtgtgtgtattcaaagattactgtaataatattcacatggtcaaaaccagttttactgctcatattttgaataatgtagctctcatcaactcgtttaatatactatgacaaattaatttttaatacttttatcctatctatatgctgatgcttagagacgatcaatcttaattattggttgtcatattgatcaataatatataaagtgcactttactctgtttatataaattcatatttactttatagttgtgagttgtaaaaataacgaaaaaatggagcttagcaacttattatgtttataacgaaacaatagatctataaaccaaaaaacttgaaagcatattaatggataaccgaaaaaaaaggataaccgaattcagtctatatactcgacgtaagcaaattagaattttggtttcattaattaggtctagacaaaaaggagatgacgtaggacgagtctcaagaaagaaaacaataaaggtttgttgaatttaggaagtaaaagttaagtgaaacttagtttcattcacatgttttagcatgtgatctctttgtatatcgtttgactaaacccaacgaatgataaactgtttaacaaaaaaaaaaaaaaaaaaaacctatttaacaaatgagtcccgaaatagttataaaaccaaaaaaaaaaaaatcctttaatttgtttgttgtgattgcatgaaaaatgtgagaggtgtcgtatgtcctcttgtggatgaattgcgtgttaaggtctaccatctttaaattccaatacgacgttactaccgaagcatgcaagcttcaaacaaatgaatgtaatttccttaatctatcttcctttaaaaccctatctcttcactcactcctatctctatcttttactacattatttcaaacagaaaatg

SEQ ID NO: 676 - DNA, 3000 bp, Unknown
  misc_feature (1)..( 3000): cDNA_ID_2122789_gDNA_ID_1620305_Annot_ID_152789 3000 nt of promoter + ATG
acaacaccttaaacaaacatttcagtttgtaaacttcatacgaatgattcattttctgtcggtccagtaccaaaattttaaaatagtttggaatctttgaaacttagattattttttcgcacttaattgtgataggatatttcctgttttaatcagttattaagtcagtaaattgacaaattaaagtctgtatttagttggcatgtcatgtgagaacacataccgagacaattatccaacataatagacaggatttaatttgttgatcttctagacaaacgtgagttaactattacatatacgagtatttcattaaactcatagcatatattaaaaaagataccaaattaccactcttcactatcattgtttgtttcaaactttcagtttcagattaccattctttaacagaaaataaaattttatatttttcattggctttgatttctttgaatgtgaaacaagtatgtatgatgacacatgagttacgtttgtacctatatattatcatggtaacttaaaccgtaataaaaaaaatgtgtgcagaggtataataatgaaaaaaagagagaataaactaataaataataaataattggagaaaataaaatagcactacatatgttgcatgcagccagcaaagtaacatgcagtaccatgcaagtaaacataatgtataaggaccaaataccacatgggttcttacagttggactttgcttatttcactcacatttgtcactattcttttcttgctttcgtcatttacaataattctgaatcggcaattttatgttcctttctttattaaaccgatcaatagatgaaatggaacaccctaaccaaaaatgaaaagaataaataatgacaggagtacccacggacaaaggcaactagtcgcaacatagactttttagttttaactctttatttactaatcggagcagtttagctttgaacgtacccaagtcataagtatgttataggcccctaccacaggaacaaagttttatttacaaatagaataattcattaccaaaaccaaaaagtttatgcaaatattagtctttcagaaaagagaaaaaatgggcatctttgttactttagctataaaaaatatgaaaacaaaattcaaagaatcaatcaagttttgtagaaaacataattcaggaactaactggtgggatccaatgtccatatacatatcatatataattgatatcctatctactttggcactgaaactcccctagacatttttttttaaggtgttatttcaatctttatttgtcggcatatatatacgcaaacacgtacatttgtgcgtatatattaaattacgtatctatcgaatttttaaaaatgcttttttagtctccctccccttttaaaagctgggaaggggttgttgaaacctctttaattaaatgtttaacaattatatactaagtatgatgttcgatcatctgatcatacaatattgtatatcttatagttctgaaacatttaggaaattttagtgtccatttttattcggcgtgatatacgtatatgttgtataaactataaattgaaattaacggttcattagaaccaaacttaataatttgtctaagcataattgttctacaaatgggtaaacattttataaagtcattaactcattatacagttagggatttaaaaataagaaatactcaacttcggatttggtaaaagtaatatatttaatcggctacgtagtgtgcaaagatacttgccgtccatattgaaatcatgaagaaaaaactattcaacatcaaaggatcaaatcaccataataacatgaaaaataagttcagttatatttttaatttgtgtaccaagttatactaagactacattatatatgagaatttcgagaagctatcattggatatggtctaccttctatgcgaaccaccgagttgatgtatacaatgtggctcgagtggcgaagtagacaccacaccttagtcttcaagaccaagtcttcatcactcttattctcacctacttcaatgtttcattactaattttgctttatatttatatatgtgtaatgggaaagttcctaggtcaagttttttttttttttttttctaattttaaaatatttcacttttagttggagtatcatatattaattacttttgccgcttttgacaaaactatagccatctttgacattatactataaattatttgttcttacgtcaattaatcaaatattttccaacaaacactggtcttcattatatttaaaaatatacataacctgaccagaattgcgttttaacaacggattttttttatggctctaagataaaataaaaagtcgttgcatagctagtcgttattatttcgtatttagaattgatatgtttagccacgtgaaggagaggaactaaaaacaaatataatattaacataaatatgttcattatattagagaatttctcttcaatatcaaaaatgtaactggactacaatttggaacttacaagttagtcgacgagataaatctgaaacgatagataaagctcaccggcaagcaaacatggcacgtgggaagctaaacttgttatcaaagttattcttcaacattttgcactgaagaattttcttaataaaatcagtgaaaaaaaggcaaaagggtaattctcatttcacatttgtttccacaaactacttttgaattattatagagttgtctcttttttcttaaaatagaaattaacagttcataatgtaacaaaatcctgcatttttaagaatcttaagatcattcccacacgtaatgaataataaatagtagttactttaatcgtcgttctactagttgggccatactttggtattattgggctcaaaaataattaatgggcttaaggcctcattagaaaacggcaacgccattgaaggagtctacggtgaaggaaagaagctaacgtcggcgccgtcgttagttgccggagacgcg

SEQ ID NO: 677 - DNA, 3000 bp, Unknown
  misc_feature (1)..( 3000): cDNA_ID_3083365_gDNA_ID_1620305_Annot_ID_152793 3000 nt of promoter + ATG
catgttcgaatgctacgaattacgtgttttgggatggttttcatccatccgaagcagccaatcgtgttatcgcaaataatcttcttgtccaaggaatacccctcatctcttaaacctaagtttattccaaaacattgattcagatagttaagatgttatatgatcaaacaaaacacagaaaaaagatataatgaaaactattcttgatataaacaaacaaagataagggaaagttagtttctttcacatgatttagcatgtgatctcttcgtgtcgcgtttgactaaacccaacgaattaatgataatctaattaacaaatgagtcccgaaatagtaaaaagaaaaatcttttgtttcttgttattgcatgaatagtgtgagaggtaacgtatgtcatctttaaattcgaatacgacgacgttactaccgaagcatggcttcaaacaaactaaaagtttatcttctttttcaagcaacttcctttaatctctcttcctataaaaccctaatcattcacgacttcttcgtactcagtcctctcaaaatcttttactgcattcaaacagaaaatgaagatgtttattacaatgtcgatgtgcttatcggttatcgcctgtttctacgccggcgttgggaccggtgagacacttgtaccggctctaatcataatgggagattcagttgttgatgccggtaacaacaaccaccgtattaccctcgtcaaagccaattttcctccctacggacgtgacttcgtcgcccacagtgcaactggccgtttctctaacggaaaacttgccacagactttaccggttcgaaccagcctagctaattcacattatagtacaatctatcatgcatttcctttttccttaaaatttgtttgttgttgagcagctgagaatttagggtttacatcttacccggtggcttaccttagccaagaagcaaatgagacaaatttgttaaccggagccaatttcgcatctggagcttccggttttgacgacgcaactgccatattttacgtaactaattaatctcctcaagcctgtttaatgtagctatatattaagttagtaataaataacattgatatggtcttatcgatcattattgtagaatgcaataacattgagccagcagctgaaaaactacaaagagtaccaaaacaaggtgacgaacattgtgggaaaagaaagagcaaatgagatattctcaggtgcaattcatcttctaagcacaggatcaagcgattttcttcaaagttattacatcaatccgatccttaaccggattttcacgcctgatcaatactcagatcatctcttgagatcctattccacctttgtccaagtaacttaaccaacactacaacgcaccaagttttaattttaccggtttactctctaaaccggttttcttttttggcagaatttgtatggtttaggggctaggaggattggagtgacgacgttaccgccattaggttgtttaccagcagcgataaccctgtttggtggggtcgggaacaatatgtgcgtggaaagactaaaccaggatgcagtttccttcaatacgaaactcaacaacacgtctattaacttaaccaacaatcttcccggtctgaagttggtcgtctttgacatctataatcctctattgaacatggtcataaaccctgtcgagtatggtacggtattttgacatttcgactaacacctacattctttttttttgttcccattaatatcttttgttaatggttttttaaactgtagggtttttcgaatcaagaagggcttgttgtggaacgggtacaatggaaacttcgttcctatgtaatgcattgtcggtgggtacatgctcgaatgctacgaattacgtgttttgggatggttttcatccatccgaggcagccaatcgtgttatcgcaaataatcttcttgtccaaggaatacccctcatctcttaaacctaactttattccaaaacattgactcaaacagtcaaaaatatgaatatatgatgaaaatatatcctagatcgttatatagttcaatgaatggttggagattattaactaaaggtttggtttggaaattattgctttctttaataaataaatttgtaaataaataatttcagttacggggatatttgatcatatcaatagtaaagagcgaaatgtatatatttcccactaatatagggaccttaaataaattgcttgattacaaaaatggtccttctcttctgaagtaaatagaacaagtgagaaaggtttatccatggcgatttaggcgcccaaaagctcaaaaattcattcatgtccaccgttaatcatcactgcctcctcaattttcctcatatcccaccttcaattcctccgaatcatcgtcccaaacttctttcttctctctccctctatcgaaaaccagaacgcctctttgctctctctgcgtctctgtctctttcaccagcaacaatccatgaatgttcttcttcctcatcttcttcttcttcatcgttcgataaagaagaaacggaagacattgaatctgttattgatgggtttttctatctgcttcgattgtctgctcaataccacgacgtcgaggtaacaaaagctgtgcacgcttcgtttcttaagctcagagaagaaaaaacccgtcttggaaatgcccttatctctacttatctcaaacttggtttccctcgtgaagctattctcgtcttcgtgtctctgtcttcgccaacggtggtttcttacacagctcttatctcgggtttctcaaggttaaaccttgaaattgaggctcttaaggttttcttcaggatgagaaaagcaggtcttgttcagccgaatgagtatacttttgtagcgattttgactgcttgcgtgagagtttcccgattctcgcttgggattcagattcatggattgatagttaaatcagggtttttgaattctgtgtttgttagtaattcgctgatg

SEQ ID NO: 678 - DNA, 3000 bp, Unknown
  misc_feature (1)..( 3000): cDNA_ID_2122922_gDNA_ID_1620306_Annot_ID_152827 3000 nt of promoter + ATG
ggtatactatggatgaaatcctagaattaacaatcaaaatacaattatataatttgaaaaactaaacaaaaatattattattaacataacaaatataattttaaatttcaaaaaaacaaaatttataaattcattacaaggtgtatcatagtatcatacaaaaaaaataatagcatctatctatagatcatcttaaaaataaaaatttaattttttatttaataaaaatatagacttatgatcattgtatttcttgaagatgttatttctatataaataatattaattaaaagaaaaatctctaattttttaaccaaaatattaacccacgggtcaatatctacgtaatacaagttttaaatttttattccctctaaaacaaaactcaaactacaaacaaacaaatactgcattttaataataaattaatatacaataaatatccaaaaataaaacatgaattacccaacctttaaatgtgtcaaaaatatattatcatatacaaataataattcttataacaaaatatctataacttttcaataaatatattttcggtatactacggatcaaaatttgattttttactattagaggtatgttttagcataataatataatttaacataatacattggtgggagtatgaaaaagaaaaccattttcgagcacaagcaaactatatgacgccagcgatttatggcttcactgtgaccctttcaaatgatttctagagaggttaggattttcaattgattgttggttgctgattaagacactttgattgatgaaaatgacgtttatacttcgatcgattgtttaattgtagtggattgggccaaaaaaccataaatatatgttgaccatcgtatgaagaagctattttagatattattttaaagaaggaagaataataaaatatagtaaaaaattgaattcaagggacaaattaaaatatatttatcatggaaaatcagcagacaagaaaaagtcaaattgtagtagagtttataaagtgagaatattatttatttacaagtaatttgcaaacgcttaacgtaaaatttgccatcagaatccatagtcttattctgaggaaacatatcaaacatataccttatatatgacaaaaaaaactttccaagtcacaagtttttacaatttaccttatatttctagaaaatacaaattaattttataaaataaaaaattattatacaatataagcttcatatatattacaaatttgtcggtagcgaaaaatgtttaaattacgcattatctttaacttgataaaattaattataatatatattttttgaggtagagagtataattgcaaagatctgcgatttggaagttctttttacacaaaccccttgttatcacatccaagttggatggagtttgaattttttgaaaatgacaagaaaattttgttcacgaatttaatcttaaaataaaagcgctcaaattgaacattacttggaatggaaaacacaagatacaaacttttagtaaacaatacaaattaaagctttgaggactctataactttagtctttagaggtagaggccacttttacgtccatgaaagaggaacttagacagataggctgagcgaagtgtgtcaaaccaaagctgaaaatgcaacaccacaaatgagagagccgtggcagaagccacgtaaactaagaggattaagctccatttaggttcttgatcacggatcaagatcaatgtcgctgtgaaggcaagaaccattgaaataattgaaacaaacaatgctaaaagtcccaacattagcttcgttggtaaagtcgtctggaaactagcttctgcataacgagatgtcaggattgacaaaaatatcataatagatgtcacagatgataggagggcaaccgaatctgatatgataaacacttcaaaccagaactcctttctaaaagtagggaagcctagtgtttttatgtcgccactcgtatcgtttccaccaggtagagtaaaggcagctgcaaagaccacagttgctatcagtgttgatacaagaatgcatgcagtcgcagtttctttcatccatttctctccttctttgcgtaagttgtcatgctctttcgtaaatagatcatgcgccacctcctcttttttgttctttgttttgatgtatacacgaggaactatctctttaacagcctggaaagtcattagaagttttgtaaagatatatacaagatgttaaattatacccattgtggaatgtgtttagcataccttgtaccaaagaatctctctttgcatctgaagtgctgctcctgatacaacttgtaacctatttggaggtggtaaacgtgccacaagatgcaacaagttgtcgttggattctttctctttatacatagctatcaaatctttgatggccccgagttcatagattctattaaagattttttcatgacgatttatagcagcaatgtggaacaagctttggttcttatgatccaccgtccatatcagatctggataagaacgaatgagaataagtaaaagctcaagatttccagattgtgcagcatcaaagagtagcattggagatgatcccacaaattgcgaaatttcctccactggcaattttataacaaaactccatagctcctctaccaccatatgagctaaagtccgcattttggcttcacgaaatacccctttaaaaactaaatggaaagagttcttgtcaggtgtgatgttcaaacaaaggtttagactataggttatataattctcaaactttggtcacttctgagcacttgttcctactacttatatatatatattttgatatgaaaagaatgagttaactaagaggtgtacttgtgagaaactcgttaccaaacgacctgttcaccccaaggttaatttgatattatacctgtgagtttttggtctaaattcaccaagtatgagaaagactctattcggtatagagggttcgaagttcaa

SEQ ID NO: 679 - DNA, 3000 bp, Unknown
  misc_feature (1)..( 3000): cDNA_ID_2122929_gDNA_ID_1620306_Annot_ID_152830 3000 nt of promoter + ATG
ccaaaaaaatcagataaaagtcttacaacatctgcattaactatttttggtgggtgtctaaataaattaattataataaactttttaacgttatttaattatgaatatctttaaaatgtgcaaaagtgtctaaagacacttataaataaatttgtttatatcgacaaaaaaaaaaaaaaaatttgtttataaaaattctgaagacactcacctaacatattagtctaccaaaaagccgttttttttctttactaaatataaaatttattgatcaacaaaaataactatttacaaaagaaacaaaaagtggagaaagaagaatagaagtagatgctcatgggcaggttccaatttgtgtgaacgatgtgtatcagtcacagcgaggagatatggtttcttattgctttctcaataatgtgcgtaaggtgaagaagccaactatgttgatggtgtcgtgtgtcgcctaaaagcccaaccttataaggaaaagtagcggacaaaatctcttgaatgcatgcttttcagtatttcgctattataggctaattaatgaccgaaactttggtctttcatatgtgtcttattattattgaaaaataataaaatatgcattgaagagattttggatacaaaggagagatacttagaaattggattattattattattacttttagattaatatgtgaattcttattaaataaaaagggttgtagaagctacaatattcttaacacaaaagattgttcatttccaaaaaggataaaaacaagaaaaaaatctactaaaaggaaatatgagcatagatgaatatagtcatactttagccaaactcacataaggttttgaatcctgtgtgttttctctttgcaggaattgcatcatgaattttctgtctagaaccttgaataaggcatgagtatgtggaatgttgttgtggtaccgattgttctctccacccaaatcgcataaatgcatgggtgaggtagagtcttagatggctagccaaactgagaatgcgttagtgtggaaagtaaaaaatgattacagcccagtcttcttgttgttttagaccaaataccttcactaacttaatattgaagaacaatatgatctctagttacaaggagcaagccaattatgatctagtttcaaggaattggctaattatacttaaaacccctaaagtctaataggaaaatattagatcatgagggaagctaaacccttaaaactgtgagcgttagtccaaccaccatggccagtcttgagggaagctacttgaaatatttgtttgtggctcccattttgtttaacttttttattactacgaaactaaacttgaattaatattgccataactttttcataagaggataggaaaatctaatatgaactctatcaaattatatgtttcaagtaagaatacttaaaatgtttagctgagctccattatttttgaaaacagctaaaatattttttagattctattaattaaaattaatacataaatgatatgatacaattgagaaaatgaaaaacgcccccgaatataatacgtatgtggcttcataatcgtatagttgtaggatcgacccagcacaccacagccgtcactagtatttaatagattacaagcagaaaaagaaatttaggtctatttaattagtgaaaataaaaaaataaaaattaaataaggcaaataaagtttagatgtacaacttgaatctttaaacctttgacgtatctaagatgcaaacaaccaacttttctaccgaaagttataagataatgaggccaacattttatttatagtaattgaggtcgcaagcatgggattggcccgcttgtgctcatgaacggctatgcacctaatcacctacaaaatatcaaaacaggaaaatctatgtaaagtgatcatggagatcataaacttcctagatgcttactatgacattcagaaacccacttgaaatgctaggaaatgtattagtagacatcaagaaaatcagaattctatatttaatagtcatgtatggacacatactctattgtgaaaaccaaagatttattagtgaaagttagcatccaaataatcctgatttgcttaactttcttaaaaatccttaacagtcttcaaaatctactttacccaataggcatccaactaatctgaattatagtagatttatcttatagtcagtgtcgtgagtcgtgaccagagttatagaagcttaatgcagtcttaaaaattgtactcttttcaaaaaactattttcgtatttataaagttatcatcttggctatttgtgatggaccgaagggatacgattattgggttttcatattttggtgtttcggtcttttcctttttagtattggttttgagagttttctttttaattatgtttaagtcggtttgtatgaggatctatataagatcctcttataatcaataagaaatcaaacctccaacaattaacctaattctctaagagagacttggattaaaaggaaggttttgcttcaatatctatcttgttctacttcaaatcacggctccaattactagatctaagtcaaaggctttagctcataacacaatgctatttgatctcagcattcttatttctctaatttctaaaagaccaaaataacgcaaacggcacgcagtttagctctcaatacccgagacaacacttctcgtagtccgtacttaaacccgccacgtagttcactttattcaacttaaaaaagcatgacgttttggtacatctatcttcttcttcccccttcctctctcagcttctctcccaccactaaggaggaacgttccaaagatccctttctcagagaattcccagaaaaatcttcaacaattgaaaccctaatggagaatcattcggatccttgaatcctttggtttgtctctcacctccatttctgaaatttcattgctttgtgattcttctgcagattcgttttgaagagaagaaagaa

SEQ ID NO: 680 - DNA, 65 bp, Unknown
  misc_feature (1)..( 65): cDNA_ID_2121696_gDNA_ID_1620307_Annot_ID_152840 3000 nt of promoter + ATG
gatcatcctcttcaggcgtagtagtctcgaaacacttaggtagggttttacagaggaagaagatg

SEQ ID NO: 681 - DNA, 3000 bp, Unknown
  misc_feature (1)..( 3000): cDNA_ID_3058377_gDNA_ID_1620307_Annot_ID_152852 3000 nt of promoter + ATG
tgagacagtgagaaactcatcagtcttttttcctaacgttattaccaactttgcttttaatgaaacataaatacgaggttctgaaattctcttattgttggatctcctgacgtttttatccaatgttggtagggtggggtattgttcaaaggaaatctaagaggcaagcctgctacaagttacgagaagataaagacgaggatggaggtaacaattctgctttttgggtttcctttcttaactatgatcgttgacaagcacatgttgtgacaaagagtaatagtgtattgctcatcaatctgcagaataattttggtgaccagtacaagcttttccttctcacgaatcctgaggatgataaacctgtggccgttgttgttccaagaaggtccttagaacccgagacaacaggtatattgctatacacttccatgttaataaggatatctctctcagattattaagttttagctggatactacatataatttgcagctgttcctgaatggtttgctgctggttcttttggattggtggcattgtttacattgtttctccgtaatgtgcctgccttgcaatccgacttactgtaagaacatcttgaacatgttttctctagaatatgttatgcttccaaaacatctaactgaataaaaaatttccctcccatatatgaatttaattgcagatcggcctttgacaaccttgaactgttaaaagatggcttaccaggagctcttgtcaccgctcttgtccttggagtacatgaactgggacacattttagttgcaaatagcttaggaataaagcttggtgttccattctttgttccaagttggcaggtgaagatgcgatgttctatttgaaagaaaaggaaaaactttcagctgaaatttggtttttttagacatttaatgaacatgttttagatggcagataggctctttcggtgctataacgagaatcaaaaatatcgtagccaagcgagaagatcttttgaaggttgcagctgcaggacctttggctggcttttctctaggcttgattctgtttcttatagggttattcgtgcctcccagtgacggcattggcgttgtagttgatgcatcagtgtttcacgagtccttccttgctggtggtattggtaagctttagctctcaatcaaatatgataaagtgttgcaggctgaagctggagagttgatcaatgtttaaattttgtttctttttctcttatagcaaagctcctactaggtgatgcactcaaagaaggaacttcaatatctcttaacccacttgtgatctgggcatgggctggacttctcatcaatggcattaacagtatccctgcgggggagctcgatgggggcaaaatagctttctccatttggggaagaaaggtaacactaattagaatgacttaaaaagcttaacaatgtcttatactattcgtctttgtgttcgagtccattccccatagtagattgattaggtagtaatcagaattatatatgtctcctaatgatttcagaccgcaacacggctcacgggtgcatccatagcgcttttgggcttatcggcgttgttcagcgacgtggcattctactgggtggttctgatattcttcctgcagcgtggaccgattgcgccgctggctgaagaaatcacggtgcctgatgataagtatgtgtctcttggaatcctggttttgtttctctccttgcttgtgtgtttgccttacccatttgctttcacgggcaatgaagccatgatgattggcttgtgaagtgactcatatcattacaccgcacaataagaaatcagagatatagttgtaactttttgttttggtctctatgctctactttgacatctaaagttatgtttttgttcttgctctatatttttactctcatggagcagtttaggaaacaaaccaaatttctcacagaaatgtgaactaatattttgctaatcagttattaattacgtgtgggattgtcaatctaggttttgaaaaagagactttcactggttggaaaaacagaaaagaccaactttgtttatggggtagtgataatcatattgttaacaactttgtatatatatatatatatatcagacgaattaatagaaatttaaactacattatagacatgcgagagtatgtgacaaatttgatgctataacgacgttaaattctctattcaagaaaaacaattcaaaactttaataacataaagaaatgactaggaaggattaatattagtataatagaaggaaagaataatattatgaaattggaaggtaaaagataagaagaaaagcacatgcttttaatgtggatggatttgattttggttggtagcaactaaaggctaaagcaaccttccaatttacatagtcctactatgatcgttgtttattcaagaaaatgtcaaagtttctacattcgtactattatataattgactgaagaaattaaatactaatctggtaaaagaagtagtattgttaacattccgctatcaggcatgttaccaacttttctatgtttttatttttgttggaaaaaaatgaaaaacgcatacttgaggattgtcttgtaatggcattaataaagaaagacttttcgaacactaaagtaagaagataagggtttttgacttttgagaaagacgaccgttcgtatcgtttgcttatgaaactgatgcaatatctttgtgaatgacaagtttgcttagtttttccgaaaagggttcgctgccttcatggttcatgcacatgacttatagtgaaaaaatgagggaaattggaaaatacaggtaaggggtattaaagtaaattgctaaataagtcacatggtcatcttctttataaatatgccacatctcgtagaataatcactaatcaaatttactcatttagccgtcacctctgaatcttcttctccgatcttcaaacattccggccgccaccgagttcttagccgttacaatg

SEQ ID NO: 682 - DNA, 3000 bp, Unknown
  misc_feature (1)..( 3000): cDNA_ID_2121746_gDNA_ID_1620307_Annot_ID_152856 3000 nt of promoter + ATG
gtttaggcattaattaatctaactttgggcccaaaacccaatattatttccgtcttttttagtttagaaaagtctttgttttttttgttgctgatttcctaatatcaaatttgtttcgtatataagataaatggaatgagaccgaagttttggaatgagtcacatgatccgagccagaccaacaaaggaagcatatgagaagcatgagaaaaaaatcacttaagtatcttaattttgttcatgtttgttgtgaagggcttactaagatattaataaagagaaaagataaagtgtgagattagaaagttgtatataagaagtgaatggaaattaaaggtttggggtaatgttggatggatcagcgacaaacgtggaagcgaggagatccaaaaaggaagcttcccaagcttcgcgaggcgtaggagtctacattttaagcatgccacaatttcatgcccttgtttcccaattttgcgattttttcatgttttttttcttttacgtacaaataacatttattcaaagttcagatgttatgatttatgctttatgcttccatacttaaagatttttagttatgatttatgcttccatgcttttactttttttgccatggaaccatttctgtaagtatataatcatcgattataaacctaaattgttttcatttttatgaaatatttacattcttagcaaaaaaaaatagttcagatgttattaagtgagtgtttactgtttatcaacgaattaattagtgtgataaaaatttgcaatataaatgtattgattctctcaatttaccaatcgttttatcttgaatgcatttagagatgggagttcctgtttttttttttgcaattggaatcataaaacgagaacttacgcaatctgaacaaggtcatttaggatagacattttaaattatacaaaatgacagtaatttgatttttgacaacgcatgatgttaacttaattttcttataagatttttttttttttttttttttaaaaacttttgatgatcacatacacgacattgacctaggagttagagcaagaaaattaaaaaaccctttgccaagaactagtaaccaaaacttatgtcgcatgaagcttcatttcttatacgttatatacagtataacattaatagaaaaactagaaatatttctttaatggtgcatgtaacatcattgggaattgcatgtgagtgggatttacaaatttacaatgtgagaccaccttccactcaatatatatatgttccaaagtgaaattttcgttttaatataacatacttgaatatagaaccaaataatatgtatcatgtgtgacgggttcaacgttttcaaatgtcctaaaagaaacaaagaaacaaagtttttgatttattattttaaaatcacaaaaccatataaagtttaaaaatcttgttaaacttcataaaatccgtctttaaaatttttaatataaaagtttgattcatattattgttctttcttaaaccaacatttcgttgatgaaagatggtcaaatgaattttttgttgtcaagctagagaacacctaaattttttccaattgatattatgtatgttaacacaaaaagagttatctaatacgattagttaatttatggatgattccaagtagaaacgccaacataaactttgactttgaggccgaattgatctgcttcttttatttctcttacaaatttgaaattaaattagtcaagtgtgatgataaaatacataacgtttgtacgcattagtatgttgtgtagcggagagactcttgtttataaaaacaatgtttggtttattctaattgtcattttattctttggatctttagttctcgcttagcgtctcgtgcatatttttcctcaaaatcatcaccattaaatgactcacgtacacaataatcacaacaacatacatatatatcaccatgccaaaatacatctgaaaaaaataaattcctagtcgctacactgtcatattttgattgatatttagactatttagtcattcagataacattgttacgaggaagtatatatacatacgtagcgttgtactactgtaactggttttaaatttatagtattaattttgttgatgttccgattgaaaaagtcattttaggaaagaacgaaaaaatagtttgaaagtgatttttttttaaaaagatataatcctacactgtcatgttttgattgatatttagtcattttgtgtgttaattaacactttattatagacagggttagttattaatttaaatctaaatgttcttgtaaaggcttccacttaattttctaatcaccatctgccgaccaaactactttatcaagtcacagcttttgtggaaaaatttccgttaattcatgagcttttctatttgttcacacttcacacaatcattaaattaaattttgcggctaatgttagaattatcgtacgacaactgatcacacgctacatgttctctagcttaaatttgcaacatatataattgaaacatcactcaaccccacaggctacaacatcccacatttaatcaagaaatcaatcagttcacaattactgatgaaattacgcagcaagtaaccctagctaactaggataaaagaaaacgatcaattctcgggaaaattcagtctctcccgaatcccaaaaacaaaagcatgcatttcgtaataaacaacgcactgattctgtttgattttttctacctttatcctacacaacactagttaaacgacacaaaactcaaaacacgaacacagttacttaatctattccccttattctttctttttgattataatagcatatcggaaaaaaatctacaaacattcaaaaaaacatcatctactcatctatatattcaaaccttggtccattcacatcacgaagtccatcgcctataatcatataacatatccaaaaccctaaaacgcaaacactaagataactatttcttgaaattaata

SEQ ID NO: 683 - DNA, 3000 bp, Unknown
  misc_feature (1)..( 3000): cDNA_ID_2121760_gDNA_ID_1620307_Annot_ID_152860 3000 nt of promoter + ATG
cgtctcgattcccgccggagataattatccggtgctcaaatctcccctcaaagctctcccgattcggaatcaacaacaatccgtcttttctctgtagacgatccaagcaattaacggcgacagattccgatttctcctcgccggcgtcgttaactttcagagagctatcgagtgatctccgaaacgacatcggattcgatttatacgacgaagatgttctaatctcgttgagtcgactcgctcgttcaccagccgaggaatgacgaccggaaattcgactaaccggaataaaccgggttaaaccgggaggattattattaacactgtttgattcatctttagagaactggagctcgaaccaggagttacaatcaccgatcaagagtatatcttccgggtcgacccggtaacggcaaagcgggcaagtggagtgagcgtcaagccacgtgtcaacacattccacgtggaaggcgtgtttacatttcggcaataacctcagaacttccgtcggttcgaaccgagcgagacacacggcgcactctaaaccatccttgtgaccgcttaatgcaccaaaccggaaaaccggtaaagattcaatcacggaccggtctataccggagtttttccttcctcctactactcctccaccgttgtaatatcctcctccgtatctagtgattgcgaaacgctgcgggtggtttacgtaaacgctgccgtttcgtcgtttacagtgtttgacgtagaggagaagtaagaaagtgagagagaaaaacgcagtgaggacggcgataacgactgcgattccgggcatgagagaggaagtgaagttatgccgtggcggtggagaaggcggaggaagtggcggtggagtatctgaggttgttataacaaccgccgtgtgattgtctgcgagtgagacattgagaaagagagagagagtagagaagagaagtatcaaggaagaagaagacatggcttaaaggcttctagttgaaagagaaggtctttagacttaagaaatggttattttattttcgtatatttattttgaagtgcctgaaaataagggagacacttttgtgagtgtgtgagatagggagagaggtttttataaaagggaaagaaaacaaagtgaatgaggacaaagaggatgcattaaaaacatgactcccttctttcatctttcatgccttacaaatttgattttaggaactactatagtaaccaacattttttatttcattttaaattgaattcattaatggaaattaatatatagggacacatatcaatgatgatatctatagaaattgtttttggaattttcgtactgatcataaattctgactctaaacaaatataatggctagcacagagtcgataacagcataaactagaatcaaatcatcaatgcatgtctcttagcccttttctctatcaaaactaaagactacatgccaaaccaccgaaatcataaccaaactctactttggattgaggttttttctcccatgctaaagagtaaagactacatgcattttaagataataaatgttaacatcatagtcatgtgtctgctgctttctcacgatgtcacactaacggtttagagagtgcaatcacattttaaccgttgagacaaaatgtttgttagaatctcaacttttcagtcacattttcaagccatatatatgtcttcctaatatatttttttggtaaaaatcatgtgttatgcctcgttatctttctctctcgaagattttctgtataacacaaaaagtaaagtatacaagatttataacgtgttaacgctaatcagtccacaagaaaaccacgaatagaaaacaagaaaatacaaagtccataacagaataagcaaaagaaatcataaaaaaaaacgagtagaaagcagtttgttccctagtgacgatttgggggagctggagctagctagctatttctgtaccattatttcttaaattttggactaatttccattatttttgtatctggatttatacgttacggcccatttaaagcaaatgttatttattatttggtcggcaccatttaaagcaaatcttattgctggagtcccctattaattttggtaatcgtggtcaccctcccccacaaactatatctatacttatcaatgatgccgatagtcacctaaatatatttgattggaacaataatcaccttttcgataaacccatattcaattctcctaactccttcacataatcagctataaaaatgtttcgataagaaagcaaaaaaaacatctaagtcgagcagaaatttgaacaaaatcaagaccggacccaacgcaaaccagtctcacagtctgtgtcctcttaaccaatcagagtatctcttcaaacggaaacaaatagtcaggcaagaaccggtgtaatttattgggctatgacccatgaccaaagaactcggcccagcccataactcttagaaaagccttggaaaatccgtacagcgcggcgcaaacgcaaaaagcagagaaagagaggaaaaatcgcgatcggcttcttccagccacacccgtcacagagtggccactcaatcgctgtcgcgtttccatcagattcccggtaacgttttcccttcttcagcttcccaattcccgccggcgaaatcctaaccactatcgtagtttttcagtctcccgattaatcgagttagggtttcgtgcaattttccccattttcgtgttcggttactactgggattttgaagtaggcgaagtctcaggtcgcaaaatcatatttttccctgaaacacgtttcaagtaattgcgtctgcgttctctggttcaatgccttgtttatatgatttgtgttcaatatctagaattgttgggttaatgtttatgcaaatgtctctgtctctctgtgcttttgttaaaaacgagttcacaatgataaaggtatcgtttttaattgttaggagttttggagaacagaagttaaaaaagaaatg

SEQ ID NO: 684 - DNA, 3000 bp, Unknown
  misc_feature (1)..( 3000): cDNA_ID_2121756_gDNA_ID_1620307_Annot_ID_152859 3000 nt of promoter + ATG
accagggacacatttttcgaaagaaggttggaggaacatattgatatcgtttcaggagcaaacaggcgccatgtacgatagaatgcagcttaagaaccattgggatacaatgagcagacagtggaaaatatggcgtagactcgttgaaactagttttatgaattggaaccctgagagcaacaggtttcgtgcaactgatgatgactgggctaactatttacaggtttacaaatcaaaaccacttgttacattcatttttgttgattttataaaatgctaaaatgtgattgctttgtgccgtaggagaatcctgatgctgggcagtatcggttgagtgttccgcatgatctcaagaagctagagattctctttgcgggttgtaatgtagaggtgaaaaatgatgaagtctcgggtgtaaggaagaggcgaagaagttgttacgaggaagaagatgaagataaccaaagcatgtgtagttcatctaaccctcaaacaaaagggtattggtctccgtctacacataagctgtttcttgatctgttggttcaagagactttaaagggaaatagacccgacactcattttaacaaggaagggtggaagacgattctggggactattaatgaaaataccggccttggttatacgagaccgcagctgaaaaaccactgggattgcactaggaaagcttggaagatctggtgtcaactcgttggagcaagtagcatgaaatgggatcctgaatctcgtagctttggtgcaacagaagaggaatggcgaatctatattcgggtatgataatgttagttgtcttaactattatccttctcccattggactacattttgaacagatagtgtttgtctttggtttattacaggaaaacccaagagcaggacaattccgccacaaggaagttcctcatgctgatcaacttgcaatcattttcaacggagtgatagaacctggagagacatacactcctccttcgcgttcgcgcaagaagctcctccacaatcgttctgaatcaccacaatggcgtgacacaactccattatcaaagatgcacgtagatgaagcagaaacctccaggcaaaatggttgttatgcagagtctcaagaagatcggatagacagtgaaaacgctcaaccattggatgatatgaagttaatgaatgacgttatgttgcaggaaagtccggtattcgttgagattgaatcggcaaagccgatgtacagcattggagaatgcattaaaagcctcaacgcaattgaagaggtcgaacaaggtagtgagctctacatgtttgcgttggacctgtttctgaagagagagtatagagagatcttcttagagctgaagaagcccagtttgagaatcgcatggttgcagagacttcaatctacttcatttcctattcctactacaacataggttcaagtgtattttacaagccatcctttttgtactctgacctctgtctctgtctgatgttatacccaaaagaatcgttctttgttagttctatgaatatggattatataaaaacagacaggtagagaatcatgttgatgaacctttgaattgcctaattcttaagtggtttgtgttagaattgttctcactttcattcattaggagaagatatttagcatttagttctatgcatattacgagagagcagaacaaggtttgggacaccgacaacaatggagtgtgtgaaaggggcttttgagtgagagttgatgattagaatcttttttgaattaaaaagtagataaagcgagtgacgacaaaaaacagtacccaaagtgggcaaaaaaaggtttagtcgcatcccaataattaattacccctttaaggttaaggagtaattttctaaaaagtaagaaactaaaattaacgcgccaggtaggggtcgaacctacgaccttctgcttaggaaacagacgctctatccactgagctacaggcgcttctgcatttattatatttattctttctttttcaatcttgtttttgtggcggcttatgaaatttcgtagaagtatcattttcaagtggtacgaaatacaaaaaaagacataaagaataaagtgtcgttaagtttaagcttacgtgttatctcgaataacattaattaagttacatctataaacaatttgtagcaatcgcattgtttttgttaagtaaagcaatcgcattgtttttggttttttttagtaaatttgaagtttttctccttattttatgtgtgttttatgattagttaagccttagacatagccgacgtataacacgtaaactatcattaagtatgaacaactttatgtgttgtcgcttttattttgaataatattagagaaaaactacctaacaaaaaaaaacggtgtatactagtggttattaaaattttggaaagatatgaaatgttggcctagctagtagctagttagaattttataattgaagtttattgttatttttagaattcgtgtcattgtgaagaatcctctttggaataaaatgaagccaagtaggggagtggagtggttccattggctaaaacttttacactctctctttctctttataacacaaaccacaaataccttcttcttctctccctttgcttcacaatctctccctatctatcttactgattatctctctctaccatctgagttttgcctgttttgtattactttgacgacccacttttgcagattctcaaggattcttcaaagtcttagtcttttgtgtttctttccagattcttcaattaatatacgctataatctctcactaaatcaggttctttgattccatcattaaactattcgttagttttcccagtttgattcctatatatctttagatcctataagaagcttcagtcttttactaaacccacaaatcaagcttccaagaattagaggaaaaatattaagtactttattttataggtagaacttttatctcgtagcctttaaacgatg

SEQ ID NO: 685 - DNA, 3000 bp, Unknown
  misc_feature (1)..( 3000): cDNA_ID_2121782_gDNA_ID_1620307_Annot_ID_152868 3000 nt of promoter + ATG
taaagagtagaagcaaataaaagagaaaaaaaaactatataccgaaacagagaagcagcggcaggaaaactcaagactgaagatcactttggaaactgatacttgagatatcgtcacgaaaatgtaaaatgaagctcaaagtcatttcatagctgctggtcaaggtaaggatctctaggcggattcgagccaagatactccgagacctcagtaacatacgttttcagcttcgaggtggttcgggtgagccaatcggtgtttgtctgatccatctcatccttcatattcgccatcttctcttcctcttccaacatgctgacccatctcttacccatatacattttaaccgcatccacaccttgtttcacgacttcatcaggcgggacaacaagcgggttttggtccaagttcagtttggtcaagttcacgagcgtgccaaaagcgtctggaagagaatggatctggttgttgctcaagtcgagttcttggaggcttatgagatctccgaatgaagcagggagatcttggagatcgctgaagttactgctcaggttaaggtactcgaggttcgtgagcagcccgaaagaatttgggagaccattgagttcgttgaagtgtgcatcgaggtagcgtaaggatctcatttcaccaatggaagttggtaatgatctgattttgttgagatggatcaagagcttctctagtttcactagctcgaatccgatgtttgttggtaagtaggtgagattgttgtagctcgcatccaagacaaccaacgatctttaaataaaaaaaaaaacagaagtaagaaaaaaacagaggaaacagagtcaacctttaaagataaaaaacacttacccacaatggcagatggaatctggtaaagttgtgagtttgttacaagagacattcaaaatcttcaactttgacaataaaccgatcgaatctggtaatgtctccaggaaattagtggaaacatcgagttcgagaaggttatgcaaaccagctatcgaatcaggaatagcctgttacatacataacctttgatcaaaaacaagcaacacacacttctaaatctatctcaatctagacactaccataagaaccgatccaagaatctacctctatgctaaaagactcaaaatccagagcaaagtttacatctttgacaagcaaacacacttttgaatctatcacaagtactgatccaaatgtcaaagaattcaccctaaagagtcaaaatccagagcaaagtttacatctttgacacataaacatatcagaattctaacagatttgatcaaaagattatgaatttgaccattagggacttagaaaaactgacctgaagctgattgttatagagattaagaacaaggagaccttgaatctttccaaatgcttcaggaagcaacttcaatttccgaccagacaaatcaactcggtccaatggattctccgcagcttgttgcagtatactcacaacctcttcattgacttcaacctccgcagcttcctcctccgccaccgcggcagcattcttctcggcagactcatagatcctcacgagcctctcctctgcttctttcaaaagcttctcataagattcatgaagctcgttaagcttaaggatcgatttataccaaatcttctcttgctccacagcttctctcctcttctgttccttctccgccacgtcaatatcgttaggagagagagcgatctcttcgaaagattccgacaaagacgcgtcgatctcacggagcctagcacgagctctgtcgacggtttcgtgatcgggtcttggtcctagggttcgaagaacagatcgggtctgagaaacgtcggcggttgcgttagtcatggaggcaagaacatcaggatgagccaagtgaggcatctgagtcactatctcgatagagtggtttgatgatgaagaaggatcggatttggatggtggtggctcgacatcggaagaggaagaggatttggcggtgaatgaagggagacgatccaagacataagagagaacagggaagttcttagggttaagctccgtcgccattgttgggagcttgatggaagagacgattgggagattgaggaagaagaagaagaagaagaagcgattattggttcgtgtctcatgtccttccgtactattagcatctctattgccaagtcaaagtcaaagatcgttaaattacacgtggttttgtattaatacaagacaagtgtcaatgttatcctacaaagaagaaaaaaatcattctaaaaacacttcttacacaaataataattttacacttagtagaaacaaattaattaaggttttagaatagataagataaccaagaagtttagagaaaactttaattaaggtttttgaaaaagtgaataatttttgttgttattttgtcttcattttaagattgtgaggcccaatattggtgacacaaatgttttatgggcttgagaatgatcttagggaaaactatattgttattcttttggaaatgaaaaaaaaaagctcatttttgagactatgcaatggagactctgttttcgatatgtatgataataataataagttaataacttttggaattttactgatttttctgtaatctcatgatgattcatgatgatgaagacgatgttatagttatacctaaacatttgcttattttcaacttaaaaatgtatttattttataaaattcaacttttaaagtaaaaaaaaataaaactcaatatctctgatagtgacgacacagggagtattaaaatcgaaaaacgtcaacaaaaccggtggaaagttgaatgggtcgaaaccaaacgcatatagccataaaagcattgtctccattatagattctccatatctgagaataaacaaacgattggataaaccgataaagtacatagaacttcgatctttttcacaataacccaaaaaaagagagaaagcaaaaaaaaaaactagagcgtttcaattaca

SEQ ID NO: 686 - DNA, 2503 bp, Unknown
  misc_feature (1)..( 2503): cDNA_ID_3058356_gDNA_ID_1620307_Annot_ID_152867 3000 nt of promoter + ATG
cccaacctcctggtaggcagatcataggaaccccttcgcatatactctctagcgttgagttccaaccattgtgtgtcaaaaaccctcctgtggcacgatgcgcaagaacctcctgttgtggtgcccatttcacaatctttcctttctcttcaaggctactaaccagcccttcagagagcggttcgatccatttcgcgccgagtactgaaccgggtcgtactacccacaagaaaggctgtttgctattgcttaaaccacacgcaatctccaagaactctgtttccgttatgttcacaacgcttcctagactaacgtagatcacagatttatcttcttgatcatctaaccacagaatgcaagtctcgtcttgtgtgaacaagctgcttgacgaagcagagaagtagctgtgaaacggaccaattgcaaaaaccggaactttaaaaatttcgttagaaagagtcaacgaatctttctcaagctcttcgcaggacatgtatattaaccctgaagatcttattgtcgtttcgactacagcatgtaagaacggatcgagtttctctccgaactccccgaaaacctttgaaagatctctcttttgaagcggcgggaactcaggaacagagtcctctgcttccgattctaagacacaaaggctcaaaacaatcttataaacttgataaccagaattcaaaatagagtgtccatagtaaataacctaaatatcctactcttttccttagttacgtgaacaactttaactttttatttgttagaccaatattcattgacatgccatgctattttattagtagagatgacgccatttttttaaaaaaacaacacaattatgaataaatacaaatataccattttggtcaaatgcaaaaattttactttccttatttttattggatgacacattttccttttaatagactgacatcatcataggtgagagtgcgaagagcatttgtagtcacagtatgcaaatatgtttacaaaaatacgaatttcctacccaagttagataactttttcctatatagcaatttgaccattaaaaataagcatttcatgaagcattaattacctgaaactggaagatatcccttggttcggataagtggaagactcggataagcattgaagaaagtggctttaaaagtacagagaacgagcctcggaagcttcaaactctctgaaacagattgtgtgaagagccatccacagtcatcgatcaaacaagtaaccctctctgactcttttgattccagcaacactttacgcaagcaatcacgaaacggagactcagcgttaaggttgatttgcgcgagcaaagacataacaccatcttgaatctccgtttcagacaaaccatcaggaatctgtaagaaagtgaagagaggatggcttgaagcttttggcgcgttgaagcgcgtgtggatcacggtaatggagaagcctcttacgtgaaggatgttggcgagctgaagcatagggttgatgcaaccttgtaatggaagagggaagagaatcacacgcagaccatttctcttctcctccattgtaattgaaacgctctagtttttttttttgctttctctctttttttgggttattgtgaaaaagatcgaagttctatgtactttatcggtttatccaatcgtttgtttattctcagatatggagaatctataatggagacaatgcttttatggctatatgcgtttggtttcgacccattcaactttccaccggttttgttgacgtttttcgattttaatactccctgtgtcgtcactatcagagatattgagttttatttttttttactttaaaagttgaattttataaaataaatacatttttaagttgaaaataagcaaatgtttaggtataactataacatcgtcttcatcatcatgaatcatcatgagattacagaaaaatcagtaaaattccaaaagttattaacttattattattatcatacatatcgaaaacagagtctccattgcatagtctcaaaaatgagcttttttttttcatttccaaaagaataacaatatagttttccctaagatcattctcaagcccataaaacatttgtgtcaccaatattgggcctcacaatcttaaaatgaagacaaaataacaacaaaaattattcactttttcaaaaaccttaattaaagttttctctaaacttcttggttatcttatctattctaaaaccttaattaatttgtttctactaagtgtaaaattattatttgtgtaagaagtgtttttagaatgatttttttcttctttgtaggataacattgacacttgtcttgtattaatacaaaaccacgtgtaatttaacgatctttgactttgacttggcaatagagatgctaatagtacggaaggacatgagacacgaaccaataatcgcttcttcttcttcttcttcttcctcaatctcccaatcgtctcttccatcaagctcccaacaatg

SEQ ID NO: 687 - DNA, 3000 bp, Unknown
  misc_feature (1)..( 3000): cDNA_ID_2121771_gDNA_ID_1620307_Annot_ID_152864 3000 nt of promoter + ATG
aaaattccttgaagcactgatttaagtgctctcgcagctgttgctgcaatgcacataaggaatccaaacaggtgaaagcttggctcaccctgacaacacccataaattaaagaatatcaagcatagaatcaaacacatcacacacacaaacagaacaaaatctccattactcgaacttttttagcataaagttcacatggttaagagaagatgagagaaacacaaaatctagcgaatacaagcacaaaacaataccaaattttctcatgtgaagcataattcaacaatgtctgagcttgtcacaaagataaaagctagcatcattggccaaacatgaaactgaatcaacgatatcacgttcattgctccagaaccatacctatgttcccaacatatctagttcattgctcctacatcacatctacatcaacctctctaacaactcatccaaaagcatacataagggattcaaatttaagaggtcaaaagaagtgaaaataccccactagcaataacaactccggtgacgacagggacgagagtgaagtaagtcaaccaagcctctttcttacgcgtcatcaggtaagcaaacacggcggtgaaaaacggcgtcgtagcaccaatggcttggttaaacgaaacaggaagaaagcggagagagatgttaccaaagaccaccgacacacaaaaaacgagacttagagctgcgatcttaaagaactgaactctggatcgaatcgtctgcatcggaaccatcttcaaccaagcaatggcgacgtagctgagtaacgaacaagccgtcatgtgacacatggtgagaaagatcgggtacttgaatccgtaattgctaagcaagtacttgttcagcaacaatacaccaatgttcgatgagtaccaagacgcgactagcccgattgtgaaaaaccggccattcgtcgccatcttcatcgcttttcttcttcctaatcctgggtcgactcgatctgatgagatgagattcaaactaaaaccctaacgaatttcacgaaattgggattggtgggaatcgaatctggacaggagatggagatctctcggtcctccgatacagaattttgacgcgtcgtgatgatgttattccatcaatgggtaagatttggattaggttacaacacgcgaaaatgctggagacgaagaaaccgggaaagagaagaaagttgggatttttggagaagaagaagaagaagctctgcaaaaaggagagatctttgggctaaagctgcaacaacacttctctttccttttttaactaatttattttttctttcagtttcatgatattataattggtgcgttatgtaatgtttctttgggctaaagttttttttgtttggttacttgaaaaatcaaagtgtgaagatgtgtaacaatgaaggaaaggagccattgactttgttattggttattaccgaatctgagttctaaatttaatgatttacgttcatatactaatccttgaaaattcctagctaacgaaacatttcagttctgagcatatttaattgactaagtaaatcgaccacgaatctaattgtaattaacaaagcgtttggttagttaggcaatcgattttacattaatttttctaaaaatacgaactattcagagaaaagcttatctaagtagcagaagtttggcagaattatgatgaagttgaataaatttagcaaacgtttttgacaaagtgggtgttaagtctagtggtagaagaccaataaaagctttattagtggtgtagcaaagggaaattatgtaatatacaatagtttagaatcgatgctcgattcttaagtcaaaacaatggtaggatcatctgcatttgggcttgatgttattagccgttacaacttgtgaagatgaattacaactcgtataaataacaatgaaatttgcatatgaatcatttagattcaaatttgattttataaccactcaatttcacattacattagccacttataaaacaaaggatttttcttaggaatctcgccatatccataaataccatcttcctttgcttcccaagtacaatttctacatctagaagaatctctaaccgctttataaatatcgaacacacctttttttacttgttcttggctaaatccacagaagtagagtgtcgaattcataaaattcacgtaaaacatccaaccatataatccacctttttgtagaatatggaagccatgatcatcatctcttgatttacaatgaactcctaaaagataatcattgtcattataaatcacaaccctagtaagaggacctttcattggaaatacttttccatcatgttgtagagtttcacagcctatcaaagatattaatactataaagatgattataaacattgagtagaaaattgttaggaaatttatgttagacgaattcatcatgaagattttcttaatcatgatattgcattttctagaacttataatttatttatatataatgagctaactttacaaaaaaaattataatttacattaatttatgttgaataacctaaaatagtcatgaaatcactagaagtttttgtgaagtaaataagaaagtaaaagttgctttttgttcccaaaaaaaaaaaagactaaaagttgcttaaataacccaaaatataatagaaatacatcaattaggttaggtattcatatccaaaaaattaaattgacagtaatgatccaaaaaatagtagatttattagaggtgggtctgtctaggtgtccaggtgaacaagtgagaggagagagttaatagttttgtctgagaatctgacgatcacttaactccaaaacccagtggcaatcatgtaattttactgtaaagtttcaaccagaaatctctttttttctctctctctctgcgctgcaaagcattgatcatcatcattcatcatcttcacaagtctcgttttcataatttatatgaggattcgtcatccgggtctatacgaat

SEQ ID NO: 688 - DNA, 3000 bp, Unknown
  misc_feature (1)..( 3000): cDNA_ID_2992131_gDNA_ID_1620307_Annot_ID_152862 3000 nt of promoter + ATG
agagttgaacattacttgtgttgctatgtagaaggaacattgaagtggaagagccatgagataacaaatgcaaagaccatacaagctaaaaggaaattcaagaaccggtgaccttgccagaagcttctaccttccaccaatcgtggaccagatgttctcagagttagattctctacaccatttgcttcattccggctttcctcagactccacctcaacacttccaacaacattacccgcaatcgacccacaaacttcacagattctgcaaagcaaaaccaaaccatgaatctcatcacaaagaaagaaaaagctaagctttgcgtctctcatctgacaacaaatggcctcaaaactgaaacttctcaaaaagacagtcaaaagaaagctgttcaataaccaaaagtgacaataacctaaagaaagtaaaaaactttcctacatcaatggaaatgttagtcatttagcctttcctaaactatcttaaagcttagatttttacgtactcctaatggaagtaaccaccaaacaaccattctcaagaaatatggagattttgaacttacttgtttcctttgatcttgaaccaagtctcagcacagtgtttatgagcagcagcgagatcagctttacaagaacagccaagctcaatgggaacaccagattcaagattcgctgcatctaagctcatgtgacaaatcctgcaatctctctcagattgcgacaaatgtacaactttctcaggcaatccaagctccagatctatttccaccgaacacaccgacgcattggatctcctctcctcatctttcactatttcttcctccttctccaccgcaccggagctccgacgaggctctccatcgccatcacagccacttgagctattgattactttaacagagacaaaggtctcgagatgtggctgtacggattccatattcgtatagacccggatgacgaatcctcatataaattatgaaaacgagacttgtgaagatgatgaatgatgatgatcaatgctttgcagcgcagagagagagagaaaaaaagagatttctggttgaaactttacagtaaaattacatgattgccactgggttttggagttaagtgatcgtcagattctcagacaaaactattaactctctcctctcacttgttcacctggacacctagacagacccacctctaataaatctactattttttggatcattactgtcaatttaattttttggatatgaatacctaacctaattgatgtatttctattatattttgggttatttaagcaacttttagtcttttttttttttgggaacaaaaagcaacttttactttcttatttacttcacaaaaacttctagtgatttcatgactattttaggttattcaacataaattaatgtaaattataattttttttgtaaagttagctcattatatataaataaattataagttctagaaaatgcaatatcatgattaagaaaatcttcatgatgaattcgtctaacataaatttcctaacaattttctactcaatgtttataatcatctttatagtattaatatctttgataggctgtgaaactctacaacatgatggaaaagtatttccaatgaaaggtcctcttactagggttgtgatttataatgacaatgattatcttttaggagttcattgtaaatcaagagatgatgatcatggcttccatattctacaaaaaggtggattatatggttggatgttttacgtgaattttatgaattcgacactctacttctgtggatttagccaagaacaagtaaaaaaaggtgtgttcgatatttataaagcggttagagattcttctagatgtagaaattgtacttgggaagcaaaggaagatggtatttatggatatggcgagattcctaagaaaaatcctttgttttataagtggctaatgtaatgtgaaattgagtggttataaaatcaaatttgaatctaaatgattcatatgcaaatttcattgttatttatacgagttgtaattcatcttcacaagttgtaacggctaataacatcaagcccaaatgcagatgatcctaccattgttttgacttaagaatcgagcatcgattctaaactattgtatattacataatttccctttgctacaccactaataaagcttttattggtcttctaccactagacttaacacccactttgtcaaaaacgtttgctaaatttattcaacttcatcataattctgccaaacttctgctacttagataagcttttctctgaatagttcgtatttttagaaaaattaatgtaaaatcgattgcctaactaaccaaacgctttgttaattacaattagattcgtggtcgatttacttagtcaattaaatatgctcagaactgaaatgtttcgttagctaggaattttcaaggattagtatatgaacgtaaatcattaaatttagaactcagattcggtaataaccaataacaaagtcaatggctcctttccttcattgttacacatcttcacactttgatttttcaagtaaccaaacaaaaaaaactttagcccaaagaaacattacataacgcaccaattataatatcatgaaactgaaagaaaaaataaattagttaaaaaaggaaagagaagtgttgttgcagctttagcccaaagatctctcctttttgcagagcttcttcttcttcttctccaaaaatcccaactttcttctctttcccggtttcttcgtctccagcattttcgcgtgttgtaacctaatccaaatcttacccattgatggaataacatcatcacgacgcgtcaaaattctgtatcggaggaccgagagatctccatctcctgtccagattcgattcccaccaatcccaatttcgtgaaattcgttagggttttagtttgaatctcatctcatcagatcgagtcgacccaggattaggaagaagaaaagcgatgaagatg

SEQ ID NO: 689 - DNA, 3000 bp, Unknown
  misc_feature (1)..( 3000): cDNA_ID_2121736_gDNA_ID_1620307_Annot_ID_152853 3000 nt of promoter + ATG
aatctgtacctgagcctcctccttggtcaagttcatcaaatcctttcgggaatttacaacaaccactgtgagttttgtttaagaactacttcctatgtaatagttgttcttatctaattaggttttgtctcctgtaaccgatcagattacctccattaaatactggagctccgccaggtagccagctcaggtatgtcctaattcccattacttacaactcttgattgtgtttgttcaccgttatgcttgaaggtcaaaatgatgtataaaacatgatgttttgtttatgtcatgctaaaacagacgcagatccgcgatcgagaatgctccttcacagcaaatggagatgtccttgttgcagcaaacagtcccaaagcaggagaactatagccaaagtcgagcggttgcacttcacagtgttgaatcaagaataacagagctcagtggaatattcccgcagctagctacaatggtcacacaacaaggagagctagcaatcaggttcgttaacgttttcttacccacaacccgacattttccgagttgctgggaacatcatctaacacctgttagttttatggaacagaatcgatgacaatatggatgaatcgttagttaatgtagagggagcacgtagcgctcttctgcagcatctcactcgaatttcgtcaaatagatggctcatgatgaagatctttgctgttatcatcttgttcctgattgttttcctcttctttgtggcttaaaacaataccattttatctcttgttcctgggggtatcaaatctatacatatgttaagcttgtaagcttctagggctccttttttttgtgtggatagtggagtgtcaaaaagtttaatttttctgcaagactcagttgtattttaccaggaaacttctgatgtaatagcatttaactcaagtaaaaattcaaagcaaacaaagtaattattattctaattaagatataatcacacataatatgtttcatactaaacatcataaggaggacagtaatcaacgtatatgagtttgggacttagaaatcaaactactgaagcatcaacaaaaatgctcagaagttagtaagtaccatagctatgtctcagaacaatccaaccaagtttcttggatttgagtttactaacttggtgcttcagtctctctctgacctggatggtttatgcagcagctgcatcaaacctcttcatcatgtcgcaacgtggcgtttcgcggatatatccccattgttgtctctgaagctcatggcgacaattctggccaagtatagacaagtaatctctatcaacttgctcttcaaccctctgtctctcgaagctacttatcggatattcctgctcgaacttggctgatctcacaaagtaagtgacgcccctatgcgtggtgaatttgagctcgtagttatacgatgagaaagcgagtaaattggttgaggagaaggcaaaaagttgagtagtagtatgaacacaacaggaagtatttgaagaagtacacgaggattgaatcctgtatcagaagcttgattagctgttctagttcctccaccaaaattgaatgatcggaactgagtagtagcaggattcatttcaccaccaccaaagaagcttctgaaaatctcatcagcatcaaattcatcgtcgtagaatccattgaatccgttgtttcttctcgcatctcggcgtggttgataagcaggctcatcggaaccactgccgtcgtactttcttctagtgtcttcgttgcttaggcattgaaaagctttagagacggatttaaaagcttcttcagaaccaggagctttgttcttatcaggatgaactttcaacgagagtttccgataagatttcctcaaatcttccactgaacagttacttttcaatccaaggatctcatagtaatccttcttcgattttatctccctcacgatcgttcgttgttcttccgtggaagacgaagatgatgacgatcccgcggctgatgacgaagatccacgttgacgaagagaaggtcgatccgacggcttagatgactcgttggcagcagatcccggcgaatcctcctccgccgctggttcatccgattgcttcttcagatccgaaacaagaccatcgatcggaagatttggatcaagacgacgagctttctcaagaaatttcaaagcgcgagatctatctcctgcttctatagcatccttgccgatttttaggcatttcaacgcgtcatctttgttaccatccattgtgattgttcaacggaaaaacaatttcccgatgatgctatcggaaactcccgaggaattagagtttctcgaagcgattggagttcatctaagatgtgaggactttcccaaacgagcgacgattgaaaaatatcgcctcctcttccacaatccgcacacagctttcaagcctttctacagatgaacgactttcagaaggattgcgtgcaaacatgcgtggcgttttgtatattaagtagagaacctagtgtcgtttaaataaaagaacatgtatgccgtttttattatcaagaaggggcagtcgtgtcggcaaaaaactggggataatcgggctttggtctttcttattcaggcccggttctttgcatttgcaccaggtccaatatatttaagacctagtatatctaaagcctaattgtttaattttaaggcccaaattctatccttaccacataaacgtgtcgtttgagatattaagaaaggaactacatgtcgctctaaaaggcgaaaacgacgaggcgttattcttggaaagagctcctccaacggataaatgaaagatcctctctcctccaacgataagagaaccacgagaggacacagcatctgaaatcgtacaagtatctgaagaacataaattaaaaatctttactttgtaataatggcatcagagttttgatcggagaatctaaaagtctcgacttttcgaattttgttggtcgctttcttaaggacatg

SEQ ID NO: 690 - DNA, 3000 bp, Unknown
  misc_feature (1)..( 3000): cDNA_ID_3058388_gDNA_ID_1620307_Annot_ID_152848 3000 nt of promoter + ATG
tcactattttcattaaccttcccttcttccctcggaggagggtccgcaacctatataccaaggagaatctgatttagatttgaaactagtactacataagtgaaactgagtaattaagtgaagattaataacctcaacagatattcgataagtatcaatgaaacacttgttaacatatgtgatagcatcttgagcttcttgttcagtacgaaagccaatataagcaaattgtctacttttgccatcactgcaaaagcaaaacgaaatatagtgacacaagaattagctgtgaaaaacactcgatttgaatgtaccttttacgcttcaatttcacgtctgcgatttctccttttcgtgaaaagacatctcgaagtcgttcctctgtcacatgtttggaaggaagattcttaacgattatccaagacctgtaatttacagaaggccgaaacaaaaaaaaataacttgcctacattgattgttttctgctaaacctaattagttaaaggaaaaagaaaactgttgtgggaaatcaatacttacattctcaagttagggtttctaatagacgaagaagatggattttgtttccttcttgcaatgtttttgaagactctaagagtgtcggactaggaagaagaagaagaggagaggggttttaggtattttgttgttccttccagacccggccctgaatggaagcgggtagggtttaggacacttaatgacgagaggaactttccatacatgcatcttagtctgtacgacgaagttattgtatttgatcacgtgcaaaaggtattgcttctgttaccatatttggtaagtacatgtttgaagaaccatataagtctttgaaccagaagcgttgcccttgaagaattaggttttatattatatgtttttcggatatgagttcatgttttcaagcagagacaaagcttttcatttcttgattttgtaagatttacatttaagactccatcaatgaaagctgtgatcataatcactttgacaaaagacaaaaacagagaaactttagtgtttgttatcgtaatcaacgatctcagaatcggtaacggatctggagttttgcacgatggaacgtccaatggaattgatccaatcttctttctccttctccgaatcagcaatgaagtacatagtctcatttctcgtcgatagctcgaacgcgttttgcttgttgagtacatcctctgctcctttagcggttaagcacgattctacggggacgacaccgcgagggcgtgacacacgcgtgacgtcggagtctttgaaccagaagagtttcccttgtttgagcacgaaccatcggcgtcgccaagtcttgatgtactctccttgtttcgtgagccagccggttcgttctgggtttgaccagaactctacgcctccgtagtcttcggaattgttgttctgaccgccgattactgctcgccacaggcttgccatcttccgaagattgaactggagaattagggttttgatccaaatctgccgatgctatcgaaaatctgtttatcgattccattattttttcgtgtttatcttttgccccaaaatgtttttatttttcattttcttcccttaaaatatttataattacataacaaccccttcattttgccaattgcataacagtcagcaacaatgttttaatattgaaaaaaaaagtcaaatgtgaaagaagattatgtcttcttctccaaacggaaagagcttagcaaaattcttctgaatgaataatcggcgattatgtctttgaaaaacgatgcgagtagtagccacgacggtggaagcaacagagaaagcgtaatcgatgatcatggccgccgtaaaagcacttgcggctactgtaaatccccagctcggtccagtatctctcacggttcgtttaattttgcttttcttacggattaggttgttgaatcgatcgattagagtagaatcttctcgaattgctcatatgcttgataagaattgattttgtttatgatcttaaagttccaatgaataaatgattgataaacatagtgaatgtcaatgcaggtttatcagcacagactcttaccgtttatgactaccaaggtttgttgctattattggactctatgtgtgatgaaccaattttgttgacagaatagagatcttttatgtatctttgctttacttttctgtagctcttattgaccgaggctggagaagatctggtacttatctttacaaacatgagatggataaaacgtgttgccctccttatacgatacgtttgaaagcaagtgattttgttcctactaaagagcagcagcgagtttctagaagactagaaaggtgcatatagcttcactttgcttctctttttggatcaatagatgaaagtttttgtggtgttagttgtttcatgttattggcttagtcggaaaggttttacctttgaaacatgcatatgaggagagatctatgattctgatgtgtaaatattcttcacgatcttcagatttctctaatgaagtcgttcattgaagagcttcctgaattttcttaataatgttttgtcaaaggttcttggatggcaaactagatgtgcagcccagggaacaaagaggtgcttcttcctctggtgatgtttcagatacaaggagaaaaacacttggagctgctaaaagtgaagagaataagaaagttgaagcagttatggatgatttgtctaaaaatattgaccaagctgtgcaattatgcatacggagtggggaattcccgtctaatatgcagataccaaaagcttcagtgaagaaggttttctgtgctagaagaaagaaactagctgaaggaacagaacaaatcttatacaccagcaacattgcttttccaatagcagctgcaataaaacgcatccagacatctgagaaagaggggataaatagtgcagaaggaaatagattatcacctgaaactatttctgagatgttgttgagtgcaatg

SEQ ID NO: 691 - DNA, 3000 bp, Unknown
  misc_feature (1)..( 3000): cDNA_ID_2121711_gDNA_ID_1620307_Annot_ID_152844 3000 nt of promoter + ATG
ggtggctctggagaggaacccacctaaccggctctttgggcgtcggagatcgtcgtgaatctggtgcatcctctgtctcgttaaagttaaatttcatactttcttcactcgagtgtatctgttttcgtcggaaggagatgcagacacagacaccagattcacggcgggaagagaagggagaaaagaagcgatgaagcagatacagttgaaacgacttcgtattgacgtttaatgggcttttattcggcccattaactatcttcgaaacaaattgaaatgaagaagcactaactggttttaatatataaaattaaatctgaaccctaaatcatcgtcgccgtgttcttctccgcttccaccgtcgttgtattcgtcttccgcctcctctcccatcggtgcgtttctatctcttccaccaaatggattcatttactcttgggtaaattttagctcttgtttgtctatattcattatctggaattttagaggaatctgtttgtatttttttacatctcgttgaaacagcgcatcaatgtaggattagcatttatcttttcataacttgggatgatcgtgtatgggtctacgggttgtattgatctggtaaaactggttttaaattgggataaacaaattgtgttccttgttcacaagatgattattgtcactgtactgggtttatcacaaggatgaacatgataatgtgagaaccagtattgatataatgtttgcaaatattagagagttccgatttcaatttttgttttcaggaagcagttttaaattattcccatgcatgttgtttgtgtaggagaagagagttttctagttaactctaggttatttttatgtcttaagaggaatgaattacatctctggatgcaggttttgaacagcttggcagaagaagtgaaacttgagagagtaatggagaacttggaagatctgaaaattctggctgagcagtggtcgcatcaaggaattgaatatcttcagaagataccaccgaatcagctgtatgccgccattggtgttttgttgtttacaaccatcttgctcttcctatccagtatgtattagacaccactttgttgtttcttaatcctttcctagtagaattgctttatttatgtaagatctccccctggtagtatcttgtttgccattgataaggacatatagcctgttcttcttctaaatgtcttcaattacttttcttctgcctgctattgtttacaactgcagaggttatagttctcatggtaccattttagacttgtgattaagccagagtattttgtgtattggaattagaactattattgcaatttctgaggtttattcatgatttttctttgattatacataaacaaacttttgatcttttgttgctaaacttgttgttcttgctggggtatgcagttcgcctggtcagacgtaccaaatccaacactgtactcctttctgggctgaccggaagtggaaagactgtgctcttttaccaagtgagtgttttggcttgacgttacctttttcatatgaatattgtttatgactttccttcaaatgtactttttttttgtaatgtgtcactattgtgagtcagtgtgagtgactaggtcattgttggagagttataacacgataattgtttgattggcagctccgagatggatcgtcgcatcagggcactgtaacatcaatggaaccaaatgaaggcacttttgttcttcacagtgaaaatactaaggtaaagaatcttactgtgttctgttgtaaacaacacgtgcagttgattgtgatggatggaataacatattactaaaccatgtcccgtgcttgctctttgtgacagaaaggaaaaatcaagcctgttcatcttgttgatgttcctgggcactctcggcttcgacccaagctagaagaattcttgccccaagcagctgccattgtgttcgtagtggatgccttggagttcctcccaaactgtcgtgcagcttcagagtaatttcaaacaccctctctcttccacacacacgcattgtaagacacagataagagacatgtttgcatatgtttgcatctcaatgttgaaaatgaggcattgccatggttttttatggtgataggtacctatacgagattctgaccaatgcgaatgttgtcaagaagaagattccagtcctcctttgctgtaacaagaccgataaactcactgcacacaccaaggagtttatccggaagcaaatggagaaagaaatgtaagaatttcagttttcttgacaaaattttcttatatataaagcctatcttcctgcataaaagctaatcatcattggttgatgagtttttgcagtgagaaactgagggcttcaaggagtgcagtctctactgctgatatagcgaatgacttcaccattggaattgagggagaagtgttctccttcacgcattgctccaacaaagtcactgtcgctgaggcatctggacttaccggagaaaccatccagattgaagacttcattcgagaatacatcaagccatgagctccaacatgccttcatagattgaatctaccacaagtttcttatgctttgggctgtgactttgatttgagtttagagatccttttgtatatgagatctttggatgatttagggtgttcaaaactgagtagctgtattttcgagttagataatctgttttaaatcggaatgattttaaggaaatgttaaatgacttaattctcttgcaaaaaaggaaaagaggataatcatagataagtgatcgtgcttatcaacttcgagaagataacgcgagaagtccttggggataagctagaaactgtcttaactaagccggtaaatccaaattaaaccggtaatttggtcattacaatgctcacgagagcatcacgtgtcttcttcttcttcttattcccccccaaatttctggactttgtccttaagaaggagatgaagaagaagaatgactaatatg

SEQ ID NO: 692 - DNA, 3000 bp, Unknown
  misc_feature (1)..( 3000): cDNA_ID_2106505_gDNA_ID_1620307_Annot_ID_152845 3000 nt of promoter + ATG
gctcagtcaaatctggaaatgtagcttccaaccattcaatagccagactggagttgctaactgctaacgaattggatgacttaaccccatacatattagcatcgttgtaaatctccattacggattcccatttgtaaacactgttgcaatatacatccgaagcaatctcagtcaacctcaagggcagttaaacacaaaacatcacaacgaactaaaacatcttccatgacttatagaagttcgacataaagaggatagtctgtggaaggaatgcatctgttgcatatcaagtcgtcaccgcgtcaacatgcataaactatttgatacatcaaaggaatcatgggacccagctgattttacccctcaaaagcttcaaatgagcctagatttgggatctaaaacagcttaatgagaatcattcatatcttgttcaagaaaccagaaaaccacaaaaaattgataaatgttatcttggaaacttagcataccaggtacaacttcaagcgataagaaactaattaaaaaactgccagagagaaatgaaaaggagaaagaaccatcatctgcctaccttccaaatggcacaacggggcataagatataaattgaaccatcagtgaataatataaagacctgcaccaattgaaagattaggtcaagacctaaacatgtaatcctcaaggctctatttgacaagacaactaaacaaaatcactgtcagttatcaaacaagtggagcaagaatttgtactgaacttacagtaaatctatcccacagatgatctcctccaaaactgaaatcagcaggataaattgatgaagctgttctagatcttcctggctcaccgggctgcagataatattcttgctctggtagctcagtatctgaagacaaatcgaaaagcctagcatacaaatatcttttagtaagctaaaaagctcttaaatcaggattaaataaaacgatttgattctttataatgagagactggaccagatggtaacatagtaagtcattgcatggcagaaactaacaatctacaaccttaggaactgattttttctacaatttctctaacatctttccataatgatattgatcaatatattgacatgtacatccaccttcactatcagccgaaaagattgttacctgaaaactgcatccgaggatagaattcccaaatgggtgtcactatcagggtgccacgatgcttgtagcaaggttatggcactgtcactactagtatagatttctgaaccaatagaaactaccctgcaacacatagattatgaagtgataacgtataagcagaaggccattaatttaagcaagataacatcataatcaagataacaatgaatataaatgcatcttattagggtaacgttaatcactacctgcaaatgacattgtcttctatcacagaagcacgtccaaataggtacatcacacatatcccatctgagccggcaagaagtacagctgatccagacttattgatggagattttgctaacagaaaatgtcacctgaaggtctggttgcatcacctataatatcatttattagtaaagcttagtcaatcactacatgatgaatcaatcacctataatttatcttatgtagcaaagacaacagaggaaaactaaaggtttttgacagtagtacatagcaagtagaaaagatcttcctattatcatccatcagtaagaaatctaatttctcaaactcttcctaaacctaatttctcaaagtcagtaaaatgtcagcactaaaaaagagctttcgataaatcttcttttcaatactcattttggccgacttagcggtgaaaacagaaagagagagagagagagagagagagagagtaaatgaccttggacgggactgcggcgaggacggaggatggttcaggttcacccaagcgcagagataatcggtgaaggagatatcgtctcgaatcccagtagtatacgcgcgagtctccgtcccaagccatgaaatttctcggaaacagctgcgacacggcgggttcatcttgggaggaaggaagagaagcgaaaaccgggtggctctggagaggaacccacctaaccggctctttgggcgtcggagatcgtcgtgaatctggtgcatcctctgtctcgttaaagttaaatttcatactttcttcactcgagtgtatctgttttcgtcggaaggagatgcagacacagacaccagattcacggcgggaagagaagggagaaaagaagcgatgaagcagatacagttgaaacgacttcgtattgacgtttaatgggcttttattcggcccattaactatcttcgaaacaaattgaaatgaagaagcactaactggttttaatatataaaattaaatctgaaccctaaatcatcgtcgccgtgttcttctccgcttccaccgtcgttgtattcgtcttccgcctcctctcccatcggtgcgtttctatctcttccaccaaatggattcatttactcttgggtaaattttagctcttgtttgtctatattcattatctggaattttagaggaatctgtttgtatttttttacatctcgttgaaacagcgcatcaatgtaggattagcatttatcttttcataacttgggatgatcgtgtatgggtctacgggttgtattgatctggtaaaactggttttaaattgggataaacaaattgtgttccttgttcacaagatgattattgtcactgtactgggtttatcacaaggatgaacatgataatgtgagaaccagtattgatataatgtttgcaaatattagagagttccgatttcaatttttgttttcaggaagcagttttaaattattcccatgcatgttgtttgtgtaggagaagagagttttctagttaactctaggttatttttatgtcttaagaggaatgaattacatctctggatgcaggttttgaacagcttggcagaagaagtgaaacttgagagagtaatg

SEQ ID NO: 693 - DNA, 3000 bp, Unknown
  misc_feature (1)..( 3000): cDNA_ID_2106021_gDNA_ID_1620307_Annot_ID_152846 3000 nt of promoter + ATG
cagatccggagtctgaatctgaatctgaaatgggttgctcttgtgacggaggctgtggtggtgatttccaccggaactcggtggtggcggttccggccatattagtcattcttcttcttcatctccttcttaaggacaaagtccagaaatttgggggggaataagaagaagaagaagacacgtgatgctctcgtgagcattgtaatgaccaaattaccggtttaatttggatttaccggcttagttaagacagtttctagcttatccccaaggacttctcgcgttatcttctcgaagttgataagcacgatcacttatctatgattatcctcttttccttttttgcaagagaattaagtcatttaacatttccttaaaatcattccgatttaaaacagattatctaactcgaaaatacagctactcagttttgaacaccctaaatcatccaaagatctcatatacaaaaggatctctaaactcaaatcaaagtcacagcccaaagcataagaaacttgtggtagattcaatctatgaaggcatgttggagctcatggcttgatgtattctcgaatgaagtcttcaatctggatggtttctccggtaagtccagatgcctcagcgacagtgactttgttggagcaatgcgtgaaggagaacacttctccctcaattccaatggtgaagtcattcgctatatcagcagtagagactgcactccttgaagccctcagtttctcactgcaaaaactcatcaaccaatgatgattagcttttatgcaggaagataggctttatatataagaaaattttgtcaagaaaactgaaattcttacatttctttctccatttgcttccggataaactccttggtgtgtgcagtgagtttatcggtcttgttacagcaaaggaggactggaatcttcttcttgacaacattcgcattggtcagaatctcgtataggtacctatcaccataaaaaaccatggcaatgcctcattttcaacattgagatgcaaacatatgcaaacatgtctcttatctgtgtcttacaatgcgtgtgtgtggaagagagagggtgtttgaaattactctgaagctgcacgacagtttgggaggaactccaaggcatccactacgaacacaatggcagctgcttggggcaagaattcttctagcttgggtcgaagccgagagtgcccaggaacatcaacaagatgaacaggcttgatttttcctttctgtcacaaagagcaagcacgggacatggtttagtaatatgttattccatccatcacaatcaactgcacgtgttgtttacaacagaacacagtaagattctttaccttagtattttcactgtgaagaacaaaagtgccttcatttggttccattgatgttacagtgccctgatgcgacgatccatctcggagctgccaatcaaacaattatcgtgttataactctccaacaatgacctagtcactcacactgactcacaatagtgacacattacaaaaaaaaagtacatttgaaggaaagtcataaacaatattcatatgaaaaaggtaacgtcaagccaaaacactcacttggtaaaagagcacagtctttccacttccggtcagcccagaaaggagtacagtgttggatttggtacgtctgaccaggcgaactgcataccccagcaagaacaacaagtttagcaacaaaagatcaaaagtttgtttatgtataatcaaagaaaaatcatgaataaacctcagaaattgcaataatagttctaattccaatacacaaaatactctggcttaatcacaagtctaaaatggtaccatgagaactataacctctgcagttgtaaacaatagcaggcagaagaaaagtaattgaagacatttagaagaagaacaggctatatgtccttatcaatggcaaacaagatactaccagggggagatcttacataaataaagcaattctactaggaaaggattaagaaacaacaaagtggtgtctaatacatactggataggaagagcaagatggttgtaaacaacaaaacaccaatggcggcatacagctgattcggtggtatcttctgaagatattcaattccttgatgcgaccactgctcagccagaattttcagatcttccaagttctccattactctctcaagtttcacttcttctgccaagctgttcaaaacctgcatccagagatgtaattcattcctcttaagacataaaaataacctagagttaactagaaaactctcttctcctacacaaacaacatgcatgggaataatttaaaactgcttcctgaaaacaaaaattgaaatcggaactctctaatatttgcaaacattatatcaatactggttctcacattatcatgttcatccttgtgataaacccagtacagtgacaataatcatcttgtgaacaaggaacacaatttgtttatcccaatttaaaaccagttttaccagatcaatacaacccgtagacccatacacgatcatcccaagttatgaaaagataaatgctaatcctacattgatgcgctgtttcaacgagatgtaaaaaaatacaaacagattcctctaaaattccagataatgaatatagacaaacaagagctaaaatttacccaagagtaaatgaatccatttggtggaagagatagaaacgcaccgatgggagaggaggcggaagacgaatacaacgacggtggaagcggagaagaacacggcgacgatgatttagggttcagatttaattttatatattaaaaccagttagtgcttcttcatttcaatttgtttcgaagatagttaatgggccgaataaaagcccattaaacgtcaatacgaagtcgtttcaactgtatctgcttcatcgcttcttttctcccttctcttcccgccgtgaatctggtgtctgtgtctgcatctccttccgacgaaaacagatacactcgagtgaagaaagt

SEQ ID NO: 694 - DNA, 3000 bp, Unknown
  misc_feature (1)..( 3000): cDNA_ID_2121700_gDNA_ID_1620307_Annot_ID_152841 3000 nt of promoter + ATG
tcatagaattgtggatttgattgatgaactacttgtatgtatgtagggaggtgatagaaaagatgtgtttttttaccaagcggatgaccaacactatataccaagagctctcctcattgatttggagcctagagttatcaatggtattcagaatggtgaataccggaatctctacaatcatgaaaatatcttcctttctgaccatggcggtggtgctggtaataactgggccagtggatatcaccaagggaaaggtgttgaagaggaaatcatggacatgattgatcgtgaagctgatggaagtgacagtctggagggttttgttctttgccactctattgctggaggcactggctcaggtattttactttttattgccaatccctatcttcgtttagcttatgtttattcactgaatgacttttttttatgtattttcacatgaaggaatgggatcttatttgttggagactttgaatgatcgttatagcaagaagttggttcagacatacagtgtatttcccaatcagatggaaacgagtgacgttgttgtccagccctacaactcactgttgacgctgaagcggcttacgttaaatgctgattgtgttgttgttcttgacaacactgcattgaacagaattgctgtggagcgtctacatttgactaatcctacttttgctcagaccaattctttggtgtcaactgtgatgtctgctagcacaacaacgttgcgttatcctggatacatgaataatgacttggttggcttgcttgcatctttgatcccaactccaaggtgtcacttcctcatgactggatatacaccgttgactgttgagcgccaggttagatatctcaatcagttttataactaatatcatcaaaccatttttatgggaagctgctgttatctggaacatgacttctgaatgttatgattgacattttcattgatttcctactctcttatgtgaattgttcttggcaggcaaatgttattcgtaaaactactgtgctggatgttatgaggagacttctacaggtgagctgtttgctttctccagtcttttttcgaaaattgaattagattttcttctaacatgattgtattcgcagacaaaaaatatcatggtttcgtcttatgctagaaacaaagaagctagtcaggcaaagtacatatcaatattgaatataattcaaggagaagtcgatcccactcaggtacttttatgtactaatttttttgttcgatatattgaggatgaatcggtaattctttcttgttgatgttatctgctctgttgtctcactacttgatattaggtgcatgagagtttgcagaggatacgagaaagaaagcttgtcaatttcatagactggggaccagcaagcatacaggttctaaccgaattgcgtcgtcaaattaattattgcttttggatttaccatggacttgcatcacaattttttccatatcttactctcaacaggttgctctttccaagaagtccccgtatgttcaaacttcccatagggtaatcttatatcactctatatatatctgtcatgcactcatgctgagagttggtactccttacagttaatgtctaaggctgcagttcctgctttagtagatacatcgaagactcttaagtttggtggtgtatttgatatttcaggtcagtggtcttatgttagcaagccacactagtatcaggcaccttttcagcagatgtttgagccaatatgacaaattgaggaagaagcaagcttttcttgacaattaccgaaagtttccaatgtttgctgtaagttgactgctcaaatatatcggctgatgtttagtgcaacccaccctattattagcattgacagttaatgttgaaatcatgagaatctacatgttgatatggacaggacaatgatctttcagagtttgatgaatcaagggacataattgagagtttggtagacgaatataaggcctgtgagtctccagattacatcaaatggggaatggaggtatataagctaagcttttgccatctatagtcacacactaaaggaagaacttataatgattatcgaatatatgtgactctctcaggaccctggacagcttatgactggtgaaggcaatgcttcaggagttgcggatcctaagttagcgttctgaacaaaaaataaaaactcaagagtaagtcatatgatgtttcacttttaactgagattttcaggtcatgataggttttctttggtaggatcagtagtagtaacgataaagagtgttggcattgtaaaccttgaatagtattatgatgtggatgagtttcaatctatgagatgaatgtgttttttttgggtactttctaagattaagagcacctaaaagttgcatagcaggaatcttgaattgtattagtaacatatattcttggaatcctatgcatattgaagttacaccaatgtaacatcgtggacccctcctaccttaaagtttgtagctgcgagaaaacaggttgttctaatagtgcagcaacaaaaacaacctcgttttaaccttgagatgcatgcttattaggtgagtgagtgctaaaatataaaagattttcttttgggtcggcaatacaggaatttattcattgatggattttatctaatagggtttttaaaaaatattaaagaaaaaagaaggttttatcgttatctaacatctcttatgaatttattatcctacataagttgtcaataagaagccttgtttcctttttctttctgtatttcaatataagataaatttctgaaacctggaacaacaacatctgcgattgtttctgggtattcattcttttcacaaagtgtaaagctttaattttcgatttcgcggagctcaaagtttcaaacttttccatgtttcttgtttcttctagctctgttctgtgtacgtcgaagcaacttccctagcactttctcaattattttaagttccaattctcg

SEQ ID NO: 695 - DNA, 3000 bp, Unknown
  misc_feature (1)..( 3000): cDNA_ID_2121786_gDNA_ID_1620308_Annot_ID_152876 3000 nt of promoter + ATG
attaagccatgtatttaagtaccttttagtgaataactgttgatgtttgagcttctggggaagaaaaatacagaaagctccatggggcatgttgggggatggattgcacccctcattttagctcggcccaaatcaagaataaactaatcaacatcaagcccaaaaagcccataaaagttggtccattatcctatcaccagcttagtttttctataaatagagaggcatctcaaggaaaaaaggaggaagaaatccatattaaaacgtcttcaagctcctcagctcgttctctagctcctctgctcgtcctcaagcttatcagctcgtcctcaagctcctcagctcgtccttaagctcagctcgttctcaagctcctctgctcgtcctcaagcttttcagcttgtcctaaagctcctcagctcgtcctcgagctcctcaagctcctcagctcgtctttaagctatccagctcgtctttaagttcttcagctcgtcttcaagctctacatcactcaacgaccatctcctcgcctagctgtcagctcgtccaattctcacctagtcgtcagctcgtccctcaagtgcacaactcatctatctcctcgcctagctgccagttcgtccattgactacacagtccgcctatctcgtctgccagctcgtctagactttcaccagaactcgatttgtccgactcgtctctctactacatttcgtctagcttggcccctggctaccagctcgtcactcaaatactcagttcgtctaactcgttgtctatcaaccagttcgcctcgtaactaagttcgtccagctcttcgcctacctgccagctcgtcacacatctgctagctcgtcgcctagctgccagctcgtcaccaacctgccacctcatctctaaactgcctatctcaatatacgacctacctccaacgatgacctagctcacttattataatatgaactacgtatggcttgatcccttttctaagggtacgtagacaaccttttacaaggtgcagctataaaactaataaactcttatgtttatcgcaagaacgacctaactcccgaccttcaacgcgatgagaatgtttttcccttatcaaagaacttacaaatatactttgttgaaattcgttcatcaacagggcagtgactgaaacactctttttctctttcgtcgtcctctgaattgcgtcgatcgaataggagaaaatgaaatcaagggtttgcagttttaactgggttttcttaggtcctttcggttcataggttttttactaaatcttggcccgatacacatcactaagtctatttggttctttggctcatgggctttttgaccaaatcgtggccccataaacatcactaaatctatttcacgtatagaaaaaaatgtgaaggcgagtaaaaacatgtgggctccacattaaaaagatgtagtgacgtggacacttttagaggagagaaaactctgctattatatatatgatttaatcttcttggttgaagaggccatggtggcatggtccatgtatatttttgtttcaaaagtaatcatcttgaccttgtaaacaagatgtaccttcttcacttcacattctgaatctagacgaatacagatgtctatttaattagtaaaactaaaatctagagttttgtgttcatgtagaaattatttataaaatcaaatataaataaatggaccgacaacatgtaagaatatgttagtggatagagatctcaatagccatagatttctgataccattctctttttaaagatatgggatgttttgactatcggaattgaagataaacctgctagggttggtaagtgataaaagatgtagttgttcttgtggggttatcttatcttctaaccatttttcttgttttattcatacggttagtacagtcgatcaatatctcacctaacgagttccaaattttaatctcaaacacttagattcactcattcaccaatattattgctagaaacaaatttgttctcttcttgaacaggaatgatcacacgtctgcgtatgataagaacgtcgaggaagaattgcaaccgagtcaagtgcctgatgaaatgataaagcctgactctgacaaatattggtctcctcatccccaaaccggtgtctttggaccttcctcctcctcgaccaacgcaaaggacgaatttcgcggcggtcaggaggactcagtgatggaggagaaagcctggttccgtccaacaagtctcgaagatttggacaagactcaccattcgtagcaaacaaactcttccttttatttgtgttttccaaataaaatttgaagtaaaactgttatgcaatgtttcgaaacgaactaacttttggtgttatgatgtgtgaatgtatcacttgttgcagtttgaaaaattacttctggttcatatattaactaaactaataaagagaaaggtaggataaataataaattgaactttcgatcataatactaaacaagttatattgcaatgtgattactccctacacaacgtatggcccataacaccttatctgggctgtattgtttatatggcccataactatacttttatgtttactcaaatatggcccataactttataaaaacactattaaaatcctatgatttgaattaaaaattcctaaaatgctcttgaaatactgtaattttcttattccggtgtcctttttcggaatatttcttcctttttttggcagatacatgacaaggtggagagtgtaagagaaactaattaaaatattaatttcccaaaaaattcaaaatttaaaagctccgctccaacaacggtcacacttgcaatcttagggattcaatggcttcccttggaaacgagatataaataccctatttgctctcatctttacactcatagcaaaaaacatcttgttttctctgccaatctcaatttctctcccaaccagaaaattctctcactctctctcgatttcgcggaaatg

SEQ ID NO: 696 - DNA, 3000 bp, Unknown
  misc_feature (1)..( 3000): cDNA_ID_2121839_gDNA_ID_1620308_Annot_ID_152891 3000 nt of promoter + ATG
acatggttgagtatattagtaaacaataacatttgaatacaaaatatcgattcaaattgagtttctctatatatggtttttatttgttttattctgtcccctgtaaaatatgttatctctcaagattaaaccctaaggtacaaagtgtagactatcataaaagtgtggtggtccatgagaggttaacgaaaagtatttgaggatttgaccagagggaatcctacaattgcgtatgctctaatcaatactactatagtattatggctatattgttatataatatattcagaaaaatcatatacttccaatccaagttgaattgacaaaaactaatccaaacgttgaattgattcattttaattgttaaaattttgatttcttgatatatacgaaaaagtcaaagctagtaccaaaaaaaaaacacatggtatcacaaaactctttgttatttaaagggatttctaaatattagttaaaatcctcatgattagtgaattctagaaatatttcaaaattttgcttcgattttcaaatcaatcaaaatatgcaaaccaatataaatgtatacatataattttggtaaaagtgttctatattatagttgtcctgttattgtgatatatattctttttcttttcttcactctatctttcgaacctatacgttcaaaacctattcagcgcttagaccataaaagggtctcattccaaatatatatatatactgatagattgatttatggttaactaaataattcttacctggcaagtcccatggttcgcacttgtagaggtctacttcagggataatctctagctcgatctcttggccgttgatctttctcttgagatagtaagtgattagttcttcgtccgttggatggaacctaaaacctggaggcaacgagaccggagccatgtatatactcttcaacaatattgaaacctctctatcaatttaatatcggattatataacaaaaaacttaacgaacggtcttgtttacgagataaactccaacaagaccgatcgtttttgtttatataaatagttttataagtatggttgggtagtagagagaaggagaatgatgatacgaaaacctcgagagaaagaaggaaacagagagaagacaaatgttttgtgttttcagggcttgaagggtatagggttataaataaagaagagaaagacagaatttcatataaaaatagtggcaggaaagtgaaagggatgatgccaccctcaaataatatatggaacttataatataaaagttataaaaagtatggctatacccaatttgtctctcgtaattttgtttcttccttacacatattctgattcttactgtcgttttcttcaagattcataggtaggttaatgcaaaaccgtgtttcttcatcaaagtggtcgcctcaaataatcacattcttctccaagtatggtcggtttggaatgtatccacgtggcggaacatcattggcttcatggggggaacgaatcttggtttaaccaatagaaactggtttcaaatctttgtctggcggcgcttctaactgaataaaactgtctcctttgtatcgtatccccacttgcgagaatcctttagttccttcgtgattgccgctgatcaatatgccatcatctcaattatttcttatatctaatctcttttctgaaataaaaatattatacttcattttgtatcatcttcattgtgtcgtcacaagtggctcgagtatgatcgtttgattggtcattagtgttagtttgttcatcttcccccatatatatctgatcttgtgttcataagttatgtctcgggagtatgttttaataccgcccaaaactatattataaccttttttcagtgtaaaaatatgaatcacttaaacgaggagtcgaggatgagagacaagctcgctcgttcacgagcatgtggctctagatggatatgaaacacatgatatagtgacgcaaacacaaacacaaacacgagcacaaacgcacacattaattagattcatatgcaagttcatacatagataaattaaaggcatagatatataaaaccaaaatttgtttaaaggtatagagatgaagaataaaggtccacatggtagatcatgtgggtccagcttgtaagcatgtgaagaaatccttggaggcatagatgggccaaccccagcatcacttctcagcttttctcatcatcatcatacacttttctgtcattatgcaaattccatattctagatctatatctaattaatcacacatataataagcattagcatatataacacatgtatataacaaattgtacatacccttctttacacttttccctcacatgaatccatctttttgttctttacttttatttatttctctttcacacacatctataagttaatgtactccaaatatctttaccaaataaatgtatcttaaattcccaagttgagaacatgaactatttgaatatagtttcaaagaaagtatttagaaaaaatatataatatgtaagacaaaaacccaaacttctgtctctttgtttatgctaagctaatttaaatttttaaagtgttattaacatttcagagtctagtgcatgtttattttctcctagaaaagatgagtgacaaaaataccaaaagagaaaggtacatctgtaaaattgataaagagttaagaaggaaaaaatgtttaaatcataaacttaatcgcatacacaacttagcttcaataaatttttgaaaattgtcaaaactcaaaaatggggagaagaggttaaacttggtttaaccggttcgttcattatacttccgggttagcattttgagcggttcttttccggtaaccaaaccggatagacattcgagttattgttcaaccggtttcaccgtcaaacgacgtcgttgtcacagtactgtccctcacaaaaacctcacaaaacctctctttcgttctcgtctcctccagaaccagtacaacc

SEQ ID NO: 697 - DNA, 3000 bp, Unknown
  misc_feature (1)..( 3000): cDNA_ID_2121851_gDNA_ID_1620308_Annot_ID_152894 3000 nt of promoter + ATG
gagattatataaactttggcttaaaaataaatggatggtggtgaagaaaagggaaaatatcacaatggttgtcacgtgtcacttcacacaatccagtagaccagtacctaacatccagcaccaccaagcctaaccataaactcctcaaatgacctaaaaggtttttttaacacttcgtttcgacacctgaattgttatctgttattttatctttttcacgtcttacgcctcctaaatcctaatcgcttaaatattttttgaacatgttctcatctgtttttaaaaaatttggattttcttttcactaatgattgttacattagataaatgtgatttccactacaggtttggattttattgcattagaaaatatggtaataacaaatatttttataagagatgacaaaaacaaatactctaagtagacaacagccacacaccaaccactttctgatatttgaaaccctaagtaaagaacgagaaggaattcttgtggctgagaaattttgttgtattatcagtgaacgtgaataaaatgaataagaaacaaataaaaagaaaactagtggctagaaccctccttctcgtcattccacatgtcaagtttctgtagaacagacggctaaaataagaatcagtgacatggagaaaagtgcactgacattcactaattattagtattagtactatattataaattaaagtgtaattactttcacttccaccgaggatgacttttacaatttgaggagtatattaaattatgtgcttaacaatgatttcaataaaatatctacacatttgtgaaaattgatgacgacctggacgatggataatcatattaattcgagaaagttgaaactaattataaatatcatagatagattcgtatctgtatatattatattatatggtatgtatacgtagacttacgttatggatagacccccaccatgtttttatatagaggcagaagatatttaacttatggttttcgttttttcgtaaaatatgaaacaaagacaacgacaaaacgaaaaagaaccaaaaatagtatctcattctactttcacttgattttggaatttcatttatttagattgtgattcaaaaccatttcaactatgtaaaattctgtgcaatatttttcccaactaaacatataagtttgacatgaaaaagaatataggaaaatttagaggtccaaattttatatgtatatcggaatcatggtaggatacgttatcaattgcatttgtatgaggcttgctattgctagtatagaagcatcatcaacaaatcttaatatcagtccaaatttgaataacccattttgtggatctcatttcataaaataaaccattttagtgtcctgcaaaaatgtgtttagacagaaatcttttttaaaatctgaatttagatattatgatggttataatttatatataaatttactatcaaatattgtgttcatatatggaagaatggagaaaaaagagtagaaccccacaaaataaaaaatggatagactatgttttctaagattggacaaagtgtataataaaatcttctgatctggtccaaaaataaaatgttaagagttttcgaattcgaataatttgattttgattaagatatccacttcggatatgttttcatatgtagctttttaaaataccctaataaatattttcataaagagtttatgtaaataaatcaaaatatatttttaactttttatttattatagttttatatattactgttttaattattttgaagtatttttgatagatatggatttggatggttccgcaaacaaatcctatggatccggatccaaagaaccaatcataaattttggaatatgtccacccatatatggatcaatagagatatagttaagaaaagaaaatgaatttatcccgcaaatttacatttttatctcatgtagtggaaccaatgaaaagcgagtaagctaagaagtcatactctcgagagtacgcctttccatattttcctttaaaagtatcttctggtggctcacatttctccgtccagcaaaatcttttttgttacataaatattatatttcctgatattttatattaaaagattatccaattgaaatgatgtcaaaaaaggaaaggaaaagtaggggaattaaataaatacatacagtgataatcgaagtaccaaatctaactgttttaaaacaagtagattcattttaaaaaattaaatatttgatttttcaaagagataaatgaataaatctagtacaaattttgttgcaaaaaaagaagatgaagaatatgagaaagagcgacacgtggcaaagatggacattgaacgtgagccacaagattttccatctgtttctcgagcgttccatggaaaaccaataagaattattatttttattttttaaaaattgggaaaaagcgcacatagcagaagctgacgtggcatcaccctcctttttgtcttccctattttctcacccccctaattcccttcttcctccttcacagaccccaaactcttctcttcttcttctttctctctgttttcttcttcttccgccgaatcagaaagcttgtctttttctttactccggctaccaaaacttctcggagtttctctgagagtttcatttccgaccttcttcttatccttatttgcggcaagatttccagcgagagtttttttctcttttcctttatcgaacataagaaatctctggtttgctggaagttttttttccggaaggtggaagcttagattggttctgatttcagaagcaaatcgtttgttgttgcctaagtaaaccgaatcaatttatgggatctatagaaacagacggagaacagaggaaattaagctgattttttcaagtctagattcgcgaatttatcttggtgtttccttttctgtgttccacacctttcgagtttttttttgttttcctccgccgagatcttaatccgggaagttatg

SEQ ID NO: 698 - DNA, 3000 bp, Unknown
  misc_feature (1)..( 3000): cDNA_ID_2121867_gDNA_ID_1620308_Annot_ID_152899 3000 nt of promoter + ATG
ttccttttctaattacttgataaactttaatctaaatttattgtggtgtcattttatcaacctcacaaactaaaagctaaactacatctctttgtaaaatagttcacatatgtcactattacattaattttacttttttatgaaaaacataattataagatcaaatcttatacctaatattcttatcacctctgtttgatcctaggtgaaacaaaaaaaaggtgaatcatctgatcatttatattgtaagaacaaaatttttttgcatatatgattcgagctagtttgtaacaaaaaaagcgctcaaatatgttgttggatgttgaagaggagaatccaatatatatgagaagtaatttttaaaagatcaagatatgtgttttcacatttcacaagctttcttaaaatattatagaccaaaataacagttgtttttttacattattacatgtttgcaatttcaaaaattaatctcacttacttatttgaaaatggaacaaaacctctataaattaatattctatctcataaattagtaacttctataattttaataaattctttctgttccaagttgggaccagtgtaaaaatgacataaatcgataaaataatattttttttcaaaatcatatataaacatatggtctctacaatataaataattaataattgtataaagttatcaataaatatattaagtgaaatataactctagtatttttatatattgtattaattcttggtagagtttatttctaatatttttactacattgaaaaggtttgcactatgttttaaacttaataattgtttttctacttgtaattgatttttgaaagatattaattataaaggaaataactgtgtttgagagagtatatatatattatatgataggattaagaaggatgttttatcttcattggtcaagatggaaaaaatagttaacatgatctctcatcttgaattatgtaataagtctatgcatttactgatccatttgaaatagcagaatatgaaatcaaattaattttattgagatggaagctaatgaactattaaatatgaagaatttgaaatcctttaccttttgcttatgtgatattaccaagctatgatgtgagtttgtatgtgatatcatgttttatatgtaatatttcgaaaacaaatatataaacaaataaagagaagcaaatgaaacaaaactttggcttttttatatatcatttgtcatttatcatttacaaacctaaaagtcaaagataaaccaaaggataccctgatttgttaatgttatgatatttgagcaaaactgtggagtataatatattataactcattgaatataaccacatagtcataacaaatcaaaataaaataaaagtttccaaaacgtagtcataacaaataacaaaattatttaaaggttttcaatttttacaagataaagtatattaaaaatgataaaatagaataatatgtaactttgttaacatcttggaaaaaatagaaaatttaatatgaagttgtgtctacgaattctatttatgttctagttattgtacatattcaaattaacgatgctaaatcattcttctgatattgagttgtgtcacatgttaagtatatttattttaattttcttagtatcataatgttttctttcttgtatgattaggtgcacatggaatatatgtcatactattttaaaattcatattttattaattcttttgtcatagctagccatcatatataggtagaccagtatataatagaaaaaaagaacacattcaaatgattttgatttcttctaacactagattaatcttaacttcacctttttttttgtcacagttaacatcttatataacttcatttcaaatgtctatattttttaatgtctacataaatatacatttcatcacacgatttacaatatgaatacatgtttataagcttttagatcatggaatataaaatagtgcactttttaattatgtcgatatagtctttgatttttaaaaaattaaagatgaaaaattagaaaattatgtgatgcattaggactcaataatagagactatacataataacaattgcagttagttcttagttggatataataggtcagtaaaatatattattacaaacatcaactctgcactacgcaagatgtagtaaattacgaaaatatatgataaacaaattcgcatactacattatgactacaatagccaccttccctatacattatgacttctaacattgaaaaaatttgcaaacatttggtgtaaattaacaaattaaaaacatttggtctaatgtatgaagaaaaaactagatattccgctaatttaaacaaacatttggccttataagaaattttaggtaagaaaaaattctgagaagtcttttttattcacatcacatagtcaatattcaattcaatgcatataaatttcatgtaaagcttcttttttcctcggatcccattcattattttacttaccattgaatactttcaccgtgtagtctttttttagaaatcgttgaatatcaaaaacaagaagaagaaaaagaaaccgtgttttcaatgtgctgtcatacgattcatgaccctttatgaatctaatacagagtttgaaacataaactaaacttggaagtttgccaaaaaaaaaaaaaaaaaaaaaacttggaaataacacttctcaaaaagatattgggtcaaagtctaaaactgaaaacgaaactagaggcattattctctaattcaaacaaagtttagggcttgggaagaaatattcacaaaaaggaagtttccgaaaattcttttatattattccccaagcaaaccattcaatatcattgattattgatataaaacccatataaaggtgtctctcatcatcctccattcccatacatcactttcctcgatctcactttctctctcttatcatcatctcctggtattctctctctctcatctccgtg

SEQ ID NO: 699 - DNA, 3000 bp, Unknown
  misc_feature (1)..( 3000): cDNA_ID_3058405_gDNA_ID_1620308_Annot_ID_152896 3000 nt of promoter + ATG
tcggaaagttattcacatctatattaataaattctattacaatttcaataactttggcattaactatatgattggtttttttttttgttttcttatatagccttcaattagggatattaatactaagctaatgatactccaagatagcttcaaagatgcattgggaggaatggtggcctacgctccaatggatctaaacaccgcctgcgctgccatttcaggcgatatcgatcctaccaccattccaatcctcccttccggttttatgatctcccgtgacggccgtccttccgagggcgaagccgagggtggcagctatacactcctcaccgtggctttccagatccttgtctccggtccgagttactctcctgataccaacctggaagtttctgccaccacagtcaataccttgattagctccaccgttcaaaggatcaaagccatgctcaagtgcgaatgatggtcagtgagagtcgtttgatgaagttaccagttcccaactctcaactctttggttttttatctttctttctttttcaaataagtgagaagagctttctccgtttgattctctaaggagagtcctagtacttttccatatttttcgttggttttaaaacttattccaataaatttctaaggtaagggccttagctgaacaatatttatgttgttgccttttggcatgtttgttttctgacattggtgttggatttataagatattattgcttaatttctgtttttatataatatttttgatattttctgttttatgaaattgatctagttagagaataaatgtagctttcatgcatgtttgtaagtgatacatcaaaatatcttgagataagttgccaactagacacttttatcacaaataatttgtaaactagatagtttttttagatattagaggaataggtacttttctcttcttctctaatagagctcctctctaatatagagattttggtaatagacaaatatatccttttgttgttttgttatgtaaacatataaaaacaaaagacatatgagtgtgatattaaatgggctagcccaataatttttttatcttctaattactaatatatttcttaatttaaaaaatacacatcaataaaattctttcaatcactttatacattttaaaatactaatctttttaagtattttaaagattttaattttgttatattttgcggatatgtattatttttaacattttactatactaacattttcaatttttaatacatattaaaatactaattttgttatatttagctaaaataagtttactaaaatactaaaattttatttttattatattttgcgggtatgtaatattagttttaaaatactaacatcattaatatttttatatattttgaaatactaaattttatacatctctaaagattttaattttattatattttacggttacgtaatattctatcttgttttatctgaattcgatggtgtacaaaataatattaaaaatagtgtacaacaataattttaaagataaaacaacgatagtgtacataaaataataaaatagtagatgacgccatttataactctttagatcgtctatcgtacaccttcaaaaatattgtacaccgaatctatgagatagagaattatttggtgtacttgaaagtttatgagatagtgtacagacatcagtgtacaaaatgatgtacactagtatattgaagtaataggttatatattcaaaaatattatacaccatatctataaaatagagaattatttggtgtatttgaaggtttatgagatagtgtacaaattcagtgtacgaaatgatgtacaccagtaaattgaaataatggtttatatatttcctattagtataccccaaatgttgtacgttatgtctaccaatctcacaagctatcatttaaaattgtgtacatcattctgtcattattctcgtatatcataatattgtacaccaacatgtacaccattaaatttaattatattaaatcatttaaaaattgtgtacaccatcccgtcaccaatatcatgattttaatggtacaccattccgtattcatttaaaaattgtgtacaccatagaattttcctaaatttcgttttaatcgacaaaaatgatataatgttaagtttaaccgtctgaagaaatagattgaaaaacgaaaacgattggaattttttttgggccaaataacataagtcaaattaattaggctatgaaaatagtatttgacccattatctctaaaagatttgggcctacaccaaaagttctttcttacaaaacaaaagggtacaattgtatttaacatttattttgtttttttagttatgtaccttctatctcacatattttctatcccacaaaagaaaaaaaaatacctatttctctaatatctaaaagaactacctacttctcaaataacttttgaaaaagtgtctagtttgccaataaacccaaatatcttttctcgcacgagaaaactgcaccatcgaaaatggatagctaagcttacctacaagacgtggtactcgtttttccaccatcatatgatgatataataactggactagggtgtcttcgatcggttatgttgaaattgtagttaaaactggtttttagcgggtatacaattcgggtttttatcggtttagtttaaattcagtttacatttttcattagaaaaatcgattcacatggttaaaatactaaaccgaacggtacagtagtaaagtttgcatgcgattgcgcgagagggtgtgacagatatctgaattttctttcaattggtaaagagaagacaacggacatatttttggtaaccatccatttgtcaccactaactttcttccactataaataccccaccgctttaactctagaacactctccatttttcaatattgctcaaatctcaatctttctctcctgcgttttaatttctctcggattgaaatcatccatg

SEQ ID NO: 700 - DNA, 3000 bp, Unknown
  misc_feature (1)..( 3000): cDNA_ID_2121847_gDNA_ID_1620308_Annot_ID_152893 3000 nt of promoter + ATG
ctccggctaccaaaacttctcggagtttctctgagagtttcatttccgaccttcttcttatccttatttgcggcaagatttccagcgagagtttttttctcttttcctttatcgaacataagaaatctctggtttgctggaagttttttttccggaaggtggaagcttagattggttctgatttcagaagcaaatcgtttgttgttgcctaagtaaaccgaatcaatttatgggatctatagaaacagacggagaacagaggaaattaagctgattttttcaagtctagattcgcgaatttatcttggtgtttccttttctgtgttccacacctttcgagtttttttttgttttcctccgccgagatcttaatccgggaagttatggcgtcgtctccgttgactgcaaatgttcaggtctggtctcaaaatttgatttttatccactttttttgttttgtttctgctttattcaggtctggtctcaaatgaatctatgagtttaaaatactgtatacggacatttaagtaataaagcttagagttaaagcaagttcgttgcaattcatttgcagactcttgtttcttttgagctataagttctctctagatttgtgtgttgcaactacattcatttgaatccttgagatggaatcgactgtgttggaattttgtgattaggatatgtaaatcgagtttaattagttggactttgtgaatgaatgttcattgagaaactgaagaagaaagtaaataatccaatgccactttgtgtcatagtccttaaaatgatgtttcctaaagtcgttttgcttgatgatggctttagggtaccaacgcttctttgaggaatagagatgaagaaactgcagacaagcagatacaattcaatgaccaaagttttgggggaaatgactatgcacccaaggtttgtttcttttaacatcaaatgtcaaatattgttatgtaaagtgaagatctgtggctcagttcatcttttcttacttaggtacggaagccatacacgataacaaaagagagagagagatggacagatgaagagcacaagaagtttgttgaagccttgaaattatacgggcgagcttggagacgaatagaaggtaaattaatgatttagtaatatctcttgctactgagttatggccttacctggaccctcaaaaatatatgtttgtttcactaacagaacatgtgggctcaaagaccgcagttcagattcgaagccatgctcagaagtttttctctaaggtttatacacttatttgctattatatctttacccttgttcaaagaaagtatcagtctaatctctgtagcaaacctaagttctgcataaataaggaatcattatacatacattgtttggagacttgtgttctgacttggctttgttctgttgtattcacacaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctggtacttgacataaacaaaaccgaatttatacttaacagcaatacctgctgttagatgcttaatgcttaatattcttggtttaatcaatttgtacagaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataacacattttcttacgtaccctaaagaagagactttaaatttactattcattcgactttctaagttttcatcaatgtaatttttgttgttgtttcattgttttctcttgaggtgtttgttctctaggctaaaattttctgcaaaagtttgtaactgtaaaactcgtgtacaatttatacagttaaatctaatgattatgagatctttcttaattgatggttcaacaaaagcaagtttcaggtgtctctcttcaatatctccgattaaattaggtttggtaaagagtttgctttgaaatgaaggcaaagaagaaaaacagtgaggttaccaccaactgaacaagtgtgtgttcaaagttcaaacccaacaaataaccgaaccgattcggaaaccaactctaacctgaaattttgatagaatttgaccagaccaaattagaccggttaacaccctttcacgttagccaccaacagattaagcagtgtctaacgtacgccttattaataccacataaagacgcaagagaagatgacgtcatacagaaacagcgtcgttttgaaagctgagttttttttgtgaagcgagcgagcgtgagaaggtgtgacggggaagagaatg

SEQ ID NO: 701 - DNA, 3000 bp, Unknown
  misc_feature (1)..( 3000): cDNA_ID_2121832_gDNA_ID_1620308_Annot_ID_152889 3000 nt of promoter + ATG
agcttagagccttccaggataaagtcatcttgatgcagaccaaagagcaggaaatatcaagatcattctactataagataagaaaaaacaacaagcttgtgtggacatatctaaagcataatacatttggtttattcctctcaaacattaacgtccaacaaacaccctccgaaacacaaataaagactgggacaacaacaaagctcgaattgatgaaattgaaaaatgcagtagcacgaagagagtacctggagattagaaaacttcccaagcaagtcagaaccgacagacatgagctgaatcttagcccagttctcccactcaactaattccttactctctgacactctaaggggcaacgaacatttcgttgatccttccgttgacctaacagtttaaaaacaatcaaaagcctcaatgagaatttgaatataaccagattccgaaatttgaagaacactggaagttcataaattacgaagaattaaactcggtgacttacccagtcagattgcaacgggtgaaccacaaagcagtagcgattgctaagcacatcaccagaacagcacggcgagccttatcgatttcatctgaagaatcgttcaccacgaacgattcgaccttgtcgagaagctcggagtaaacttgctcggcggaatcaaccgtatcaaccaagtttaactcggaatctccgagtattagcttagtagcgtcggaggatagagctccaagatagtctccagcctcgattgaagacaaaagagacgttataagagagtcgtgtggatgggttccggattgagttccatcgagcggctgggattcgagaggagaacctgtctgtggaaaggatacagtgcaccggaggagacggagctcgtaaccgcgaaggatttcaacttcgccgtcgaccatggttgtactggttctggaggagacgagaacgaaagagaggttttgtgaggtttttgtgagggacagtactgtgacaacgacgtcgtttgacggtgaaaccggttgaacaataactcgaatgtctatccggtttggttaccggaaaagaaccgctcaaaatgctaacccggaagtataatgaacgaaccggttaaaccaagtttaacctcttctccccatttttgagttttgacaattttcaaaaatttattgaagctaagttgtgtatgcgattaagtttatgatttaaacattttttccttcttaactctttatcaattttacagatgtacctttctcttttggtatttttgtcactcatcttttctaggagaaaataaacatgcactagactctgaaatgttaataacactttaaaaatttaaattagcttagcataaacaaagagacagaagtttgggtttttgtcttacatattatatattttttctaaatactttctttgaaactatattcaaatagttcatgttctcaacttgggaatttaagatacatttatttggtaaagatatttggagtacattaacttatagatgtgtgtgaaagagaaataaataaaagtaaagaacaaaaagatggattcatgtgagggaaaagtgtaaagaagggtatgtacaatttgttatatacatgtgttatatatgctaatgcttattatatgtgtgattaattagatatagatctagaatatggaatttgcataatgacagaaaagtgtatgatgatgatgagaaaagctgagaagtgatgctggggttggcccatctatgcctccaaggatttcttcacatgcttacaagctggacccacatgatctaccatgtggacctttattcttcatctctatacctttaaacaaattttggttttatatatctatgcctttaatttatctatgtatgaacttgcatatgaatctaattaatgtgtgcgtttgtgctcgtgtttgtgtttgtgtttgcgtcactatatcatgtgtttcatatccatctagagccacatgctcgtgaacgagcgagcttgtctctcatcctcgactcctcgtttaagtgattcatatttttacactgaaaaaaggttataatatagttttgggcggtattaaaacatactcccgagacataacttatgaacacaagatcagatatatatgggggaagatgaacaaactaacactaatgaccaatcaaacgatcatactcgagccacttgtgacgacacaatgaagatgatacaaaatgaagtataatatttttatttcagaaaagagattagatataagaaataattgagatgatggcatattgatcagcggcaatcacgaaggaactaaaggattctcgcaagtggggatacgatacaaaggagacagttttattcagttagaagcgccgccagacaaagatttgaaaccagtttctattggttaaaccaagattcgttccccccatgaagccaatgatgttccgccacgtggatacattccaaaccgaccatacttggagaagaatgtgattatttgaggcgaccactttgatgaagaaacacggttttgcattaacctacctatgaatcttgaagaaaacgacagtaagaatcagaatatgtgtaaggaagaaacaaaattacgagagacaaattgggtatagccatactttttataacttttatattataagttccatatattatttgagggtggcatcatccctttcactttcctgccactatttttatatgaaattctgtctttctcttctttatttataaccctatacccttcaagccctgaaaacacaaaacatttgtcttctctctgtttccttctttctctcgaggttttcgtatcatcattctccttctctctactacccaaccatacttataaaactatttatataaacaaaaacgatcggtcttgttggagtttatctcgtaaacaagaccgttcgttaagttttttgttatataatccgatattaaattgatagagaggtttcaatattgttgaagagtatatacatg

SEQ ID NO: 702 - DNA, 3000 bp, Unknown
  misc_feature (1)..( 3000): cDNA_ID_2105477_gDNA_ID_1620308_Annot_ID_152884 3000 nt of promoter + ATG
catacttaatgtttcagacaatccacttttgaagcaaataaagacccatgagcatttttgcaggaagaaaacaacttgtgaccaaatgtcgctgaaaccatattcacattgtccatcactatatctgagcatcccaagtctgcatcgcagttcaatgtaatgtcttgatcgcttgcagatgacccacggattctagcgtaacgcacgtcagtcactttcacgcctttcccattaccagacggagtccgttgttttgctgttaaatgacagttctgatagctactagatgacttgcttattcctccgttcgtacctccattgtggtaagtctggtctatgataatagggttctctgaggcaaccatgttgatatcctcgaatgagattttccgagcatatcccgatccgttctacaaaacattcacgccaacaaaaaaaaacagatttagtttgtgaaaatgctgaataagaccaagaactaatgatgtataataaaaaaagaagattaatggacaacctggtatgtcttgattcggacaccgttctgtgtttttgtaaaagtgcagttctttaccctcacttcttcaacagtttcgaaatctccagttactccaagacttcctacgctataatatcaaatccatactataaatgatttagcatgtaccttgctgtatattatatgatgattgtttgtgaatctgtgattttaggaatcacctgataccgtgaccggggccacaaaaaatgccggttatgttgatatgagaggaaccgctattaatggcgatgcagtcatctccagtggcaatcactgagtcatgtatgtggactcctatacagttcgatatgtcaataccatccgtgtttggactatcaccgggtgctgtcatccttaaacccctgacctcgatgttctgtgaacaacttagacctacatggttccgagggctgttcaaatgtcggagattagatatcctaagaccattacagttgttgaagtgcattgcctaagaaaagcaaggaagaaaaagaaacatcattaataactgagaataaatatttgatcgaagttcatatttatggttgtgaggatcttgcaaatggacttacgcaggggcgattattaacgttgccccaccacaaagaaccacgaccgtcgatggtaccacctccggtgacaacaagaccattgatactgtcaaaactaatccatgttgtgtatcttcccgcataccaagtgtaacccggtgccacaagattacctcttatctaatgtaaataaatcaccaaattatttaaacattggttcgagttattgtctactcataagctaaaatcgatcactattgaaatcattcacattagggctggattttccaatataatttgaaacaagagaaagagacaagtatatatataccgataaggagatggtcgaagacttgcatggaccgatgaatgtaagaggcttaagcatgaaggttttcccttgaggcacaagaatctttctattgtgtcctcctttgcatacagcttcccatgctttaagaaaagcctgaaatatattgatacacataacacatacattaaaacaaaggttatacataccactttgatacaaatagtgatgattctataaataaacaccttagtatcatcagtctttccatcgccaatagctccgaaactagtgacacttatgaatccattgcttccaaatccgtttttaacctttagagattcttcttctaagcagaaacataatttgtttatttgaaacaaacataacaagacaaagaacaacgaagatttcatttttggacgactcatatgcttgacgatgagaacgaatttcgatgataatacgttttctatctatatatatctctaaatgtatatataggtttgtataaagaaaggtggttaattgaaagatattgcgtttgattttgtgtttctatggtaagagattatcgctaatcactaattttgtgtgctataacatggaaactaataatggactataattgagatattgaaatctttataactatggaatattcaaacttattgacgtatttaacaaatcgcaaacgatatatttttataccgttttgtttagcgataagagtgaaagtttacttatatgcttgattctttctattgcttacatgcttgattctaggaatgaattaattatggcttatctaaagatagaaaatagattcatcattaacttatgtcataagagagaaagagagacctatgattgaatcatttatatgatgaatatatccaaggcggcactaatcttttttgattcacaagaatctttagattgattaaaccaaaatgtaaatatgacgaaacctcataagaattttatcaaatataagtccatctaatttctttaattagataaatagtaaatttgaaatgaataaagataaataattcatggacgaataaaatacaaatgatagaacaaaattctcattttcattctttatatttttggtcaagaatattgtcattctattcatttttgaattatagtaagaaacagataaaatgtgttcgtcttataaatgatgaaactcttaaataaaataaaatctatgtaaccaataagctattcttatttagttaaatggaggaaactttaaatagattaattttctctaaataatttctttgcatacctcagtagcaaaccggtccggtcggatctgaattgaacaaatcaaaccaaaatcagaaaccaaaccaaaacagagaaaatacattttattgaaacttgaaagtaccattacgcgtggatctatgtaataaggaggagagagtagagtactttgccgactaaaagtgagtgcggtgtttaatgggtttgtcaccaactttccattttcttaccaacgaagaagaagcagaaaaaaagtaaacaaagactaaaaaaaaaaagccagcatcttcggagttggtgggagagagacagag

SEQ ID NO: 703 - DNA, 3000 bp, Unknown
  misc_feature (1)..( 3000): cDNA_ID_3058409_gDNA_ID_1620308_Annot_ID_152888 3000 nt of promoter + ATG
tccacacgagctcgaatataagtggtagctcgagttttgacgtttgttcagatcttgaaataagttcaaacacaccttataataccgctgcccatatccaaccgcgatttggaaacgcaaacgcaattagtgatcatgatgactggtcgcagtacttgtcacaaaacatgcctacaagcttttcagattacggatctccttatggaccatacctcactcaatcaaaggtaatttgttaattaatacagttgattccgtatcatatacagaatcaaatatacatgtatcttaaaatgttgtattattatataggtgaatacagaagtgcaatgtgagatgtttcaacaccaaatgtcattgccaccattgcgagtagaaaactcgcaggctcaaaccagcgatttctccaagagactacatcaaaacagtggtcaaagtgggttcgacgactttactttcgctgcaagtaactccaaccaattctacaacagcaacgttgatgatcatttgatacacattggaaatcttgacgagcaggtaattttatttcatagttaccaatttgatttcgtcatttatattttatatatgctcgaagaccaaatattaattgtctctataatctatatgatgttaacagagttatatagaagaacaagaattgattttgccaagtttccagagtaatgatcaagatcttgaactttatggtgggtatgatataaaactcattataattggaagtttggaaccatataaaatgttgattataatgatctaatcggaaataattgtatatttattacaggcggatctcggaccaatacaatagacaacatagagatcgacgattttttctcgtttgagaaccaagcacaagacaacgacaactcaaacgtaaccccaaactcggcaggattcgaaatgattggagaagagattatagtaaaccataaaatgctcattagtacacggcagactacggagattttatactatcaagtggtaccgtcgcagatattgaaaattcacataaatccggttcatggaaatgaagagagaacaatgttaatggaagaagacagtgatgattcttggttccagaaggctgaaaatgttgcgaagatgaaactgaaacagattagtttagttgcaaaacgttattacaaatgtcttactattattttctgatttatgtatttcattatttattgtcgtatactaacccccttttggaatgaagagaggaaaaatacatatactcaattacttgtatactatatagtttgatttcactgtcattgttaaataagtaatctttgctagttaccaaagcccaccaaaacataaggatccaataagaaattcctaataccacaagtcacgtgaataacacgcgcattagggtttctagaccgacataagcctcaccaccgtacctataaatactcttttgactaaacctcaaaacaccaaaataacaagccgtcgacttctctccgctagatttcttatccttaatatgttcttcataaggtttcctaggttatgttctcattagaaattgtgcgtcaatattactgattaccaccgtacttgtttatgttcgttgtgtatgagctgacgccaaatcgtttccctatatctgttattcgttttgattttcttcggaaaaccctctggggttttcttcaatcagctcgaatttgcagattagggtaaatctgattttgtattagtgttttatagaattgttttaggttttagttcatacacaacattgaactcgttttttttgttcttagaaatcgagatttggattggttaataatggagaatggaggtgatgacaatttccccagatgatcgaatctgattatactgagcgaatagaacttcctcttcggaggaagtcaagccaattagtctgatccttctccttagattattacgattgatttgggtttgtttgttgattttaaaactttcgtggtttttttgaaaagagatatggaggtgatgacaatttccccaaatgatcgaatcagattatactaagcgaattttatttccttctcaacagaggaaatcaagccaatattctgatccttgtctcttttatgtttttttgatgagtttgcctttagataggttcactagattcaattgtgattcgtttttaatttgttgggtcttttttatgattaaactataagattggtattaaggagaatggaggtgatgacaatttccccaaatgatcgaatcagattatactaagcgatttttatttccttctcaacagaggaaatcaagccaatgttctgatccttctcctaaaccttttttaataatagcttcgattatttttctagaataatttgaggttttagatttttttttgttttgggtttattaggtatatgatgatactaaactgagacaaatggatttaagtttggactgatttggatttgatgaattgaaacacatatctacaagctgtattgacaagacgaaacctttgttcatatcataagagatgatagtaatcggatgacgaaatcattcttcatatcataagagacgactgtaatttgattaacttatactgttgaatgctagctaaatcggaatcgtataacttactcagttaatcaaatatcaaaggactgaagcttattttgtagtaaaaattcgccagaataatttacttcaataaccggagtagctaaactaaatttttattatgcaccctccataccggttataacctgtaaaacgaatcgattacctaaatgtctgaaaatataacgcgccattgctaaacaaaacgcaaagcagcaaaaactcgattacacttacaatgataagttatacgacgtcgttttccattcacgtcttcatcaccttcaatagtttattttgccgcggtcagtagcccgtcacggcgaaatctacttatcggaaatacgaccggagaattttgatccggagatg

SEQ ID NO: 704 - DNA, 3000 bp, Unknown
  misc_feature (1)..( 3000): cDNA_ID_2121883_gDNA_ID_1620309_Annot_ID_152907 3000 nt of promoter + ATG
ttagttttcgctgatgtttaaacagaacaaagtcgaagggatgatttggaatcacttggttatgttcttatgtattttctcaaaggaaggttagcgtctacagcttctctacctgagtctgtaaaattctgtatattttcttgaacagagtttaaaccatatgtttttttgggctatcagcttaccttggcagggattaaaagctgggacaaagaagcagaagtatgacagaatcagcgagaaaaaagtgtcaactcctatagaggttaggttacaacaacttgacaaaccgaaaggattttcattttggcattggtaggtaatctagcttttctaactgagcttggaatgtttcgatgtaggtattgtgtaaaaaccaaccgtccgagttcgtttcatactttcattactgccgatctttacggtttgatgacaaacctgattactcttacctcaagaggcttttccgtgacttgtttatccgagaaggttcttatcttaacatcattattccgagaaattttattcgcttactgtttcaagccactctcatcttatctttttcatattgttgaaactcttacaggttatcaattcgattatgtatttgactggacagtcttaaagtatcctcaaatcggatccagctctggttctagttcacgaacaagggtgattattaaaaatcttatacttgtgtttttaccctcatggtttttgagtttctctgtacttacgtaaatgtaaatctttggattttccagcatcatacaacagcgaaacccggattcaacgcagatcctattgaaagacaagagaggatcctaggtaaaattctgcttttcctacttctattaaaaatctcaaaaccatacacatccattcctcactctaatttctactctttttttatttaccattcgtgtaggaaaggaaacaacccgatataaaatcccaggtgcagtggaggcattctccagaagacacccgactacaacttcttcgcctcgagatcgttctagatcaagaaactcagacgacggacctttctctaagcagacagtaaaaatcttactctttacatacattgttgatcagaaccgctaaataagacaaagacctaactgtgtttgttttatttgtgcagcatggagactccgaaagagcaaacagttcctcaagatatagagcatcttcttctaggaaagccgttgctgcttcaagctcccggccaagttctgcaggtggaccaagcgaaagccgaacttcaagtcgtctggtttcctcaagcggtggtggtggcagcggcagtggaaatggccgtccctcaactagccagagagtgcaagctggatatgaatccaagactctgtctttctctcgtgcaacagcggcaagaaacactcgggaagatcaattaagaagcttcgagcttctctctcttcggaaataaaggaaaatgatggagagagagacagcaaactccatgaaaacccaaagaaattacctctgaagaaagatgagaatcttggtttgagggaattcatatatttgaacctgatgaaatcctcagatctttttacatgtaatttcagcttcagcttgcagagatctttttcactcgttttgtttatgtaatcgtgatatgtgttagacaaacataacaatcaaaaatgtagagagagtttccatgtaaaaacggtaaaatttctatccgtatattcgattacttcgaacctatctgtactggtactgtaataaacaaaacaatcaactgctctttggtctcttttaatgcttctgtttttttggggcaggcatactctggtcaaatcatgtaaaaacggtgaaattttggcttaatagtaaaattagctcatctacttagtcaaatcatactttagatgactccaatctaaaactctttatttttattttttccatacttcaaatgtttacttattcactgatcgtatacttgaatggttatagttaaactcttcacattttgttagcgctcatcttcgaataaagtggcaaaactgaatttcatattgaagttacacatataaaatacattcatttttagattcatatgatctactcctacatacttttgcatttcgactaaaaaagcaagtgctccaatacaatttttgagaaatgacaaatattcatcatcattcttcaaaactaggtttacacatgtgaagtcacatttttatgactttaatgaatcagttgcaatcttgatgataacagtcgaaacgtcatgaagtttaacaaccaaacaaacaatttgatcgctaatttctgcgatttattaattgactcgagactcaaataaacatgatcgcaaaaacggataaagaacgctggatttggttgactttttggtcaacgttgaggactaaaagtggaaaacaaaaataccaccaccaccgctagtactactgcgtctgagactgagagagagtattaaaatcaaaattaaatactttttcctttttaattcattttctcatcaataacacaatctccctggaaaaattctctacgacttcctctcgtcgtcgagcttgttattgatcggagagagagatcagtgttctttggatcttccaatttcttccacgtttgtgcttgaattgcagaagaagttttgtataggactctgttttgcttgttgatagaatttgggaatctagggtttatcgaatcgtttattttggttttcgtttagtttctcttcttcgagctggtgtttctcaactagttagagagtttctcgattggtcagagctgcttttattgaattttctttggatttcgtgcttatagatctttgaaaagtctgagaatcctgttttggagttactgcttcaagttattggaagaaattagggtttcgatccaattttagaattgactcaaggaattccgatattggggttttgttgtagttctgattctcagtgaataagatagaagataatcatg

SEQ ID NO: 705 - DNA, 3000 bp, Unknown
  misc_feature (1)..( 3000): cDNA_ID_2121939_gDNA_ID_1620309_Annot_ID_152924 3000 nt of promoter + ATG
ggaagtcatgaataataatctgtattagcgattcctgaagaattaagatatgtcagctctctgttttcaaattagttaaacaaacaaattttaatatgaggtgaataatcttctcatgtctctcgttttccagggaaagtcgtataggatccatgcatcttcctacaacaaaatattaaaccccaagcctaatcacattcaaacgtttaaggccaaaacatctattacccgaagtaatatttatctaaacgatggaaaatacattttttcactcaaaagagatgggtttgttattaatatatgcctttaagcactttacataccaaaaatattcaattgaaataatctcatttatccggttttgtaatcttattattataatttatgatttttgtaccaccaaatattgtggcatacctatatatgatctcattcctctttattttgaagtgcctagaacactagtcttcttcttttcatggttacgaaaatgtttacagaaaatcatggatgattcaagaaaatagaccactttttgagatacttttccgtaaaccctaagtatatccataatatctctacattgaccaatgacaaatagtagtttagatattgatggacttatgggagctagtttttattattaactagattttaacccgcggtataccgcgggacgatttatttttaaaagtaatatatattaaaacttgcaaattttatttttacaaaatatttatattttacagtttataattgttattaagtaacgctataccacgaattcatgagacaattgttaaaaaaactgaagttttgacccctattaaaacagcatattaataatattttaaaattttataaatattgattcaaatacatccaccatataacccaattccaaaataaaacacgttctgtaatttctttacccgtcccatgattatttttttaagtagtaatttttaaaattttagaattatttttatatataaaagttttgcaaattgtatcattctctaatacatttatattttatagtttaaattaaattaattaaaatttagatatcaaatcttataagttgattttgattggctattatttttaaaaattaataatgtatttcgtttttaattaattaaattaattaaattagtatttgactttttaatccttaaagagataaattaatttactctttaaaattttatttctaatggcatacctatgtaattacttacaaaaattaaggttacatttaaaatgtacttcccaaataatatagtaggataaattgttttatctatgatttatgaatatccacatcagttctgtaaaaaataaaactaaaagaaaaaccaaggagaaaacaaatcgccttgtaaaaaaccgtttttgataaatgtaacatttaggttttgtgttagttaagatccgaaacaagacaaatcttatacacgccataatccagtatgtcgaaatctacaccgtattaattattgctactatgaacaaccattctatccgatcatagactttactcttatttgtcgttattatcataaaatgtcgtttaaataaattatttgtaggataccaattctttaattatattagttcaaacacgtataattttggtggtttttgaggatgaatatcatcaaagataaatgcattttggtgaaataaataatcaaataattattttaaattatctttatgcaccactatttttaataaattggactcttacaacgttttccttaaaaaaaatcatggatcttaaaacttatacccaaacaaatatgtagaaaattattattatatatataaatatatatatatatatataagctatacaaaatcttattatatagtagtagcgcttgattctaaaatagcataattagacgaaaaagcatgcattttgtaacattttatactttgtaagtaaaacacataaaaaataattttatgaataagaaatccacataaaaaaaaaaagaagtaacatactgtgaaaaattaggaaactttttgaggcaccaattttttatgccactttcaaaaaagcattaatgaaaatttgtttaaaatatcattttaaaatttgacgtacaaaagtacaaaacctcatacaatttcaaaactttacaaagactcaataacatgtgttatagagactttataaactttcttataacatactctataattttttatatccatatatttgtgatatttttgaaaatggataaaataaatttgatatttttataaatagaaaatattaatggtatttttgaatttttcccaaaataattattagtcttatactccaaaatgtaaaaaaaaatcactttttattaaaaaaatacttacgcatttgcttaattgctagtcgtcaaagttttgtcattttatgcaaatactaaaaaaatgtagaaagcatttcctctttatttttgggacaaccaagaaaggagcatttcaatagtgtatacatagacaaaaatatttctcatttcctatatttgactctttaaatctttaatagctcttgtaattttttccattcattgtaatacagccataatgtttaaaaggaaactgtcaattataaacttatactagaatataaaatatggtattgaattgaatattttcaaaaataaaatattaaatttacgaaaagaataaaaaaacttaaaaatctctctctcctatctctcaaccacaacttatttttcatgtcagtatccaccaacacatatatacggcatataaaagattttaataaaaccttggaactatctatatctattcagacacacacgtctatatatatatatacactcatatactactttcactgtatcattcttgttttctctaaatttttcaaaaaacctttagaattttcatttttttacgattccgatgttaactgtttctccggctccagtactcatcggaaacaactcaaaggatacttac

SEQ ID NO: 706 - DNA, 3000 bp, Unknown
  misc_feature (1)..( 3000): cDNA_ID_3058443_gDNA_ID_1620309_Annot_ID_152931 3000 nt of promoter + ATG
gtgttccaatggatccatacgctcgccgtgtaatcgagcctgttcaattccggaacccgtttctatggaccgcagtgattcgtgggtatgcgatagaaggtaaatttgatgaagctattgctatgtatggatgtatgaggaaagaagagattacgcctgtttctttcactttctctgctcttttgaaagcttgtggaacaatgaaagatttgaatttgggtcgtcagtttcatgcacagacgtttagacttagagggttttgttttgtatacgttgggaatacaatgattgatatgtatgtgaaatgtgaatctattgattgtgcgcgtaaggtgtttgatgaaatgcctgaacgagatgtgatatcgtggactgagcttattgctgcgtatgcgagagttggaaatatggaatgtgcagcggaactgtttgaaagtttgcctacgaaggatatggtggcttggactgctatggttacgggatttgcgcagaatgctaaacctcaggaagctttagagtattttgataggatggagaaatcgggaattcgagctgatgaggttactgtcgccggatatatatcggcttgtgcgcagcttggagcaagtaaatacgctgatcgggctgttcaaattgctcagaaatctgggtattctcctagtgatcacgttgttatcgggtctgctttgatagatatgtactcgaaatgtggaaacgtagaagaggcagttaatgtgtttatgtcgatgaacaacaaaaacgttttcacttatagttcgatgatcctaggtcttgctacgcacgggcgtgctcaagaggctttacatctttttcattacatggtaacacagacagagataaaaccaaatacggttacatttgttggtgcgcttatggcttgcagccactcgggacttgttgaccaaggacgtcaagtatttgattctatgtatcaaacatttggtgttcaaccaacgcgggatcactatacttgtatggtcgatcttcttggccgtacagggcggttacaagaagcccttgagctgattaaaactatgtctgttgagccacacggaggtgtatggggtgcattgctcggtgcctgcaggattcacaacaatccagagatagcagagattgctgcagaacatttgtttgaattggaaccggacattatcggaaactatatattgctctccaatgtctacgcgtcagctggagactggggcggagttttaagagtgcggaaactgattaaagaaaagggtttgaagaagacacccgcggttagttgggttgtagataagaatggtcagatgcataagtttttccctggaaacctgaaccatccaatgtcaaataagattcaagacaagttagaagagcttgtagaaagattaacggtattaggatatcaaccggatttgagctctgtgccatacgacgtgagtgacaatgcgaagaggttgatactgatacagcataccgagaagctagctttagcgttctctttactcactacgaacagagattctacgataacaataatgaagaatttgaggatgtgcctagattgtcacaagtttatgcgtttggcatcagaggtcacagggaaggtaattataatgagggataatatgagattccaccattttaggagtggagattgttcttgtggtgatttttggtgagaatcgaggttgtacacagaccaaatgcaatcttcgaggagacttttcttgtgaatcaagaaaatggctatggagaattgagaaactgggatagttttggtcgaagaattttgaacacatctcgtgaagacttgagagttttaacagaaacgccacggatctgaatcagatcatagctagtgtatttttatgcgacttcgatcttgcttggtcctcatgggcttgggctgtctctataggcccaattatatacgtccttttgtgttagagctaattcgttcttttttgtgttacagctaattcgttcgttttttacgcatagcatatacctaccaaaacgaacgcatgtcttcgctgtagcctgtaattcattttttcactttaacaacttcgaatatgatcaataatacaaacactttcgtgttaatttttttcttcttaaataaacttttctattagtctctttgtattgctatcataagagtataatgtttggtatatattaagactttttggaaatatgatggtccacacaaagaggtatattcgactattcgtagatttgcgagaggatcaaacttttcgtcgtaaaatgtttaccaccgttttatttgtctgaaactgaaaacaacgaacagtgtctatttaattaaccaaaacggcagacacaaatctctgggtggagccgatttctacggaagtcaacaaaacgcaccgtcgctgcagatcactacctcctctttcttccttaacgaaaacgaaaacattgaacagagagcaagaacaaaaaggcacgaaagcaaaagaattctcaaactcctgagaaaaattcgagctccgtgtgattaattaggtaacgtattgctcgatcttcagatgaatttggagttttgctttcttcaagcttattctattttgcgagattttcggagaaatgataaattaattgatgtttttgagtttcttcctgatctcgatgtgttcgaatgtaattagatttgagttgcgatattgagagatctctgttgtttgaattttgaatttggatcttcctgatgtggttttgcttcttcaacgatggggtttatcgttgctttcccaatattttactgagttcttaagcttactcgtaaagtgattatctgctaggtgttcttctgcaattgcttttgattcaatgtcctctttgatgtgaagtaatgcttaatcaattcatattttgcagtttgtgttggtaaacttcaatcagatgagtttgatgatgaaagtttagaagagtgtttttgcttccaaagcaaaataaaaacaa

SEQ ID NO: 707 - DNA, 3000 bp, Unknown
  misc_feature (1)..( 3000): cDNA_ID_2121943_gDNA_ID_1620309_Annot_ID_152925 3000 nt of promoter + ATG
aggaaaaggtttttggtttagagaaagagaaagagacggtcaacgagggtttgactgaaaagcgccgcccaaaaaacagacaatgtgagaggttttaatgtttttgtgacggctttttgccttaacgtcccgttactgcggcgtgactttgcgtaatttgattgcttgatctcacgctccttcattaatctacatgactaccacgctctctaacgattaaatgagttttacattaatatgaatttccaagccttattttagtacccaccaatatgaatagccttttttttttttttttgtcggcccaatatgaatagctaatagccacggttctatacttctatgttgacaatgttgtcatttaaattttgtatagagatatatttatgtacaatgtttcgaatgaaatatgtagtaggtgatttagatatatggtttgataatatgtgagtaggtaaatgtgtcaatatctttttttaataaatggttagcagcttaagaatccagtttattttaagaatccaatttgtatcaacttaattatcattatatgacatatcatattgcaaaaagttttttctttttttttgaatctattgctaaaagattttgatttgttatttagatacatggcatacaggttgatacacaattttatttactttgggagatttcgttgatttcctgttttaagaaatcaacaacaatcaactttattgatgaacattgtttttttttttttttgaataaaatgtcaaattatatttaaaagaaaaaatatactttttacatcagcttttttgatattttgataataagagaaatagagctagatcaaaaacagagtaaatagaattgagagagcaaaaacagagtcttctttcttagaggatgctatggacgcatgtcaaaccatacttgcagccccttctcgagtcgaagatcccctttctttttgattgtcgatagctggtttctaatagtcttgtctatctgtcggatgaggtttgaagctgaacgtgacttctctccgtgacgacgagaatttctctccctccaaatggaatgaatagagacttggaatgtgtacctggataagaaactttggatgcgatcaggctgagaatcagatatgtaattcaccacagcagaccattttgtggaaaatctatctttgtacacattctttgcgattgatgtccagatttcagaagaatagcagcattggatattgatgaacattgttgtgtaacagctgtagaggatttcatatatgtaatatatgttatagttaactcatttaactcgataaataaaacaaatttagaattatattaacttttattgaataagtattttactttaacacatgaataatggatacgtctaacgttattgtcaaatgttaatccacacaaaagtcacaatttttttgatcctacaacataacacaaaaaaagagaaaaaatggtatttgaatcccgttacgttacagatacacgtatgtatgttagagtatcttcagtgaatctctcaaaaatgagtattggagtaataaaaagtgatctggagggaacaccatagtagattatgaagcttcaacacagatttaacgagagctttaacttcgaaaatgagtcacctaaaccaccgcttacaacaacgagaaataactatttctatgtctcctcagcaaagttccttatatgattttcttgtccttaaagaggtattttcttaaaacattactttgaagatatcttcataggcaaaaatctagaaattagaaataaaggatgtttaaaaatataaaatttaaggtttgctaatgctgaactgtgaaattaaaaccaacaaccacaacaaaccaaaccggaatatcatttaaaccaaattaaaactaaagggcgttcagtattcggatcgaatatttcgagtttgtgtatttcagatttagaagtttaagacccgttcgggtattttaaaattttaaaccgttcgagttcaggtttatttaaatattaaaatatcaaaattttgtatgtaaatttatcaaattacttgaaaatttcaaaaactctcaaaacaacacgaatagttttactttaatatatccaaagtaacctaaaatacacaaaataactaaaatatccaaatatccaaatattttctgtatttaagtatgaatataaataatatatcaaatatttgaggtatgtttggatatttgttcagatcgggtttgggttagagtttttcgggttttgaagtttaggacccgttgaatatttgaaatttttggatttggatcagggttttcggtcgggtttgggttggttcgtagggttcgattattatgtcgagacctaactaaattgaattacaaattggttttatggtttaaacaaataaagcgaaaccgaaataattgaaccgaaaccaaaccggaattgttatttgattgaacattttagatgcaaaaaatttgggttttttatttgttttaatattaaattaataccaacaataatatttgtgaattaattgtaactttgtaaggtttcgtaaggtgggccatgaaaccggatactcgagagtcgccggagtgtccttgccttcttctatcagttctgcttctgctttagaaattagggttccctttttgaagaagacgagtgtaagtgtctctccttctcgatttctcgctcatcttcttcttctttcaccccgcatagacctaatttaagctatcctcctctctcatcatcgcagattcacttcttctcaccgtgaagcgatggcttctttgttcaaggtacataaagtttagatttttatcggaaaccatttctgggttttgctttttctagcatagaaaatcgagattcgttaatgtttttagtgaatttagtatccgggttgtctggaatctgatgggtctgaagcgattctaattgatttttgaagttgttgtctagggtttggtctcacgatttcatg

SEQ ID NO: 708 - DNA, 3000 bp, Unknown
  misc_feature (1)..( 3000): cDNA_ID_2121929_gDNA_ID_1620309_Annot_ID_152921 3000 nt of promoter + ATG
tgtctataaaatatttgtttgtctataaaatatttgtttttgtacgaaattgcatagattcgtttgagcatttcagcccaagctttagaggaagaaacattggttacataacgaactaccaagcccattcaaaagcccattagtgtataaaacgaaagccctaatttctccaatacgcaaagtgagtgtcgaagagagagagataatcgaagaagaagagaaatgaaattcacagattctccggtgatcgatctgacggtgaacggcacaaaactctcaatccaacaagacaatggctctatgcacgtcggaacttccgtctggccttgctcactaatcctatccaaattcgctgaacgctggtcaacactagactcatcatcatcaacaacatctccaaatccatacgccgaactcttcgatttccgtcgccgtcgaggaatcgagctaggaacaggatgcggagtcgccggtatggctttttacttactaggtctaacggagatcgtactcacagacatagcaccagtcatgcctgcgctaaaacacaatctgaaacggaacaaaacggcgttaggtaaatctctaaaaacctcgattgtttattggaacaatcgagatcagatctcggcgttgaaaccgccgtttgatttggttattgcggcggatgttgtgtatattgaggaatctgtagggcaattagtgacggcgatggagttgcttgtggcggatgatggtgcggtgttgttaggttatcagattaggtcaccggaagctgataagttgttttgggagttatgcgacatcgtttttaagattgagaaagttcctcatgagcatctgcattctgattatgcttatgaagaaactgatgtttatatctttaggaagaaggtgaagaagaatgaagctgaatcagtgtcatgaagctagttttggttctgtaatgttgttgttacattgatatgtaatttgtttcttgttatagaattcgaattatctcaactatttatattttcttagatattggctactaaaagatgacaaaggctgaaatcaaatttttgtaacgatttttttaagaagtatacaagttttgttgtgtgtttttgaaatatatacaaagtaagttctcttgcccaaagaaatatgtgaagtaaccaacattgtgtttctatattagactgataaatttgttcacaaatgtatttgtagaactctcaattgggtgattgtatttgcgagttttattccacatcgttgtggagcggctgcggttgaagaaccaaagttcggattagaaacagctcgaacaagccaatcccaaatcaaaccgcatacatacgtgatatggtatttctatagtgaaggaagtgtcagggtattactttcacctttcaatgttagctctctactcatatcataatctatggaaggaaaaacaaaattaaaaaatagaggaaaaaaaatgatctatatatcggacatgtaatttttagagcacacatattatcactagagaatcccatctaagcacatgttatgatgtttgtagtaagagttctcatatatatatgtatatggtgtaagacactgatgacagttctcatatatatatgtatatggtgtaagacactgatgacagtaaccaaatatgccgttttgagcagccacattcaacaatttatgaaatataatcaaaatctaaattgttcttgaaatcaaacttaaacacttccatctttctttgttctttgcataataaagctcttcatgagctattcaatttctatcttaatatttctcaagcttaatgggcatcagtctaatcttgtttattacaatttgaagttcatgatgattaaaagggggagctaaaccacattttctatatgctaaggtcgtagctaaagcatctagaatcattttcactaagaaatatattctctcttccaaactacacgtttactcttatgaagattggaaaatcagagtaaaaaaaaatgaatcgattggacgacaaaagaaattaataaacaggcttagttatgggctaatttggataatgggcctttatagaaccaaatcagtgaaaactactataaaaaaaagtaagcggttggatttattacatgaactgggcaacggtcaggtccaagatccaaacacaaagcgacaaaacacaagtccaaagaagaaaaaatatatttattttaaaattaaatttgataaatgcaaagcgagagaaacaaagagagagaaacgcgagccctgaatcaaactccctcgattttcacaaaaaccaacccaaagaaaaaaaagaaaagaatctgacaattcaccaaacaactctctcaaagtcttaaattaaaattttttgtcaatcaattcacaaactcaaatatctttttatttttcaatataaattttcgaaggaaaaaaagaaaagtagaaaaaaatcatgattatgaaagaaacgaatagtcagaggcaaaacactgttgttgttgttcgttcgttcgttcgattgttgttgctgttcttcttctcacgatttcatcttttatttcttttaatattaaaattgttctcggtttatattaatgatcttgtcgatattgcgagactaaaatgtttaatgtttttgattttatttgtgaaattcccaatcacattcttagtagtagagagagaaaggttttttctttttggtcttttggtggacagatttttattcttctttacttcttcttcctctttttcgtcaaaccataaacaataatccaaaccctttgttcttcagatatgttcttctcttgacacacacctaatctttctccaccaaaatttccgaccaagtctcatacttttgatctgtttttcaactttctcatcagcccaagtaagtatttttttcttacccatgactgaaatcaatttcattagtttttgtaatttctagggtttccaattttgtggatttggggattgttgcagaaa

SEQ ID NO: 709 - DNA, 3000 bp, Unknown
  misc_feature (1)..( 3000): cDNA_ID_2121887_gDNA_ID_1620309_Annot_ID_152908 3000 nt of promoter + ATG
gctgagaaggtgattgtcgttgcgcgtttcattgacagggaaaactacgttattgaagattcttgctggaaaacatatggttggaggaaagaatgttgtacaagtgcttgatcgctcagcatttcatgatacagagcttgtttgtagtggtgatttgtcttacctaggaggatcatggagtaaaactgctggttctgctgtgagtactgagatctcaaagttaatacactgcaagagttttgatgtgagaacgttttgtttctaattctttaaaattctttagggtgatattccactccaaggagacttctcagcagaacatatgatatttggaggtgagattctctgatcctagtatgagtttttagtgaattgtttcgttgtgcttatactctgaatatgttttgtgtttagttgaagggattgatcctttcagaagagagaagttgattgatcttcttgatatcaatcttcaatggcgtatgcataaggtttctgatgggcagagacgtcgagtgcaaatatgtatgggtctattacatccgttcaaggtagtataaacaacaatcaactcttcattgtggtctctgttttttctttgatcatatctgatacttaaattgtaatgatcacaggtattactactggatgaagttactgttgacctcgacgttgttgctaggatggatttgttggagttctttaaagaagaatgtgaacaggtaagccattcactaaccccccctcatcttatgtttagaaatatcaaatgctgattttcatgttttatatttgagtagagaggagctacaattgtatatgcaactcatattttcgacgggctcgagacatgggctagtcatttggcttacattaatggaggagagctgaaactctcggccaagttagatgagatcaaggatctcaaaacctcaccaaatctgctatctgttgttgaagcttggctccggtctgaaaccaaagttgagaaaaagacgaagaagaaacctgttgttacctctccatttatgtcgtctagacaaatggcatattaccgatgaatcttaacttgtttatgagatcagtaagaataagagcactgcttctacagatgcctttgttttctatggtacttcattgtttagaatccgataacttttatcacacatgaaagaatttctgtaaaaccacgtttttaattaaattactattttgccaatatttaagagcttatattcaaaataggcattttaaataaagttatttcaaaataggtattttagacagttgaatgtaacagtatcgatttattgcttcaattgggacaattttgtccttgtcttcttttctcttcttcttcatcgaacatagttgcagaatctgatcaaatcgatttcttcttaatttttcaagcaaacttaatttttttttttaattacacaatattaaaccttaagatagtatatagggaacccaatcaaaaaattttatagattttatggaatttcagttctgattttgtgtatatatgcatgtatatacatgtgtatttgtgtaattatgccactgaacaacaacccataaattataattgaattctaaatcaacgcaaaggcatctcgattcctctttaaacttcacttaattggctttttgtttgagaaatcataaaatttggaatcagacatcgccatggaatatcaaaattgtttttgataccgacatttctctattcatcatcttcatcggccagatattccattttgatcagtttctgaattccaatttcaacgctgcattaacttaataaactattataaccaaacgttgaggattcaacgattgaaaccgttcacatgtctcgtcctttgcgagtgagtaaatagaacgtgtggagaagatgacactagtgaatgagggagaaagatgacttttcacgtagtgatagtacctgtttttgaatgctgggtcaaaagtgcctaaaagcaaatatatttataaaacaaatgccttatttgaaattaactcaatatttaactgtttatgtccaaattttggtttggagcggatccttcttaacactcgcatggcaaaatatccgatcgaatcgaacccaacctaaacccgaagttaaaccgaaatacctactcatagtagagaaatctaaataaatactaaatcttaacgttttacttttatttttaataaactatataaaaatagaaaagcatgtacatgttttgccttttgcgtttatagtttttctttttcaacacaaaaattgctgtaacacaataaaaaatattaaaatactagtgtaaaaacaatttttgcaaaatttaacaactgttagagcatgtcacgcttaacctctaaatatcaaaaaccaaaaaaccaccatattaacttttgttcccctcttcacacacctttttttgtttgtttcctacacaaaaccttaatctggatatttttgttaatttatccgactgtaaaaataattaaaacctaacttatcaataaataaaaaaaaatcttttctaaaggaaacccaaaacaaaaaaaacacaaaggcacgacaaaaaaatgtcacaaatctccatttcttctcgtctctcttcgtattaaccaatttacccaatatttcgtgcccaattctcgggtcaaatccatctaaaagtttgtgcttttcgtattgggattagttcgatttctaaatctgatttagggttttaatcaatttggcaatcgggtctcttgcgatgaagttttcggagatttattgatttcatggtgggtttttgttttcgaaggtcgttgatgaagaattgacttctggaatctcaatctctgaagggtttttcgatgttaaatccgtgaatctgagttttaaatgctgaattggaaaacagatccaggggctaattaacgaaaaaaggaggtttctttttgatatcgatttttgggaattttgaggtttgagagagatcggagaagatg

SEQ ID NO: 710 - DNA, 3000 bp, Unknown
  misc_feature (1)..( 3000): cDNA_ID_2121922_gDNA_ID_1620309_Annot_ID_152919 3000 nt of promoter + ATG
tataaaattaaactataaaatataaatgtattagagaatgatacaatttgcaaaacttttatatataaaaaataattctaaaattataaaaattactactttaaaaaaaaatcatgggacgggtaaaaaaattacagaacatgttttttttttggaattgggttatatggtggatgtatttgaatcaatatttataaaattttaaaatattattaatatgctgttttaataggggtcaaaacttcagtttttttaacaattgtctcatgaattcgtggtataacgttacttaataacaattataaactgtaaaatataaatattttgtaaaaataaaatttgcaagttttagtatatattacttttaaaaataaatcgtcatgcggtataccgcgggttaaaatctagttttcttttaagaggatactaatataacaattattgtaagacaataaccacaatggtttataattttatattatgatgtaacctactttaacgtttttcggaaaatttactataaataaaagttttcgtattcaaaatctcccctttgccccactcatgttatttttcgcatcatgtaaatgacatttgactcagcatctctattatattcatcttcgaatttcactatttatcttattctcctaaacaatcaactttattgaatcagggtaataattaattatatttatagtgttcaactctttttccatgggatgcattgtctattatattgaaatcatataaatgggaaatggtgtaaagtttgagcatcgtcatttaacccaaaacacacataaagttaactaagttgtatcatcgatcaagagactgattcacgtatatattgggtcaaggaataaaggaattcaaagaaataatctggttttataagcatattcggtgcagaagataaagtgaagatccatgcatattctccattaaagagtaagaaaggtcttttcttcttgtatgcaagaatatacaaaaacaaaaagcatagatagagtggagaagtggtggctgtggggacaatgaaaggtggagacttttgaagctcaattattaaaatcataaccctaactcgaaggcaaaaattttatactttatagtggaggaaaagaataggaaaagagaaaaaagcttgatattcctagcttaggctttttccaccttttatcttatctcccttttgctctctcatgaagaaaattagattcagtcaaataagaaaaatagaaattaaaaattctccaaaacacttttaagttttcttcaaaatttatcgacaatataaacagtggcggttcaaaaatataattgaaatgactacaaatattttcgaaataataagatataacattttctttaaaagccacaagataagttcaatatttaagggtcaaacaaacataaaatctataaaaacatgtatataatggggtcaacacatacaaaagtagaaaatattacaaacattcaagggtaataacaaaaagttgtaattttagggggttcaaacaaaaaaactacaaaactttaagaaccataaaatcaattcaccccctaaagcttgctcgataacatcatataatattattttttaccatgtagtcattgtttcggagatgtaagatatgcatgacatatatagtttaaaaaagaaagtaatgaacatttagggttatttttaatgacaataaaaagttaactactaaggctaaaattgtatacataataattatagtatactcggactctacctatgaaacataggtcactactatattgcctcagtaaccttcaaagacgaaaaaacctcaccaaactgcttctaaccgtgaccatcagattctttaaaaataacatcttcaatataatacaattggtcatgtcatttctgttgcttatgaaccagagcacacagtttataaccctcaccaagcatagccttcaaagcttcaccaacctactctaccttagcagtttgtatctcatctaccttactagataggccgttgatttgtgtctcagcagcagtctcaccaaactgctccattgccaaatttttagtttgtgcctcaacaccaagctgatatccctaatcatgacacatacaatatatgtgttggcgacgattgggaggttgattagatagttaagcatttaaaaattttgaaaactgatttgatgaaactttgtaatttttttgtttgttgttgtgcaagtgagattttatttatttgaacaaagacaattagggtgatatagtagtttcaaatcatataaacgacatagtatgagtaaagactcttcttcagcgcaagtatctcctactcgagctcttccttcttgaatcctttctcttagccactattcctcatcctttgcctcttctcataccttctagccattcttccctttctggctcctttactcacaaaggctaatgacacgacaagactatcaaatttgagtaacaagtgatttgtgtttaaaaacaattaaaaataaaaagataaatacagttataattgttgaaacacaccaacaaaacatctccgatttgacccaataaaagaaacatgtagggcaactaaattcattgtccattcaggacaaaatattagaccaaccaccaaactttagcttttgcctatgacattgttcttatatcctactattatgtttgcacaaactcgagtataaatgtataataaggcattaagccattaaattgtttaagccattaaattgtttttgtaaaatatttgtctataaaatatttgtttgtctataaaatatttgtttttgtacgaaattgcatagattcgtttgagcatttcagcccaagctttagaggaagaaacattggttacataacgaactaccaagcccattcaaaagcccattagtgtataaaacgaaagccctaatttctccaatacgcaaagtgagtgtcgaagagagagagataatcgaagaagaagagaa

SEQ ID NO: 711 - DNA, 3000 bp, Unknown
  misc_feature (1)..( 3000): cDNA_ID_2121918_gDNA_ID_1620309_Annot_ID_152918 3000 nt of promoter + ATG
atcaaaatctattaacatatttaacataaaatatattgtaaaatatacaaataatctaacgtagctgcataatgtgcttaattagctcaaatgacaattacaagtattaagctgattgattttatttttttaatcgatcaacttgagaaagagaaaagacacagttttaatgtggactggctagaggtttatcaaaaactgctttcatgtataaaatttattaaactcagggattattagtagttaacaaataagaataagataaaaacagcttatgagtttgtatgactgtcaaaatgtaatgtagaagtatagaattcaaagaagattaagaactcaaattataaagaataactctctttattagtttaggaagattctctcaaaacctaaactctcttaatctctcaaactcataagttgtatcacaccttgatacctccttatataataagcttttaaccttatcctaattattaaataactcctaatattataagataactcctaacaatatattctagattatctcctagaataataaagcttaatttccttttctctttagtaacttgctcttcaagttacttcttcttcttcaagcttattccaacaagaagaagttcagattgatgatattccaaaatagtgatatatattcgcatgagatgtaaatgaatttcgcaaagatgtgagaccaatacattcttatgttttgcggaagagataaaaatttactttgttaaattacaaatatttatgtatatactttttccaaaagaataataagctttgttacttgataccactttcttaaagaaaaaagaggggagaaattttatcatcgaaaagcaagaaaaattatacttttatccaccattcaataaagacaccaaattttcttctcaaatcgaaaaaaaaagtgttagcaaaaagaaaaaaatccaaaaaaaaaatattcataaaaccaaaatgttaaataataaataaataggtaggcgaatcagtttaagagttgtaggttctgaagagattgatttcagctagcttcatcgtaataataaaatttcaacatttgattttactgtcgaacgaactctcaagtctgaatgaatgtctaatttatcttaggtatttttgtcgtatgttgttggagtatacctaaagagcacgtgcatgggtacacgtgcatggcaggctttgttcgacttcgacaaacaagagatgtgaccataaccgttggatctgttttacctctttcacatattgtgaaaaattctgattcatgaataactaacaaaaatgactatgtccgtatatgatatctgatgggagtgaatagtgatcccgttaactgtgtatttaaactgaatacaactattgcaaagaaaaaggtgatagataaagttataattttcttattgatcactaatgtcaatcaatttttttaatacattgttttgttacttatactgcataccttcaaattaataagcattatagagattgtgcaattgataaatcagattaatgtttttatttgttggcaaagcaaatgtatcttattgtaactagatatacattacaatactttgtaaacataattcatttaagataaaatttacggatatataaaaacatatatatatatatatatacatataacaatttctttatgctatctgtatcaaagtactccttgaatccaaaaagattaactacactccactacagcctcatcattctttaggcagattgatcgatgcatttcgtattatatactctacaagcttgaaaaaatcacaaggcgtacacaattttgatctcccagtagtttgtttacatatgcgtaaagccctttctagtgcctaatattgttgtatctagatttttgtttatttttattttatttttggcaaatgaacctttgatgctacgaaaagatcttctaataaactgttccttttggtaaataacttcacattttatccccaaaaaaacatatagaaagaagtgtaaaaaataaaataaaaaacaaaaaaaatatagtaagattgtttttttgcactgagttaacatgagcatgtaggaacaaaaagtaagtaattattggacccaaaaaaccagaaaaaaaaatggagaggaaagggcaacacaaaaataacgagataatcattctcaatagaaaagatagaaatatcaactttctatgtgtcataacgcactactacaacaaaattacttcgaatatcttggtaatttaattacattttttaacagctcgcttcgaatttgcaaggctattaatcgatttttctaagatttaatataaatgaagcatttgatgctgtatgatgcataaatacatgattatcatttgtgaaaaaatgtaattaaaattactcttagcaaataccatgtctatacaaaactaaggatgtatgaacatgaaataaaatgaatcaaactaaaagaaaattgtttattatattgaaataattcatagtgaaactgcaaacatagggtgcctataaagtaatcaagggatgttaaattttttctatctctgcattttgaaattttattggctctgctgctatcactttcagcttatgattttccaccgccatccactttgctcttttaaaataatctcataaaggaaaagaaaaatacaattaaccacatattttaatcaaaatggctgcaacagtttaacatatcaaggtgctaatatacccacacacacacacttatatataggagctaatatagagtggtataggttaagacaaaagccatatataagtggagaacccaatatatctttgtctttgttgttttttccttctcgttcatagttaacttgcagatttcttagtatttctaatctttttcttatattaaccttttgtctccttctctctctctctctctctgaactatacaaaaacctacttttaatttctcttccaagaagtcaagaacccagaagaagac

SEQ ID NO: 712 - DNA, 987 bp, Unknown
  misc_feature (1)..( 987): cDNA_ID_2121994_gDNA_ID_1620310_Annot_ID_152941 3000 nt of promoter + ATG
gatcgtggttttcgagcttggctgtgaagatcttaccgatcctgggcagatttacatgtttcaaggccttctagctatgctgccgccaacgactcctaatggaaaaataatttgaagtgggagagaaaagaaaaccatttggatggttgaagaagaaggaaagctctccaataaagccccggcttcaagaacttttgtctcagcccggtattcggttgagtttcagtcggattagtatatccgttttaggcttaggaccgaaatagtgaaagccaaggagtcaaaacctttctgaagttgcgcttttggcgtagatgctattaggacacgttctacactcggatcttgagggactaatagcttggaattggattggatctcaggataggatttgatgtgctttgtgttagtaattgtttttgtgtcattgggtgaatttaggtggtttaagagatgatttcacttagagtcgtggtgtaatttatctcgttatggttgaaaaaatacagtgaatttcagttgggtaacgttgaatccatcttagtgtttcagggtgatactagactgattcattgtatttggttaaaatatgttgtggtctaatgatttgtacctttgaattggttaatggaaagttgttgttgagccaaaaaaaaataaaaaaaaatcaaccgactctgctaagaaaaggaaaatcagtcgattactaacggctacttatggaaacaaatggaaattaaccgactttaattttaagctaacagtaaaaaaaacactgacgttatatgttgaaaatttgaaataaccgactttggtttattatttgtatcatcactattcaaattacctttacggcccaactaaataatatagggctttgaagaagcccatctagaagttaatataaattaagtttttaagggcacaagaatgacgtcatattagtaaaccccaattacaactctgattctccttcccggcgatatg

SEQ ID NO: 713 - DNA, 3000 bp, Unknown
  misc_feature (1)..( 3000): cDNA_ID_2122063_gDNA_ID_1620310_Annot_ID_152963 3000 nt of promoter + ATG
cgcagcttaagtggggaagggggaagtgggactggaagcctttcacggttgcaaggtttgggacgtgctgcccggagacacttatctgcgatccttgatgaattttggggacatttatatgattttcatgggcaattggttgctgaagccagggcaaagaaactagatcagctgtttggcactgatcaaaagtcagcctcttctatgaaagcagattcgtttggaaaagacattagcagtggatattgcatgtcaccaactgcgaagggaatggattcacagatgacttcaagtttatatgattcactgaagcagcagaggacaccgggaagtatcgattcgttgtatggattacaaagaggttcgtcaccgtcaccgttggtcaaccgtatgcagatgttgggtgcatatggtaacaccactaataataataatgcttacgaattgagtgagagaagatactctagcctgcgtgctccatcatcttcagagggttgggaacaccaacaaccagctacagttcacggataccagatgaagtcatatgtagacaatttggcaaaagaaaggcttgaagccttacaatcccgtggagagatcccgacatcgagatctatggcgcttggtacattgagctatacacagcaacttgctttagccttgaaacagaagtcccagaatggtctaacccctggaccagctcctgggtttgagaattttgctgggtctagaagcatatcgcgacaatctgaaagatcttattacggtgttccatcttctggcaatactgatactgttggcgcagcagtagccaatgagaaaaaatatagtagcatgccagatatctcaggattgtctatgtccgcaaggaacatgcatttaccaaacaacaagagtggatactgggatccgtcaagtggaggaggagggtatggtgcgtcttatggtcggttaagcaatgaatcatcgttatattctaatttggggtcacgggtgggagtaccctcgacttatgatgacatttctcaatcaagaggaggctacagagatgcctacagtttgccacagagtgcaacaacagggaccggatcgctttggtccagacagccctttgagcagtttggtgtagcggagaggaatggtgctgttggtgaggagctcaggaatagatcgaatccgatcaatatagacaacaacgcttcttctaatgttgatgcagaggctaagcttcttcagtcgttcaggcactgtattctaaagcttattaaacttgaaggatccgagtggttgtttggacaaagcgatggagttgatgaagaactgattgaccgggtagctgcacgagagaagtttatctatgaagctgaagctcgagaaataaaccaggtgggtcacatgggggagccactaatttcatcggttcctaactgtggagatggttgcgtttggagagctgatttgattgtgagctttggagtttggtgcattcaccgtgtccttgacttgtctctcatggagagtcggcctgagctttggggaaagtacacttacgttctcaaccgcctacaggtaacaaaaaccgcagtagttcattgaaaatcacagttttgcagtttgaaaatattgacatgtatggatttaaacagggagtgattgatccggcgttctcaaagctgcggacaccaatgacaccgtgcttttgccttcagattccagcgagccaccagagagcgagtccgacttcagctaacggaatgttacctccggctgcaaaaccggctaaaggcaaatgcacaaccgcagtcacacttcttgatctaatcaaagacgttgaaatggcaatctcttgtagaaaaggccgaaccggtacagctgcaggtgatgtggctttcccaaaggggaaagagaatttggcttcggttttgaagcggtataaacgtcggttatcgaataaaccagtaggtatgaatcaggatggacccggttcaagaaaaaacgtgactgcgtacggatcattgggttgaagaagaagaacattgtgagaaatctcatgatcaaagtgacgtcgagagggaagccgaagaatcaaaactctcgcttttgattgctcctctgcttcgttaattgtgtattaagaaaagaagaaaaaaaatggatttttgttgcttcagaatttttcgctctttttttcttaatttggttgtaatgttatgtttatatacatatatcatcatcataggaccatagctacaaaccgaatccggtttgtgtaattctatgcggaatcataaagaaatcgtcggtttgaaatgttaaatctcctaaaccggatctctgcacgtagctgacacatcgacgctagattactgacacgtgtccttatcaatatttcttctcgaaacgtcttactgtttcataaagtccttcaaatttctggggaactaagaaaatccagcagagtaactaatccaatgggttatgtaatctacatatcgttcccggcgattcttctccttctgatcgtcgctatcgccttttatctcatcggacgaaaaatcggccggagagaagggattcaatcaacgtcgcagttacactacggaccgccgttggctaattttccggcacctgcaccaccgcataaagctatggagaagccaccggagccggtttagtgtatgtatgatgacgtaataatacttacgtattacgtaaacgttctatatatgtagtttgtgtgttaaataagatgtaattgggccgatgctgaaaccaattttaaaacaactctttattgggcctggggtttaaggaaacacttcgtgccgtttaaattccgtactcacctaatgcaacctagaaactacgcagcgttttgacggaagaagaaatattcgcttcttcttttacaacttttgtcccacaacgcagaaaagtcctctctttctctctctcgaataataatttttcatttgctgcgtccttttggtgcttgaagcg

SEQ ID NO: 714 - DNA, 3000 bp, Unknown
  misc_feature (1)..( 3000): cDNA_ID_2122067_gDNA_ID_1620310_Annot_ID_152964 3000 nt of promoter + ATG
cgccttttatctcatcggacgaaaaatcggccggagagaagggattcaatcaacgtcgcagttacactacggaccgccgttggctaattttccggcacctgcaccaccgcataaagctatggagaagccaccggagccggtttagtgtatgtatgatgacgtaataatacttacgtattacgtaaacgttctatatatgtagtttgtgtgttaaataagatgtaattgggccgatgctgaaaccaattttaaaacaactctttattgggcctggggtttaaggaaacacttcgtgccgtttaaattccgtactcacctaatgcaacctagaaactacgcagcgttttgacggaagaagaaatattcgcttcttcttttacaacttttgtcccacaacgcagaaaagtcctctctttctctctctcgaataataatttttcatttgctgcgtccttttggtgcttgaagcgatgaccatggcagcaaatctagcgcgacggctgatcggaaaccgatcgactcagatccttggagccgtgaactctagctcaggtgcggctagttctgtcgctagggctttctgctcctccaccactccgatcaccgcaactctcttccctggcgatgggatcggtcccgagatcgccgaatctgtcaaaaaggtccctcatcctaatctcttttctgcgcagaatttcgagttctggaagtcatagttacgagataattgtttgattgaattttgtacgataatttgtgggaattcggcaattttgttgatagtttttgcgttttgtactgatccaggtgtttacaacagctggtgtaccaattgagtgggaagaacactatgttgggactgagatagatccgagaacacagagtttcttgacatgggaaagtctcgaatctgtgcgtagaaacaaagttggtttgaaaggtccaatggctactccaattgggaaaggtcaccgttctttgaacctgactcttaggaaagagcttaatctatatgccaatgttagaccttgttacagtcttcctggttacaaaactcgttacgatgatgttgatctcattaccatcagagaaaacacggaaggagaatacagtggccttgaacatcaggtttagtttgttttaagtctattgatcgaatatttcaggttagttcttctaataaatgattctaatgatggttttgttttctcctgacgcatataataggttgttagaggtgtggtggaaagtcttaaaatcattacccgtcaggcgagtttgagagttgcagagtatgcttttctctatgccaagactcatggaagagagagagtttctgctatccacaaagccaacattatgcagaaaactgacggtctctttctcaaggtctgcccgttttataactccaagcatttcttatacggagggatcaaagcaatgattgttatttctgctagtttttttttttttacattttgttctgagaccatttttattttgcttccgtttttcagtgttgtcgtgaggttgctgagaagtatcctgagatcacttacgaggaggtcgttattgacaactgctgtatgatggtaagctatgacaccgaatctactattttttcgttaattaagttagtggtcgggactcgggatcaccttgtagatttagaagtttggtttcttagcaacttgtatttgagttctgcttttccactgtttttacatgtggaatatgcgactgataatcttgagatacctgcagcttgtgaaaaacccagcactttttgatgtcttggtgatgccaaacctgtacggtgacattattagcgatctgtgtgccggattggttggaggactaggattgactccaaggtaaaaacacttgttccttcatcttgtgtaatagtgatctttagtatgattatgagctacatcatcttaaggccttattatctttgacgcagttgtaatattggagaagatggtgtagcccttgctgaagcagttcacggttctgcacctgatatcgctggaaaggttggtccttcaaacaatatatcattccaatttcatcatttacgggctaaagagtatcatttatgcatccaatgttgaaagattaatatgtgtgatttttaaatttgttgttgtctttctgttttgggtgatgtagaacttggcgaacccaaccgcgttgcttctgagtggagtgatgatgttgcgtcacctgaagttcaacgaacaagcagaacaaatccacagtgcaatcatcaacaccatagcagagggcaaatacagaaccgcggatcttggaggtagttcgaccaccacggaattcacaaaggcaatctgtgatcatctctgaacatcgtaaaatccaattctttatcgaatcttcttttgggagccttttttatagcctcgaattcttcttgttttcttgttttacgattagaataaaagaaaaagcaaaaaaacggctcttcatgagttttgaagttattgtttctgccttaaaatttctctgccgtaaggcaagaagattcataacactggaaaaagtgatgttctttctgaatcgatcagaagaattttgttttgttgcttgaattgtttacatactcttataacttcaatcagtttatcaatttcatacatacatccaaacctttttttttcttttcactcgtagaataaaatgagtaaattactatgattatgaatgaaatgacaaaatcatcaaatgaagaaaactcatacatttgtaaaccatttcaatacaaattagtcggtccacaaagaaaagagtactaatttagtttaaaaattatacttaaaaaaaatctaaaaagagaataataatgtgtcgttggtgcaccaacttcccctcgagctaagattataaaggcaagacgcttcactcagcagcagtaactaaacttgcctccaaaaaccaatcccagatctgaatctcaacctaaacctcagattcatcatc

SEQ ID NO: 715 - DNA, 3000 bp, Unknown
  misc_feature (1)..( 3000): cDNA_ID_3058470_gDNA_ID_1620310_Annot_ID_152961 3000 nt of promoter + ATG
aatatggataatgttgagtatgttaaatatatagtgacaagttacataaaaaaagcctaaagaaatcaaattggaaaaaatagtaaggtacaatgtatggttatcgaaagcccaagctgtacttccattgatgtaggagatgattaggaacacgtggattatatttgaccaaaaatagtagaaattctatttatatttgttttcttcttttggttttgggtttgattttgtgatttggatagttcggttaaggatggtttgatcaatcaatataaccatactaaaatatgattcagttaactaactatagtaactgtttcttcgttagtaaaatgatacatttattggaatctattgacaaatcttaatgacttattataactggtgataacaaaatctagctattattttgtatccaactacatattttgtataaaatggaaattcgtatatgatatttgtttagtttaaaagtagagtgtatttgttttttcaatgatgatttaatgaaatcaagctcttagttgagatcaaaagacaaataaaacaaaatgtttttttttgttttgtttcttttctatttgagggaaggccatgaattcttatttttgacaaatagttgttctatgcaattaatattgatgtctaatacatatacagcagaataaataaaaacttgctatataaagacgtattatttatagcattctgtggagtataatgtcgaatcctgttctcatttccgattttacatatttatggtactaacgccttcatttatttttccattttcgttagtcaacaacttcagcttttgataacgcctaattgtatcatcaactttagttagttttctcaaataacgtcattttcaaataaagtttttgatttctcttttattatatttatgcaaaaggaaaattataatttcagtattttgcagaacgctgaaatgtataatagaacctattcatgtatttttgtaaaattttaaagattgttttaatactaaaataagtaaatcattaaaaaaattcctagacattggtctctaatataagataaatagatctaaattatgtttggattttaattctaataaaaaggtagccaaaagttatatatacaatatttaaacaattttatttgtttaagatttgaattttatagtatgcgagaatcgcgtaaacttttctcgaatgtaacaaaaaatttcaaatcttctcgacacatgtaatcttttgcgagttagaagatttgattccttattttttgttcgtattcttaaagttagtcacgtttatattatttttcgctttgtaaccgtccctttaaatttttaataaaaattaaaaaaattgctagaaaacaacatttttgtattactcaaatcaaaagtacaaaaataaatttagctagcgtttcacaaaatcaagtaaaataatctccatttgaaactccataatcaagctgtttgatgtattattattacatgtaatgaggagaaagaggggtcgagaaatttaaagtaataataattctcttcttcgtccatggaataaactacgattagtttaaaaagattaataaagatggattaaagaaactatatgttaaacctggaaaatttatttaaaaagacgtttttttagctataagaaaaaaaagaataatacctttatttttacatgttatttacaagtaataattttttttttctctctctctctttgaaggtggcacgagcacccataaccttcagacctatagatacaaatatgtatgtatacgttttttatatataaatattttatataattgatttttcgatcttcttttatctctctctttcgatggaactgagctctttctctctttcctcttcttttctctctctatctctatctctcgtagcttgataagagtttctctcttttgaagatccgtttctctctctctcactgagactattgttgttaggtcaacttgcgatcatggcgatttcgaaggtgacttctttcaaaaaccctaatcctctgtttttttttttattttgctggggggctttgtacggactttcatgggtttttgtagcttttccctcggcttttgcgcaaatgagactttctgggttttttttccagctttttataatttcatcaggtggatcgaattcgtagtttcagcttagatctctctccctcttcattatctggactttccagacttggagttcttcgggattgttttcggtttctgggttttgttttaattgcgagatttaagcttttttcttttttactactgtacttggtttgtggttgaccttttttttccttgaagatctgaatgcgtagatcatacgggatctttgcatttttgttgcttttcgtcagcgttacgattcttttagcttcagtttagttgaaatttgtattttttttgagcttatcttctttttgttgctgcttcatactaagatcaattattgatttgtaatactactgtatctgaagattttcaccataaaaaaaaaattcaggtctgaagctgatttcgaatggtttggagatatccgtagtggttaagcatatggaagtctatgttctgctcttggttgctctgttagggcttcctccatttggaccaacttagctgaatgttgtatgatctctctccttgaagcagcaaataagaagaaggtctggtccttaacttaacatctggttactagaggaaacttcagctattattaggtaaagaaagactgtacagagttgtataacaagtaagcgttagagtggctttgtttgcctcggtgatagaagaaccgactgattcgttgttgtgtgttagctttggagggaatcagatttcgcgagggaaggtgttttagatcaaatctgtgaattttactcaactgaggcttttagtgaaccacgactgtagagttgaccttgaatcctactctgagtaattatattatcagatagatttagg

SEQ ID NO: 716 - DNA, 3000 bp, Unknown
  misc_feature (1)..( 3000): cDNA_ID_3081744_gDNA_ID_1620310_Annot_ID_152946 3000 nt of promoter + ATG
agaaaaaaacaaatcaatcgtcaatgaacccatgcttgttctacttctaacaaaactttcgttatgattttggctaactatgtacatgtttttattttattttttgaacaaagatgtacatgttttactaggtgaagtttattactagactatcatttcatcgcttctgaatttatttattagtgaaaatagaggttagatttagtgccaatatattgttcgatatcacattttgacttctctcgggtgtacactaaattacgtttaattcttcgtattacttttcttggctttaattttgtttacgagtaatttgtacttccaagttttgtaaaatctttatataaaaagtagtggaaaaataaatacaaattacaaaaaggcttttttgagttcctaaaactttttgggagtcaaagatggtgctctctttaaacaacgggaactttttgcatcgacctatatgctttgttcttgggacacagaacattttcctttgccaaatacaatttcttgggtggataaaattttccttttatattaaaataggagttgaaactatgtccaattaaattaatatgtagatccgaaacatagctagtacatatcaacgtagattttttataaaataagtaataaataaagagctactgtttcttagtctcaaaataccttataaaaagatattgttttgttttataaagaataaaatgaaatttgttaagaagatatatatatatatatatatctcaattagtctatatatagggagtatatatatatatagttattgattactgcttctaaaatatgcaacaattatattggtacgtatataaattgtttttttttaaaaaataaataaattcaatttgtagaaaaaaaaaacttattacaaataacataaaacaataaaatgccgaaactaagaaaccctttaaagttatgaccgtaatagttaaatgttgtatctacaatcctttgaaactatatctatgtgaatgaagattttagttgaataaagaataaatccaaaaatatcatcaaattatgcatcaacattaagggtgtcaaaatggatcaaaattcatggatcaagtcaactcaactcaatccgtaaactctaatgagttcaaaattttgactcaaatgagttgatgagtcaaatgagttgatgagtcaattggtttgatgagtaaaatgagttgatgagtcaattggtttgatgagtaaaatgagttgatgagtcaattggtttgatgagtaaaatgagttgggttgtaatggttaatggtttcaatggtttacccaattaacccatcaagttttgtaaaattgaattaaaccaactaaaatctctaaaccaatgccaatttaagtttaaccaacacaactaaaccgatttaataaaattaatatttttctaaatttcttaaatatacaagcgatgaaattgagaaaaaagtaaactcgtaattttccaccaaaaaacataaacccgtgattttcctgccaaaaatttaaacccgtgatttttcccccaaaaacgtaacccgagatttttctgccaaaaatataaacccgtgatttttctgtcaaaaacttaaacccgtgattttcccgccaaaaacgtaaacccgagatttttccgccaaaaacgtaaatccataatttttccgccaaaaacgtaaactcataattttcccgccaaaaaacataaacccgtaattttcccgccaaaaacgtaaacccatgatttttccgccaaaaacgtaaacccgtgattttcccgccaaaaacgtaaatccgtgattttcccgccaaaaacgtaaacctaagattttcccgccaaaaacgtaaactcgtaattttcccgccaaaaacgtaaatcttttaaacaccgtgattttcccgccaaaaatgtaaatccgtgattttcccgccaaaaacgtaaacccgagattttcccgccaaaaatgtaaacccgtaattttccgccaaaaacgtaaacccgtgattttcccgccaaaaacgtaaatccgtaaaaagtggaatccgtaaatatcctaagtttgatgataatgaattaataatgataattatttattattgttttataatagtaattaattaaattattatttaaatgggttaatccatttaacaactcaacccatcaaattaaatgagttatgggttgacctaacccatttaacaaaatgagttgggtcaacccataactcatttaaccctaaactcatttgattatgagttgagttgagttgggttacccattttaacacccctaattaacatacactaattgatgatatatatttttcaaataacaatatcatctaaaatataatttagattacatcccttaaatatttataccttctcccaacttataaacacaccatagatgtacacatgcacgtgtgtctatctaaactgcaagaaaggaagagactggccttttcgaagaaaataattatttacaaaaaatcactttcccttttagaaaataatttactagtcgactacaaaaaaaagggtagatctctatatgtacatctcccagatctctcaacattatttatacaattttttcttttattcctgcaagagtttttttttgtttataacaacaaatcctctttcaatataatctttatatatacgtatactttcgtgccttgaaattttcttcctcatcttctttggtcttttcttgtcatttggcataaccaaagagtcaagcacattcaaacattctcaagccctaaaacccaaaaaaaacttatatgctcttgttcttgttcttcttctcccctcagcatattaaaccctaattaactatctcttttgtttgtatactgttataaacctcctgatcatcttcttgttttcttgcaagattttataaaaaaaaaacaaaacccagctgttcttgttcttgttctttagctccgatccgttttaaattaaaacacagat

SEQ ID NO: 717 - DNA, 3000 bp, Unknown
  misc_feature (1)..( 3000): cDNA_ID_2122045_gDNA_ID_1620310_Annot_ID_152958 3000 nt of promoter + ATG
cgaccaccatcatgaacagcttgagacaccaaacccattaaacctatgcttcctccaccataaacaagatcaatcttcctcatcacctgttcatcaaattttgaaaaccgaatttggtaattatcctgtcttcggtttgtgtcaaagaaaacaaataaaaattgacatataaactctttattaattagagactgtattaataaatacaaggtttcttaagaatcctcatgcatgatgttattgcaaaaacagaacgttttatcattgttaaagaagacctaagaatttttataaagaacttgcaagttgtatatatgcataccagttccttggccaaatcaatggctgcatcttgataactagctttgttcccattgctactcccacaaaagacgcaaatgctcttaaaccttgaactttgtttcttcgtcatctctctttttccctcttcattctccattgtttcggctaacttgtcaaagtcgcaacttttttttctctacgtttgtttgtttctagttcttatggaaaaacaaatgaataattttttttacacaagacaagtctattattagttaactctctctctctctctctttttttgtgtgttttaattaactctcttcttctctaaccctttgttatgttttatagtgtggattgtctttctcaagtctgctaggcacgtgagaaacgtggtcacacgagtgttccactctctggctagctctttctatcaacagtattctaactcatcggttaagtagcacaatcgcatgcaagtggtgctcacacgctctttttcctcatatttcatatatattatttacaatcttccaaattttgtgggggtctagtaatcggtgaattatttttactcattctctatttttttctttctatttttttattttgatatatttttttctcatatacttcatatttgcaatcttccaaactttgttggggtctatgaatcgctgaattgtctatttgatgaatcggtcatccaaacaccaattgcatattgttataaaactatttatactaaatttccgcatttccgctagctaatattttcgaatttcaaatatttaaattttggtacttaaaagttagtttctttaataactgaaaatccttttaggtcaaagtttagagactagtcctcacaatctatcccctagagatataaaaagttgcatatttgtctatatccgcaataatttaagaagttattattatatgcatggccacggaaaggaaagttgatattatactgtgaaaatcttgtctttcttgaatctacattgtttctgttcatgatgataataggagttcctgttctggataggccagcataaaatgatttcatatatgttcgacgctaaagaataagatacgtatgatttgattggattttatttctcgtgattgtttaaagctatgaattttttgttttttttctttggtttgggtgccaatcaatgatatgattagggtagcaaatgtattggtgtatatatgttgggtgtcgacaaaaaatgctttagtgttgattttctccttgcaataaaaactcaaattttaatgatacaacgtggagatatattatgtttcagattatacgacaaagcgaaattatggttaatttgtagcattagcacaatagtatatcatatttcagcataatagcggatggtaatttataacgtggcagaattaaagcgtgagaaaatttgtcactatgtcattggtggacctgactatattacttatgtcctaagacacgttaatacgacgcgtttcgctttggccaaagcaatgtgttgtctcccctaattcatatctaaattagctattgaaaccaagatgaaacatagaatagtatcacccaataacaaacaatcaaaagttccaaaaacttgtggtatttttttttttttttttttttgacatttctctttctagtagattctaaaccactcattcacaacaaatgcgatgatcttacaaagtaaaatattataaaaattataatatgattatacgcgacaaaacattgtaaatgatacaatatgggcttttcgttatgggcttttggactcaaagtgtttgatcctatgatccaacgtttatgattttgactaatcaacagcgtaaattttaaataatttgaccaaacttttcgtacctgtaaattaaaatacatttgttgagaatttaatttagaaaattatacatatgatctcgttggccgaaaacaaaaacaaaatggtcaaaaagagcagtcattttccgttacgccaaaacatcactatataattggaaccaaataatctcaaaaagaaaataaatttacagactaaacgaatggctaagcaacatgttactgcaaagcaagttttcagaaataaaaaataaaatagaaatattaactgatactaattgagttctcgaaatacataattcgatcggttatatgaaagaaaaaaaatatgaaaatagattgattcattcgaacttgggggtctttggtataaaaagaaatattataagaatagtttcatctttgatttatagggcttttgtgatgataacataactatacaccgaaattattatttttcattgttaacgaaaagtcaaaaacataaatagaaagctgagatatcaacttcgaaggtactccataatattaacaaacgttacgctgattcgccaacgtctttcagaaagttgcttacaagccttcttcttcgattctatatttctctaagcttttcttaataatgttattttatgtgtgttttcacattattattttcatatccagagtgattcaccaaccttttcttttcatgatggctctatataagcatttgtaaccagcgactatttcttcacaacattttgtataaccaaaagcagtagaagattaagtacaaataaaatctcatcattgcatcaaaccggaaaattgaaccggagatgaagatg

SEQ ID NO: 718 - DNA, 3000 bp, Unknown
  misc_feature (1)..( 3000): cDNA_ID_2122018_gDNA_ID_1620310_Annot_ID_152949 3000 nt of promoter + ATG
cggatttgacaagacgattggcattagtactcacaaggactgctccggttccaccaggcttcagaacccgctccatctcaagcacaagaagagcaggggaagcaacatgatcaacatccccacagagcacgaaatcaaaagacttgtcaccactaagctcaagctcgttgacatgcttcctactgaaaaaggaaaacaatggatgcttaggaaccccttgaacaactgagaaacccatctctttgaaccctgaaacagcagaatccgatccctgaccaatgcagagaatcttagcatcataatgcaatagctttaaccccatgagctcatcaacgagatcagcaattaccacttgtggatacttctctgtctcaattttaccccagaatggttgaacgagcttatggaagaacaatttcggtcctggaataacaaatcggccgagatcgaccaaatccactgctccatgatcaccaaagacgtgatttttagcggttaactccaacaaagggacaacagatagagcagaggcgatgatgagagcacgaaacagagcatgcctattcgtagatccacggaagatattaagcttcaagatctttatacccattgatttcttcaaatacttcagctccgatggaatcttaaaatatgattaatgtctagtacgatttgctaaacagatcttaagaacaaagaagaatcgcaaagagaaaatcgaagaatctagcgagtacaaaacctggaggaggtatggtttccacccacgaggagaactatagatatttgtgatccaaaccagacccttcttggaaccctaatcgacttcacctccgtccccattctcaccgttcgatccaccatgcagaaaaaaaagaaacaaaatctcgtcttacatgcttgtagaaatctaaaagctaaacacagtttcttgattgtgtttgagaaatgcttatagattcgaagggtttgggactatggtttcgtgattctcttcctctgtcttgttttttttttggggaagaagagtgagtgaggaagcgcttttaacagatttaatggtgaagctaaccacaatgttaaaattctaccgccacaatattgccacgtgacaagaatttatgctaatgttaaatgtttgaccgtttgtgattatacacatactacgtggatttcgttttcatggtcttctatgattattgagtagtagtaccaaactaccaataatcgtttttttaaacagaataagtgagaattgtttatatcgctaatttgttattcaatatttttgacaaaaacgagtggctcccacttattgtctgtgccttcgaaataattatttgatgttgaatttggctgttgtccctacacagtgtccatatccgtgtgggtggtgaacacatacgtgttgatcccaagtagtttctgttttaattttcttaaaaagtttttaggaaactaatttttttgaatggttgtaaaaaagaaataatattgtacgctaatcatattaatcatccaacctagcatagataaactctcttttttttttttttttaagttagcaaaaaaaaactctgaaaatttgtaaaatgtaaacctattatgttttggatcgaacacgagtcgagtggtggccacacagttttggctaagttgggccgagttgggccttccacaattatttttttgcttttgatatcgtcaccgtcccattttctgtcaagcatgatttcatttcatctttcatgtgcttcagccttcagagtatagcactaaaaatgctatcagatttgtaagattacatgctctttcgacacgtcgttgatatagtttcgtgaaaaaaaattcacattgttaaccatcttatagtcattcatatcataaacataatctatacatttagtcggtttgatgtacacttgtacatgtgtttgttgagacatcgatcctacttaggtgtgatgcgtgttacattttgccttatccattatttctttgtttgtgtcagcgtaactaccatattttgcgttatgagtcgttcttatctcgacagaattttaaattgttgtccaaaggtttatcactctcaatgttatttacttctttctctcgaaatgttatactttttctcctttttcccaattaataaataaattacaaaagtattttttttgttgttttatctttcaaaagcagtataagataaactcagcattgcacatctaaataagtaaagacaatctgtatttttcttccaacaaaattttcatacataatatttttttcctaatctctttttctgttataaatatgttcagattttgtttttaaaaaattcattgtttcttttttttgtttaatcagattttgttccaaatatgatcagaaatacacataacctatttgtgaaatgttctaaaacattcagcagaagttcagataatatccataaaccatttttgaatcattttttaaaatgttatgaatatctgtaatctgtacatacatttgagtgggctgccatacttgattaccttcttactattgctttacacatttgatgcattcaaatttttgaatagaaacatgattttctttttcttctttcacaagaatgttgaagacaatttttatttgacatgtaagctggaaattttgattcaaaattatatgcaccactggttaaagatatataccaaaattagaaaaaaaaaagaggttattacttaagtaagtaatagagacaaaacaataaaaataaaaaccgccgaatccaatttacttctttagttgagagaaacggggcaggcactgagtaagcacacaaaattgaagcaacctatatgagtgttcttgatcaaaagcttctttctcagattatcatttctcctaaaaattagtccttttaagcaaattaatcccaaagattgatactttgttttcctgagattcttcttttacttcactgtttctgggttttgtaatttgatggtgatg

SEQ ID NO: 719 - DNA, 3000 bp, Unknown
  misc_feature (1)..( 3000): cDNA_ID_3058520_gDNA_ID_1620311_Annot_ID_152978 3000 nt of promoter + ATG
aagcttcaacaaaaatacattcccaggtcacatacatgattattatacaagagactcgcccaagtcattgttattggcttcataaacttaacactatttaaaaattgaaaacaatttcatctttgactcaaaaattcatatccccatacaataaccagatgtcacgattatagaagggaagagtgacataactatctaccttcgggaatgtcatgatgacgaggtggtgatgggatgagagttgtaggtatttcagcgccttctcttggattggagttcatctgtgtttcatcatctccttcgatgtcaaatctgagatgccattaaaaagcagaatagaatagaacaaatcatcaccagctttttgctgaaaggtggatgaaagaaaatacagaaatagtgaaacgctacaacttctaccttcaacagttattcgagaaggtttaaaatctgggaattaaagactgaagatagatagtgggattgaaagctcacctttcaaaacgatcatatgtttcattgttggtctggaatgaaccatgatactcaaagagtgtgatattctcggcatcagctgagaatgttacagaaattgacaagcggataaatgtaagttattaacatgtcgtatactcacaaaggttttgtctcaagatactcaccttgatggaactgctgtccaagatcttctggctcggggttattgttaacatgggattcatctaaccgctgcaaagagataaaaccacgcaatgaattagatcaactgaagatgcacacgagtaatcattggtatacaaggagatgaacactactatgatcaattcacattaacagttgcatcttttgtgcattgtccatttccacagcccataggttacacgtcaaaatcttaagcgatgttcaaatgattttggtttgagttcatatgcttcaagttccaaaaagattttcctttgaaatattcacctgtagactaaaatgaggctactcataaaccacatgcttgagttagaccaagtcttaggtgccctttatgcgccaacttatttactccacttttatgggcaatgaagaatgatggctactgatttttctatatcttatacactgttttaggttggagagttcaagccacaattctacgaattgatgaatattgagacgtagaaagaaaataaatacccaattcaatctagaattcacagggaattgagttgattaccatggaaataaaagtctgctgaaaatccatgtaattgccaaatttaggaacattacgagtctgttcaaaatctccaaaatcagcttcttcgttctcaggcaatgtaacagcctctttcctgcaaacaaaaaaatccaacacgccaatcatttctattattcttcacgacaatgttcttatgtttacgatttgatccttcagaatccttcaatggcatgagaagctccttcaaggaagaagatgtgacattacctggcatgggtttttcctttaggtagtaaagtgggatccggaacagattttgtgcgccaagctccattaatttcaacctgagaaaaataaacacatgtgaaaatccagaaatcgaggtacgtgaatatgattttgacggggaaacaaaaaatagaagaggatcggagaagatttgattaccagaaagcgattaacatcatctgaaatattgacggaaaataaaacccagaaaaagagcagagtctcatcagaaaaagaggagagtgtaaacttaaatcccaaaattcaaaaatgatttgaatcagaaaattaccgaataggagcttcactttcctctcataaacaatcacaacaccacctatcgaataaacaaaacattgaagaacccagaatgtgaagaactgaggaaaaaaaaaatccgatgagcaaaagcatacccataagaatcccggagagtctaagagccatcggaaccgacggattcaaaatctcttcgctgtaagagtaaagtaaccaacaaaaatggaaaaatcaacgttcgttttcatggcaggaacaccaaaaaaatcgaagcagagtaaaacccaaaaaaagggcgaacactatctcatctcctctcaccagatttgaatgatatcgagcttatctagtttcttccggttgatcttcgcgtgcaatgtagcggccatccttaagaagaagaaaaatcaaaaacagagtttagagattttactctatgcattcactaataatccatatacagatcaatcaatggaaatcgcagtgacgatttgaagcagtgacaagtgcttgatcgcgacaaggaagttcccagccgatttcaaaaacagatacagaaacagaggttgcaaaatcatcgtgataatcggaaaacgtttcactgatagaatttgactcaccatatctgacccaacggagcttttcgagctagaagctggtgagaataaaacatgattcagctcaagcaaaaaaaatccaaactcaggaagagaaaaaaagagaagcgagtctttgcgtggagaagaagctgaatctgagtaaatagtttttttaatgcgtttctttatgtgtaaatttgtctgtatatagatttatgaagccgccatgagagcttaagaagggaaaactcgcagtgatcgtagcgggagaggagagagtaagcatgtcaggagaaaggctaaaattaagtgacagtgacgaaagtgtcactagtagccctctcttattttgacacgtgcacagattataagtaaccacacgtgacgctaaaataaatttcgaattccgttaccgtcgctggtccccacactgttactatcaaactctccagtctcaacatttcctttctactatctgccaatttaggatgtcaaacgacacgtagttgattctccgaaatataaaaacgctttggtgtttaattacgtcccttctctctctccagtctccattgaagttcgcatcggcgagctcggataatcaaaaacacagaagctatcatg

SEQ ID NO: 720 - DNA, 3000 bp, Unknown
  misc_feature (1)..( 3000): cDNA_ID_3058498_gDNA_ID_1620311_Annot_ID_152990 3000 nt of promoter + ATG
gagaccgttaccatattttaatttatatttttattcactcgtacatataaggttatttgtaataggtcagttactcagttatccctttttcttcataacatctattaatattgattaatgacgagtagagtacttaaataggtcagttattctgttattgttgcacatcaaacatatagaactgttttttttcttgactgtagaattgtttcatagaaagtttatacaaaactacttgcaggttataagtgaaagtttctagaaatcggatcatatgataatattgtataaacacatgaatcttagaaagagtaaacgaaatcccttaaaagggaatacgatcaagtcaacaataacaggttccgtcgacataccagagcttatgcatgttttttatttttttgaatcgtactcataaaattagtcaacgctagctttggataaaatgaatcgagacgcaaagaaaactaaacaattttttttgttttgcttcaattgaatatcgataccacgtgggataataatcaactggtaatcaatacatataagatggcgtcattaatgacgtaaagctttcaaaacttctcaagaatacttttacccaaagacagatttcggagatctaataaaatataatcgagaaaactaattcttttgtttaggtcaaatgttatctgccaataatacatattgaatgattcaacaggatctaaaagccaatgtgataatgttttctagtctttcctgaaatattctttttggagtttgccttctataagttaaaaccttttttttttatataattcttgcgaataaacaatttaaaatgtttattatttgcttttccaagctgtttttctttaaaagattcgtaagtcttttccgaacatgattttttaaatcgattgtctgtgtatatggaacttagatcaaataattctgacagtagtacaccacatatttctgcactctactgtaattccaatcattctagccgcctcgctcgtaaaagcctccacactcatcatgcgggccttactattggtagacaaactaaatcaactagttccaaaacgtttctattatttatggagctcttgttctcctttttttttttcttggtttttactgacttttatatactaaatcgcttatatctatgtaatttttctcatgggaactctgaaataccttaaactttcttcgcttacaagtagttatcatgaaagtaaaattgagcctctccatgtttagcaaaagtgataacattaggagtacgaaattaaatctttttacatttatgtaatccgtacattttgccacatatatgtcacatcgaacaagtttttcaatacattagatcattctctagaaataatgttaattctctcattccaaatcccaataaagataattaaaaagaaaatcaattctgcataatctatatatagtgtgtttttttttctgttgaagataatctgtctatatatagttaaatgttgattgattaccatacatcatagtgttatccaatcataaataaggacgaaacaggccgtataagtataaactatggagcattggtttataaataatggacgaaggagaagggacataaagatgaataatcgcgtaaagagaagaagagtttgattgagtctgaaaggatagttagagagattagtttgcgcctaacaaggacgaaacgaatgaaaattacgtatgcttattgaaaatagttctgttttttagctgttcgaataagtacgctaaattaaattgcatagaaaaagtttttaaagaaaaaaaccaaaatgaatagtttggtaagttatagataaaatcacatttagcacgtgttataaatagagggagacaattatgtaaggttgggggctcactttgatggatgaaccgccgtgttactagagatgtcggcaaatgttgtcttcgcatgtctcatcatgtgccttgtattcgaataacgttgcgttcacactttgatatttcttttacaatatatacttcttatatctttatattttcaacttgcaattcgttagttaaataaaacagaagctagtagtctactactaccaccagtagagcgacaatctttgatcacataacttaatcccatatttatatcctccagaaatctattattatctgatcatttcttcgcattcattgaatcttattcaagtagatattgacaaatgacatgttgttgttgttgttgttgttgttgtagacatgacattccttaccgacaactgatgagtgatgagatatcatttttagagtttatcaattgtagcttcaacatgagaaatttacaaattattattattattattattatttattttttgttgaattatgagactggaatttaataagatcaaacaccaaaatacaggctctttctaaacaagtcaattaatatttacgtagaagactattgatttcggatatgaataaaccaaacatcatttttttctttcttttctaaccaacatgtcaattaatgtttcgaagatgataagaacatatatagtatacatcatgaattttcaacgtttacattacttttattttatgattgaaaaaaaaactttgaaaatgaaaattattggaacaaacttaaatatttattttgaatatttgatcaattatctatctttatgaattattgatcaagaaacaaaatttaaagaacatcggggacttgaaaaagtaatggaaatttcacaaaaccgaaaagcaaacggttaattcggttttacaaagaccaaacagaaaattcaataattcggtttggttcggtttaattacacctaacaaaaaagttggtacattcgtttttatttttccgccattcttgtcgatcttcttcagtcgtaaaaccgccgcgtctctgctgacccttctcttctcatttcatcgacgggagaaaatccgataccatctgagatttccaacagtgaaattaagatg

SEQ ID NO: 721 - DNA, 3000 bp, Unknown
  misc_feature (1)..( 3000): cDNA_ID_3058491_gDNA_ID_1620311_Annot_ID_152995 3000 nt of promoter + ATG
ttgtctaccaatagtaaggcccgcatgatgagtgtggaggcttttacgagcgaggcggctagaatgattggaattacagtagagtgcagaaatatgtggtgtactactgtcagaattatttgatctaagttccatatacacagacaatcgatttaaaaaatcatgttcggaaaagacttacgaatcttttaaagaaaaacagcttggaaaagcaaataataaacattttaaattgtttattcgcaagaattatataaaaaaaaaaggttttaacttatagaaggcaaactccaaaaagaatatttcaggaaagactagaaaacattatcacattggcttttagatcctgttgaatcattcaatatgtattattggcagataacatttgacctaaacaaaagaattagttttctcgattatattttattagatctccgaaatctgtctttgggtaaaagtattcttgagaagttttgaaagctttacgtcattaatgacgccatcttatatgtattgattaccagttgattattatcccacgtggtatcgatattcaattgaagcaaaacaaaaaaaattgtttagttttctttgcgtctcgattcattttatccaaagctagcgttgactaattttatgagtacgattcaaaaaaataaaaaacatgcataagctctggtatgtcgacggaacctgttattgttgacttgatcgtattcccttttaagggatttcgtttactctttctaagattcatgtgtttatacaatattatcatatgatccgatttctagaaactttcacttataacctgcaagtagttttgtataaactttctatgaaacaattctacagtcaagaaaaaaaacagttctatatgtttgatgtgcaacaataacagaataactgacctatttaagtactctactcgtcattaatcaatattaatagatgttatgaagaaaaagggataactgagtaactgacctattacaaataaccttatatgtacgagtgaataaaaatataaattaaaatatggtaacggtctcattatattgcacaccgtaactgtctgcataagtttttaagtttaaaagaaaaccattatagaaagaagaaaaaaaaagccttacaagggttatatagatgaaacgagaaatacacactggtttgctttgaaatgtttcaccagatataatgaattggaagactcgagcaggatataaaaagtttcatcaaattctaatgaaaagaaaactcacttgatctctgttaaaataattttaccattcacattttagttttactaaaattattaaagtatattttagaaaactcacttgatctctgttaaagtatattttgaaaaccaattattgtggacagtaaaaactcatttgtgaagtgaaatccatgaagtctaagtcgaataatatttagaaacaagagttaaaatctttatgtatttcattttctaatttggttgaacataagctaaactctatatatatattgtattgtttttcttaaaatcaatcatacatacagaaatagttttctcaaatcatttgctaatttatctgtttctatttttcttagcatcaccaaatagatatgtcaatttcccatctctttatatataacaaaatatgatttatttctataaaataacaatcatctcatacacattaatctcgttgtgtgtcatctattgtgcaaaactgtttaattagtatcttaaaatattaatatatttactcttagtctttgtcgacacttagtcattgaaatagttaaaactattacaaccaaagattgcctcaaactcaaagtaatgcatagtttcacatgtcgatacaaattttgttttgtccttttatcccaagaaaataaaaattaaatcaatacttattcacacgtttcattaaataacaaagacgttgctttcatcgtctctagccgatttctagattctcctccaccaccattttacccttcttttaaattccttccttcaatcaaaattagaattatttctcaaacctcttctttatatactaaaacgtctcacatgaacaagaagaataaatagaaacaaagaagatgaacaagaacaagattgatgttaagatcgagacgaagaaaggatcgatggatgagtggcctgagccaatcgtccgagtccagtccttagccgagagcaacctctcctctctccccgaccgttacatcaaaccagcgtctctacgccccaccacgaccgaagacgctcctaccgcgaccaacatcccaatcatagaccttgaaggactcttctcggaagaagggttgtctgatgacgtcatcatggctcggatatcggaggcttgccgtgggtgggggttcttccaggtggtgaaccacggggtcaaaccggagctgatggacgcggctagggagaattggagagagtttttccatatgccggttaatgccaaagagacttactcaaactcaccaagaacctacgaaggctatggaagtagactaggtgttgagaaaggagcaagtcttgattggagtgattattactttctccatcttcttcctcatcatttgaaagacttcaacaagtggccttcttttcctcccaccataaggttcctcttctttaatcattttctcttctttttaagaatttttttagtgaattttcatgagtactgagtagaaaataataaatacggtatttttctattctttaaaatgtacggacatgtggtacaatcttgggaaattatcctctttttattagttttgatatactattaagttcttggggaatgtgagaaggctgattttttgcttttcacgaggagaattatgtgagttttaacgttgggataaagtccaatatagggaaatggataaattattgattatatttatatttattcaaaaaatagagaagtgatcgatgaatacggcgaagagctagtgaagctaagtgggagaatt

SEQ ID NO: 722 - DNA, 3000 bp, Unknown
  misc_feature (1)..( 3000): cDNA_ID_2122129_gDNA_ID_1620311_Annot_ID_152988 3000 nt of promoter + ATG
ggctcactggcaatgttgctcattactctctatccacggttgccttctggaccaaatgacaaccgttgtcacctccaggcaagtttaaatctcttatttattctttgcatcgctcttttttgtctaatatgtcaattctatagaagcaagagttgcttttctatagaaaatgctacccaacaccaatcactttgtcgattgtgatatcaaagacatgctaagcttggaagttggtttcaaacttttgttgtgctatttatgcttttgcaagaatacatctgacaaggtgaattttccttttttttaggcattcaggcatttatatgtccttgcaacagaggctcgctggctgcagaccattgatgttgattctggtctgcctgtctatgcccctctagaagtcacagtaaaagagacaaaactttattcagaaacaaaattttgcgagataacaccgtgcattctgccagagcgtgctattgtaagaaaagttcaacatcttgccttgcatattttttatgaacaaactacagaaggtttcttgatttgcatgtcacactgctttctacaagattatgaaaaaaaaatagttttctggtagaagcacatttgtggcaactgcaagttgaaacatcagaaaactaggccatataccagcttgtctcaatgctggtttaagttttttcatgaaatacttgctcagccattctacctgtttgtttcgtccacgtcacctaaaaatgtatttgtatcctgcagctaaagagaatttgtgtatgtggtccccgatactggccccaacaaattgagctagtccccgaaggtggttgatgcatttgcttatatattccttatttgtccttggtcatttcgtctacctggttttaagataatttatttttatccaatgaaatatagagaaaaattggtggagctttggggacaagagtgatcccttcagttctggtgttatatatgtcaaaaggaaagtaggagcttgttcgtatgttgatgatccagttgggtgtcagtcactgctttcgcgagcaatgcataaggttgtatacgccatcatatactcttgactcagatagattaatattcagtcatagaaaactggttctgatacacgtttgtatgctttctgtgatacaggtttttggtttaaggactctgggagaatctaatttgattgctaatagtcatagagaactggattctgatagtgttgatcacttggtcagcactttctcatcagatccaagcctaatagcgtttgcacagttgtgctgtgacaaatcttggaataacaggtaagtactgttttatccggttgattcacatttatttgtgcttttagttccataagtcataacagagttcggtagtttgcttggcaaactcagaagggcgaattctaacatattcattgatccagatctgattctgaattcaaggagttctgtctgcaagtgttgtttgactgtataagcaaggatagaccagctcttttgcaggtgattgctacttacagccacctaaccctactattcaatgtttaacggaacaattcttgatgcagtttatttggcaatgtgtattctaatattgagtatacgttacataattgttgtaggtttatttatctttgtacacaaccattggttcgatggctgatctgcttgtcaaaagcgatagtaacatgtgtgattcactttccatctcaagcctcaaggtactgttcctgcaaagatggaactgaaacaaagaacattgattcacattttgacttttgtaatcagctttgatttcctaattttggatctaatcttatggtctcaggttgctcttgcctacaatgaggcagtatcaactggaagattggcctcctcaggtggctttgtacagtcaatcttcttagcatcgctgagaaagcgatgtgaagaggttttgaattgctcaacggagctgaagattaatttgaggaattatttgacctcagaagcatggccttatgataagaactcaaagttgcagaaagatataattattctctcatggtatctaaaatggttcaacgtaccatctccatcgatcatcaaagcagcagtggaaaagatcaaatccaagtccaaaaactcaacttcggcaatacctttgttgcgattgttgttaccaaatacgcatattagtgtgattggtgaaattgatagggtctttttcccctcgaattaaacaattgtattgtgaaaacatgattttgtattctcttcgtttgggctaataagctgataaattttgtgagcaaagctatcatggtcaatttcaaactcaaatgtgcatgacaaaagcataatataaaataagctaaattttaaaagatatttagttgatgttttttaaagaatatttatgagatcaatttttttaaaaaagtattagaatagacatggagttaaatggaagtgttaagatcatacactgtaatagtgagatggtttaaatatggtttgacacttgtaaattcaattataaaattttataatttgtcctccatatttgcaattgcattacgacataacctgtttcaaattcttcttagtcgcaacatggacaaccttttaccgagcattgagatgtgtgactggaatgccaaggtgttcagaatcatcttccattgtgctgaccgcatctccttcactcatctcgagatttaccggagtggacaagtctacaagtttgtgcacgggactcctcactatcttgtggttaacgtgacgtgagagggtgttcagattcgaattcaggagaaatagagtggatatttagtttttctatgttttattttaaaattgtagtagatgtgtatgctttgacattagatgtttatatctatttttgacaaacgagatgtaaaagaaacgaaaatatatatccagacacaagattttgggaggttattttgtttattagattgttataatttagtcgttaaaatcc

SEQ ID NO: 723 - DNA, 3000 bp, Unknown
  misc_feature (1)..( 3000): cDNA_ID_3058508_gDNA_ID_1620311_Annot_ID_152983 3000 nt of promoter + ATG
tcttttccagagtatgatttgatgtcgacgatcaatgaagccagcaaattctcgtagccgttctcgttcttcgccatttttacttcgccgaattgaagaaagcaaaaagggacaaggctagtgggagatagagagagagagggattatatgaatttgaaaaaagagtgcaccttttgattttgaaacgttctgatacagcaagaggctccacgatccctgcgtaaagctaaccggctaatcggtcaaccggttaaccagataatcagataaccagctaatcactcagccggttagccagataatcagataaccggttcagtaaggtattgacaggaattgtaaaacgctttttggaggagccgtcaaattgatttcgccgatttgctcatctctgactctcagttgctttgctccttctcatggagaatccggcggagaaacccgacccgaatccatcaaaacccaaaatcgaatctgaagatgaaagagaagaactaggagatattaacggcgacgaagaagaagaggaagagtatgaggaagaagacgatgggaaacctcgaacgcgagaggatgcaatcgcggataggatcaaagctgagtctctgttccgtcgtatgcgagcaactccggtcgctgtgcgtgttcacgacgtgatcgtcaagggaaacgagaagactaaggatcatgtcatcgaggctgaggtggatgttgtgaggcaagccactacgttgcaggagcttctcaaagcctctaaggttgccaatttcaatctacaagcgcttgatatcttcgattcagtcaaaattacgcttgattctggtcctcctgagcttcctggtaccaccaatgttgttatcgatgttgttgagagcaaaagccctatcaccggtcaaatcggaaccttcactaaagcagaggtatcactttcgttttcttatttcagtggattaggatacttaggtcttggcaggaagaattagatacatccattgattgatgcatagagttggatttgttgctttatgaggataattctggatttggatttcatatatagacttttgtatgtcatgtgttttagtgatttccagattaagtgttcttgtgagaatttgaaatgttgaatgttgttcataagtctaatgttcttgtaggctcggtcatcaagccttgaaggctctttgaagtacaagaacatatttgggtatggagatatctgggacgggtctcttgcttatggctgtgatcactctgcagaggtcggcttggggatgtatttgccaaggttcagagggcgtcctactccatttacgtcgcgggtttacctttctacccaagattggcttaagttttcgtcttataaagaacgagctcttggtctttccctcgggcttatcgctagcaagtatcatgagctggcctataatattgcatggcgtaacctgatagacccatcgcaaatggcatcaagatcaataaggagacagctgggtcataatttggtttctgctctgaagtacactttcaaatttgaccagagaaactcatctttgaggccaacacgaggttactctttcatctcgacttctcaaataggtggtcttgcacctgatagtcgaactctccgctttttgcgccaggtttgggattcttcattcttatgtcagaatttacataaacctatatattacagtgtggaaagttgtagcacaaatatattactcagaaaacttccatggcacctagttcctcgtttatgcttttgcaccatttatccataacttccgaagtacatctgacactctttacttattgtagcagtgaatgaaaagattggttagcccttttataacatatgtggttcttttatgtttgccatacatcatgttgagggtttcttgtccttttgcaggaaatcgaccttcgatatgctgttccactcgggttttatcgtgctgctctgaactttggtatagctgggggaatcacatttccatggggaagcggatacaagagcagagcttcttgtgtacctgagaggttcttcttaggtggaaacatatcgcctgtgtgttctttgggaggaccatctgcattatggggattcaagactaggggattgggtcctaacgaaccaaggagggaagtacaggacgatgagagtggtgacacatatgaacgggattttgtgggaggagatgttgcggttactgcatttgcagacctttcttttgatttcccattgaaatggttcagagacagaggaatccacggacatgtgtttgcatgtgccgggaatatggcggaattatcagagaacaagtataggaacttcacagctccaaagttgttggagacattcagaagctcagttggtgcaggaatcgtggtaccaactagtctatttcgcatggaggttagttagttctcttgtttctcttttcttatcaaggatcataaaaaaattgcaatccttttaacagatattgattgttcttcttttgttatgtgatctcttatgccagctcaactactgccacatactgaagaaacaagaacacgatcgagcaaaatctggatttttcatgacattttcaacatcatcttaatgctacttttgatgatatcttaattttggctttgcactcacagtgtcatggcggagtcttttgttttgtttccaggagctttcattgtttaggttgttgtttggaattgaaaactgtgcaaattttagagagagagattacctgatgtgcggattgttcttgggaaggagatagatcaagaaataaaaattaactaaagttgatttgttttgaattaaattttaaattagtaataaactttttgttttccttccttttcaatgaagataaagatgacacggtagaataaatttttgtttcctttttcatgaatatgttttggatcgagtactgtcatctctataaatataagtccaattacaagtagattgttgggtggacaaagtc

SEQ ID NO: 724 - DNA, 3000 bp, Unknown
  misc_feature (1)..( 3000): cDNA_ID_3058502_gDNA_ID_1620311_Annot_ID_152985 3000 nt of promoter + ATG
atcatatctttggttatttcacagatggtggtgatataacaagtttctatgtatttctcttacaggattcgagggggttgtcacaaaaacagatctttctagagccgagttcatcagaacctagattatatgttctcgttcgtaaaatggtcgaagatgatttggttggggaagtcatagcagaggagaataatgcgagttctaagaaacggaagagagaaaatcattctaaagggaccagagatagacgcaggtgtaaaccattgtccagacgaaaacagagaagcaatgtcaaacgaagaagataatatcaaggaaaatcaagaactcaaagcaaaatgataagatgataattggtccggattcttgaaaattgctttcactgtgactctagtttgtgtttggtcatcgttgatgcccttaatgaaccttggatagtattttgccaatttaaaggttaaagaactcagagactattgatttaagatactcggatgcaactgcatacttgtggatgtattatatatatcttatgataagtggttatgataaaaatttagacatgaaaaagcccaagaagaagcataaacatgtaactgttaagcatcagaagctgtagtttggatacacaagccatcattatacgtggacactaacacaaatgtagatcatacttgtcagctactaaagagttaaggaagatttgctccagtacaccaatgtacactaacacgctagaaagtagaagaaaacaaacaaagacatcctaaagagttctctaacttccatcctacagattaaaacaagtaacaggatcctccaatttcaatgagcttcagattcaagtaactcctctttgcttcaccatggtatttcctccaccaatctaattctacaattgcttacctgtacaataaaggcagatcaaacttcagtgaactcattaccatatgaagaatgttcgactactatgaacattgatcttttttctcaatttcaaacctggaagtctactcctcctaatccagttcaacattccacgaagctggagaagctaaagaagtaagagaatgctatctagacttttccttgccagaccactggaagcacagaagctcaactgaattgtatattgacaaaattggtattcttcaaaagcagagaggcacatgactttcacatatcaacaataagtcaattactaaccagcctcatccatgcttacaacaactaacagcataggtataacattgttgttgaaatctaaggtccttccacggatacattatgcggtttaaagagaaagagtaacaaccatgtaaagtctaagccaccactagtaacttgaaaacctaatgtgagttcttcttacctgaagcacttgcgcgtttccggtgctttgatttctcaatctctaactgcatctccatcaacatgttcattcgttttaactctacctcctttgtcacttccattctctgcttctccaactcaatcatcatctgttgcttcttcccttcaattctctcgtaaacttctccaaacttgagaatcgccgtagctagttccctacacgttgatccttcactcagatctacctcttccacacgaggatgcttcctagcaacgaattcccaatcaccaacctcatcatcatcctcatcatcatcttcaagagagcttccagtagagttcgatccagttggattcagatgattcttaaaaggcgctgatttgacaactccgccagccgatttcttcacaacgggaccgattagaacatcgaggcggttatagaaacgccaagtcgacggcgagagtttagctttctctgttttgtacttcttcttcaaagtatcgacccggttcttacactgtaagtcggtcttcttacggctgttatcaccgtgtctagagttaacggcgtcggcgacgtctttccagtcattctgccggagatttccgtggttcagcttgacgtaacgattgccccaggcttctaccagcgtcgccgtcgcttcctcactccaccagtcttctcttcccaacggcggtcggtgggacacacttgattttgactgcggcgtcgtcgtctccattcgtcgggagtagtgttgctaatgtgcgcaccgggaggagagtgacggcgtaggataagatcggaatagaaacaaacaaaacataaaaagaagttttttttttttggtgggaggaaaccggaatgggagagaagaggataagtgtggcctgacattgatgaccggcggtgacgtcactgaccgtattggagcgttttggtcccaacggcgattatccgttaagaccgaaccaatctctttggtctcgttagtacttatgattaaactgttaaaaaaaacctcataatttttcatttatcccaaaacaaacctcaaactaaaaagattacataaataaacctctaaaagtgacagattgggtcaatagcaaatagttggaaatattttagttttatttcattttaagccttcaagttttacttctttccaatgtttaaattttgtctttcataagctcagacttcgtcccagatttcattgcatctagcacagaaagtgtttgattaaattcctctgagaacatctctctttcactaagcgaaatcttccgactttcgatacttttttgaacctcactttcttcattccgttcagtttagagcctcgacaatcatcggaactcgtttgaaacctctctatccggtttctaatgtaagtgacaattcttcctactcacttcttcttcttcttcttcttcttcttcttcaatgttatcttcctctgtctcgcttacttttcataaaacgatttcgacccgcaggtttaaagagaaatgagaatctcaaataaaattttgaaaatagaaaagactagggtttaagcgctaagacaacttggaaagagcgggagagtgtaaattaaacttcaccaatctccattgcctgttggcttcggagaaaaa

SEQ ID NO: 725 - DNA, 588 bp, Unknown
  misc_feature (1)..( 588): cDNA_ID_3058589_gDNA_ID_1620312_Annot_ID_153006 3000 nt of promoter + ATG
gatcttccttctcctaactaaacatagaaacatcttcaaaccctatctctgaataagtcttatttaagtgaatacacatctttttggtatgttttgtttacttttttgagattttgagttattttctaaacatttctacatttgaaatattactttattattaaaacatagaaaacgtctaaccggtcggaccaggatgaaccatgattcatgacccgaactcacacccggttttgataaaagttttaaaagagactactagacgacaaaaacaaaaacaaagactagtaaataaattaaaaaatgacccgaacacacagccggttcaaagtccggttattaaatcattgattaaaaaattaaaaaacaaagactactagatgacaaaaacaaagaccagtaaaaaacgttttaaatatttttgctgtaaagtgtaaactacataaattgtctttacgcaacacacctccactcgcgcagcccaaccaaaaaaaaaggtgccctgattgtttactcacccaaagtttctctctttctctcttctccttctgctgttttccgcctcacaccattactctcccagaaatg

SEQ ID NO: 726 - DNA, 3000 bp, Unknown
  misc_feature (1)..( 3000): cDNA_ID_2122292_gDNA_ID_1620312_Annot_ID_153012 3000 nt of promoter + ATG
accgagcatgaccgagcttcctctcatcacaatttctccgacagtttctccatttctctcaacgctcaaacccgattcaggatccaccacgtcgatttcagtaaacccgacggttctcactccttgccgtgccttcaatctcgctcgatcgcttgccggtaaatgattccattttggcttccacgcgcacgagacgattacaccggcggtttccgttaatccgtaaccgtgactgataacgaaaccaattgattcggctcggaggaggacggtagctggaggcggagaaccggcggttaagatgttgacgggatggttaagaggctgagattcctgagtcgcggataacatgttgagcaccaccggagctccacacatgtgtgtgacgccgtgatcacggatcagacggtagattaacggcgcgtcaaatttacgcaaacagacgttagttcctccgacggcggcgattccccatggattggtccaaccgttagagtgaaatatcggtagagtccataagtaaaccggatttttcggtacggcccaatcaattagtgaatcaactgacattacgaaaattcctctgtggcagtgtaccactcctttaggagctgaagtcgtaccggaagtgtaattaagcacaaccggatcccattcgctttcgggtcggatccatttaaaacccggatcacctctttcgataagatcatcgtaagtgtaactgaattttgaaagatcagccacgtcagcaactcctccttcctcttctttatcggcgatgacgacgagaatcggcggatcagtcgtcatcatcgagaccgcttcaacggcgagatcaacggagaagacgtcgacgaaaagaagcttagattcacagtgacggagaagaacagagacggtgcgtgcgtcgaggcgtgtgttgatgttgttgaggattgcgccggacatgggaacagcaaactggagctcgtacatagccggagtattgggagagagaacagagactacgtcagacctgccgattccgattgaagacagagaagacgccacgcggagacaacggaggtttgtttcacgccacgtgtaaacggtgttgctgccataaacgatggaggtacagtcaccgtaaacggtggcggctctctctaaaaaacctatcggcgtcaacggcggcgagtttgcggcgcatggcttcatttcctccatctcttcctcctagtggtaatcaaagactctactgtactgtactgttcttactgtttattatataatgacattttatttccaagtgaacaatccacgtgatgaaaaatttgtaaaacaatattttgggtttagaaattgagaacaaatctaaaccattagctggaaattaattatcttcagcttccaccacattataatcatagacatttgttacctaccctacacaaccactagcgtactaagtcttaaaccaatgttcgaaactactaaatataattagatgttgatttataatgtattgttattcgacaccacaactttctttgtttgctgatcgtcactcaaagtcacattaattgtaatcttactattacgccaatatagattgttaaacaaacaaacaaaaaagtttatagagaataaccttaaaatatcgcttaatctcgttgcaatattgtttggtggatctaaatgtcgtatgtggtaatttcaatgttaaaaacaaatataattggcatattatcttttatgttggtatggtatttttctacacttttataacatgaaatgatttttctttagataatattgttaaactttgtaaaagaaataatggttgtaatattgaaaatgatgttaatatttatgtactattctcttgttaaacattcattttaattaggctattcttaattaagtatagtatgtgatgttgttattaacatttttacgataccaagatatattaatttgtcattttttccgatataaatttgatcatttgtatagaatattttaaatctatatattgaacttaaattttaatggaaatatttcttggtttagtacgtacagtatatattatttagagaatttttctgatatccatcttttagtgactaactaatttacttcaaaggttttgaatgaattttaaaataatttacttagatatatatatatatatatatatatatatataatgactaaattaatctactttaaaccatcgttaactaacagttttggtcgaactattttgacgaaaaaaaactgaagtaaaaaagttccaaaattggttacaaacggataaatggaaaccataatttcaaccaaactctacagaataagaaaaaacaattatgaagtcagagataagaaaattgagagatattaaaaacaatttacattttatttttttgttaaatttcattttctttaaccaatataaatgtttcaaaactttagctccgaatagtaactgcgttttgcgctatgggagaaatgcggtgcggttcaaatagtaatgaaaatacatagatacatatgtatatgtagaaattttgatagggttacagcactgttgtgatacggttttgagtgcggttttagttacctttcacagccttaattggttcagggatcaaccgatcgtccgcgttcgcgtcgtgggtcatgtgatggtttagccatttcgaattccaaagcactcacatgttttatcccttttatttattacgggatatgctttgctacattttcctcacgacacattaatacattattaatgagattggactagtggcgggtgcaaaattatatgggaaggggaaagatttttttgttctttttttttcagccacattaaaattatgaacatacacaaccacttgagtactagctaattccaaaccaatgttcaaaaaaaacccaaaaaaaaaccattatagacaaacttaataaatagcgttggagagagagaataaacatgaacatctaaaaagggaaaggaga

SEQ ID NO: 727 - DNA, 3000 bp, Unknown
  misc_feature (1)..( 3000): cDNA_ID_3058583_gDNA_ID_1620312_Annot_ID_153013 3000 nt of promoter + ATG
aaacgcctgaccgctgcgtgtcttttctaaaagaagtgcagtgtcattatcattcctttggcctttaatgatcgattatgtcatgttgagcgtggtttacgtggggccttaaattagtgatggtagagagaaaacgataagtgaccataacacgtgcgaattgtggtaaatctaaaagtatgcatttaaaaaattcgtgaacggcaggattcgaacctgcgcgggcaaagcccacatgatttctagtcatgcccgataaccactccggcacgtccactacttgttgtctcaatcatctgcaaacggtatgtataatataattcacatcatcgtcatctcttaaaactgaagaataaactatacagtaattcggtaaagatggtaatgttttatttatccttatagaattttgaaaccttaaaaagttaaaatcttatatatcattcaatgcgttttcaaagtggtattgtatgccttgtcatacataaatatgaccaaagactatagcgctacgtagtcaaacaagtttgtttatttacatctaacatgccaattggcttgagatctgtaatatttgtcaaccttatctccattgtcatcaccaaggtgtcctagataatcacgaaactcttttttcttttctcttatagataagtgtttttcaatttataaggagcagacattagaaaacaatacatttgaccactcaagatggagcaaatgaagccatgcgccgcaaactcgccgccgttgacgccgataggtttcttagagagagccgccaccgtttacggtgactgtacctccatcgtttatggcagcaacaccgtttacacgtggcgtgaaacaaacctccgttgtctccgcgtggcgtcttctctgtcttcaatcggaatcggcaggtctgacgtagtctctgttctctctcccaatactccggctatgtacgagctccagtttgctgttcccatgtccggcgcaatcctcaacaacatcaacactcgcctcgacgcacgcaccgtctctgttcttctccgtcactgtggatctaagcttctcttcgtcgacgtcttctccgttgatcttgccgttgaagcgatctcgatgatgacgactgatccgccgattcttgtcttcatcgccgataaagaagaagaaggaggagatgctgacgtggcggatcgtaccaaattcagttacacttacgatgatctgatccatagaggtgatctggattttaaatggatccgacccgaaagcgaatgggatccggttgtgcttaattacacttccggtacgacttcggctcctaaaggagtcgtacactgccacagaggaattttcgtaatgtcaattgattctttaatcgattggaccgtaccgaaaaatccggtttacttatggactctaccgatatttcacgctaacggctggagctatccatggggaatcgccgccgtcggaggaactaacgtctgtttgcgtaaattcgacgcgccgttaatctaccgtttgatccgtgatcacggcgtcacacacatgtgtggagctccggtagtgctcaacatgttgtcggcgactaacgaatttcagccgttaaatcgtcctgtcaacatcttaaccgccggtgctccgcctccagcagccgtactcctccgagcagaatcaattggattcgtgataagtcacggatacgggttaacggaaaccgccggattaaacgtgtcatgcgcgtggaagccacagtggaatcgtttaccggcgagcgatcgagcgaggttgaaagcacggcaaggagtgagaaccgtcggatttactgaaatcgacgtggtggatcctgaatcaggtaggagcgttgagagaaacggagaaaccgtcggagaaatagtgatgagaggaagctcgatcatgctcggttacttaaaagatccggtcggaacagagaaagctttaaagaacgggtggttttacaccggagatgttggtgtgattcattccgatggttatctagagattaaagatagatcgaaagatataattataacgggaggtgaaaatgtgagtagtgttgaggttgaaacggttttgtatacgaatccggcggtgaatgaagtggcggtggtggcgagacctgatgtgttttggggagagacgccgtgtgcgtttgttagtttgaaaagtgggttgactcaaagaccgacggaggtggaaatgatagagtattgtaggaagaagatgccgaaatatatggttcctaaaacggtgtcctttgtggatgagctgcctaaaacttcgacggggaaggttatgaagtttgtacttagagagattgcgaagaagatgggtacgacgaggttgagtcggatgtaaaattagaacttgcgaatttgatagaacaaaggcttaaagtgtacttttgatgtctaataaacaaattaaagtgtatgaaaatgactttcgtcatgagttacgtttttttcgttgccatgttgagttccgctcaagaactcggccagaaaaagctgaatgaccgtttccgtggttgaagcctagtttatatggtgcaccccaacaatcagccttagccataactaacaagtatgagaatgtcttaagtccattgtagaccgtttcagtatagggttaaaaatttatggttagtgatcctcggccaggagaccaaacaaaacaaaacagaactaaacaaacatcaaactaactaaaaagagtaacatagtccaacgcgttaacaccgtgtcttaaaagacacgtatctcacaactcacaagttgcgtgtccataattatctcatttatatgctgttttgtaattaattaatttgatgactgttttgcagtttccatatatagttggaagccatgttatcttaccaagattaatttgtaatataaaatacctccacgaaaaaagaaaacccaactcattaagcaaactcggatctccttctcttctctctctcgctaagaactatagaagatg

SEQ ID NO: 728 - DNA, 3000 bp, Unknown
  misc_feature (1)..( 3000): cDNA_ID_2122305_gDNA_ID_1620312_Annot_ID_153017 3000 nt of promoter + ATG
gtagagaaatatttggagagcgagatcgatgttctgctgttgggtgatcatggagactaatcgcttcgggaatagcctctgcggccacggtttgatcggtggcttctccgtgcagtattgctgaagagaagcggcggaggcggaggcggagaagagacgacgagaagctacgaatggagggaagcgcgtggggttcacgcgggaaaggaacattgttattgaattttgagctgcggcgactttacgaaggcgacggaagatgaatttaaatttgccggtgtctttattaaccggatacgtgccggtttgagtattcccggtcttctaaatccattatctttcacagccatagttaaccaaaaataaaaagtagtttggttagtaattttggtttagtttactttgtatttaaaagttgtagtgatacgtatacgtagttacgtacatgaaaagttgattttgtctactgcaaaccggttttgtaaacaaacaaaaaaaaggtctggactaatttgcccacccgctgctgcaactattcacatctttttaaacagtggtttgttatgtgtggctcaatgcaattatacaaatcaagcacaagattctgctaagttggaaccttttagattctaaatcacaatacattggcacgtgttgtaatagatagttattttaatactttttgtcgaacaatttgcaaaaatataatttggtcgctatatgatcgctaggttagaggttaccatcactgaacagtgctttggtcgtaaggttaccccatccgcattcgtattattctggataaggttttattttgggctcatttccctttcgtggaaaacaaagaaaaaaaaacaataatgatgattcacttttactcctcttctctccacagctcgaagttcttggacggattcagatatcatagcctatctgtgattagatctgaagcacgtagtttcaacgtgaccaccacgaggaaggaggtcgttgtggcggctgctcctcttctctctttgccggaaaacagggttatccctctctccaacctcgacctgcttatccctcctgtcgacatcaacgtttgcttcttctacaagaaaccactttatggcattattggtgatgccctcaaaacggctatggcggaggctcttgtctcctactacgttctttccggggaggtctccatcaatcccaccaacggagagaacgagattctctgcagtaacggtggtgtggagtttgtggaagccgctgctgacgtggaactccgagagcttaacttgtatgaaccttatcaaagtattgccaagtttgttcccatgaaaaagcatggagtctttgctattcaggtaatagtgtgtagtgacgaaagctggctccactgatatgtctcaatctgattaatatatatatattggaataagttttgggattctagttctgtataaaatacaaaattgaagtgtctatctattcgttgcatttcacaccttcaaagattacctatatagccatatacttttacttattcagctctatataaatcaacaacataactctgttttttttttcgctcgttgttattgttttgaattgtctgaataggtaactgaactgaaatgtgggagcgtagtagtgggatgcacatttgatcaccgtatagcagatgcttattccatgaacatgttcctcgtctcgtgggccgagatatctcgatccgatataccgatttcgtatgtacctttgctcaaaagatccctcttaaagccacgacgacccttgatcatcgactcttcaatagacaaactgtacatgcctataacgtccttgaccgttccacaagaaatcactaatcaagataatatcctaacaagccgtatctattacatcaaagcagatgtcttagaaaagtttcaaactctggctactaatggtaagaggaccaaactcgagtctttcagtgcgtttctatggaaactcttggctaaacacgctgcaacagagtcggtactcccgactaaaacctcgaaacttggcatcgttgttgatggaaggaagaaacttatggagcaagagaactgcaattactttgggaacgtcctctcagttccatttggagagcggagaatcgatgacttgatccacaagccattgtcttgggtgacagacgaggttcacaagttactggagagtacaatgaccaaagaccatttcttgaacttgatcgattgggttgagactagccgtccgataccagttatatcaaggatctacagtacaggatccaacgatggacccgctttcgttgtttcgtctggaaagagttttccagtggcccggattgatttcgggtggggctcgcctgtttttggatcgtaccatctcccacccgggagcagagctggttacgtaatgacaatgccgagtccggtggaaaacggtggctccggagattggacggtttacttgcatcttacgaaaggacagttgaggtttattgaacaagaggcttctcatgtgtttaatcctgttgacaacgactatctcaagatttaaagcattatcaaactttggttatattattatgcaaataaaggcttatataaatttggcttttatagttgtaaatttcagtttaagatcaatattttgatttaagtttaaaccaaaagaaaatgagtgtgcagattgctaatggtaatcgactaatcgtcaattcttggccttacattgtgggggtatgatcgtcattttacactccgataattctgaacctcgcgtccatcgaacccgaaaatacgtaaacatccccaaatgtcttctttcttcgttatccatttgagggtattattgacctcacggtaagaaaatctacaatatttcacggataacgaaaacaacactcgaattaaaatttggaaatcaaaagtctcccaggttcctttgaaagatcacactactgttttttggactcgagcttcttcttcaacaatg

SEQ ID NO: 729 - DNA, 3000 bp, Unknown
  misc_feature (1)..( 3000): cDNA_ID_2122311_gDNA_ID_1620312_Annot_ID_153019 3000 nt of promoter + ATG
tgtttctaagctacacctcaccacacaggaaccaatccttctaccggaatctaaaacaccaccaccaccagaacagaatccaattttcgtcgcgacgcccgaattcgggatccggcagtgctgcttcacgggggaaaatcctccggcgccggtagatgtaatcggagaataacggaaagacgtcggagatggagcaagtcggagagagagaggcattgttgaagaagaagctcgagtccaaaaaacagtagtgtgatctttcaaaggaacctgggagacttttgatttccaaattttaattcgagtgttgttttcgttatccgtgaaatattgtagattttcttaccgtgaggtcaataataccctcaaatggataacgaagaaagaagacatttggggatgtttacgtattttcgggttcgatggacgcgaggttcagaattatcggagtgtaaaatgacgatcatacccccacaatgtaaggccaagaattgacgattagtcgattaccattagcaatctgcacactcattttcttttggtttaaacttaaatcaaaatattgatcttaaactgaaatttacaactataaaagccaaatttatataagcctttatttgcataataatataaccaaagtttgataatgctttaaatcttgagatagtcgttgtcaacaggattaaacacatgagaagcctcttgttcaataaacctcaactgtcctttcgtaagatgcaagtaaaccgtccaatctccggagccaccgttttccaccggactcggcattgtcattacgtaaccagctctgctcccgggtgggagatggtacgatccaaaaacaggcgagccccacccgaaatcaatccgggccactggaaaactctttccagacgaaacaacgaaagcgggtccatcgttggatcctgtactgtagatccttgatataactggtatcggacggctagtctcaacccaatcgatcaagttcaagaaatggtctttggtcattgtactctccagtaacttgtgaacctcgtctgtcacccaagacaatggcttgtggatcaagtcatcgattctccgctctccaaatggaactgagaggacgttcccaaagtaattgcagttctcttgctccataagtttcttccttccatcaacaacgatgccaagtttcgaggttttagtcgggagtaccgactctgttgcagcgtgtttagccaagagtttccatagaaacgcactgaaagactcgagtttggtcctcttaccattagtagccagagtttgaaacttttctaagacatctgctttgatgtaatagatacggcttgttaggatattatcttgattagtgatttcttgtggaacggtcaaggacgttataggcatgtacagtttgtctattgaagagtcgatgatcaagggtcgtcgtggctttaagagggatcttttgagcaaaggtacatacgaaatcggtatatcggatcgagatatctcggcccacgagacgaggaacatgttcatggaataagcatctgctatacggtgatcaaatgtgcatcccactactacgctcccacatttcagttcagttacctattcagacaattcaaaacaataacaacgagcgaaaaaaaaaacagagttatgttgttgatttatatagagctgaataagtaaaagtatatggctatataggtaatctttgaaggtgtgaaatgcaacgaatagatagacacttcaattttgtattttatacagaactagaatcccaaaacttattccaatatatatatattaatcagattgagacatatcagtggagccagctttcgtcactacacactattacctgaatagcaaagactccatgctttttcatgggaacaaacttggcaatactttgataaggttcatacaagttaagctctcggagttccacgtcagcagcggcttccacaaactccacaccaccgttactgcagagaatctcgttctctccgttggtgggattgatggagacctccccggaaagaacgtagtaggagacaagagcctccgccatagccgttttgagggcatcaccaataatgccataaagtggtttcttgtagaagaagcaaacgttgatgtcgacaggagggataagcaggtcgaggttggagagagggataaccctgttttccggcaaagagagaagaggagcagccgccacaacgacctccttcctcgtggtggtcacgttgaaactacgtgcttcagatctaatcacagataggctatgatatctgaatccgtccaagaacttcgagctgtggagagaagaggagtaaaagtgaatcatcattattgtttttttttctttgttttccacgaaagggaaatgagcccaaaataaaaccttatccagaataatacgaatgcggatggggtaaccttacgaccaaagcactgttcagtgatggtaacctctaacctagcgatcatatagcgaccaaattatatttttgcaaattgttcgacaaaaagtattaaaataactatctattacaacacgtgccaatgtattgtgatttagaatctaaaaggttccaacttagcagaatcttgtgcttgatttgtataattgcattgagccacacataacaaaccactgtttaaaaagatgtgaatagttgcagcagcgggtgggcaaattagtccagaccttttttttgtttgtttacaaaaccggtttgcagtagacaaaatcaacttttcatgtacgtaactacgtatacgtatcactacaacttttaaatacaaagtaaactaaaccaaaattactaaccaaactactttttatttttggttaactatggctgtgaaagataatggatttagaagaccgggaatactcaaaccggcacgtatccggttaataaagacaccggcaaatttaaattcatcttccgtcgccttcgtaaagtcgccgcagctcaaaattcaataaca

SEQ ID NO: 730 - DNA, 3000 bp, Unknown
  misc_feature (1)..( 3000): cDNA_ID_3058560_gDNA_ID_1620312_Annot_ID_153031 3000 nt of promoter + ATG
agtttaattgagaaacaagagagttatcgttatcaatataattgaccagaccgtgccgtggcatatgattctattccaattgtttcctgtaaatagtgagtgtagtgtttgtgtatgacgtaaacatttctttcaatatttgactatattaattaatggtaatgtcgcagaataaagaatgaggttgcagctttagcaccataactagaagatcgtctcgaccaatatatgtttttggctgtcgtaactcgtcgccacaacacatgagactaaccaaataatatattttcaataatttattcgaaatatttgcttaatcgtttttttcttaatcttaatatttatatttattaaccactttcataaaatgggagcagaactatgctagtgcatgtaatataagtaaagtgcatggaatagtttgtatatatgccgaaatgggtatttgtgccctacgacctggcgatagcaaccaatttcataaccgacaaagagagatttcttataagaaaatgaatttcacttacttatacctagtgatgatttgaatgtttcaatatattcatggtttaagaaataacatgtcatgggttttagaatatgttaatatatagatagatagagaagtctacaaataacttacttacttttatcttaaaccatgttttacgttgttttttatgtttcgttcgataaaaaatcatatggccatgtctttcttctttgttaaaatatcaaagaaccatattatactacgagctagcgaaaaatctatcatcgtgaggattgaggaagccattcaagaactacaaaagtttacagaaaaatttgtacctcgtgctcttgtcctttcttgctagacaacaaatttattatttgccttctggactctaatataatcacaacaacacatattgctaggtgcaatatcatcatattagcactttttaattctatggtatatttttgttttgtaaccatatatattgtccattcacaaagtcttttctattacacatattcatgatgagaaaattgatttgatctaattactagagaatcatgcagaggcataaaatgatctggaaagcatttatttatcatttgatttgataataacattttatggaaacacctatctttaccaaagatttggaacaaatagaaaaacataagcaaacaaatatatatagtcggactaaaacaaaaacaaaaagggggatttgactgatggaacaaaagttaaaatcggtggattagaaatctgtgaaaacgtggaggatgcttattcactggtgaaattgagggatcatatataaatatgaataataatgctagtagaataagttctatttatcacttgatgattacaaatctataatatgctttcaaatttctctcctgatgtgttgatatatattacagtctttttaatatcaaaaaggtttttgtcttctctcattcattcattcatcgttaatacttttgtttttgtgtgacatattttcattattcttcttgaattatgtcagaaatagctagctagcacgattggaaagtttattcaaaatccatcttatttgttttgtacttttgacgtcatgaatattatgttgatgttttttcccaaaccacaaaaacaaaacaatcaaagtttttcagaccagaaaacactatatgttggggtttatactgttcttcctaaattagagttcgaattcaagagtagtgatcatataactttcgttttcctttcaatctttcataaacgaatccaagtaccaagttaaatgcatggttacgtattatatactatatataaatgtaatcatgttaatgttacaaatcaaatcagaagaaacaaagttatacataaaggagaggatgttttgattttggtcgaaaagaagttcaacgtcaatcattgaaagaatgaagtaaatagcagccaatagaaagggaaaccaaactacaaacatatcaatattacataattttttaaatataattaattatccatatccacacactaatctttcattcaaattccatattaaaaaaaaacacagaagaattattcttaaaggcaaatttgttctttagacttatgaaaagaggaaactcctccaagtgcaggtggaataaatcctctgtttgaaacgacttcactactgtattatttcttaatttattttgtggctcacaataatctgttccttcattgcttcgtcactcaatatatgctacagcacctacttgttgtactcttctgcttcacatctcgtgtttttattctggaaacattcgtttttccagagaagagaagacgcaagaacaagttttcaaccatggagaatggagaatgatttacttttagcataaagtcctcaaacgtattagccgcatcaacaacactctttgatgtgaacacaagtcttaagttacatgcaaagtgttacttattcattaattctagtatagttcttatactttagaacttgaagggtacaccataataatagctaaagagatcaagatcggtgattatagttatcaaatttccaagaatatgtgaacacttcatagattatgtaatgaactaatgattacaaaaaaaaaaaaagtacaaaggcaaagctagaaacgacttttgaatcaggaaaatctctctgcaggtttgtttggtccggcgggaaaatttgatatataaaccgaaccggataacatgaaccacccggtttttaaattttgctggttcttgaccacgacgaagtcacttgcttaacaggctggttctgcttcgtggtctggttctttaaagctggtccaaataataataaaataattaaaagatgaaattcctttcttgccccttttgttcttctcctttctccgtctctctctctctctctctctctctctctctctctctctctctctctctctcttcgacttcttcgtcttcgtttcttcatttcgaagctctctctgtgtgtgatg

SEQ ID NO: 731 - DNA, 3000 bp, Unknown
  misc_feature (1)..( 3000): cDNA_ID_3058553_gDNA_ID_1620312_Annot_ID_153035 3000 nt of promoter + ATG
caaaaatcaagcttcgttgctctctagtttcaatgttcctttaattaactaaacagaaaaaggtttagttcccaatataggaattcatggatcagctaatagtttaatactactacttctgtactactgttaattaatgacaatcctttgggtaagcctaggggttttaaaaaaaaaaaaacatttttcaaaagtataaatgtagctcgttgagggactcattcagaaaacgaaaatatgagtacattgctaggtttggaatataggagttaatgaactcaattccttgtaccattaactaaagataaaagaaattaagtgtatcctaggagttttagaaacctaactcaaaattaggaatggacctcattcaaaaacgttagaagtatagctagggttgttatactgtttttgattgaaaatgctttttaaatagatcataatagtatcttgtttaactcacatgcagcaaaacgtctaaaaactgcaagcatactgtacttctttactttccaataattaaaatttatatctaataagaaaaatatatattactgtataatcaacgaataaaatctcacttatttaaatttcctgatatataaacatagtcttacaatttatcatatttttatttcaaggcattaatgatttgtcgagatgttgtattgatatggtcatgtgaggagtgaatagtttattttttttcttagaagacaatttaaagaaaattagaaaagagttattaaattgagaaggaatatttgggagaatgaaaagggaattagaagcaaatatttaggttctttagggttcacttgtttttgtttattaagggaaacaaacaaaatccactttctggctgagtattttcttaggtctaatatatatttaacttcacgtataatctaaaagcatgcatgttacgttacaataattgatcgaattctttatatgacacttggtttatatacgtacgagggcaccttgtattgtacacacgtatgcatatatgtatgtatttgaagagaaagatactttctaagacaataatttccgtacctttggaaggcaaaacacagagtttatatattccaaattaaaagtgggataaaaaaatataataattctttgacaaaaacatacgaatagttaaatactattcaattttgtatatttttcattatttttcagtatgacatatttctgtttcacagtagataaagtcaactccataattttttttgtagaattataaacgaacaatgtgaatgtaaaaatgtcgagtacaaagaaaacagaaacactagaatgcatacattattacattcgacacaaacaagtcaaaaatatatataaatctgcctaattttatttcttttcaagtacgtattttaaagcgacatgtatatgacttcgatttggctctaattgatagacaacacaaaacggtcaaacaagtagccggttgatattgtagtcacatctctaggaactaaatgtctatacgagctattcataaactcaagaacgtactgatatttaatgtatatttatctctttaggtatagttgaacaatctacggtcagaaacttgaatttgtttgattccaaaatcgtataaggaattattataataagatgtgaatagagagtgaagtgagaagcgaagagagtgggggagaaaataaaaaaggagtcagagaggacacagtctctttctctctctcaagtctcaacatatgtatcccgtcgtctccggggtaccaaaatcaaagcactctctctttttttattttatttttttttggttataatgaaactttttatttattttagaataggtcttgtgtttgtttttttcttcttgttatttatttatttaatttaattttggcttttgctttgactatagattagataggacagaagagagcgaccctttattctctctcctcttgtactcttctccaacatttttaattattattcttcatgataatctgtgaacattattattttaaagatcaattgagtttttgatttattactcaaattgttaaggttttaatggatgataatcgtattaatttttattgttaaaagttgtatgcttttcatctatgaaattggtcgattattaaatacactttacatttgaaaatttcatctactaaattgatagaaaacaagatttattttgctattattcttcaactttatctatggaaatcaaaatttcagtagtttaaacgaataaactaaaacatgaaatcaattaatctagccgtaaaataatttatattatattgatagatgggtttacttgttgaaaggtgaaaaagacaaattgaaataccatcccaaaataaaataaaaagcttccaatatttggaatatagcgaatgacaatattaccctttctcaactatcgttttccaagatatactctcgaggaacaacatctcacacatacacatacacatacatgtacatgaacgaacacacatatatctctctctcttacctgtttttaattttcctggatttagttttattccttttttctcttctgcctttgcttcacaacacacatacctctctctatctctctcttccttctttttctctctctctgcgtcttactttgagcatgtttgtttcttcaagaagatcatcactcaacttctctctcttcttctaagcttctctttaacttcatctctctcactttctcctttctttctgagatatagagagagaaagagaacaaaaaaaatatcaaatctttcagacacccttttgacttctttgcctaaagaatctctctgctttctcttctccttagagaaaatcattttaaattcctaagcaaaaccctcaggagaaaaaaaaaacaaaagaatagtcatcatcatcatcaccatcatcatccttatcatcatcaacaacttcagtggcagcaatagcaagagaaaggtttctttaattatgtctatg

SEQ ID NO: 732 - DNA, 3000 bp, Unknown
  misc_feature (1)..( 3000): cDNA_ID_3058532_gDNA_ID_1620312_Annot_ID_153034 3000 nt of promoter + ATG
aattaaattaaaattttgataaatgtagggtgatatttgggatgttggtctctctacctgtgctcgtcgcctactacgcagctctggagtttattcattgattaaactaataaattcgattatatcatcaatattaccctttgttcatctttcacaagtttttttttttgttatctcttttacactttcctcctaaaggagattttgaagtatattcgagatatgaaaaccattaactgaatgaattaacctagtttatgcttaattttatactttcttaagctctctttattttcgtagtatgcataatttagtattttgttcacatatacgtatcaagaaaagataaaaactctataaatgaaaatacatcatgttcggatctaaaattgttttaatacgtacactaaatattataagccctttttttgttaacaaaaaaaaaaaaagaataaatgaaacgaaattcaggttagagatcaaataaaatcttgttattatttgattcatgatcatacatactaaccaaatcaggatttatgaaataaattattctttctcctcaaccgaatcaatatgaagataaaaggggtaatttagtcttttcgaattcgtttttcttaccgaatctctttagttttttttctttcttttgtgtggaggagagaagagaacgcaacactttcttcccaatctctctctgctttctctctctagacgtgatctctaattctctaatgtcttcctgcattgccatttcctctaacccctccacaatcggaggaagacgattcctgggagcaagagaaacgatgggacttcccatcggaaaatctcttagagtgagagaattatggtgtgttcttaatgcttaataatcaccgacacagccattgttcttcatcatctccatggattttgattccatttctcgggaaagcacttttctttccccattgcttaaccaaagtaccatcctttattccctctctgatgttctgattcaatcttaaaaacctcagcttgaatttttgttgtggggttttggttgggtttgtgaattttagatgcaatgtggcaaatgaacttgggatcagatgatacaatgggtgttgatgggtcttatccggaacgtcacggagagccagattgtgcttattatataaggactggactttgtaggtttggttcaacttgccgattcaatcatcctcacgaccggaaactggtactgactctgtttctgtgtttgttctttcctctgtatcttgttgactcaaagtttgtagctttgagggtctgtgtgtgtgtgtgattacaagctgatgaatagtctcgtatccaatttctaggttatagcaactgcaaggattaaaggagaataccctgaaagaattggtcagcctgaatgtgaggtagctctgtttcgaattactatcatagtaatgtcttctagttatcacattgtctcaaagcttctatttttgttgttgtgtctgtgcagttttatctgaagacagggacctgcaaattcggagtgacttgcaagtttcatcatcctaggaacaaagctggtattgatggaagtgtatcagttaatgtcttaagctatcctctacgtccggtatgtatacatttcaactttctaatctcaccactgctttgtaaaattttgcctctctcatgagttctgtttgcagaacgaagatgattgctcttactttttgagaattggacaatgtaaatttgggggaacttgtaaattcaatcaccctcagactcaatcaaccaacttgatggtttctgttcgtggctctccggtttactctgctcttcaatctctaactggtcaaccgtcttattcttggtcgagaacatcttttgttgcaaaccctcctcgtttgcaagatccttctggtttcgcttcaggatctcaaggaggtctcttctcatccgggtttcattcgggaaattctgttccgctcgggttctatgcattacctagagagaatgtattcccggaaagaccaggccaacctgaatgccaattctacatgaagacaggagattgcaaatttggaacagtctgcaaatttcatcatcctagagacaggcaaacccctcctcctgattgtgtcttaagctcggttggccttcctttacgcccggtaagctaataaaagacttcagattctttcctttatagtctcattatgtggtttggtaaattcttgttgctggtttgaaacagggagaaccactgtgcgtgttctattctcggtatgggatctgcaagtttggtccaagctgtaaatttgatcacccgatgcgagtcttcacttacaacaacaatactgcatctccttctccttcatcatctctgcatcaagagactgcaatcaccacagagctcaggaatctcctagtctcttcttctgtggaagcaaaacccacatcactccctgaaacaacctctgctaaagacaccattgttgatgcacagcactgaaaaccctgtgttttgtctatcttgaaacaatatgtaacatttgttttgctttatcttgtaagcatttatgtacagagatgatatctgatctaatctgattcgccttttgttgtaattttctattggcaacagtttgtgcattaaaaaaaaaaacagtttggtcttaaacgggccttcaaaaaacgtctaacaagcccaataataaaaccataatgaaaagaagaagaaaaaagaattaaccactcgcatgtgtaacgcgttgaatacacacgctcgttgtatctatctatctactcctccggttaacgggggtttaaagccacgtcggtgctacacatgtccctgatttctcctttaacataaaactaaacagctgttttgtccgcaatcattatctattactaataaaaaatctcaacttttgttccttactcttattacttcctaaatccgatcgaaacaactgttgggttagtttctaatttccaaga

SEQ ID NO: 733 - DNA, 3000 bp, Unknown
  misc_feature (1)..( 3000): cDNA_ID_2122339_gDNA_ID_1620312_Annot_ID_153027 3000 nt of promoter + ATG
gtgaaacacggttctgcaaacagatgcacattccgaccacacgagatcagtgctgcagccgcgtgagcacacggcaatccgtaaatctgccaacgacggcatgagcaatcccgtgtccgtatatccacaatgttggttctctctgtcgacacaatctcaaactcgacctcgttcgctcgtaaaacttggtaacaccgtgcgtctgcaaccgcttctgttatacgtctctctgcagatggcacgagtattgagttccatcccatgctcaactcacggcggttatcgaaccaagacgatatttgatgccggatatgttccatcatctgtatgattgggagttcatggcattcgagagcccaattgtataatacctctgttatccctaaaccgaaatgtccataccgcacaccttggaaatatgctacagcccagagatgcggcaggtagagttcgaaccactgaacaacatcttgcgatatctcaatcatttcgttagacttcgtttcgaattccgctggtgtcagcgcgtaaacagcactccagaagatattaacaagcttcgtgttcttgaatgtatcccggaagttttcgctaacataacggagacaaaacccatggaaagcagttgggaaatgagtttcaacggcttccacaactgcgctctgtctctcagagagtatcgtgagcttcggcatgctatcggtattcatcccaagaagcttcctcagctccgaaagaaaccacgaccagttttcatcgctttcattatcgacaatagcgatagccaagggaaacaaaccatcatccgcatcaacagctgcagcgcagaggattgcacccaagtacttccctttaaggtgtgctctatccaattcaagaagaggccgacaagaactgaaaaacccggagatacatgctcgatacgcaataaacaaccgttggaaacaattctcaggtcccaaagcagaaacagaagcaaaactcccaggattgactaatttaatctgctcacaatacgcaggaagaaaccggtacccttcctcataagtcccatgaagcgcagccatactccgctctttcccacgccaagcctgcatataagaaaccgcaaccccatgctcgtcacgtatatcctgcaatatctcctttggtttatactgcggattatctctaatgcgtgcctctactgatctagcaacccaaccaacggatgcttgctgatgatggagatcacggacaccttcacaagtatgctcactattaagcgtcctaaccgtaaatgtctgaacacctggacatttagcagcatggatacgccaaggacaaccttctttagagcatttggctatgaatcgactacgatctgatttcacaatccgaagatcaaaatgcagagctatagccaaatctttcaaagttcttctgcaagtttccacatcgggaaactctttaccaactgctaaaacatgttctgtagctaaaatatcgtcggaatctaaagtaattagagctccatcagccattaggcattgcatctggaaaagggtttcttcgtctctgtgatttcaatgcaaaatacttatcagcatctcacaagaacacacacttggtacatactaggagagacataaagaggcaaaatctcagatcgcaacacaaaaaaaaataactaatttccatgcttggatcacaagctcaattaacaaacaaaaaagacaaactttaaggaaattaaaagagacccatttccaaaatcaataacatttcccaaagatttcagacaacaattcaaagggaaattaacagacagcaacaaaacctttccagaaattggaaaactacggggatcttcgcgacagcgaccgaatcaggttcgtatcggactcggtggcctaactcggcgttaagcgactgtaatttgaagccgctagggttatcagcgtcggggagagaaattgcagacggcgacacaaaaagaaatgaaaggaggaagagagagagagagatgggaaagtggaaaagcttaactaaagatgatgacacgtgtcaaatatgaaatggttaattttattttgttgtatagtaagggataatacattaatgttttggaaacttaggataagaatacattaatgtttcaaaggattcagctctcttgattcggtattatatctaaaaaaagtcatatgtatgttttattagaggaaaaacaaatgttttgttataatttttgttttcaattaagaaataaatatgtatgtattgtggtaataaaattgtcatccggtatgaagaacacttgttgataaatgattaaatggcctcaaagatgttaagtgtccaaccaatccctgatcagagattttgggtcatgtaattaaaagtaattcacccttactgttctagtgtgatggatatttttgatagagcaatttacacttattcatgtttgttatcgctatttctgattatctttcacatgtatccaaagcggataaatcattacaactataaacaaaaattttaaaaatataaacaaaattttttaaaatataagaacaacaaaaatgtaaagtcatttggacgataataaatatataacaaactaaaactagatttaaaattagatctaagaaaatgggtaataagaatggctctccatgctttagggatattgaacaaagtagcaaaacaacaaaaaatagaattcgtaaaaaacgaagcaaaaaaaatccacaaaaaaagatcaccggagaagtttcattgatcttcatgtattctgattggcttcaatttgatctcttttctttctctctccttttgcttccttcctctgttttgttttcctttaaccatctcccaaaatactcttccctttaacgtgggtccttcaatctttttgaaggaccccgccattgtcaatcacctttcaaagggatctttattctttttggttttaggctatttagattattgaattgattttgaatgataatcatg

SEQ ID NO: 734 - DNA, 3000 bp, Unknown
  misc_feature (1)..( 3000): cDNA_ID_2122307_gDNA_ID_1620312_Annot_ID_153018 3000 nt of promoter + ATG
tatgtgattgacttgcctctgaagtctgaaccatttggaatatctctggcccgcttcatttctactagtcttaaggaatgattgctgcagggaaacatcactttatatacactagcgcttgtctctacataacattgttgttaatgtttgattcttttccacattcctctcttcctattaggatattttcttaggtccacagtcccgttagagatacaatgtattgttattagtagcatatcttgtgagttcaaaacataaaccaatcatacattgagctacacttccatgatctaacttggttttgcctatattctctaaattaaagttaacactaacagtatcaaactctctttccacaactatctcaccagaaatcatgattttcactctttaattagcatctatgttacaatcaacattcatatcataagttatcaatttggagatctcttcattctttgcaagcctccatcttcctccatcaatgtcagctgcttgattatctatatagcttgaagcggaacatggatgccgaatcttaagcggcctggagtggctgcttctcttcccttatacgttcatctgccacaagagcctttggtcctatttatattattcataatatgtaaaacaatgcatctaaaggtctcgaacgcataaaaccaaactcaagagtaagatatacatacctccaggacatagataaagccttttgagtattgatcatagtcctggttcttcaagagacagaaatttcatgcaacaattctttaagaggcaagacccctttatctagttcaccagcaaatttcttcaagaaaagttcccaagactctttatcaactttcccattcataacagccatggaaacaatcttcatcgcatcctcttctttccctaacttctgcaacccctcaaacaatatcaggaacgttgttttgttaggaaagcaaccaatctccagcatctcttcaagtaccctgactccttctttaacattcccattcttggacaacccttcaatcaaaacgttatacgtgaaagcattcggcttacatttcctctcatacatatcgtcccataatctacccgcctctgtcaactctcccttctcgcacattccagcaatcaacgtgttatacgtcaagagactagggatcgagcctttctcaaactcatcaaacaatttcctcgcttcagtaactctcccttctttacaaagccaatggatgagagtgctcagaagggcattatcaggcatacaattgttcttcaacatttttctccacagaccacatgcttcatctaccttatggtcttcacacaacgcatcaataactttacaacaaagagaagaatctggcataaaacttctctcaagcatttcatcgaacatgttacgtgcttccccagatttcttctccttacataaagctctgatcataacaccataagttacttcattaggctcaatctcattcttttccatatcatccatcaccgtagctgcctcagagaatctccctaacttacagtaaccatccatgagaacagtgtaagtcgtcgcatccggataccacccacgatccaacatctcttccaaaaccctcttagccgattccatatcacctctagcaacatacccacctagaatcgtagtgtaagtcaccaaatttggcactaatcccatcgaaggaatttcgtcgagcactttatatgcactttcaatatcatttttcttgcagagagctttgactagtagattacaagtgaagatgttcggcgtaattccaaaagactccttactgttcttaaacatggcatgaaccaaatcaaatctctgattctggattaaaacgtttaagagtgtgtttaacgatctaacggagcgtttaacaccgaaatcagggattcgaagaaagatcctcattgaagattcgtaacgacctgcgagaccgtagtttcgaagcaagtcgatgaagagattctcgccgcatttgatcggagggtatgagttccgaagatccgccatgagagactccacgggatcgaaagcacgagcacgggatagtttgaagagaattgagtggtaagtatcgtaattatgagtgaaaccgggatgagatttaccggcgtagagaaatatttggagagcgagatcgatgttctgctgttgggtgatcatggagactaatcgcttcgggaatagcctctgcggccacggtttgatcggtggcttctccgtgcagtattgctgaagagaagcggcggaggcggaggcggagaagagacgacgagaagctacgaatggagggaagcgcgtggggttcacgcgggaaaggaacattgttattgaattttgagctgcggcgactttacgaaggcgacggaagatgaatttaaatttgccggtgtctttattaaccggatacgtgccggtttgagtattcccggtcttctaaatccattatctttcacagccatagttaaccaaaaataaaaagtagtttggttagtaattttggtttagtttactttgtatttaaaagttgtagtgatacgtatacgtagttacgtacatgaaaagttgattttgtctactgcaaaccggttttgtaaacaaacaaaaaaaaggtctggactaatttgcccacccgctgctgcaactattcacatctttttaaacagtggtttgttatgtgtggctcaatgcaattatacaaatcaagcacaagattctgctaagttggaaccttttagattctaaatcacaatacattggcacgtgttgtaatagatagttattttaatactttttgtcgaacaatttgcaaaaatataatttggtcgctatatgatcgctaggttagaggttaccatcactgaacagtgctttggtcgtaaggttaccccatccgcattcgtattattctggataaggttttattttgggctcatttccctttcgtggaaaacaaagaaaaaaaaacaataatg

SEQ ID NO: 735 - DNA, 3000 bp, Unknown
  misc_feature (1)..( 3000): cDNA_ID_2122300_gDNA_ID_1620312_Annot_ID_153015 3000 nt of promoter + ATG
ggcttacatgtacgatgcttgtgctttgttttcaatggatgttccaacttccagctagattgttaacaagtcatatcttcatttagttgttcaccaaatccagtctcgcctaattttaaaaatttaatacatttggcgtatgtatattaggctaatgtatttggatctattcatgtatttttttataaaaattggagacaccgacagcattttcatctttagatgcagtcggatttttttcttgctgaaaaaatgtgtttcctctaaagagtttagagaaattgtaatttcctaaacaggattttaaccctaacattttttatatttatttaaaagtaataattcatttaaattcttcaaggtaaaaaatacgatagtccacaaggattgggagtaatcgcgaatacagaacaacagatcagagtatgacacgtggcgaaatctgaaagagagttataatcaaagagaaacgcgttccgaatccgacatcttctctctctctttctgaagtgaactgttgttgttgtgctctttggtttcatcgagagagaacctaaacccgatctgaaccaataacaataagaagacgaatggcgtcttcgtcgttctcagtcacatctccagctgctgctgcttccgtctatgcagtcactcaaacctcctcgcacttcccaatccaaaaccgctctcgcagagtttctttccgtctctctgctaagcccaagcttcgctttctctccaaggtacacgattccttcctcgattaagataagatcatttatcctgcaatgtagtttttagcttttcgaaatatggataatttcaatttactcaagttttgtttggctaatcttcgtcgattagtttttatctgcattttacgatttgattctctctgtatatatatttggcgtcaattagaattcagagaatactgtttttccggagaagaatgataaaatccgatttccagatttatgggtacaatcgtgatttggggttttttctttttaaatatggttgaaatcagtggaaatgtttaggaattttctagagtagtccaaagttgtaattcactaccgtagtagttgatctccaaggtcgagattatgggataactgtttctctgcatttgatgacattgcagcctagtcgcagtagctaccctgtggtgaaagcacaatctaacaaggtaagctccttttttagtgatctctttgagaaagtgtttatccagaaacttgttcatttctggactctccttctgcctttaaaggttagtactggtgcatcatcaaatgctgccaaagttgatgggccatcatcagctgaaggaaaggagaaaaactcattgaaggagtcgtctgcttcttctcctgaattagctacagaagagtctatttctgagttccttacccaagtaacaactcttgtcaagtgagtaaagttgctctgttctattacttaaatcattttaaccgtgattaatactttacctccatcatgtaggcttgtggattcaagagacattgttgagttgcagttgaaacaactcgactgtgaactagtcattcgaaaaaaagaagccttacctcaacctcaagctcctgcatcttatgttatgatgcagcaaccaaatcaaccatcttatgcccagcaaatggctcctcctgctgcacctgctgctgccgcaccagccccttctacgccagcctctctgcctccaccatccccacctactccagccaaatcgtcacttcctactgttaaaagccccatggctggcacattctaccgtagtcctgcacctggtgaaccaccctttattaaggttagattattttctgaaactaagacatgcgcttttcggttgatgttaatgcatgtgctttataaatagcgatttttgcaaattcatggctgctgcatttcactgtctgaattcgtaccatataactttcttggtctttcaggttggagacaaagtgcagaaggggcaagttctatgcattgttgaagccatgaagttaatgaatgaaatagaggtgagtttctgaatcatctgaaaatggggtaccatctgaaccttttatctaccttaactacttcgaatcatctcttactaaatacatacactaaaaaaatatgttgtttctctgttcaatcccacttagtcatctacttcatatgatttgtcaattatatatggatgaatacttgtgcttaacgtgtgccattgatttaactctgaaacttgaacttcttctcctcagtctgaccataccggaaccgtagtcgatattgtcgcagaagacggcaagcctgtcagcctcgacactgtaagttttctaattgtcgcagattacactgtcagaattttgtgtgctttactagaactagtttttacgatttcatcatttcaattgaaaggttatatataatttagaaagatatctctactgatattcgatgtttttgcgattttacagcctctgtttgtggttcaaccgtagaatcggcaccatgagaaatggagaaaagaagctctactaaattcattctctgtgctttggtaatacaaaatttgctgagacttctaaaaacgtttccccttcgctgtcactgttaaagtctgttaggtttgttagtttggtgaggaagaattgagttttctttagtttctctattcgttaaaaaaaaaaagatgagacatttttttccataagctctgtttttatttctttcctatatacacgaactcttcttgttctgttctatttgcaaattatccaatttcagaatacaagcccaacgtcaatatgggctgaataagggcccattttgtatgatagttaatgaagaatttaataaatatctgagaaagaaacggattgtttgttaacagaggcaactacaaccgcctttcttcttcttcctcatagcaatcgaaaacgctttcgcactttctcttgctttgacaatttctgtttttattcaatg

SEQ ID NO: 736 - DNA, 3000 bp, Unknown
  misc_feature (1)..( 3000): cDNA_ID_3058585_gDNA_ID_1620312_Annot_ID_153007 3000 nt of promoter + ATG
tgagtcacagtacagagtcttttttatctttctatgattagtcaagtcgcattaaaatctcaaggatatagatgaatatagatgaaaagaggttttcttccttgttattaatggagtcacagcaaatgttttttacttcttacgattgatcagttcacattaaaatctcaaggatatagattagatgaagctatgttttaaaaaaactgtttttttatgaagtttccatgtactgcagatcatgtggttggtggatatctttagagcaaaaatcgtggatacctcagagcaatctctaacgattgaggtcagaccttttcttcagtttatatgtgctcagatcatatggtcaaaatggttccactaagtctcattttttattgtgtaggtaactggagaccctggaaaaatggttgcactaacgacaaacttagagaagtttggaataaaagaaattgcgagaacagggaaggtaatttttcactttcaaccactttttgctccaatccttcttaactgtcaacaacgtctggctctaaatgtcttcaaattacatcttctgtcttgaaaaagcttgtttgaacggttggactcacatgtatcattacttgtagccacttggagcctcttttttttttttttttttttttggtctattatgtcacacatacagacccgagttcctttggtgaatctcaggacactctaaatggcagagcacatgaaattcccagtttagctttaaatacatgttcacatcttacatgaaaactgattaaattacttaatctctaatgcggattttatcttcttttccatgtagttaatttctgcgtttcactgactataatgagtaattttaagaatcagcttttttaatcctaactgttgttgtatactactactctagattgctctgagacgggaaaagatgggagaaaccgctccgttttggagattttcagcggcatcatatccacatcttgtaaaggaatcatctcatgagactgttgcagagaaaacaaaactagcattgactggaaatggcaatgcatcatccggggtatagaaatattagctaatttattttctccctgtgtatatctaagcactagtagattgaacgagattaactgatactttattttagggtgacgtttatccagtggaaccctataacgatttcaaaccggtccttgacgctcattggggaatggtctacgatgaagatgtaagacacgtttctcggatactgcattcgttttataattttctttttgatccagtaaatccttcgaaattagaggtcaaagtgaactaaaactgtttacctttttgcagtcgagcggacttcggtcccacacattatctttacttgtggccaacgttcccggagttctcaatctaataactggagctatctctagaagaggttataacatccaggttattatgcacacacttttgcttttagcttcaccgatgtgatgcatactactcatttctctcaagagtatgtgaaagttgttgcttttattgctctagagtctagctgttggtcctgctgagaaagagggcttatctcggattacaacagttattcccggaactgatgaaaatatagataaattggttaggcagctccagaagttgattgatcttcaggaggtgagctaatgattcgaaaccgtagtgtactttggttttaattttaattttatatgtctaataacgtttccctttcattggcttttctagatccaaaatataacgcacatgccatttgcggagcgagaactgatgctcatcaaagtagctgctgatacttctgcaaggagagatgttttagatattgctcaagttttccgtgctaaagccattgatgtctctgatcatactatcacccttgaggtgctgatatcatatctccctgaactttacaacaaaaagctctcgtagctttctgatatttcaagcttgagatgagatctagtagctgatgaaatccgtcgatttgcaggttacaggggatctcagaaaaatgtctgcattacaaacgcagttagaggcctatggaatctgcgaggttaaaaaaaagtttcttgatttatctctaatctcttcacagacacggtcactgttgtgtctggcgattcttatggtttgtgttttatgaaaattgaaggtggctcggacaggaagagtggcattggtaagagaatctggagtggattcgacttatcttcgtggatactctcttcctttgtagttctagaggttagtaatctcttttataatcacagatgcatcatgcattgttgtcgttttacatcatcatcatctgtgttatatatcaaaggaaattcttgtgcagaggacttgccgcaagcttcagtgtcgttcctggaaactagtcaaaaggactgcacgttgtttcagcatctgtgattgattgcttcctcacgagtcatggcgcttcgagttgttgttataggaggagctattttatgaactaaaaataaataattatctttgttccgttaaattagttttgcatactaatcaaatgtagaacactgttactagtttgtcacttatttagtatcaaagacgtgtattagtatatactccaatcgatcttaacttaacaattaagctctaaccggaccggacttggttagatcttaacttaacaattaagctttaaccggaccggacttggttagaatccttccttgcgaaccaaattagggcaaacttgtaatattgaggaaacgtttaattcttttcgtgtttcttcttcgcagcaattgcagaaacttaaaaaaaaaaactcaaaaattagatcttaattcgaggattctacttctgaatctgaggaaaagctatcccagatccgatcagatctgttttgttgattctcttcttcttcagtcagtggaagctatgatggattgctaaaagagaatacaatacgcacgaagccacgcttgagaaacc

SEQ ID NO: 737 - DNA, 3000 bp, Unknown
  misc_feature (1)..( 3000): cDNA_ID_2122286_gDNA_ID_1620312_Annot_ID_153010 3000 nt of promoter + ATG
accgtcctcctccgagccgaatcaattggtttcgttatcagtcacggttacggattaacggaaaccgccggtgtaatcgtctcgtgcgcgtggaagccaaaatggaatcatttaccggcaagcgatcgagcgagattgaaggcacggcaaggagtgagaaccgtcgggtttactgaaatcgacgtggtggatcctgaatcgggtttgagcgttgagagaaatggagaaactgtcggagaaattgtgatgagaggaagctcggtcatgctcggttacttaaaagatccggtcggaacagagaaagctttaaagaacgggtggttttacaccggagatgttggtgtgattcattccgatggttatctagagattaaagatagatcgaaagatataattataacgggaggtgagaatgtgagtagtgttgaggttgaaacggtgttgtacacgattccggcggtgaatgaagtggcggtggtggctagacctgatgagttttggggagagacaccgtgtgcgtttgtgagtttgaaaaatgggtttagtgggaaacctacggaggaggaattgatggagtattgtagaaagaagatgcccaagtatatggttcctaaaacggtgtcgtttatggatgagttgcctaagagttcgacgggaaaggttacgaagtttgtgcttagggacattgcaaagaagatgggtgataagacaatttcttaaacgtctttctttcaccgttccacaaaattacgaatcacattgattctaattttatggaatgcatatgttgtaccaatggacaatggcttaatctatatttgtaatccatctattgtatacgggatgtgtttcctttatatgtaacaaaatggtttggggtttatttgttttcacgctgtttggaaattggaatattcttaaaaatatatattgcctatgagcttatgtaagatgtttaagaatcttttttagtgtgtttcattttattagattctttaatgttttaatgagaaaacagaaaacctaaaccctaattgtcaagctttcgctttcctacataaaacatatgttactatatttctgtgagagtaaatattacttcttccaatccttaacctcatctctgtataaaaatgtcttcattctggaggaagtgacaacaagtgtcttaatttcccttatggagaaatgagtttagtgggtacgtatgatcttttagacaaatattgtgaagattttgcaatttattgcaaaactggtttggttatttttttagcgatcgttaccaagtttacaagtagtggactagtggtcaagccagtccgatgtctgcagactgcagctggtggttgctaaccaggttatctcttctatagttagatatgcacttcctggttttggtaatatggctttgacggaatatggtaactactgtattagtcacttgttttacgacattggtgatagaaatgatatatacttgctaggtttctgtggaagagcttgttgtagttgtagccttgtaggagccaagcaatgcataatggagaacaagaagtgttagagcatcattatcaatgggttttcaaaaagtttagaaaaattcttaaaatattatataagataaaatatgaataaaaaatagaaaagagttcttagaaaagttaaattggctcttaaataagagatttttgatacattctcttaacttattaagagcctcctaatatttaattattattttatatataaaaatgttaagaattttattaagaacccatgaataaggatggtcttagcacattttttctttctctcttttttcctattaaacccaaacaattacaaggtccatgacgccaacaaaagcacgcaggcccataattataaatcttacaaggcataaactgcctaatacggcacacatgcccaaaaacaagaaaaaccgatctgcattatgtatgtttttttcggcgagtatgtgcattatgtatgtttgatgactaattagtttgagtaaagaaagattttgcttttctgcttctgtgttttcttcgacacttcgatatgtagttcccgtttctggaagttggtggtctggtgttggttggtgggtatagtaagtattgtatgaatcgtttgcattccgacattggtatgagatccgatgttaattaggttcctgtggaaaggctcgttttccttattgaactcatggaaaagaacaagtctagttaattgacgttattgatgtttgtttgatcactagttgttgagtaagagagattttgcttttctgctttgttttgtattgtgaaaactgtgttttaactatttatcaaatggaaatacaattttggtaacattaattgtccaagaaatgaactcttcaagactctttagattatgaaagaacaatataacagaatccaaccaaagtcatcagctggattaaataaaccagcagttctttggtttatgctgcttcagaggtgttgtttcgttttaagagtgacgccgcttcagtgagccggaatcgatgaaactgcttccacgaatatgccgtcgtagaagacgaagacactttcttggctctttctgagctatcagtaactaacttacctagttgttgttgtgaagtagaggatctgcggctgcttttgttgaattgtccaactctatattttatgttatgctgtatggatattgatcacaagtaacatattcgacaaaggaactttcgtagactcacataactgtttctcctgccttgtaggggaagaaagttcgtgcaggggggatataagttgacaaagatagatgggaagactctgaaatcaaattttctcttattttaataccactactccttttactaaagccaataaagaagaaacattcagctacagacgtaaaaaaacaatatggctgctgactttaaattttggttataaaatcacaaccataacaaagctaggaagagagatagtcatcaaaatg

SEQ ID NO: 738 - DNA, 3000 bp, Unknown
  misc_feature (1)..( 3000): cDNA_ID_3058629_gDNA_ID_1620313_Annot_ID_153058 3000 nt of promoter + ATG
ttaagcttctccgagcatccaccctcatgtggacccactacagttatggccgccggtaaacaaccgaggggcggaagtgtagtcactccgatccttcttgctcctaacgaatataaattctacagaatccccaaaacaaaacaaaaacagaacaaaattacactttaactatctcaacaatattaccattcccgccaccataatttgatcaacattttgactgtcttattccgattacaccatctaagtttatgatattgctcaaatcattctatcggatttctcatttaagcattatttaaacaaacaaacgaaaaatggagaaaaaataacctgaataaaactggagtaggagaggataaggagatcagagaactcatcaggtgattggtctctgtagaggagagggttgatatagtagttttgtatgaagtcgctgctccctgcgctgacgatatagatgccattggagattatggcactggcgtttgaattgttgtttgaggttgcgatttcttggattcgactaatgtagtctttgtaatgttctagctgttgcggcaacgatattgcactcttcataaccaacaatgaaaataagtaagaagacgtttttatctactaaagtttaattttgctgttagaggacgaaataagagctatggtactaacgtagagcttggctgtgccatcgtaataaccagaggctgcagaggcgaaattagctccaatcaaaaggttcttgccttttgcctttttgcttagataagcttgtgggtatgatttgaacccaagattctcagctacacaaccaacacacaaaaactaattcatcatttagttattatatagcatgtacatatatatgcatagagatttctcaacctaatgcatgtacattgttttcttcatttcagtaacaaattgctccccgtgcatgctaatacaacccgagtacccgacaatcggtggtttaatttttctactctaagttgaagaaatcatcatcaagtcatggctcttaatgttttactctttgagtacacatatacatatatgctgttcaaaagtttatttagtttaaatggatgtgtgtatggtgtatatgtatataaccatgcatgcatgtatatcttcatgttatgtgtcactagctatatatatatcactgaaataaacaacgaagaaaacagaaaagtaccggtgaagtcagtagctaactttccattgcagaagcgtccggtgggtgtatgggttgtgaaatctcttccataaggagggaaattagctttgacgattgtgtagatatcattgttgtttcccacatcaaccaccgaatcaccaaatatgaaaattgctggaaccagtggctgtgccttcatcaccaccattctctcaaaaaccattaaagatccaaacaccacataaagatttaaccaaattcccgagaaacccataactttgttgctcaaaaagatgaaggttctaatgatgatgatgattatggtgatgtatatatttgtttctgcttttgatgcttgtgtgagtagcatgagtgtgtatgtagtttttgcatgcaagggtgtttatatagaattagaatagacaaacattttggggattgtaataaatgtgatagattaggtggactcaaatgtttttatataatgatacgtttatgtatctatcattatatgtctctctgataacgcacaacacattgatttgtctctgttggcctgaaaaatgtaaaaacactttgcaaatagcaaagagggacattgaaagaaagtagttgcgagacttgggcattgatttgtctttaacatttatagttctgttacgttgtgtgtgccatttgacacttgtctttctaactcattcatacgtcaatacgatttatatatgcacacgtaaatatatcttttgaaaaatagccaatgtaacgtcgtagttttggtacaccggtatggtggatttctcttttactttggtttttgagtccgtatattattagtcacatagggcggcaaaacgtttttgagtcagtaaattattgagtcaaatagggcaaattattagtcggtaaattattacttctctttttttttttgtcaatcaattacttctcttttactttggttattactaaggatttggttggaaagtaaaaaagaattcagaaaatagagagggaaaacgtgtttgagtcacatagggcataaaaagtaggtcttcaagtctctgatgatccacgaagctttcctagtcgatgatttagctgattgtaacttcaaaaaagaaagttttcttaaaaggaacaggatgaaatcggctatcaggtgggattagtccggtatatatattattagagtacacataaagcccaagctattatctttaaagaagtccatccaaactcatgtaattaggttatctagctagtaatctctcatatatatagtcatgtattgtgaactatgggtgtaacctagagagttgctcaaaaaacaaaattgtgttgaaattggataattatccataaaactattatccaacttaagctccaagctatcataaaactttgtcaccaagtcttgtatagttaattcattaacttccatatatatatatatatatatatatatctcttatgttctcaattgtagtgtaagaccatctccaatggtacttcatttttcaagaagaagaagtttgctcattcacttttattctctcgttttcatcttctttattaaattctttgtttttattaaaaatcgaagaaggggtctctcgagtctcctccaatgggagaaaaaacaatctctaaccactaatgaaggtatttaacgaattcattaacttattaataggcaattaaattttttttgattaaaaatctttcaaaccaaacgaagtggataaaaaaacgcttgaaggctagctagtgtgtcttcttcttctccctgaaactctccctcctcatactctctgatg

SEQ ID NO: 739 - DNA, 3000 bp, Unknown
  misc_feature (1)..( 3000): cDNA_ID_2122253_gDNA_ID_1620313_Annot_ID_153077 3000 nt of promoter + ATG
ctaaaatgccattttctcccggcgtgtaggggagtgagaacggcgattctaaagaaattcggaggaagaaggcggttttatctaaaccggcaccggtttgctggataccgatcagaaatcgtgagatcagtgttttgtctctgtcctttagggtgggcaccatggagtcctagactagtggaatccgccgtgttaggttgtgttcccgttgttatcgccgatgggattcaattaccgttctcggagacggtacaatggccggaaatctcactaacggtggcggagaaagacgtgaggaatctacgaaaggttttggaacacgtggcggctactaatttgtctgcaatacaaagaaacttacatgaaccggtgtttaagcgggccctcttgtacaatgtgccgatgaaagaaggagacgccacgtggcatattctcgagtcgttgtggaggaagctcgatgatcggtcgtacagaaggtcaagggttttaagccaacgagaagtcgacatgtaggattctgtgtctgaatggatgctaggctggaatttttcggactgtttcggaattggttaaccgggaatgtctcgagtggggtccacaacgtgaggggattaactcgggcacgtgagatgtttactgagctggcaattattgagtggaatattaacgtgccccagggaagtgaaagtgtaaagtattgctgacgtgtaattcttttgatgagtaggcatataaattcttttgaatatagttgatcgaaatgcaaagttatatcaaatgtcaacttcagtttaacatttaaaagtaacaactctatcaaattaattttcttatatgaatttactaactacaactacgcagctaaataatatttggtgtcaattagcaatataacaactaacaagtttagtataagaaattttgggtctagattgattttttttcaaatgacataaattatctaagtaaggtgtaatatccatacaagttactttagtataatgccgtttaatatccgaattgtagttttatgaaaaaataaaagaaataaacatttatcttcatccagagaacaattttaaatgaaaaatccaacataaaatttatttagttagaatacaaataaattaatttacaatcgtttagttcattctcggaattctgacatcggatgtaagtaaaatgaccaaaactcaacagtaatatgaccacatcaagaccacatcaaaactcaacactagacacttacgaaaccatccatggtcttgtctttgcaagaccacattatttccattggtttttttttccttctctaacaacatataagctagaaacaacattattcgttattgtgttctttctcataacaagtgtttttcattatattgttgtaccaacttttatcgaattaagtttcctatataaaattacttattaactactaccacatagctatatagtatttggtgtcaattagcaagaagtttgatacatgaattttgtgtaaagacagaatgacaaaaattgtttaactaagttgcaatatccatataattagctttagtatcatgcaactttatttcacagttgtagttttattccaaaaataaaagaaataaaccacaattatttgggtttaaattaaactcaaaagctcttgtttatcttcacacaactaatttttttataaaagaaataaatccagtataaatctacaatttgttttaaagaatacaaataggtaaatttacaatttgtttctaaattcttctataagttctgacatttgatctagctaactaaaatgatcaaaactcaacacattaaaaaaacgctctgatcggatctaaaaatttagttgaccatctttaaatatattttatggataaaataagtaagaattaggaagatataattgggaaagtaatgaataaagataaaataaaaaggatggtgtttgtatagggaaagatgaaagacagagcaatgtgagcaagagacagctagtgtgtcagaagaagatgcatatatcaataaatgtattgtctattaaattcttatttacacatattttttgaggcccacattactttcttatcttatgtcttgtagacatcacaaaacaataaaccaatcaatattattgtaatactataagttacacaattatctatgttttaaacctttaattccttctactatcgaatacacttaggttgatctatattcttttaattacaattagcggaaatacaaaatcattgcgacaacgagcacagtttggaatgattatcatataacttgttagagtgaaattgtactagtccaaaataccaacttcattctatatttcatacacaatatgttatttttttatgaaaagaaatgaaacgtaacaatctcgcttgacttgactgtatgagcattattttctttacaagttatttgatacatgtaatgtaaccccacagttagagaaagtaacaaatatgtgtcgtacagttgttttgttctaaaatcgcaacaaaaacaatgaccattaacataattttggttcgaacgaaagtgacacagtagctcatctataatgggtatggtcattgcctcattggtcaagtatcatccctggcactaaagattggttaattggggtctgctggatccatattggacctattatctaatatgaacgaaaattatataaaagggcctccaaaaatttactttactaaaaggcccaatattatgttggcccgactttgaccatacttctaggctcttttttttttgtttggacatcatttcagttcggtctgaccgtttacgggtttttttttcttccaaaccaacaattccttaagtaaaaaaaaaaacataagataaagtatcattcttattttaatagttttggtccgccagaggcataagcatacaaatattcttttctcctaaagttttaagaacagagcaaggttaaaaaaaaaaacacaagtcgcaaca

SEQ ID NO: 740 - DNA, 3000 bp, Unknown
  misc_feature (1)..( 3000): cDNA_ID_2122249_gDNA_ID_1620313_Annot_ID_153076 3000 nt of promoter + ATG
tagagatgtggttcgtgattaactgattgttattagtgtcgttattgtgtcaccgttgttattaaaattagataaaacgagtgtatatgtataatgtatatttcaaaatgtttgatttgtaattttctatacatcaacacgaaagatccgaagtttggagtgttcaattgcccaaaaacaaatccatctagcctcgtccaaaaccagatggcagatacagaaccggaaaagaaaaggttccatggctacgctacgcaatgcaaatgatttgaatctgatgctaaggctatgtcgctgtataaagatttctagtttccttctgattcaaaatcatgacagtttcaaaaataaaataaaaaatcaagaatcgtatcataagttgtgaatcaaacgattgtgcaaatatataattagcttgaagtagtttttgcatgtaactaccaatcgtcagtgatcgatgctgcaccattgtcaaataaactacacatttttcaattaccaccaagtataagttaggctggcgaagtaacaaaattgaatctattattagaataaaatactaaatatcattccaattgaagtaacaaatatattacgccaaccttatccaataattccaattaatatattttgaacaaagtaatgaaaggaaaaaaaaaacgcatcaaccatagttggcaaaaatagtcgctcaacgttaaaatggataaatttatagtatactgtaattttcattcaattcaattgtcaatactatacatgcacgtaaatccatttttgtctctatgtatataaatatacatgtagctttttatgttcagatgggtaaatgtgtgaattgggttggttacaatattaaatgttgcatttactgtagtctatctaggtgacttaaaaatgcgaccaatcagtagctgaattcttattaaacaataaatacacccaaattttaacagatgccgttactaattaaccattttgtgattggtacaaccactctgatattctttatccatgttgttgtgacggtagatttcgtttcttagaacattcaaaattttgtgggggatatagtatgaaattatgtacggtgactttgaaaccgtgactgattaagtgattaagttttggaggatatgaggctaaatatttgtttgaaacgtatttataaactaagttttacaaagtttattattagattaataacaaaaacctaaacaaaagatattcgcctcaagagtcaagaacattcattttctctttaacctttcatctattatttgctccaaatcacagcagagaccataacaaaaagctgttgtattttagtatttatatgcttcttttacaacatacaaaaaaaaactttatttcgtcttcgttgtcttaccaagtgggcattacttatacctaaagatagaagatgtccagcttctatcatcttaggcaatgtccgtgctcataaccacttttctaagtcttacttataaccacttgtctacttgaattgattggtgtgatgattaattggccattgatagaagtataattaggacaaagtaaatatggttttaatgatatctaaccccttaaataatcatatactccttccctttcactatttaaatgtttaataacgttgcatgcatattaataagtcaaaatattattcttaaaaacgacaagattatgacaatactaaggagatactactatacttggagaacaaaataaatgtatacaaattgttagccaaccaaagaataagtatacgaagctcatgcatgtatgacacaacgacacattctgataacaaccaaacacttccgaatttaacaactaatgaataacattacaaaaacaatggattttaaagtctttttcgtgtgtgtatgtaaatgtgttgcactctttctccccacacacagagtcacagacccagtggccactggccagtgcccttgtaagctttttagataccttttgcatttttttccaagccccactctaaatatatttataatatataatattatagtggatttgttcgattacaattacatgttattattttccaaatttaaatccgaattttagatactaggttgaaaaaacggtattttaatactcgtttgggatgaagtacgatgtatttttggctgctcattttctaactgaaaaaaaaaattatcttatttttatgtagggactattaacaaaaaggctaaaaagagtttagaagaagaaataggctaatcttttgataagaaaaatatacagtttctgattcaaggtttagaatttatatttgttggattagcttttaggcttctgagtttagttttaagggtttggaatatataggactgataagcgtatggtgcaaattgcattgtatatcccatcgaattattaattaacttagtttcattaatttgtcaagtttcatttctttcattatgagaactttgtaatcagaagtgagttataaaaagtgtatttaaagtcacatctaacttgtcattattaaactacaaatgataaacgtaatccaaaaaagcaacaattagcttatcaagacacatttacataaaaagcacatgcccctcacgggatcaaaacatcccaacttaccaaaatccgcaaagtaatgatcacggagccaacaagggcattatagtcattccacgttatctgctacggttacgagaaacttgaccagcgatgaacccgagaccattgccgagctctattctgctccattgcccatcaccatgtgacgaccttctctctctaaattctctctgtactctgaaaaaaactctttttttttttgtgtgggtttcttaatgatttgttatgaccctgttggattcaaaccaaacccacacgagagaatgatgagaagtagatcaccggttttgtaattctttcaacgactctttctctacatttctcccaaatctctgtctcttgagtttgatttagctaaatcaagca

SEQ ID NO: 741 - DNA, 3000 bp, Unknown
  misc_feature (1)..( 3000): cDNA_ID_2122205_gDNA_ID_1620313_Annot_ID_153063 3000 nt of promoter + ATG
ttggttgagtgatctatgacatctatataaaaccaagtatttagtgagattgggctagagttttggaccttgaattgtggtccattacaatatagtttacgaaataaatccaaaaaaaataaatttttttttgtcaagagctgtatgtttattgatggataggtggagccaatataaaattagagcatctctaatatttttttctattcttgattttaaaataaaaaaatcctataatagagctggattttattctattgtctttgtctatttttatctaattttttaactaaactatataaaaaaatatgtattttagaggtaaaaataaaagtaagttgaaatagattttattttaaaatagagtatataaacacaaaatagaggtatgttggaaatgctcttatagttgtaaataacaggaatggaaaatgttggaactgaaaagtattatttttttctgaaattatgtcatttgtacaacattgactgttaaatttaacattacgaaatattttaattcattacaaaaaatgcacataattatataattttaatacagtgacatgatatataaatgagacatgatatataagtggtaagaaatattgaatatttttgaaagaatcatatttactataaaaaatactgtacaaatataacaggataaaaatataaatatgtggttggaaaaatatatagtcttattagtcatttttattccacgaagaaatagtagatacgagtgtcaaatattgtttcgagagagatttcaattccgatgaaaagacaatatgtgttccggcacataaaatcttaattaactaaataaaaattatattaagatataaatttacatgaaaaaaataataaagaacagaaatataatatgtttttttccttagattcaatactcataaaaactctccgaaaagcatagtggtaacaagcatttgaaatgtaaaatatccttcctaacagtaattgtgagtatcaaatgtcctccttcttaatgctttgcgcagaaaatgtgatttgataatataagagtttaatacttcctgaaaaattctactcatttagtccaatgaaaagcgaccacaacgtatagtaacatctttattaatatgggaaaccaaaaattattagattatagctcatttgtctgtacttttttcgttgttattatatatttttaatttagactaagataagataatatatatttgtgtggaaagcaagtaagttgatgatatctaatcatgtacgagtgtctaatttttaaaaaagttacataaaaacaagacatgacaagagaaaacattatttgaaaaatgggacaaatgttgatgacaagccaaaaataaagtaaaaatagtataaacttatggttaattagtcttttgtaaatttatgggcctcgaaacaatataaaagacattccgtggaaagtgacaccacaccttcataacttagccacaaaggaaaaaaaaagggcattgctttatttatctcgagatatgtttttataaccatatttgaatgaattgatattatgaaaccgcctcattgatccaaactaattttgtattacattacatgtgaattgattccattggaaatgaacgaatgtccttcgtctatatattggaaatgatacatttgacccgtacgtaaaccaatcgagtcttcaagttacctaaattcatcaacttgtttgaaaatatccattgtttttttgcttttgaaatatccaatgttgttcaaaagtataacttgcatttccaatggattcttagtttcaacatatacaaaacacgtacgtataaataaatacacaattctgtataaacaaatacacacttgcttttgttctgtgcatacaagtatgaagtgcgtcaaaagtacgcattatgtggtttaggtaaccagaaatgttgtccatgaaaaaaaaagaaattagaaaaaagaaagcctaaggagatgatgccaagaaagaaccttccattgactggtctccattttctttcttttttaagaatccaaatccttattcacctacgcaattatactttttgtatttgataagtaactacgtgtttgctaagcaacctttccacgcctgttcaaaatgtcgaatttattacttaaattcgggtagaaatttatcagatttgtcttaaaaagtagtaaagaaaaagttgttgatcattctactctatgaagcagaaattacatatagaaaataaagatagcaatatttctctttcttttttactttttatacatcatgattgatctcttttttttttctattcaacatggatgataaaacatcatctataatataaaataaagattgactgattattgacttggcaacggtttaacattaaccaacttggaattccacttccatcttcaaaactattgaatatccaattttcttagatgtgccacatttactcacatattataatttttttccaaatttaaaagatacggttattttattctttttgttaaattatatataataacaataaatagtacataaccgtatatatcatttatataaacaattttttttgataaatataaaataagaaatcgattatttcaattcataatattaaaatataaatcgattaatagaaagaaataaaaatcggttgataaaaaagtaaatcaatcgaattaaaacacatgtgatattttggcgtaatctacacttgaacattttctgtttatccgctgttacttctctctctctctctatcccaaaagacgacacaagtacaaacacaaatctgcaaatcttcttcttcttctgtcttcatgaatttcaagtctaacaattcctagccgtttacaatttgacggcacaattcttcattccttgtcgtgcccggaagtaaaaagatgatctttttggtttctgatgagataaaacagagatcttgttaacacttataagcagacccaactcgggaagctatg

SEQ ID NO: 742 - DNA, 3000 bp, Unknown
  misc_feature (1)..( 3000): cDNA_ID_2122213_gDNA_ID_1620313_Annot_ID_153065 3000 nt of promoter + ATG
taaatccagtattattcgacaaaaactacatttatacaataagaaaaccaattagaatccgtcgagatgttcttaatcaagtaaagagcaaaatcaagggtcctgaatccataatccaaacatttcaaccaaacaattcgaacgaaatctgtagcgataactgtatgagaacatcttgcaagatttaaaatttataatcacgaaccaaacggataaacaataagaagatctcacttgggatatgaggaggtcgagtcgactcagtgaatcatttggggaatttgggatttgtaccgagccgcggaggtgtatgaaccgacaaatttggacgtgacgatctgggaaattgatattgggctgtagataacttaaatgggccgtactcgtataataacttattgggctaacttcgtaaatttgcataaaaaatgtttcgaagatttgtagcatcaataattaaatatattttattagtctttaatttttgggaatcttgcaaatgtaccgcttctcattcaaaatctaccacaactgaaaacaattttcaaaacctacaacatttcttgtcacatgtaaatttgtagatgaaattgcctttgataatgacagactgcggtgtcagatcaaagaataattgatagtaaactttcgtatttttgtcttcaaatattcttacgcttttaatagattgacggacccaaaaataatttttattggagtcataaaataaataattttaaaattttttatatcgtataatatatttcaaaataatattacaaaaacactaaacctttttgttaatttataatttatatttattaatttagtatcaaacacaaatattgctactttaaatcctccaaatatgttgtgattttcagaaaaataaatataaacttaaaaaatgaaaaaataattatgtctacaagaatcgaacatggtagaagagatgtcaccactttgagaattaccaaatatgatactggcactttaggattttaaaaggactaaatgttttttatatatttttaaggggggtcaagtgacccccttccttctttagtgggtccgccatggactcactcaaatttgaataaagcatttgtatttgtgtctaggctattatagattcatgtcacttgcattaccaaagattgatgtttgagttcatgcattaactactcaaattacaaaatcatatatatatatatatatatatatatatattgtttgtagattaattttctgtgttaacttttaaatttaaacattatatatattaatttatcatatcaatgagatataactatataaaacaatttaagtttctcctaaattttattctttatattttaaattatattttataattaaagaagttgatttattgttaatataataaaaattctatgctaattataataatttccaataacgtgtttgtaataacttacatttgaaaggttactcaacgaatgaaaacctttattttcgagtggttcttccttcgacatatcaatcatttattttcgagtgattcctagtggtttaatttatatggaaaatagggttggtatatggatcattattaaaaataaaaataaaaataaaaatatgggtcattattgttgaaggtgcagttatttgaacaactaaatagagtaatacatgctttattggtttggatctacaagatcgaaatgtttaacgttagaagaagtttttggtttttaatagattcagatttgaataaagtcttgtaatcttctgtctagcctattataaatttatttcgcttgcattatcaacgaatgatgcgtaatctagagtctagagatggttgatgaatcaccaatggattattcgtttatattgttgatgaatatggtagattttgaatatgattaacagtgaagttggtaatgagttccactactaatcatatgattattttatatacatatttttgcttaatttttgcttatgttttactatttttttcaaattattttatttttatattttaaatttacaacgattatgatagagttttataaggaattaaattaccgttagattctattaaattcatataaataaaaacaggctaatttttttcagacagtgactagaagcatgagacatcaacttaaaatatatgaaaacaagacattttttattttattacaagaaacgtcgatcagtaatgtctttttgtcacaaaattaaaagtgttatccagtttactcacgttatttatttaataaattaaagatagtaaaaaatttcaaaatatttattatgttcaaacttatatgaagtttcaaatattataaatatttgaactttaaaaattttaaactttgtaaaatgtgtaatatagttttaatatataaattctataaaaagttgataatattaataatttctgagatctataacaattaaaaatatatatattatgtgaaccattttaaaaaaactttaaattgagttgaatcagatgtcttttaaatagaaatataagttaaaagaagaataacaaaatgatgtttaatattgttggacggggatatatagtgtgacggatttggatagatattaatatgagacgatatattacaagtgaaatttcttggaacttacaatcaaaatacaattatacaatactaaatactaaacaaaataaacaatattaataaaacatatacaacttaaaatttaaattttttgattataaaaatcgatcactgtataccacgagttaaaacctagtttataaacaaatgttaaggtgctacaatttttatgtgcatactaatgacaataagaacaagaatgatcaaatagacgagatcttcgcaggtgatatttgttcctattgtaacaagttaattttaattaatgacactaagaataagctttggtgtgaggcctaaaatgatctgtcttcttgaaaataagcttttaaacataaaaatattatatagggtcatg

SEQ ID NO: 743 - DNA, 3000 bp, Unknown
  misc_feature (1)..( 3000): cDNA_ID_2122240_gDNA_ID_1620313_Annot_ID_153073 3000 nt of promoter + ATG
ctgcatgctaaatgttaaacatgcgatttttggaatgttaattaggtgtaaattatgatgccgtgtacgatgaaaataaaaggcatatatggagaaatgagattgaatatttctttaactgccacaacggtaatttcgttttcgcatgtttcttaaaatgtttctttaaaaggcatatcatgaggaattgaattattggccgacaaaatagtttcccttaatatggaatttaaggatcttaattaattggagaaaactaatacgcatacaaacttgttccattcatgatgacagtgaagaatgaaagcaaagcatgtcctatgcatttatggatagctcccatgtttgtggcttcgtattattatctcttatcctgaattatctttgttgtgaatattgccaacatattaataaggcattacaagatattggatattgggtcatcatattcaaaatcatactgtaagtgatatagagatctatgaagtcaataacaatgtctatttatttctaactcaagactagttatcaataattagattattccatatctaagaaaacattttttcttagcttgctatctataacgtaatagcaattcttcataatatctatataaagaaaacgatacaaaacataaattatagtagattttatcgcattatcgcgattcgcatatagattttccataatttccagttttccacaatctcatttcttatatcgcaaaaataacatttaatgcacaatattattaaatattgttggttagatcagcctcagtttattaattgaaaaaataataatgaaaaacaggttattccgcaacttagtcgttctaattaaacccatttaacacagactagaaatactattggctcacatatatttagttggtcatttttacgtactagtgatttatatattatagtgtacattatacactaatacactactgtatatgttataaaaagcacgagtaagtacaacgaatcacaaagctacattatcttcgtgcgtgaccattcacacagaaaacctaagcagacgaaagagagaagctcttaatattcaacacaataaaaagaaaagtagaaatacaaagatttgcttgacatgctcttagattaatgttggtgaaagagaccatgaaatgataactcttgtctccttacttttactattggaaatacctttttttccttcttttttttgggaataatattatactattcatctgtatattgttgaaggagagaatcatttacactctttttaatggccctattattaatattaggaatatcaccatcatgattatcacttaacacatgctgatgcccagcaaaccaaatatggatattcactttacttccacttgcagtaaaagtcaataatcattttcaacaaagtatttcaaaaaattgattataaatttctgcccaagaaataaagattgatttttcgccaccttatttacaagttttacaccaaaagtaaagacatggtacaaaactttgctcagtctaaattgatattagacgaatatttgaggaaactaaatatttatttgattactttcgtattttaagttgttactccagttacatacaaaatatagttttttgacgttgatactattacactagttacgaaaaaaaaaactatattacactagatatcatacttgatcaatgatcgattagcaaaacaaaagaacatgaatatttttacacaaaaaagattatatccgtaattttgaatataagatctaccccatggataatcgatactgacaaaaaaaggaaaaattaactattgatggtagattttatactgactataatattaaaaaccgacgatatatatctcttgctcccggttatattatgatctagcgatgttatctttcactaaaaataaataaaaaaatgagctgtttattttgtaattttcacgtaacatttgtgaacgagaatgtgagtagcgagaacatttcttcttttattccacgagtagtgatcgatttaataattgaaaaagggattccatatcaacttttctcaatattttggtgggaaaagtttggttacttgcctcttttgctgactgtggaatccacttcgcattgactctatgcttctttgatttctaaacaaaaaaaaaaagaaaaagaaaaatggtgttcgaagaagcattcgttcccgctcttttcggtgctactcgatttttcttgtataaagacaagaaacttaattgcacatcccaagaaaaccgaagaagaaaacaaaagacttttacaagagttgagactataatgtgagtgagtgagagaccaaagtcagtaaactacgatattggtccaaggtcttctcttccaccaaatacttacggcaaaagaaaaaagaaaaaggcaaaaactatagcaatatatattaaaaagatacgcccacttaaatttttttaatatcgtttaatgtacaagaactaaacttgaaacgaatgtataagaatgattgaaaaaagacatgaactatagttatatttttgaaacgttttagtacgtttagggacataatttgtctgctctgctgttcataaaattatattttgacattgtaagttaacattactttgaagttttgtgagatattttgttctttaaataatattctaaatagtttgcgcgttgtaaattataaagtggggttagttgaaataatgttgcaagatatgatacaatcatgtggcatcattttatatttcttttaatttcttagttattcgattaaattattgaaaactcgaaagagagctacctgaaaaagcttgatctgctttaagcagtccactacaaggttttactaatatataactccttccctccctaacccctcaagttaaaacacattctctttctctctctctctctctcacacacgaacagttatttagagaatcagaagatcctttttaacctcaatttagttgaattttatg

SEQ ID NO: 744 - DNA, 3000 bp, Unknown
  misc_feature (1)..( 3000): cDNA_ID_3058621_gDNA_ID_1620313_Annot_ID_153069 3000 nt of promoter + ATG
cttgtcgggaaaactccaaaaccattgcatctacggtttgatcattatcgatatcgttgttgttgttgttagatccgatttggagttgttggcaagtatataacatggatgaagcagccgtgatgatctcttgaaccaaacttccgatgttagccacggccaaagacgttgaccccgaggattggttaatgttattagtagataccatgtagaagctgaccagagattggatctgatggactttttcatgtaaggtagatagattgtatagaagagagagtgaaacgtcgtcgtcttccattgatttcgtcccggtcgtggtcacgggattaacatagatttgttttgaggaagtactggtctccccggagaagctagagattgatccttcaactttctttgcaatatgctcatctcgattcatcatatgtatatgcatgtatatgaagaatctagcttgagttttgttcttatattttctttggattttgttgaatctttaaattctttgtggtatatttgtttcatatatatgccagacggtccagactctagagagatgcaatgaagaagacaccctaccctctaccgtataaaatactcgcgagttgtgacatacattcacacaaaataacacacacaaacaaatacatgtcacacatatagtaatttattttttcgtttcactttatcaaacatcttaaaatcggaaagattatactaaattgagtaaaatttgaaaactaagctattgaacctaactatattttgaaccttgcagtttattagtgatttaaaatccaaaagatattttgatccaaacaaaatattgtaattaaaaaaaaaaacattctaattgatatattatgtcaagtaatgtttttttttcttaatttagaagttagaatttaagaattttatgttttctagagacgggacacacgttaggttacattcatctgttttagaaagaaaaaaaaaattagcgggggttgatgaacccttaatcaaccattgggccaaaggacttccacaactatatttgtttatgtttatgtttgattttatttaaaatcagatatttaattaaagatttacaaagatgttttaaattaaaaagacatctagacgtttataaatatacgatacatagaagttgtaaataatgtctttttgtcaataatgacaataatatgcaatatacagattttgatgaacccggatgctggcaagagaaaacgctagaaaagttcaatagactaagtttttgtcgtcatgaatgatgttttttcttctctctaaatgcatttgtcatgtatatgaattatttacattaggttgaaaatggaataatagaagtatgtgatgtggttaggattaacttggaagtcaactcgagatagcaaaagcgaccatccccacataaatcctcccccggatgaaaccttaactagactttgtcagctacatcttatgagttaaataaacgaagaaggtcaatcccgatgtaattaaagaatgattaacctaagtcaagtgttagtgttctttcatggccttttcttgtattgttctatatacaatacgttctgtaactgtcaagctcacatctatataatatcttatgtcaaatccaatcctttaaaaaaaaagttgcgactacattcagttctcttatctgcttacatgcacacatatttttttttcttttcatgcacacatatttgtacacgcgtgcatatacgattatatgattggatcttacatgaaatgtttataatgtggccatcggcatgagttgcaattatattaaataaatattgcttatgcgtgctcattttttaatttcggaagaagtagttttgttggtgactaatcaaaatttctatgcagtgatgatgatatgggtgatcaatgctgtttcttggggttagctttggtgagttacgttactttttgtcctttagaagaaaaaaatgccacgttagttaacgctttttaaaaaaaagaagttgctgctaccattacagtgacagtgtattccacatgcgattctagtagagttttttagttctttttgctgggaaccaacctgcaaaccacatttgtaaataagacgttattaaaccagacttcactaatataggccagtcgaactggctcaccacaacatgggaatgtaggatgacatgaatctctgaattacaaatgtcatgtatataattaccctcagttttaaaatgctacaccaaacaaattcaactcaactactttaatttagttttcaagtttccaatatgtgaccaaaaagtgaaagctaacaaaaacaagacctttgcgtagctgggagttcgaactccactttccctattattacgtactttgtcaaataaaaaaagaaaatataaagaaaaaaaatacacaaatttcttttggaaaaattatgcttgctacccaagctaactatttttgaatgagttttaaattgcaatttcaaattcctccaatctgatcaccgggacgtgagcaagaacacgggatcggagatgattactcgtcatcataatctgatgatccatcggaatcaccggagaaatagaggcggcacgtggtatcgccagaagttggattgtaatttctttcttcatgacctttggcaatttgtctgttgtagtttgctcaattacccgtaaattagcagaattaagttgtaacctgtaaaaactaacagtaatcagacaatcctttaaaatatatatatttatgtcgccggccaaaacctgtttcttgttggtaacgtttgcccattcattatttactattattagggttttaaaactcagatgatcacttgttctttagattctgttacctaaacagtaaaagaagaattaattcatataaaagatccaaatccttgtaatccttctccgataacacattgctcctggaatctttttttttttttaatttgtttcatttgagggttcatcatcatca

SEQ ID NO: 745 - DNA, 3000 bp, Unknown
  misc_feature (1)..( 3000): cDNA_ID_2990441_gDNA_ID_1620313_Annot_ID_153061 3000 nt of promoter + ATG
gtttaccttccaatacttctggaatgaaatcgactctttcagacagcatatttgcgattaaaactccagtagtaacacaagatgttgcaacctacagtgaagttcagtttatgttacattataatttgagatatattcaatggaaagcttcatataaacctaaaattacctcggctttgtcctgaagtttcataagatcacagactaattgaaaaagttctttgctagagcaaatctctttagaatagctatctgaagcagaaagggcttcaatagctcggagaataatttcaaggacggggtacctgaaaacatacacaagggttcattgtacatactacatagtaaagcataacacttgtttttttttgcaagaatagaaatgccattcactaacacttgatgatctttaagatgagtttctgttcttccatacctttctggaattctttctttagtcaacttgctcatttcaaatgaaagaagattgatcaagagactcgtcaaacccagattcattagtggaggaatcaatagctgctcaacctcaggttgaccttctatgatacctaacaatagccctacactctatggtaaaatagaaatgaattagcaaattaagaaaaaccatgataaactaaaacttacagaaaatggtggagggacatgaataggcataaagtagagaatttcagaaaattcattaactcagagttcattaaataaaattcaccacttcgatcaacctttcaacaatcaagtcgtccagtgcaagaatgactaagttacaagaacaaatttcagaagttaccttttcaataagatgaggattcaaggtattttccgcaatccacaaaatatggcgaagtatatcatcagactccaaacaatgggcccaggaagtacacccagcgccagagagtcctgtggtgagtatcctattggagatacatgtcggatagttagataacccaaccaactaatcaagcatgaatctacatttgaggtaacaaatttattgttttacctgcaaacttcacttaggcattgggtatcatcaagaaacaactgccccacaagtgtattgacgattccggctgtagactctatatgtttcaacagaccttcatggcaagcaaggttcctaataatcccgagacagatttcctagcaagccccaaaacgaaaaagaaatgtaaaaattaaagtcaattcaagaagacaacaataattagaaatgacttagacttatcatacatacactgagttacttactcgaatacggggagattttgaaaccataaggtttgcgtgaagcacttctaaaattaggttctgtacctgcaaagccaaagcattacaacttcaggtctcaactccactacatggattcaatagatagagcactgtagtacatttccaaaaccactatacggaaccaagctgctcttttatctacatggaaaccaattagttctttttcaacaactctgccccaaatttcctattggtctaaactcaactttaaaccaacgttactacttggcaattcaaaatccagagtaaagaatatataaaggcattacttcaaagtataaatccatttaccattagctcagcatgagttctactggcggcaagatcccacaaaacacaaccatgatcttcccatgccgatgacccgtcttgcattcccggcgctggacatgaactaaccgtctcccccacctcataagtggattcatcatgattatctccaatgtccatgctctctggatcaccattggaagtctcaacaaccccatttccagatatagctactacaccttgaaccacattatccgtattcatatgatcattatgtcgttcgtcacttcccgaatcaattggaaggagtttccttatcagtgaaataagatagctaggatcaactgtagtcgaaatgtcaaacaactgcacaacacagaaaataagaaacatcactctctacacaaataaaaatcacaactttaaatccaaaaactactcttaaatagccaactaaaaacccctaattgcacaaagtaccattgacgctcaatttcctacaatgaaactacctcaacaacaacgaagagtgagcaaattaagctcaaaatttacctcatcaggcggaggaggaggatgatgtgagggaaactcgttttcactttcttctcttcttccagtaaaattttcttcttcttcttcaagtattcctcgctgtttcgtcgcttcatcgtcttccattttaatctctctggttttttaatttctcctttgcccttatttctcttcttctctcgccagaaaattcgaaacaccgctttacttgttttacaaaatagtccttgtactaaatcatgtcttgttttcacacctacataatttacttctcttataaagtaccttaatcttttcaatagacgattacacccccattttgaatgaaccacaaaaatctgccaactgttaaataagtctcggtgacaggtggcagattattcacaggtgaaaagatcgtgggtaagaaaagcctcagccacaaaattaacggtcaactaccataaattgtttattcattaatccaaaacaaatctctatttaataattttttggaaaaaattaaattttttaagaaataacagaaatatttgtaagaaataaaaacttcgatagagataatttgatatatacagtaaaaattctataaattaatacacacggtaaattattattttgatattttttataaagttttcactttatttattttattgttttgtccaaaaatttattattaaaaacacattaatttgtaaaaatgccaaaaaatgattagatgtttcggaaatatttgagagtgacaagtcatacaaattggatgttgtttttacttttttagttttttggtaaaattatccttaaagctaaaaatctccataaccaaagcttcttcgttccaccagcaccaaaccaaca

SEQ ID NO: 746 - DNA, 2651 bp, Unknown
  misc_feature (1)..( 2651): cDNA_ID_3058753_gDNA_ID_1620316_Annot_ID_153172 3000 nt of promoter + ATG
gatccaaggaatgcttaaagattgttccttttgtttgttttacatacacatttgtattgttgtaagtttgtaactttgatttgctcaatctctgcaaatgaaatgtttgtagcagtattggtttctctgtataataaaaagatttaaaattgaacaagtgggtcacgaggtaatcacgtgccaagttcctgaaaactcttcttctctgtttctgacttattaggcttaagtctttgttcttccttctcgacgacggtgtcacttgcgatgaatctctccacgaggctcgctgaaaaacttcccggaatcttaccggcgccgtcttctcctctcctgcgtaaaggttggttctttttaatcttactgtctttttggaaattgcttgtttggtttggattcaattcaaagggaaatcttttctgggtttctcttcgtctgtttgatttgtctctgattgatgaaggatactttcgtgctcatatctctctacctcttatctttactaggttttaagtcgttaggttcaatctcgaattcacaagctaatgagggtttttgttaattatttctactcatgtgtgtattaggagtctccgagttaagatgcttttcaattgctaaccaaagtagaagattgagatggggattacaaaagaagatggtttggagtttggagagagctgagacctgtgtagtgagcaaatcatgtttagttcatcctgcaactgaagcctatgcacaagaagctattgaagctatcaaatccgaaaaagttattgctgtgcctaccgatacgctttatggcttcgcttgtgatgcttggtaatctaaaaatcttcactttatcagctgatataaccttttacattgcctggactaagttgtgatttatgtaacatgacagttctttagaagcggttagccggatttatgagatcaaagggcgtaaacttacaagccctttagctatctgcgttggtgatgtattagatatcaagagagtggctaccacaagtcacttacctcacggtttacttgattcgctcttgcccggtccagtcactcttgtacttcaacgaggtttgcatcttcttcttaatgtggttgcatttgatatgatctctttatgtgagagtgttcttgtagtgttttaaacaggtgaatcaagcattcttgaaaagtccttgaacccagggattggtactattggagtacgggttccagattgtgaattcattagagaagtatcgagaggttcgggcagtgtgttggctcttacaagtgctaatttaagcggtgatagaagcagcgtttgtgttaaagattttgagaatctttggcagcattgtgcttatgtctatgatggtggtttacttccatcgggccgcgcaggatctacaatagtcgatctgactaaagttggaaagtacaagatcattaggcccggaaggtatgtttagatcagtaaatgcgaattaatggatttagagtttgaatctttgtggagttgttgagctaaaatgacttataataatgttgcttgtgttgttaattcagcgcgaaacaagcaacagtggcaattcttgagaagtatttgctggaagaagaagaagaagaagaccataaagagaagagagctagttaaactctgaatcatctgatctgacttgcaaaaatttgaggttttgctttggttcttactaaatttttgatattgggttaagatatgtttgtttttagtgcaatacgagaagattgttagtgttgagggggtatgctaatgctacctcccattcccatggtacgcatgtgtaatttgaagaaacttggtggaccatttcgtaatttttacttaagtttcttattattgctccatttggaaattaaactttgttgtaatcttattaaaaaattatcaaatattagtggaaatttttcctatttttaagaacaatatttgttgtatccatattcttttcttataaaggtgtcaatttttcaatagaggaaaatctcattaatttttgtatataggggtcaaagttgaagaaaaggataaatagaggacctcaaaatttcattttccacgtatccgtgctctaattttattccacttctgctaaaacatttggactataaatgtctggttggtcttggctgtttgtttgcaacacttgtgctaaaacgttttatcctgagtttctttcaccatccagcttcatttgtgaaaaatcgtcaatccctctcaaactcttctcaccactaatttcttcctctggaacattctcttctctattattttgattcccttggcctcaacactggtttctcaattgcatgatcttggctcgtcttcaggtactgttgtttcataccttagagaatctcaaattggttcttgggtctggtttgattagtttctgtgttatttcaagggggaacgaagacaatttagctgggtaattctgggttttgcggaattttggttgatttttgcgtcagaatcagaatttgaagctaaaaagagttctgctttgattatccaattgccatgatctttcacagtaaccaaaatggatttatgaagaatatcaaattcagctaattttgctctgtgcctatgcagttactttgattcactgagaaaaatg

SEQ ID NO: 747 - DNA, 3000 bp, Unknown
  misc_feature (1)..( 3000): cDNA_ID_2125615_gDNA_ID_1620316_Annot_ID_153189 3000 nt of promoter + ATG
ttaaataaaaaccatatttatgcacaatgactttttttaataacattaacactgaaaatcctactaatcaaggcatgtaaaatgtcagatatttggtatatgattaaataacaaaaaaagttcaaatgaagatgagataatcaagaaatgcatacgagagacaatgtcacacactcacagaaagaaaaactaacaaacagatttgcccaaaaaaaagttctttatcaaagaaaacaatgaaataatttcgattaacgaaggatgattaatggcagcacgtttcttctgttgataaagaatactagttaggaagcaaaaagggtatgtaatgttttaagttcaaacaaaacggcggcgatttaagtcagagaactcaatggaagattcagcgcaaaccaatgagaaactttcagctttgacatgttatccaaatccttgttttttttttagtttaaatcataagaaaaaacaattaacgtttttcatttgacatttcactttctcatcgctgtctctgtataaaataatatctatatatgtatgtgttgcggatgattttttatttttattttcgttagaagaaaataaagaaatattatgtcacatgatacggtggatgcaaataaatgagaccgtttattaggggggcttttactatgggggattgacttttggtatgtgcaagtgtattctttttgcatttcgcaatcttcgtttggtttttgtatacaacaaagcattatcttattaattacatatttcatcagaactccatatagacgaattatcaattacaaaaaagggagttcagactaccattacgtatgatttaaacgaataaaatgatatcacgaaaattaacatgacaatagaataaaatgatatagctagtgtaatttttttaaaaacagacaaatatgttacagtattaatcaaaaaagaacaccgataattgaaccaatttatttatattgtgccatccatcattttgtaaaaaaatgaaaaataaataaaagaagatagaatttggctatttaatttacaaaaaaaagagaattctcaaaatctcattaattattaagatattttgttttggacatgggtttctccatgatatttttgtgttttctctaaaaacttgttattttttttttttaattttcctatgatggttgacaccctgtaatagaccacaatttcaatattctccacctaatgaatgggttctaattaatggctatgaaggtttttgctttatctttgtcccctcctttattttcctatcctcaactcatttctcttcgcgttttcttctctttttcaaccaaacttaatgcatttccttatcaatttcctctattgtataaaagagttactacacttccataaatttatacccatagtcccataccttcacacatacacatgcacattgtttaaatagtttatcaaccgcccatcgttgaaatagtttaacctaatttcaaagcaatgacttctatgcatgtaagaacttattacatcattcgttaactttcatagaataccaaactaatgcactaaagtacagagaagccttcttgtactcaaatatattttggtgcatttgtagaaagacttatttaaataacaatataaaataaaagctatactagaatctactatataacttccaaaatttgtttcaataattatttcaggcctaaacttaggatttggatttttgttttatacatgtaagtagttttgttttctccggagtagttgttatacaatttaggtaaaagttggtgaaccatcaatctatgactctgtctattaaattccatggaaagagtccttgcttgcgggacgaagggaatccaatacaatatgcatatttgatcatataataatccaatttcattcatgttgtcatatgtttaagatatgatcatgaacattaactgttttgccataacagcttaaactaattttgcaagcgaaggtcatgtagattgtagaatgcaatatatgaaatatacagtaataaatagcaattgcccaaattacttgacattattaaataggtaaatagtgtagttgctaaaaaaagcaaataaggcaaggtagctaatttttgtaaagtcaacaacatcattaatttagtagattgtatgcacaaggcatgcattgattaattccaactacttcaacggccatggcttaaatcttacaagtttcacggtaagtttccatccttttttgggtatatgagacctaatcaaacgctaagcatttactataatattaggcaactttctaattaaaggaaacaaatattagatgcatccatggaatgagattattgcgtagaaattaggaaatcctttcttaagatggcaaacaaaaaatataaaatgtacaaaataaaagtaaataattctctatgaattctcggttagataaattgtcaaaatatgatgtcataatttggaaactatagttattatgtcaagaccattaaatcatttattaccaaaacggtgtcgtatttatataattactgtaaagtaaagcggcgtatcaaatcaaaaccaaattgagaagtacttagtattaattaaggaaacaaaaataatgaagaaaaaaagtaaaagtcgtatgtgaccaattaaaaaaggaaactcaaaaaccaaagaaaatcaaaggtcaaatttaactttggtataaatcccaagttttcatgattaaacacatttaccaaattacccttcactcatcctaaaaaaaaaggtcaaaaacttcaccaccgtctctctctctccttctctcttcctctctctgcgcagagaaactttgcaatttgcaacacattcattaacccaatctcttctttagctcaaacatatctacacaagaagataagaagcttaagattctctccacaaaacaaaaatagttatcagattcacaaacaaagccatcaaatttcatcattgatttgttcaataagaaatg

SEQ ID NO: 748 - DNA, 3000 bp, Unknown
  misc_feature (1)..( 3000): cDNA_ID_2125627_gDNA_ID_1620316_Annot_ID_153192 3000 nt of promoter + ATG
agctaacatcatactttgaatcaattacaagaagaataagaaacaagacacctacaaaagatagtcatcatcgcatcaattccatgaatacaaagccgttccacaagctatgcaacagcattgaaggtaacaagttccttgaccttgcgaatatcaaacccaataccactccaaggaacaccaatggtaacatcctctgcacattgaaatgtgccaaagcaaatgcaatcgaactcacaagaatcgcacaccaaactggcatgtacctagttagagacggtaacaagaaccctctgaacactatctcttcccaaaccggtgcacaaattgatactacaactgcatacagtgccattgccacagggtctctagccattatagactgctcgacacttgagagtgagactggacttgaggttggtgggagtggcaagaggtttaggtttaattgggagagccggttaacgaaagggaacatgaaacagcctatgataacatctagttgccagtttcctttaagggtaaagcggaaccaatcacttgcaagtggacggaacatggagaggcaacggtggaggatagcaatcccggctaggccttctgttacatcggttatcagactgaacaaagcttggcctctaaatgttagggattctttgtggaaacctgatatatgagccatgaatgggatcatccatgaaccaatgaaccagaaagcggctacccacagaagcattacctgaaaaagtgtatgttaggggcatggcagattatcgcaggattaaccaaggaaataactgaaagctttggtatataactcatttctcattactgtttgttttgcatcttttgtatgaaccaaagcatctataatactattagcttgatgttatcttgtagtccctagttactaagtcaaggatattagcccacgtttaaatgtctatacattcaaaaactacgtcttacacagactcaatatccataatacactcttatcagataatcccgtaaaatttctatataggtttcaataatgttcttgtgtaaaagttatgaatatgatacggtaatacaaaagaggttaagtaacattaagatgtaggtacctgcacaatggtctcgacagtccatggtaccttccaacgagtcccaatggccttcaaaactgcatctgcagcctgaaaaccaacgaaacaaagtgctttttagacccaataataataggttgaacacaagatcgataagcctttgtgagagtttccttatttgcatttttgccatcacatttagtaaatagaaagcctcatcaatttgtatggcacatttccagatcaaaagaaacctcaaattcttatttttcactagtaaacaaaaaaaaacaaagagtggataatggatatatacataacagtttattgacaaatataagattctgctgcagtcctaacctctagagtctagaccctaatatcaaaaccggtttgtcagactaaaacagagacagaaggtagttcttcttcaactgtacaagtatccagtaacgtccatagatctttaccttttgaaaagttgccttccaatctgttttatctgtacatggagaatcttgatctggcttaactaattcctcaggcacaaaatgctccggattctcgggagcagaatcttcatttctaaaacacaaaatcttccatttctgcagaaaatagccccaaagtttaatacattggagacaaactaccgattcttccattaaccatttgacactgcatcaatacaaatattgaattcttacaataaagaagtcacaagattactaaaacctcaagaaaccacaaatttctaaaactactagtaatccaagcaaatccttatcaaaaagcactctctttcgtaaataaactgaatccacagtgctattcgaatccaagattcctcaatttcaacacaattcaaacaccaaagtctctttttcaattcaaagtttcatacttttgaatataaacagagaaaagaagaaagaagcgtacatgcttggcggacttagaaggtgaagaagcagttaaaggggaaatcttggtaagagcaggagagaaaacagttcgacaaggaaccctaaacttggaacgcgaactagagagagctgggcgatggcagaggagagacgaagaagagcaagaagaggtcaacatgggatgggaatctgaattccaatttcaaactcagatttcagctttagcaagctcaatgagagagatatgagaaatccctctgaagaatgaagaaccctaatgagagattcttctcagtttcatcagagaaatcgaaaaccctaattaatctgtggatttgggggttttcgtgactgattttgtgtctttcagtttttctcaccaaaaaaaagttgttgaattttcaacgacaataattaacaatccgtcttaaccggaccatcgaacaaaaccgatgtttaaaccaaaataaaccaatttattgatgaataaaccaatttgttcattatccttttatagtttatagctgaattgccttcagaacacattggtaaatttatttttatatttttcagaaaaacaaatcttttctatttgacatattgcaccaaaaatgtcaaaactatagaggtcacagtagaaacattatcaaaatacagagccttaactgtaaattacatagtatgattccttggtgaagaatctattaccatgacacgagttagagaaagtcaaacggtcaaattaaaatctgttttcgtctctttcctcctcatatatcgccatgccttcctctcatccatttcttgactctcaagatacacaacaatctctctctccccaaaaagaaaaagaaaaaaagaaaaaacaaacaaaccctaattctctctttctgtctccttcaattgtctaatgtctccttgatccatcctgatctcaagacaattctttgcaacgttgttttcttggaaaattttcagggatg

SEQ ID NO: 749 - DNA, 3000 bp, Unknown
  misc_feature (1)..( 3000): cDNA_ID_2125619_gDNA_ID_1620316_Annot_ID_153190 3000 nt of promoter + ATG
tggctatgcctatagtatatactaaacagatactgaattaaaatcaaaagtttcagtaacttttgcttgcagagagtttgtagatacctttcgtcttattgagcaaaatttgcaatcggattcagattgaggtagaagctgattaacaataagccggtggactggcacattttcttttcttaaagatgcatgtaaccttgaagactcgtttattgccataacctaaagggaaatataatagccaagtgaatatgtaaccaaatgtacccaggattccaagaagataatttccaagccaggtgttcttcttaatacaaattaatgatctttaggaacaagtaaaagaatggtgttaccgttgggatggttacaataacaaactcggtagtgtccacatcacggaaaacatttcgaactttctccatcctctctttcagttgatctaactcgttaggctgttaaagcaatgaatgttcaaaatttgaaagaaggtgaaggggaagtaatggttcaagggaaaacctatacttacaagttctttttgttgtatctcttttttgccaaagaccaacttaaaggctgaagctgctgcagtgattttcttcttgagctgaataatcaaacaatccagttagaaacaagtaccctaaacatatcaattgtgtaagcaagccacaaccaaaggctatatttcatcctcaaaccttagttattttgctaatggatgaatcatagaagtctgggagggaaagaagccgcagagtatgcccctgcaagaaattatttggaatcaatcagattaacaaacgcatcatactctaggagccgtacaaattagaaagaaacaaaataactaaccgtgggagcagtatcaaaaactatacgagtgaacctactgtattctggtgcctccataaattgaagaacctggaatgagatctcaacattagtaattaacatgaatagttttcacttttcaggggaattctgagagggataagtgccttggaaatagctgctatttcgtcaataccaggagaggcagcgttgagcatatcttcaagatttaagtcccctaactaccaaaaatgaacaacacaggtaagacataaatgaagttttccaatcataatggaggcttggaaaatcaacaagagagaaaaggaaaatgaacctcgccggcaaacattccgagccccatgctatccatcatatttttcacacttttatcgcccgtctgacgttttatctcgtccttcattatctcaggtgtgatctgtttcaacatgagaagaaaactcagcaacatatgtaaggtatcccggagtttgcagagacaagtagttttttaatcacctcaagagcaagaagtggagaatcaacaccttgaacgggctttaggactcctcctgacaagtcctggatttcaaaacaagagattagctgatgcctgaaaacataatccaagcgaaaacatagagaaccaaataaaaaattgatacctgggaaaaagaatcgctcaaggagtgagcagggtcagtagaaaccacaatggtaggatgaccgtggctagcaaacttaaccgcaagagaagcagcacagctcgttttcccaacacctcctttaccacccagaagataatacttccgctgattcacagataccatctcattaaaatgagaagctccttcagcaagagtagctaatgatctcactacacaaacaaacaagaaaccaaatatcaaatgacagaactttctatatgcagaatcacttgcttccgtggataaaatcacagttcaacaggctacagagcaaggtgaacatagcttactcttcattatgtgatccaaacagcaatttatttacatattcaactacatgtttctcatgataaaccacaactcatctattcaccaatcagtaaagttctcatctttcaactccacagagaatcttgaagtcatgtcatcactccaagaggacacaaagatcagatatttgcaattaataacgttcccaattaacgagagttcttacaatagtaagagtcaagtccaaaactcaaaccaaaaatggatctgaaaaccatagtcaactctgcggagaaaattctagctaaacaaaagagaagagacggtgatgaagaaatgtcataaagtttgaatttttttgcagagagagcaacaaggggctacctcgaaagagtgttccggagattctgtcaccgtgaatttgagcattgaaggaattgaaacccagagttcctgcgacccggtggagagagattgagctagtacttcgagaaacacgattgaggagaagtaaagccgccattgaagaattcagaatagaaaaaagggatgaacttttcccggataatcgaagaagtaagaatcactctgttttggacggagccggcgacggaagaagggctttgcgagggttttaggaaataaattatttttcataaattattttttttcttttttttttactattagtataaaataaaaatatgttaaaatttgagtaatcactttgtaaatgaaaattttaactttcaaatatgaaaattgttctttcaaatttgaagaaaaactgcttattcaattcattttggccaaaataaattaaaaaggtaaaataaagtttcacaaaaagcccttacaagttacaattcaacctaattgttcataaaatgattagtgagctaaactcataatttaatggattaaaaccatcaccaccaaaaacctaatctttacgtcgcaacaaaggtccataataatcataaaccggatattaaaaatatatgtaaaaaatgaaaaatgtttttataattaaaaaggtcccaaaattattacccaccactctctatctcaatgacggttaagagcatcagctttgaaaactgcttctcgtcttccctcaccaaacaaccctctcacgatcgctctcttcttcatcttgaagccaaagctaatatatctcaatatg

SEQ ID NO: 750 - DNA, 3000 bp, Unknown
  misc_feature (1)..( 3000): cDNA_ID_1391361_gDNA_ID_1620316_Annot_ID_153193 3000 nt of promoter + ATG
agaaggacccatcacagcagaaacacgtccaggtgatagttttccggtcacacatctcataagatgtttgttttttccttttaaagtaattgaaagatctttaaaagcaacttcaatcataggtctctttcttatatcaatatcattagccatagagataactccagagaaagtcaagttcttgttctgctcctgcattgctttttccttttcaatctggccataagcgtacctgaacatctggctctgtgtatgcaaggccttgccttttggagcatgttttttaatgtttttatcaccaatctcaagattaaacccttcaggatcttcagggttttgttcaatgtcatgtaacatctctgttagtttgttcttctcctttttctttccctttttagtgtctgagctgcttcctagcattggtggtaaagcagcatctgatccaggttttgcttggcttaaacctctcatcaaatcaggctgtttcatagatttcctcctcgaaaatgttcgagaaaacgattgttgcagctcggttgcatgcttctttgcaatatctttggcagatttccatttctctcgcgattgcgaatcacgcacactctgcactgctttttctctggattttgcctgccttctttctctcgttgcaagcacttgatcagagcagttgtataagattatgagcaagaaacctagcccggcctacacagtacaataaccaagggtcaaatgatcagaaataaccaacaaaatagatgaaactaaggagagatcaattatgactcacgaaaagcatgattccatatgctgtgatattctgatttgttgatcttggattacacgttgccaacttaaaacaatctgcaaaatattcatcagagaaaagacaccgtaagttctttgcttctccttctttatctctgatataacaagtagtgttgtttggacaaaatacatcacttactcagttctgcagtagaacctgtcctgcagtaatgtctggagaaaacaaaagattagtctacctgattagagaaagatgaatcttcaaagaaagtaatgaaaatcattcttagttagttaccctttagtacaaggaagcttgtcgatagtggaaggacaaaaggatccagctgaacagaaaacttcactactactaccaatatcagcccaaatatcagctccaccacaagtatgatttggctgaccagaaggaagctggtaatgatatctgcaaaaacaataatcctgcagcaatcttaccatatgttcaagacaaacttagaaaaatgagcaaaaacaagacttacgggtcgcataatcctgttgttctgttcagattagcttctggacaataagctcccaaaggacaagcttcacatcatagtgaggaaacaacattagaaatggatcaacaaccgaatctttcatcgtttctgaatgtttaaaggaggttaacttacggatcatgcaggtgataccacgagggcagaagaaacctgcgcaacaaggcgcacattgctgagttctaacaggaacattcttgtcgtctttaaggtcaactttcacatctttagcagtacgacaagcccatccaggctcacatccagacatccatgaagatagattgcagttcttgttcggtttcaagtaattagtagctctctttgcacctcctaataatccattgaagtatattctcacttctgcagccgtacatatcctctgcatcatgtcacctattctcaaaccaaaaacatcagcaaaattaaaatattatttcggcttctgtcaatgaaacagaggatgtataaatataccttttgtggttttaccacatgcgtttaagaaatctggctttgtagagaaattaaaggcttcgttataatcttcttttctgaaacaaagacaataacataaacatcttcaatgctataggataaaggttaatgccattttgaaactaacacattggtaatgcagaatccgagctctcttttgatgtcatcctcaaaaacttcggtgagattcgatattttgtcgaaaacgaattggttatagagacgattagccgcgggattatccaagcttctatcttcttgacaaatcactctttcttgctgaagaatcaacacgataaacacgaagaacaatggaacaaaattccctggaaaatatgaatttctccttcccatccctgaaaattttccaagaaaacaacgttgcaaagaattgtcttgagatcaggatggatcaaggagacattagacaattgaaggagacagaaagagagaattagggtttgtttgttttttctttttttctttttctttttggggagagagagattgttgtgtatcttgagagtcaagaaatggatgagaggaaggcatggcgatatatgaggaggaaagagacgaaaacagattttaatttgaccgtttgactttctctaactcgtgtcatggtaatagattcttcaccaaggaatcatactatgtaatttacagttaaggctctgtattttgataatgtttctactgtgacctctatagttttgacatttttggtgcaatatgtcaaatagaaaagatttgtttttctgaaaaatataaaaataaatttaccaatgtgttctgaaggcaattcagctataaactataaaaggataatgaacaaattggtttattcatcaataaattggtttattttggtttaaacatcggttttgttcgatggtccggttaagacggattgttaattattgtcgttgaaaattcaacaacttttttttggtgagaaaaactgaaagacacaaaatcagtcacgaaaacccccaaatccacagattaattagggttttcgatttctctgatgaaactgagaagaatctctcattagggttcttcattcttcagagggatttctcatatctctctcattgagcttgctaaagctgaaatctgagtttgaaattggaattcagattcccatccc

SEQ ID NO: 751 - DNA, 3000 bp, Unknown
  misc_feature (1)..( 3000): cDNA_ID_2125611_gDNA_ID_1620316_Annot_ID_153187 3000 nt of promoter + ATG
tcattggcgtatatattactcatctatatataatttaaactcctgtcaaataaacgtcgttggttttaaatacttatgaatcttcttagctcaattagtatatgcatatgtatgaagttgatcttgtttcaagaacatgtgaaaatcataggttaaaatcaaaatatgcgacatacatcaaacctctcagcaaaaggtaaacttttttcttttgttgacagcacataaattatataattttataatagctaagttgataacctgtacatcgattttgaatcagacatatatatgcatacgcgcatacacattagaaagtggtgtacttgacactacgaagttgacaaatactaaaagctaagtttggtgaagttctaataagtaaattacactatacatatgtgttcatatgtcggtccacatatattaggtacaatggaacaacgaagctgcttggtcttgaaaaacgagttggtttatggcaagtcaaattacaactccttcggaaaaatatattaccacaacattttctatttttggagagaccggtcatcataaatcaaatttcgttagaaattcacttatatgtctactttgtctcctaactttgttacccgctgcccaaaattatcctttcctcaccaaacataaaaataagtaaatcgtacaactaagtaatttgttatatggtggggtttttctttattaaggttagaaatggtttgtggtcttgatcagtaagatttatgaaatagttttcttgtaattaaatagaaatttgtaatttttgaatgtcatctttttagatacgtgaaaactacaaaaattacatgagttgttaaatgtccaagaacttctttctgtatatatcctttacgtatattgatgatttgtgtatataatgtacctgatgagtctaaagaaacaatcgacgtcaaagaaaaagatagcaatcatgttcaccgtattttcaattgggtgatgaaggataattatattcttaaataaaagtcacacatgtgtgaccgacctcagaactcctaatctaagtaacaaataagtaaatactgttaattagtactaataagaattaaatagctttgataataatgatcatggattagcgactagtaatatgtttgtacaatccaaataaaacataaggaaaatattatcactttacatataaacttggactgaagtgcttattgtaaagacggtctagaaaacaggctaggctatatactcaagggtataaatatcacaaagccaaaatccaaactttgcgactgttttgaaattctttgttgattatattgaaaggatcaaatgtcatttggtactatactttcaaaatctgatcattttgcgttatgagacaaacgaataatcttaagtgaaacaagcactcatgagaaatgcagcatcaaagaaaactgagcgatcacttgtggtatattaatgggtcagagcaccaacaccaaaataaatgtatttgtaaagtctttatacagagaaagtgtatgtctaaatatctccatgataattatatatccaaaaatataatttgtttttattgaatgtagctggtttggaagattgagaatgcgaagttataaactaaaattatattttactttattatgttagttcaacaaacaataattttttttaacatgaatattttagagaaaactacatcggtttaccagatctaaattcgactgcacatggaagaacaaaatatttctttagttattaaaaaagatgacaagggattcaatccaaaaaatatggactgaaaactccacgggtttaagaaatttattacctaccttttcaaccttttattttcttagtattattttaatttacaaatattggtccaaaatggaaaatttcaggtaaaatgttcggctaaaatccattaaaaattagaatattgagataacaaagaagctataatatatgcaaaaggtgcaaattgctgcaaagttcaactacgtttctcatgcaatttgcaaagtcaaaccatcgcttgtccgagacatttgttataaaatgtttttatactccaaactttcaataacgcattctctactcaaatctttctttctttctttggatttttaaactctattttacttcagttttgtattattcaaggagaatctgtactataatataatatatattgtggatcgattgttgaagaagaaaaggcttgactctcacaataggcttgatcatgtacacaaaggtattatactttatgttctccttctcgattaggctgcataaatcttaaaattctcatataattatacaaatgaatatagtacatgaaaactgattttgtttccactcctagtaacattaatgttagtcaagcttttgccttttgacaaatagaagtttagtgaatgccactaaactttgtcctctctagttcatattgataaaattgaaatataacttttaaaaacaaaccttgttaggaacaatatgattgaagtattgtatttggcaaaaaaaaaaaaaaaatagcatatggaagtgttaaatgcaagggtaacccttttatacgccaatgaacccggcttttcccgttgagtattgtcctaattatatctttttaaatatatataatcatcattagtttctataataataaaacacttttaataagttatacaatctaacggtatcgtgtaacctttttcatacaattcaaccaatgaaattaaacaaactcttgttatttttattcacactttactttattcttaatgaacgtttaccccatgtgatatcctccttatgtaatgcttcttcacccacaaatctcactttatatatacttatatgtttgtcttcttcatctatatataagcattgctctaaacagtttatagaaagaaaaaagcaccaacttctacattcttatttctctcttttcatcttcttattataaccaagggtttgggttctgcaaaaatg

SEQ ID NO: 752 - DNA, 3000 bp, Unknown
  misc_feature (1)..( 3000): cDNA_ID_2125580_gDNA_ID_1620316_Annot_ID_153175 3000 nt of promoter + ATG
tcagatttcgtcgtgagtcatttctgtttcaggatatcaaactctggggtggaattgcaatttctcactgcttgcgtgagctacgtatcgactttttttctcactatgccaatccatatgttatattgcccagaagcttgtatacctgcaaatctctggtgaccttgaaactcctaggcttgggtattcgtgtggatgttcctcgagatgtttgtctcccttctttaaaaactttgctacttcaatgtgtggcatactcagaagaagatcctcttcgactgcttctttcctgttgccctgttcttgaagatctggttattgaactagatgatgcaaaccaaaatgtgaaagcgctagttgttattgtcccaactttgcagtgtctatccttgaagatacctgcttcatgttctgatgaacggtatttgattgttaccccttctttgaagtatttcaaagttgaggatgacagagaaattttcaatgctttgattgagaatatgccagagctggaagaagcggatatctatgttacgcaacatattgagacgcttctcgaatcagttacatctgtcaaacgacttacactacgccaattgtacaacagcatagatgaggtaatttgtttctgtctatcaactttaagctctcaatcgtctgttacaacttatgacactgttacatgtgatttgtgcagtataagtgtcgtgctggtattgtcttcaaacagcttgaacaactggagctatccatatgcagtgataattggacaaagttagttatatggttgctccaaaattctcccaatctgcgagttctcaatcttgacgctgatgtaagtctcttcattgactatttttgctaaaagctttctatggtgtaatcttgagtctgagtctctctgtctctctctcacccccacgcagagtgattatgaacgttatgaggagtatgaacaggataactggaagaatatacaaagatctgttcctaaatgtttgaagagcagtctcaaaactttggagtttgcagggtacacggcaaggccagaagagagggatttcttgagttttatcttcaaaaaagctcgttgcttgaagacttcatcaatctcgcattgaccacaacataagaaacttgagagctatcgcattttattctgaatcttgttttccaaagacaatttggttttaaactgaatatggaacttgcttaagaacgaaactagtgtagattattaatcttatcatgtggttagtgacttagttctatgatctggttatatgtgtgtgtgtgtgtgtcgcagtcttatgtttgtttaaaatatttcaaataaatccgaaatacaatttagttgaaacagaagcatacaagaaacatgaaattttgtaaattcgtgatgttttcttgtagtcaacttacatcctcaaaaagtcaacattttcaaagttataaatacattatacatttgtttacaaatagccattctcttacaattataacactctcatgacatacaagtgtatcaatatggcaaacaagaaaaaaaaatcataagaaacacaaaatcacttcttgttttctccttcaaataattgggacgtaccatttttattttatttttacttcatgtagtttagatatatacggtgcagatttgaaggataaaaaaatataaatatatgatttaatcaaataagcagcaacaaacaggaccggtgggtttgtcgaagaggcagtggccgtccatggctgcagcgtcggtgctcctgtgacaatgcttgtcgcagtcgccgtcgttgttgcacgttcctcttaagcggcatggtccgtccattacgtctttctctgtttttatgtaaatttaacacacatgcatgtatattattaggtcaaaaaaatatgacatatgccacaaaacacaagttttggatttaaaagtatttgttattttgaaggggtggaagataagtacctacggaatttgcagtaatactaataacgagagagaagacgacgagaagagcaacaagttgaaatcttgatgaagccatttttcagattatttttatcttttgtattgcaagatattcaactttaaatttgtgtttgaaaaattatgatctatgttggggggttttatacgtgaattttagttttaaagatagtaattttgttttgttttaaatagtagaccagttttagtcaaggtaatttatggttaatatagcaatacaagtaaataaatctcctcaaattagaattagccatcgtttcttacttctaaatttggtgaggatatgaaagaatgaacggtagaggagtggctttgattacttgaaaattacttaaaaagtcaatgcaaacacaaagtcttaggtttaattataaatattaaacattgatattttttaccaaattttaagcatcttaaatattaaacataaaacataatatgtccaagatcatttaagtctcaaaaaattatgcacacattatcaaacaaacaccaaagaaaacaaaaatcttattaactttctttggagagtcgctgtcaaaattaaatcttatacatattcgaaattttataaatattgaaagtaaaaaatggtctggtagttttgtttttgttttttgttttttgtcaattaattttgcgtaaaaaatctatacaattttaatgtggtataagtataatagaatctaataaacttttcaaaagaaatataaccaatccaaataaagtgcaatgcgatccgaaataaatgaattaagaattttactatttgaaagaaagttgttaagaatctagatattgaaagaaatattcaatagttaccatgattgaacaacttgggcttattataataatgggcctgatacattatcaatccgagagagtcaagcctcgtgagtggttaaagctctcttcatcggaaaattccagattgggaaacaccaaaacaaatcaccggcgatcggaaaccggcgacgtaagct

SEQ ID NO: 753 - DNA, 3000 bp, Unknown
  misc_feature (1)..( 3000): cDNA_ID_1018890_gDNA_ID_1620316_Annot_ID_153179 3000 nt of promoter + ATG
aaaccaaattgaaaacatgtactgtgtggtgttgaacttgtgccagatgatgtacctattgacgggaggtccgtggtctgagtccggtatagtcttctatgagaagttgtttgatgaagaagaaccagtagtccatgaaggcttgttgggagcaatcgtgagactgagtgccgttaggtgtttgcataagtcttctgcccctaactttaaattcttcagtgttactacttactagtactagagagtagagatgttggaaagaaagtgaataaagatttttagtcatgtgcatctctagtatttttcaaatatattataagttaaattctattatttaaacatcaaagattatagagtccattatcaaattccaagtactaaaatttatggtgatcagagtgtacaaaaacatgtgctgatacttcattgttactaaataatttcttgatgttgacatcaattgattacttactaatgataggggtacagggtactctagtctctagtctacatgtttcttttgctacaaaaaaaaattgctgcaaaaataatttttcctaatctaatacaaggaaactggaaataaactataaataagtatttggtatgattgtcaaaaacacgcttataaagtataaactctgaaactttcacttatcatgttattaaactctaaaccaaaatgcataaacatagtcacatggatgcatatcttgatatgcgatctctcacctacactatattaatattcatgtaattacagattgataacatattatatgcaatgcatcaagcatgtaagtccaaggctaattgaataattggaagggttagactatgtacatggggtgatatttctagaatatcacaagtccaaaaattatttttatattaccaaaataattagaatgagattgattagtatcaatccagtgatatttgtgataccaatatcatctgacgtggcttctccttattggtcacatttatcaaaataaaaaaataatatatatagttattaaacaaatattataaataatactaaaatttttttaatgatactttgtaaatatcacctatgaacatgcttttaggacttaggagcaattacgtggacagaaaggttcgcctggcaaagacaacatataataagagctccaacgttgttcgcatgtcaagaatctcattcttatcatctcctcctcattatttttcttttccttattattattattattaaatccaacttcttagttttgactttctataattggtgggttattttgagattttgttactttgctcatttaagaaaaaagtcacttgtatactgtatttttcatatatatatagttagagaccaaactttatttgccaaaccattttatagatatatcaatttctaactacatatgattgttactgaatcagttctctttaaatttaacaaacccaagataaagaaaatgatttttaagcatcggaattatgtgtttaaaaaaaaatgaaaaatccttagaactaaaaaccaaaaatactttatgttatatatgtatataacatggtaattaaatatattttaaactaggtctatccccgttaatatcgcatatatatcattatttaacttgaaattgtgacgacgttgatattgaaatgtgatataaacttgtcctggaataatttacatgcatgtaataaaaacgttaatagacaaaaatatatcattatttatgtttgagtttgttatccatatatcattaattcattatatcttttttttggacaacaattcattatatctaaatcatcatagttgggttacttaactgataaataaaactctttttgtttatattaaaaactgtcttctgatacaactatacaatatataggtgatttcatattataatttggaaagtcatggactggttcagccagaatataaaagtaccaacttgttaattaaaccgtatattcatttagtatccagataatcttcatttaatctaacatgttggactcgttataacaaaaaacattgaatacaaatctaaaaattgaaaataatgaataaacataaatgataaggagatgaaattcgacgttgcaacgacaattgatgaaaataattaaatcaagggtcgaccaaaacaattattacaaacacaagaatgtctaaatcaaggggttggttggacggatttaaacaagtttatcctcctctaatcatacaatttaagacagctctgatcctcggtcatgttattcggaagatgtacgcataatatacaaaatgttgaattgaagaagcatcttataattcttacttgacatatcttggtgtagacaaaggattggctttaaagatttgttgttttgcgaaaattttacacttaatctactatagtacgttaaaggatgatcgtcatatttttgttttaaattgaatctcgggttaaaaatgaatttacgactagtgtatatatcgcactctaagtcataatggacttggattctaatatttaatcttttatcaaaaagaatatacttaaatttactattaaggtattcaaattgtcatgcataaaatgactcatccctacactcgagcggaatgaaaactaaacccaacatattcatattttgggtaaaagtaaacgaatatagataaccaaaaacaaaactctaagaaatcaaaacattatatgcaaaccaacatatataatagcgaaattgagattgtttctcataatacccaccaggcaccagctcatttgattttcaggtccagaatagatctgattccttcataattatttccaaaataaaaaataaattcaattaactgtccacatagttatcaaccatgtatattacattgtcttataatgtacttataccaaacctctatctatatatatgcacacacaaacaaaccaaaaatatacaaatctgaacaaacattaaaactcatctctctcatcatctttggccatg

SEQ ID NO: 754 - DNA, 3000 bp, Unknown
  misc_feature (1)..( 3000): cDNA_ID_3058741_gDNA_ID_1620316_Annot_ID_153186 3000 nt of promoter + ATG
gtctggatttaaggaaccatttttttatttatttcttttccattctctcattttaaaaaaaacaaaaatcttttgggcaatttttcgtaaatttgttttcgttgcgaattggtgatccaacaaaaggaaaccaaatttctgaaaattcaaatgggaacacttaaagtatagtgcaattgtattcaaactgacaaattaatcattaattgtattagaaaatgatatattgtcatcgtgactaatttgtcttttgaattcaattgtaactactaactactggttttcatttttcagattatttctcggttcttaaaaagaagaaaacacatacctaatatcgtgtgtatcaaaaagccatgtgcgagcaaccatcttcctttgtaaatttgacccttttgtgtatcatttatatcgagtgtttgtaattgttggttgattttgtgttatttgagaggctagtcatttacgcaatttctaaatttatcttttagtacgtatcaagatgttggagcaactgtgtccaacatacatgacatgtgaaattataattgttaaaacaaaaggacatgtgaaattactatctacttaaagaaaaaaaccagaaagaaaaaaaggtattaaatttggaactaaaagaaggttaaaaagttttttacagaaagtaattacacttgcagatgaaagaaaaaaggcagcatcatgatatgtaaaaaattgtcgaagaggtttagtcgtatcactttgtttgactgatcactgtcttctgattcatttttcagtttttctttttcaaattgtagctcacaacattaaagttattcactgctttaatcagatagtttaatactagtaactagctcatttaggctttaaacacctctttctgattactagcccactctttggtggttcttacatatcacacctaactatactgtgtatccttgaagtgaaaatcaaatttaccattcgtatcttacttacatacactattatttttccttttttttttcactcaaggtcctactctttgataccatagctataatttggaaataactatttacagtgtattaattatacctaaacagtttaatctggactaaatatttagatagatgttacaaatttggttcgtctaataaatgaagacaagacatgctaacaaataaaacactaccacaaagggatagtgagagaatgtgttttgcaacaagacataactttgattgcttgatgtgttaaaatgattatgtcagagacagagagcgatcataggctttctttatttctaataacgtcgattttcttcttcttttctggcgttcaataatgtcgaattttaattcttgatttttgcaactctaaatatccttaacgacattgaagcatggtgcatgtcgatcgttaataataaagttgaacaaaaatcttgttgaattaattacaagcacagcttcaatagcataactttacgagacgaccagatcttatagacgagtttcgcttttacttttttaatgattaaaactttcatcggagaacataagtcttcctcttaattaaaattactacccgtgcataacttcattttttaaaacatcaataattaatatacgattacaaccctaaaaattagtcaccctatagtacataacaatgatgatagttttttctttttggtgtaatgttaaaataaaatgttagccatattaaacgatagttcttttaacttagccattgtaagatatttcttactttagtttttccgtagaagatattcattatggtatggatagtatataccttaactgagtttaaatattggatcaataccatctaataacacatatctgatgttcaatacttaataattttgcataaatgttaagcgtgacaacttaaaaaaaaacacatcaacagagtaaaaacatatctgttaaataagaaaaatgtcatttttataacacttaaaaaaaaatgcatgaagcgtttcatagtttttttttttttcaaagtaatgtaggcgttagatatttcttacaattttttgaaaaatattttttatgttgtgattggctgatatcaggtaactaaaacttctttaaagaattgaagaaaatttgaaaagtaaatagatggattcctatattgtcatttcagaaaaacagtagggacaacttcgtaaatgatagccgtattattaaacaaataaatttaaattagaaaaaaggaaaaaaacgcaccacttttctttttcgctgatgcacagcttgtcggtttgcgtgcaaatcctctgtttcacaattttttcttcttctctttctctctcttcctcttttattcctctgttccaaagttcagcagaagcaaacacacacatcacttactatctctctctccttcttcactttctcacataaccaaactctctctttctctcttttttttgaagtctcctttgaaactataattgccctttagtgttgttcgttcagagtcttcaaaacttttgcagcttcaattgtacctgggtttcttcttcattgttcctaaggtttctgtgtccttcaattcttctgatataatgcttctttaagagagttgacatcatcactttcttggggtactcttctctgtttctccccagaaaatccaactctgtaattttgggtctttattctgtttttctctttgaagaatctttaaaattctcagatcttctgaatctctcttctttaaaactttttttaactttattttttgtactcgcttctttgccttcatttttctcgtatccacatgtcgttggtctttcgctacaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaa

SEQ ID NO: 755 - DNA, 3000 bp, Unknown
  misc_feature (1)..( 3000): cDNA_ID_2125595_gDNA_ID_1620316_Annot_ID_153180 3000 nt of promoter + ATG
gtcttaagagctcgatctcatcacacgtggaatcaatcaccttagatgggtgccacgtgaaggcaggacccactattctgatgatctaaacgcgttaatctctcgccagctggaatttcaggtttttaagtcctttcgttttcttctcgctcagtgtcactctcacgcgcgacagactcgtaccatctcgatattttctcatcatctcgataatatctgagtttggtctcagcgcgtgagttatcacatgcgagtgggtttatttttgatgtcacgagattcgttgaacgttgaaacttgaaagtctggttggtcctactttgcttgttaagtgttttgctcgaataaaacttcattttttttttttttttttttttgaggtttttgtgtctatccacatctacgctttcattttatgattttttttttattacgtcgaagcaattttgttgtatattgaaaaacattatagggtcaatattagtctaagcgtcattttccatattgtatgaaataatcaatccaaaacgtttagaacaaaggtgaaaactcatcattaaggttatacaattagttcatatttgatgtgtccacagattattaggtctgttttgttcatttgatgatggatagtcattttatttgcttaagattggagccattttcagtcaaatcgaaatgttatttgcttaagaaaacggataaaagcattatttatcgtgattttcagatgtcgacatagtgggcacatagatattatttaattaagtagccaaataaaataatgattagagaaaggaaaagttaaaatactgcgctgtaatagtgatgatgatgatgataataaagtgactttattgcggaaaaacaataaaataaatgaattgtccaatcatgttatccagtccagaaagttacgaggtgaaaccaaaacacaataaatgaacaataactcaaattactttatatagatacagctatccagtcacaaggctcagggaaaaagtgggaatatgatttactgatttttaaaaaaaattagtggtgaattattgggctatttttatatttgaattacgagaagctttctgtttaagtgattaatcgattagatgctacttcattttatatgattcagttggtccatcaaagatcaccatagatcagcatttctcttttcgtttcatagagagatttgtaacagatctgctccaacttccatcttttacagagaaaaagaattttgtaccacatttgttacttgttagaatgtactactccctctgtttctaattaagtgtagtttaagtgtattttaaaggatttttatttttttcaatataagtgttgttttcacttttttttatgtaaacattaaatgtatttaatcgtttttaaccaattatatttgatatcatatttttttattggttggattggttataattaatgatgtttttatagaaaaaagataaattcaatgagatttatatgttttcttaatttgtgtgcaaaaaccttaaactacaaatattcggaaacagagggagtattagttatgcatcgaatttcttgacgatgcaatttgttgttttccgtcttcattgtcataagagtgtcctgcaggtttctgaggggacatattaattattgggtttgaagattaatgagaccactttgtagatatcattgaaatgaatttacaaatgcgtacgcatgtacatcagcaaacctcattaacgtatccggtaaaattcgtatactaattaatatatacatatatatttggcattatctttctcacatcctttgaacttcgatcaattttctctgctctccatacatatttatgtgtgtatgtagatttacccattcctctttgaaaatttcaagcacaagccagtattgtactaatccggaagcatatggcgtatataccttatctcaaagatgatagaagtatccggtccaatcacttgcataaaatacgggacataccataattgaccaattacataaggattggattgctttttaaagttagatggagaagaaaatagacaagaagatgtttataagtttttgttgaatgaaattttagattaaagctttatgtgatatttcattctcgctgtactaccaagagaaagagagagggtgattgatttgttgaattagctaggcttataacctttgtgggatgagtgtgtatatgagtcttaataagtgattagtctaacatgataacaatcaactccaacctcaacgaacatgatgatactagtagactttacttacttagtttctcaaatttcttacctgaaactaaacaccttcagcgcaagaaaacccggatttctatgggtcatgaggattagtgtgggattcggcatgggattcactcggttaaaccgtttaatactttgttgtgtttagggtttcaacaaccatttatttcaaattagggtttggcaacaccaaaatgtttgtctttgaacttctaaacgttttctaacttgtggcttttcgagactgtggcatttctcattaatggaatattaaatcaatccatatcttacctaagaaaaaagcctcgagaaacaacaaaatactaaagagtgaaattttcaacgcataggccgaaaacttgggctttcagatcttatgaggccctatttatcaaaacatataacacaagagtccattaactttaaatccaaacccatttgctttcaaataaaattttcccaaattacccttgaaaaaccagcacagacacctcggtcattgaagcgaaccgaaacaaaacatccggaatggcgaaatcaaccaattgtgtgtttgtcttatttgctaaaaattattttcttttaaatatggttttgatttcggtccagggtaaattcgtaatttgcatttaaaccctagttaaacgcattataaaaagacgaaaccctagaagctgagagtgagtgagtgagagaagaatcagagaaaatg

SEQ ID NO: 756 - DNA, 3000 bp, Unknown
  misc_feature (1)..( 3000): cDNA_ID_2125576_gDNA_ID_1620316_Annot_ID_153174 3000 nt of promoter + ATG
acccgcccgaagagatatcatgtctctgaccctgtcacaattatataaagtggatgcaaacttcttagtatatatgacttctctgatgtagatccaaaagaagagtgttttacctctctgcaaattcaattcctgtttcaccgggccttatggtttgtggttccaagtaccacacttcacatacaacagcccatgatgtcatgagttgcagcaagtgcatagtaaatgattgtctgcaaaaagcatgcaacatatttagttaccaagacaaagaaatgaacctaaatcgcaactattcaatataagtgaaacaaaaagtcgtatctgtcccgtctaatatgaaagacttaaataaaatacgcttactttctgctattccagaaggcgtcaacaaaaatcttgttgtatttaattgcaattggacaaacagtgcagtccaattcaaaagcaccctgacattgtcatgaagcgaatcagaaactatagtgtagtagtagtgcaaatcacatcaaagttaagtccaaataccttcttaaacatcactgtgtaattattatttacacatgtcccttcgggaaatatgagaagaggattactgtcagctccttggacatggtcccttaacctgaatcacgtgattcatgttcccatgattagtgtgagtagatcacgtaatgacacttaaagaggataagaatcatgcatacttttttgctacaatttcacgatcctttgcctctgaacgattgaaccagatacatcccacactctctaatattgtgctttgcagaagaccttcatatataaagcaacaaaagtcaatcatggctttcacaataatgcacaaagggcaaaccaatcactaaatcagtcacaagcctattaaaaactgagcaatcataaaaggttataagcacacttttcgctctctaaaagcctgaggacttaccaacccaaccaggatgcttctgcattataacagcaaatgcggtcatctgctccaatacgatgaaatcaatcattgaagtatggttggcaacatagacctgtaaaccccactcataaagtaagcatgtgtatcatggagacacaaaataacgttttttaaaatgaagcatgacctgcttaggacggatgctaggacgtggcccgtgatatttgacaactccggtccatgaggcgacaaaaaagctgcaaatcatttccaccaagaccctctggtaacacagcaaaagaaaggaaaatcttcctgaattctagatggaagaataacggaataacatagtgaaaacgaaattatacaagacaaacgagagaatccaacctacctctatctttttcctcaacctatcttgacctttcagcaacgcatttacagggataaacaatgaaaggaaaataatccacccaaaagctaaagtgaagcacctgcaagttttaaaacaatgaaactgctcagtacaaacatgcagatctaaactttgagctctggagaggataagagccatatataattgaataaataagaggaaccaacctcaagggaaagaggatacagtatctaacaacaaccccaaagcagtatagtgggaataagtaaatattccagttccaaggttctggaggatttgatttgaaacatcttgtgaacgagtcctgcaacaatcaaacccacaaaacaaaacatcttatactcaaaaatctatcctttatgtgataaatttgaagtcttttgatagagtaatggtgagacagatttgggttttagtctgaaatatcttacatcaacaatggcaccagcagcttcagtgagcgttggagagatgtctagcaaatcacgcctgcgaatcataaagaaaggtgaatacttaatcagcggatcaaatcgaattcaaattcaacggaaatttcggagagagttttacatacaggctgagcttgccgcgaggttcattgatggaagaaccagaaggaaggtaatcttcgatgttagggtgatcgaggtcaagctcggattttgaagtcacgagcctccctgccgtactgctcatagcttacgtcgccggtttccgatcgccggtgatttgttttggtgtttcccaatctggaattttccgatgaagagagctttaaccactcacgaggcttgactctctcggattgataatgtatcaggcccattattataataagcccaagttgttcaatcatggtaactattgaatatttctttcaatatctagattcttaacaactttctttcaaatagtaaaattcttaattcatttatttcggatcgcattgcactttatttggattggttatatttcttttgaaaagtttattagattctattatacttataccacattaaaattgtatagattttttacgcaaaattaattgacaaaaaacaaaaaacaaaaacaaaactaccagaccattttttactttcaatatttataaaatttcgaatatgtataagatttaattttgacagcgactctccaaagaaagttaataagatttttgttttctttggtgtttgtttgataatgtgtgcataattttttgagacttaaatgatcttggacatattatgttttatgtttaatatttaagatgcttaaaatttggtaaaaaatatcaatgtttaatatttataattaaacctaagactttgtgtttgcattgactttttaagtaattttcaagtaatcaaagccactcctctaccgttcattctttcatatcctcaccaaatttagaagtaagaaacgatggctaattctaatttgaggagatttatttacttgtattgctatattaaccataaattaccttgactaaaactggtctactatttaaaacaaaacaaaattactatctttaaaactaaaattcacgtataaaaccccccaacatagatcataatttttcaaacacaaatttaaagttgaatatcttgcaatacaaaagataaaaataatctgaaaaatg

SEQ ID NO: 757 - DNA, 3000 bp, Unknown
  misc_feature (1)..( 3000): cDNA_ID_2125685_gDNA_ID_1620318_Annot_ID_153232 3000 nt of promoter + ATG
atatttaaaatgtacttcccaaataatatagtaggataatatgtctttgacactactccaaaattaagaaacatatttctaaacaataaaatcataagttttagttaacttaaatttagataatgcgtccctaccactagttataagataagcaatacaatgcttaggttgacaaagaaaatgttatgcttatgatttttctagacaaaaaattgttgggcttaggtcgaccaaagaaaaaaaaaattgggcttcttattttcatgtagaacgaaaaaatagaggagggtggttatggttattgatattgtgaagaagatgaaagtaataagacaagtataagaaacacagacgatttttaaggagataaggaagagaaggtgtgtgaaggggaaaaagggttttgatgaaaggttcgttgtggattatatagaaaccaaatctgaagcatccaagatttgcaaaaacataaaatgaaggagtgcggtggcggattctcgaagcccatcatcggagccgtgtcagattgttgagttgttgctagctctggtttttaggtttaagtgtgtttctgatttagataggtttgaagaagtggttaattctgttggaatgttagctctgttccaacttacgtgagattttgtctagccttagaagcgagtgtaaatacgttcacagtgagcaagagctccagatgaaaccgaataatacttgagatccgatttctgagcaaggcaagaaagtgaaaggatatgaagatgtctgagcaagaagagggagtgagagaagacggtgaggttttgttcactgagcatatgagggaatcaattgatgatgaatgatgtggtggtagtggtgttaatttgtcgttaagtaaatgtttggatcatttacacagaaaaaggctatcatatgatctgaattacgttttaggagagcctgttaagttttgatcttttagggttttagatctaaaattaacagagctctttgatttaacattttggaaattgaatcccatgttaatgtagatgaagaatctacccaagtgtgttgaaatatgtttgtgaatttaaaaactgatttattcatttttggaggaatattgatagttggttttgttacatttgagaacgtagaacaattgtagagcggcgtgtaattgattttgttagtttgtgttgaacttatttattttgagatataacaaagaaatgaaagacgtcaacaacaaattggtcttatagttccggttatttattctattctagaatagattatgttggcttaagaagacatttagacttaagagttatttcctctgttaaaatatatgtccttcattcttccaaacgattaagtgattttaagttttgtttttgaaatgattaaatgactctgagttttgttcttccaaattaaatcaaaaatattaacaacataatctgttcttaagaaactgattagcgaatctcaagaaatacatatttgtaaacaagaagaatttggaacgagaataatatatttataggtttcttaacaacaagaatttggaacgatagattgtttggctaccaacaacataaacaaaaaaacaagcaaacggatatagttccaaaataaataattttatatggtcaaaactactgttgctatataaagcacaaaaactatagaaacccaactcaacaataattatcctgttactttttttgtttttttgctatataaactaagcaaaattttcataagtttgaacactcataaactcatctcttcaaaataatggcaactcaaacaataaaaaagatatacagtgttttgatgattgtagttttatttacgatgatggtttcaaccaacgcgagtacggtggaagtgtgtgttaagcattgtgtcccgaaccaatgcatgaaagtttctcagaaggcaactcttccattatgtgagactgcttgcacaaaactctgcaatgaaaacaaacatgaggaatatgtcgtgcctcggagttactgtgagggattattttggtttctatgtgataattgaaatttaataaatatgcaaagtaatatatatgtattttttatctgtaaaaaaataatctataatgtaaaaatgtacctttaatcaatatactaatttcatgtaattattttatttatactaatcaaattgacacatcaaaatgctgagaagttatctaatcacccaactaataaaaatcttataaatgcaatattgttctcatcatctctccacatcaatatttagatcgttttgtaatctcttgctaaaactaatccaatcggttctctatcgaaccattaagttatgagttttctctttacaattttgtatgaatgactagaatgattgtgaaagaggagagcaatctcgagttatctaaattttgttttgtcacttgttcataacaataacatttttgtgctacgaatgtcaaaatttcaggatttgttaagtattagagaggatgaatttaatagttttttttgtttttgtgttttatttttgggtttttaatagaatttaatagttcatgtattgtttaatacaatgtcaaaattgtgtatatatttaagaaagatattatttaattagtgtacaaatatatatttgtaaacttatggtcaatgatgtaaaaatttcaattagtaattttgaggcttgttttttttttagattcaagccacttctttagtgggcttatcgaaggcccaataccaaatttacgtctcctctctctctctccgatctcaatagatcgctggagttgagagagcttcgggacttcgcgttccttgacgaagaagacgatacttcttctccttccatcacagcttcacgcaaatctttctgcagttacatcttcttaagattctgagttccgacttatttcgtggaaggattttgatatttcaacagtgattttaattttatactggaacttaagcatcacttaatcttccggctaaa

SEQ ID NO: 758 - DNA, 3000 bp, Unknown
  misc_feature (1)..( 3000): cDNA_ID_3011881_gDNA_ID_1620318_Annot_ID_153251 3000 nt of promoter + ATG
tgttcctatgatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatggctacacacgtgtcagattcaatgcatcagtcatatcttcagcatccaacacttgtcaaccttccattggatctcttaactctacgcctcgaaaacagtttttatttatttatcattccatttctcattgtatcttcatcagtctcttcttattccattttttcaaaccacttgcaaaattcgaatcagatcttctcttcaatcgaaaaaaaagaaaggtaaatctctctctctctaatcatcgttcgtttcgtagtttcttcttctacgtgtagatctgatctttgattgtatgtttctggagatctcgatctcatcgattctctgttcttatcactgattcagtgtgtttgatatctaaatccgatttgtgtgtaggatgttaaaatttaggtttcggttttgtttctgcttttgaacgattttgctctagattcgttatccgtgaagaacatagacgagtatgtagatcttacttcggattcgcgttgaagaattttctctagattcgtcacctatgaagaagattcattgtgttcttaatctagatgattaggttattgtttcgactcatttgtttatgcctattttctctatgttcttaatcggtgaagaaatgtatcaatgtgtgtatgttttgggttctgattttgtaggatttgctctagattgttgaatcgaag

SEQ ID NO: 759 - DNA, 3000 bp, Unknown
  misc_feature (1)..( 3000): cDNA_ID_3058843_gDNA_ID_1620318_Annot_ID_153238 3000 nt of promoter + ATG
accctggcgccttcattaggatcatcggattcgacaacacccgtcaagtccaatgcatcagtttcattgcctacaagcccccaagcttcaccgaagcttaatcccctttctggaatattcagcgttgattattctggaacccatttctatgtggtcaatgcaaatttaagaaattatttgccgacttaacagttgaggaactattgtttgaaagtgaaaatgttattcctatcagtttctctataattatagttatcatttcatttcatttttgcccttaaatctttgaaatcttatttttcgtttagctcctttaaacaacattgtggctcctttaaattatcctcataattcttgcttttgactccctagactaaccaataaactctaataaaaaaagaaaaacttgctacattgttttaagaaattttgcacatgaaagcaatcaatcaaacctcgatatttagagaaaagtttatgtaagggagtgtaaccatttttcagatgacatagccattggagatttggaaaaggtagtatatacagaaaattcaaatgcatcttttaaaattataaacataaaacatgtattccaaacccctaagtgggatattaagtcaagaaatagcattacataaagcaaggatcgacaaagactgaaatttgtcaagcatgaagttactaaattttggaaattttgtttacgttaaatttgatcattggttatgcattaaaagctgaaacagttatttagaaggaaaagtagttaacgttcccaaaaagttctaaataaaactagattccaaatgataatgaaaacgtcgcatctactatatgtttggttttaagtttttgttttgacaaaaaatcatatgtttttggattcttctatgcaaacgaaatataaaaaattcatgattcaaatacaaaatacatataaaaataataattcaaattatcgaacattttttccatctcccggatttaattcacacattttggcttcaattaaaatccaagaaaaagaaacaaaatgacttataaaagacagaaactagtaacttagatggatgggttaagacttaagagttaagactatctcactttcgaaaaatgatttatttagctgaggtgcggagtggagtggaccttgtgatccttttccctacacgaaagttttttcgtgaccagttaatgtgtactttgtacacgtttcttctcatatatatgattgaaaagggggcattaatttgtgagcctgaaggtagtagtcgtgatccatgagtgcatgaccatagttttatgtgactttaagatgagttcttgactccgttctacacctttgattacatactcaagtttgcatggtggaaatcagcttgaggtgccatatttgtgcttgagggggccgtaagtgcaatggcatggtactccaaggagaacggttgcgtatgtgggttccccattgttattgtgatgtgatcagagtcgcaagataatcgtgagctgatattacttgttgatctagaggcagcgtgcattacctcatatagaagataccatggactttgggaggttttcttggaaattcttccatgaggggtttaccgcgcacttgatacatgtagatgatggttttgccgtttcgtttgttcgctcggtctctttgtcccacaaacatatcttgcatgatgtagttgttgttagtatcgactcaaatatttactctctccaaccagtaaggttttgcttttatcctagccacataaaaatcagaaataaaagtactatttgctaaaaatgaagtgaaagtattgaattaaccgaaatcaatgtattcaaattttgtctcgcttttcttttgtcgactaatatattatcatttgaagataatatataacttttccaacaaaaagattatcgacaatttattgtggtaaatgattttcaggatgtatccagaatcgacagtctaccagtactagaatatatctaatagataaatggttcttcttacactatgctcattatggattctttaatttactctttcacaaaagggacgatgacgaaggagtctctctacagcacgttagaattcttttgataggtttacttccattagtctgaaatggaatcttatttataagtctgcctgaaaaatcttaacaattgatattaataaaacggaaagagtaatgaatatttttaagagcatctcgaatctatctctatttttatttatatactctatttttgtatttatttaactctaactcatctctattttcatttgtaaaatagaaatttctaattttttttctaaagcaaaaaatagagatttttattttttctcttatttattttttctaacgaatttttgaggaaccattgaagttaaaatataaatctctattatattttttcctctatattcagaaagaaaataatagaaacaaatattggagatggttaaagcttttttttttgtccggataaatatcatacaatatatttatgtaaatatcaaatttaaataattttgttataactattttttaatgcgaccttatttccaaagaaagtgttaagccaaattaaatcatacatggtaaataagaggtccaaaagaccaaaagcattaaatttaaggtaatgcgtctggtttcttttctcccaaacgaaaggagccaaaagcaaccgatcaagtggagaccagtaaccgcacattcacttcatttcccccacaagagaaaagataagataatggagttttctgccacgtggccttatcctagtggtgcgtaccgataagggtgtcaacacctttccttaatcctgtggcagtaaacgacgttatcatgaatcatggaccctttgatcatgagggcttttcgcctttagggggttctcattatataaagatgacaacaccagtaggaaaacaagtcagtaagtaaacgagcaaaagaagaagagaaacaacaagaagtagtaatg

SEQ ID NO: 760 - DNA, 3000 bp, Unknown
  misc_feature (1)..( 3000): cDNA_ID_2125720_gDNA_ID_1620318_Annot_ID_153240 3000 nt of promoter + ATG
ttaatgaaaactgtcttttgtcatgtgcaattagtgcaactgaacaatacttaagaataattgggaattgggaattataggtgtggccaccaatcggaaagaagaagtttgagactctatcttacctccctgaccttactgacgtcgaattggctaaggaagttgactaccttctccgcaacaaatggattccttgtgttgaattcgagttggaggtaatatacacaaaacttttcctttgtctactaatcattattatttttttcgttttcattgctagaaatattagcctataaccggattttttagaaccgaaatagactatatcaccttgtgcatatcctccaatatcaattgtattgaatggttttcttatgtgtttatagcacggatttgtgtaccgtgagcacggaaacactcccggatactacgatggacggtactggacaatgtggaagcttccattgttcggatgcaccgactccgctcaagtgttgaaggaagttgaagaatgcaagaaggagtacccgggcgccttcattaggatcatcggattcgacaacacccgtcaagtccaatgcatcagtttcattgcctacaagcccccaagcttcactgatgcttaaatccttttctggaatattcaatgttgactatccggaacccaattttgtatggtcaatgtaaatttaagtaattattttgccaaagtgaaaaaactgaaggtttgtttttctatcgtttcctctataaaaatctctattcatatcacttcatttctgctcttatcacttttaactctttttattcgttttatctcttttaactaacattttagttcctttaaatttctctcctaattcttgcctttggttctctaatgaaagagtaccctttttaggtacatttcgcacttgaaagcatagcaaagatgcgtccatcaatcaaattttgagggttgatttagaacattttaatttaaagatgaaaaacagccagtaaaggtagtaaaaatacgtagaaaatagagatgtcgtctcagagaagatgaaagttacatagccctttggaaaggaaaaaatgatcactaccgtcaaaagtttgtcacaagagatacatgctcaaaaattcgcaacactaagcctacgatggacggatacaaagggatctgtttcttttactttaccctaactactcctttctcagttggctagcttcaaaaaacagagttgccacgggagacagaatgtttaaatggaatcaacaagtgaacacaaactgcatgttctgtcacgaacctatggaaacaagacaccatcttttttttgggtgctcttactcgcagaaggtatgggagaagctgataaggggaatactacttgataagtactcgacatattggagggaagtctttaaaaccatttgtgacaaaaactatgacaaaacaaaaatcttcattctacggtatgtcttccaaaacacggttcattcgatttggggagaaagaaatgcttgaaagcatggtgaacaaccatcaccaatggagaaacttgtcaagttaattgacaaaaatgtttggaaccggctgagcacaatacggagtggggggagctttgaagtatgaaggaggtcttcaagtttggtttggtacaagacaagcttaagaccaaatcctctgttttagatttgtttttcaaaaaagtatgcattaagttgtaaacacgtttatttctctttttaaaatctaatctaaaaattttcttttttaaaatgacatagaaaaatccaactgtatattttaaatccataaacatgaattctagagccgcaagtccaaaaatttagagatgacatcatagcaagcaaggacacgcaagaattaatgaaatttataatggagataacaaagcatgaatatttataatttggaaactgttttacattaaattagatagtttacgatacattcaaagctaaaacacttatttacaatgaaaagtaatcaatgtttcttgaatgggtttggctacttcttctcatatggttggaccggggcatatatgagcttttacgtggtattcgtggacccatgaccatatgagcttcttcatgtggccttagagtgtggattcttccctcggatccacaccatccattgaagtgtgttataaaatttccccatgatccgtcatggcttttgtgcttaagttgtcatggtgggaattatcttgaggtgccacattcgtgcttaagtgggccgtaagtgcaattgcgttgtgctccaaaaggaacggtgccgtgggttcctcttgttcatcagaaatatattaattagccgtaaaacctgaaaattcacaagcatttggattgttttctaatttaatatccattatgtgactaaaagttctagtgatcgtacatactacatagaaaataataacacaaaatactagtttacatttcccaattaaaaaccattttgaatgaactctgtctgatttaattatacttttaaaatgtgggatgaattcaaagattatacttatattcttattatttaagattatcaagtggaaaaataaaaatatgaatgtgttaatataaggtaatagaaatttaatcatttttttaatctatatgtaaaaagtatttaaccgatatctacaatttgacgcctcccaattgaaaggagccaaaagcaaccgatcaagtggagaccagtagccatacacattcactcctacccttacatgagaaagataagattatggagttttctgccacgtgatcttatcctagtggtccaaatcgataagggtgtcaacacctttccttaatcctgtggcaattaacgacgttatcatgaattatggcccctttgatcattagggctagttgcctctagcggttcccactatataaagatgacaaaaccaacagacaaacaagtaagtaagagaaaaaccaaaagaagaagagaaacaacaagaagaagtaatg

SEQ ID NO: 761 - DNA, 3000 bp, Unknown
  misc_feature (1)..( 3000): cDNA_ID_4257567_gDNA_ID_1620318_Annot_ID_153242 3000 nt of promoter + ATG
tctcattccactttccgctactcaaccctacggataatccaatgacgaggagaaaccacgagagactatgcattgcctttattgtcgaattggcctctttatttatttatttatttattttttttttttttttttgaagtaatcaatagggacaatttctttttatacaagcgtatcacatggctatcctttcatttttggtatttcctatatttaaacatggttttcttgactaatccatttatcaattttgctatttttttcttattcttatcggttttccttttttgcatttagttaaaaagagtaatcttctatatatacatttttgtagacgtttttagaagataatattgaagatttgagccataattcaacaattaattcaaatgggtgggtataacccggtttaactctgttcggatcttggataacatgtttaattatgttctgatcttcgataacattaatttttggaaaagttacctaaaaactaataattaaaaacaaaaattaatgatttaattaccaaatttaatataaacaatatctctaaacgaaccatatttgttatttaccttaactaatttcctaaaatatttttacctaatttaaacataaatatataattcttctttcacttttatttgatcttatactttatttattttgaatttatataaaatatatatagttaataaaatattatatttttttctgcatatgatgtaattcaaatttttttaaacggacatatattattcaaagtatgaagaaataatatgtatacaatgtctcacatcgcttagaaaaattggacaatgtttcagacccatattataaaaggaccaaaatgattctgattacgaatgagcaggaagcttgatttatcagtcgtccaaaattaaaatagttatccgatttacttgggttttttattttaaagaattgaaactttaaaatgtttcaagaaattataaatattataactttatcaaaagttaaatattataattttaaaaactttttataaagtttatctttaaaaaatactttaaatatttataattttaaaactgataaagttttaaaaattataaattgaattttacaagaaatttaaacattataaatatatatataaaatatattaatacaagacgatatattacaggaaaaatcttaaatataatcaaggtcgatattttattttttgtaagtttcaaattttataatattgaaatttataagaaaatgacaaaattatgtttaatttcacgggactgggttatatggtaggacgggtttgggtggataataattacgattgtacaatgtcccacatcgcttaaaaaaattggacaatggttcagagccatactataaaaaggaccaaaataatttcgattacgaatgagcatgaaacttgatttatgaggtgtccaaaattaaaatggtttgtttactagggttatttattttaaagaattgaaactttaaaaagtttcaaaaaattataaatcaaattttacaagaaatttaaacaatataaaagatattaatacgggacgatatactgcgagagaaatcttagatataacactcaaaattcaatgatgaagtttgggtcaatattaatcttttttgaagtttctaattttataaatatttgaaatttataataaaatgacaaatttgtgtttaatttaacgggacggggttatatggtgtgacggctttgagtgaattataacattggatgatatgctacgaaaaaaacctataattaacaatcataatataattatataatattaagcactaaacaaaattaacaatattaaaaaaaaatacttaaaactttaatttttttaaaacacatttcgattcttttataagatttctctcgcaatactaccacgggtgaaatcctagaattgacgagtttgaatcgatattaatatgggatggtgtactacgggtgatattttagaattgactggtttaggttgataataatttgcgatagaattaggagtaaaattctagaatgacaattaaaatataattatacaattaaatactaccacgggtgaaatcctagaattgacgggcttgattcgatattaatatgggatggtgtacaacgggtgaaattttagaattgactggtttgagttgataataatttgcgatagaactaggagtgaaatcctagaatgacaatcaagttattattatacaattaaatactaccacaggtgaaatcctagaattgacgggtttgattcgatattaatatgggatggtgtactacgggtgaaatccgagaaacaacaatcaaaatacaattatacaatattaaacatttaacaaaataaacaaatacaacttaaaactttaaaatttgagttataaaattttgtctcgcggtgaattatacatttaaatcaaacaatagcagaaatttattaagtcatcctaagaaatattcaattattttttatttaatgaaaatatagacccgcggtataccgcggattaatatttagtgctattgataaatttatctcaacgttcagctttgacattgtgaaatgcattatgagtcatgactctgtttatagatattcctgttatagtatttattaaccgaagtaatgtaaaccaaattttaaaaatacatacaagataaataaaaggtccaaaacattatatttacggtcatgcatctgatttcttttcttccaaaaggaaggagccaaagcaaccgatcaagtggagactagtaaaccatacacaatcactcatttcctcacaaaagaaagataagataagggtgtcaacacctttccttaatcatgtggtagtgaacgagttatcatgaatcccggaccctttgatcattagggctttttgcctcttacggttctcactatataaagatgacaaaaccaatagaaaaacaattaagcaaaagaagaagaagaagaagtaatg

SEQ ID NO: 762 - DNA, 3000 bp, Unknown
  misc_feature (1)..( 3000): cDNA_ID_3011881_gDNA_ID_1620318_Annot_ID_153250 3000 nt of promoter + ATG
caaacgcaaatccattaaacctgttcccccaggtagggtttttaaactggtgaaccgatttcatttgctcgttttcccttgtgaatttgttttattgacatccactcttatctgtctctatccagggcatgcccgctgcagatgctggtgctggagctggtaatcttgatttcctgcgtaacagtcaacaggtattttcaatttcttttccattcgagaacggaaatcttcatttctctcctcttatgtcatttgcaattcttttgccttttcatagttccaagccttgcgagctatggtacaagcaaacccacaaattctacaggtaaaatttttaacctcttattctttatttggtaggttatatgatattgatttcccacttatactgtttcgttttgcagcctatgcttcaggagctcggtaaacaaaacccccagcttgtgcgactaattcaagagcaccaggctgacttcctacgcttgataaacgaacctgtcgagggagaagagtgggtttaatatcatgattctcctttacgttttcattttattcttttttctcaataaagcatgtaatctgacatttcattcgatgccaccaggaatgttatggaacagttggaagcagcaatgccacaagctgttaccgttacacctgaagagcgtgaagccattgaacgggtttgttcctatgatctttacatttgtacctttactagatgctctggttcctcaaaatatatggcttgtattgaaatttgattttgctgttgtttgttttggtttagcttgaagggatggggtttgatcgtgcgatggtcttggaagtgttctttgcgtgtaacaagaatgaagaacttgcagctaattaccttctagatcacatgcatgagtttgaagatcaataaacagagcaaatccattcctccctctaaactcagaccatctttctgtttctttttcttcttctttttaatatgataatctcttctccaatgccatttgacagtttcatgtttatgttcatgggagttgatgtgtttatgttactattaaaactatcatagtttatctggtttgaagatgctcctcttttatcatattattagcctttgaatccttcctctctttaggtctcagatgcaccaatattagctaagattaaaagtggatattttggttctatatgactcatctcgagttaggaatggtatgtcgaatctggtttaacagatctggcctaaaacgaaaccgctattcagatccaattattggcgcttacattgttttctcatagcctcaagctatgcaatatcaattattgcacatttgaattaacacaaacccatcaattaatatatcaacaaaaacccatcatcaattaacacatcaacacaaacataaagacatataagttgctcatgaagaacttataatggtggaaccagtgagcctttgagatctgtcataatcgtctctgaaattgtctcaaatcgagagagaaatgagaaatcttaaaattttaccctaaataattaaaccctagcttttaattattactgcacaaattatgtctaaataattttgcccatttactagcgagcttatatggtttgtaatccattttaaacactttaattttgggcttcaccaaaacccaaccattattatttggacgtggacatcccatggtcagaaaactcattcgataaccctacatttgatgatcaaagtggcacggaagctcgttcgatctacaagttttgtggtgaggagacttctcagtttttcttctagtgtggttgtacttcaggtaaattcttttcaatacttagtggaatttttcgctaactgttttgtgtaaataaggacgaggcctccatagcgttcagtgctttaacaatgccgtatccactctgctaatcttggatttcaagaggtatgacagtttgtgttgtgataggagccttcattaaattaaataatttcaacaatttatttatttttagaaccaaaagatttttcaaaaattttgattatcaaaaaaaaatccaacagattttctgttaaaatgaaaatatatattagattgtttttaaaaaaaatcatctgccggaatttgaatctggacatgcttattttcaaaaaaacattttagctaatgtgctagtgcatatgtttttgctaaggtatgaatttaaattggatatatagatcaatttatttattttaaaaccaaaaaaaatttaaaaagaaacttagcgggatataaaataaatatatattaaatttaaaaaaaaaagattttccgctacgggaatttgaacctgaaaatgctgatttttaaagaaaatttagctaatgtgctacatgagatgttttttttgctaaagtatgagtttaaattggatatatacatcattcaatttatttttctaatctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactattttcagtaacagtaaaaaggttgatttttaaatttttaatttaataacactcaatttcatttaaaaatttaaaatccataattaaataacataaaatttataaattttacataaattattagattgaatacaccgctctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagc

SEQ ID NO: 763 - DNA, 3000 bp, Unknown
  misc_feature (1)..( 3000): cDNA_ID_3058048_gDNA_ID_1620318_Annot_ID_153248 3000 nt of promoter + ATG
gggagactaatctccctcattctaccaaaaaattaagggaaatattttttcttaaatttgttgatatgataattatggtctacataatatcgtgttttaaatcaatatataataaatgttggttaaaacaagagcaataacataattttggtgaaatttcttgggaaggtaagaggaaaacttccttgatagcatggaagtatgtaaattaggaaatttcaacaaagccttacttgtgaaacaattcggccggatcgtacatttatcgaagctagttacttccttgtaaaaagttttttatgtagtgatggtggttgtagacctttgtatacttggaatagtgttctctattgatgagatctcttgaaaagtggcataataagcaatattggacaaatctactagggtttggcttgataaatggcttatggatgaacaaccaaggagacccactaagaaataaattttatttattattaaacttaaggttgctaatttgttgaatgagagaggtgttaatttctcccaaatgatgttaatcaagtcttattgatttatcttaattcaaacaagaaagatttttcgttttggcgattcaataaaactggagctgaaatcaaaattctttctagggatataaagagtttgttggattcatctcttgaaaaattctttaaaagcaaatcagggaactagacgaagattttagcggaagtagctcaaaaagcaaaagcatccatgaaaattgctatggtagatgaatcacgaaaagctgaaaaagctctgatcgctagtaaatagtaataatagattgagtctagttgatcagaagaaacttgcacaagttatcaaggtggtggtcgaaatggaggatgaactcgaggagaaggttcaaaaagtcgagaagataaacagaaaggtagatgagaagatgaagaagaaggcaaagaagagacatttttcgtttttggtttgttgaatgttgattcgtcttcagctatcatatcatgtcggtgttagacttaaaataagtgtttaccaataacttatacaagagaggttctacaccgtttaccaagagaatcaaagaatgcaaagtttgtaacttttgtttgtggtttaaaagaacaccacaatcattgttgaatgcataacatatttcaaccagataaggagttaaagaacttttatatggatctaatacttaaccactaatactaaaaattgatcttgaagcaacataggagatttgagtagttagaacatatctagcaaattctgatctattgtgaaaagaataactagagacggatgacttaatttctatatagcatttggagggtcataatgacttgtttttatttacgtgttttacgttattttgtttttgtcaaaaggctttcataaattagtaatactctataaataaataaacacaataaaatactctttcttatcgatttaggtatggccaatgtaaaaaactaaaaattaacaaaattttgaaacttctatacatttttatggttctagtaatattataaatttatacatatatagctaagataatattctaaatatgactataatattgtttgtaatttgaattattgttagcgttattctctaatgttacttattattcaaaaactcttcggtgttttcgatttgtatccaaattttatgataaattctaaacacgataattaatttacaaaaataaagtacttatttgagtacccttaaatttatgtttacttgacttcccagttcccagccagtataaatctttttcttatatttaaattaattaattaactttggatatagaattgaattattaggaaaatatatacatatcaatcaaaaatataatatttataagcttaatacaaacatagaaatatctatatctatatatatctagcttaattaattggatagtaaaagcttatctttgcatttttattattttaattaattacttgtatatatatattattttaaatacttattagcatattgacatttaagatacaaggtttaaatttcttttgttattttgaacagaagttttgttaatcagtaaaataaaattattgtaaataaaagaaaagattttgtgcaaaacaaactccaaagtcgtttatttttgtaactttatctttcacgtttaaaaatacaaaacaaaattatgaagtaaaaataatacgtaatgtagtcgattttacaactttacatctattgtaaacgttttcacgatcacatatatttgtttttaaaagttttaaagatatagttgaactcctcatctcaagggctttgatttgataaattatctatctaaattttaaaattatttatcaaaattttaaaatttgacaatagcaaaaaatttgacatatgtataatttttgatttagtattattattctgcattgttaagatgtaaaatgtaaagttgtaaaaagtaaatgattccgaggattttgtgtaaaaaaccttaaaatgttttagagtttcttgcactaaaaggataacttttactttttttccaaaccccaaagtctgatttacctgtgagttaacaacaattactactctctttgagtaaaaatcgcatgccaaaaagattatagaaaatataataccgaagaaaattccaaatatacaagcagtaaattaagttgattttgggaatagtctacaatcccatgtacacatctccactacattccatacaccttttttaatctaacggctcacaaacaataaaactctccgaataagtaatcaccacgtgatttatcttgacacaccaaagtttgtatagacgtgcatgtatgtaattaattaaccttttatgtactatgaattaactgtgttgatatataaagggtgactcaataccccaaaagcggtctctctctatactttgcttctctctctaaacttctctctttctttttttctcaaagcttttttccttctccctaaacg

SEQ ID NO: 764 - DNA, 3000 bp, Unknown
  misc_feature (1)..( 3000): cDNA_ID_3058847_gDNA_ID_1620318_Annot_ID_153237 3000 nt of promoter + ATG
gagtggattgttggatacagaatgtgatggtgcgtggtgtttccgagcttaatttatcaatctttgtggattcggttttcgaagatgactataatctctttccaaaagtgtttgagaacaaaaaactagttaagctcggattaagttatatttcttggttggatgggagcattttcttaccaatgcttaaaacactcgttcttgaatcagttttgttatctgttgagaagtttgagattcttcttcatgctttgcctgcgcttgaggaattagtcatgaataatatatactggaaagagcgggatgttgtcgatttgattgtttcaagtgaaagcctcaagaccctaacaataaacttcatcgtttgtacacatactttgtcatttgatacacctattcttgcttacctatcttactctggttatgtcgtggacgattatgccgaagctaaaatggaaaacttgtttgaggctcgaatcagccttcttgtagttgaaggcgatatcagccgagtaagagcgctaataaacaatgatttgttagaggatgatgagtacgatgttctccaatttgaaaatgtgtggaagctaatgaatggtattcgaaatattcggtgtctctatttgtctcctaatactcttgaggttagttttttttgttcttttctctatttagctggtcttggtaaaataaatgaaagataaccagtacttcgtctcaatttacggagcatggcagtcatgtttcttcggtcccatttttaacaaatataataagcaaaggtctaattatggtttctcttgttatgaggtgctttctctatgctgtgaatcgatgccagtgttcaaaaacctcaaatctttgtctatcaagagtgccgagaatcgaggatggcaagcaatgccagttcttctaaggaactgtccgcatttagaaactctagtccttgaggtacgtataacacaattcattaatttgccaaacatgtacaaaatatcatactttgaatttctcattgtcacttttatgctttcagggtctattgcaccatgtaacagataaatgtggggatgcttgtgactgtgtttcccgagaagacaaaggtcgttcactcacatcgtgtccagtaaaagtgttggagattaaagggttccaaggaacaaccaaagagatgaacatgataaaacatttcttggaatattttccgtgtttgaaagagctaaaaatgtatatggaagagaatgatcctgcacagctcagagtccctgaagttatcacgggggagatgatggaacgctacaaaaagtcatcaagttgcaatgtccagctcctagtaggtggtaagttgtataagaagtggactccatgatgaagcctctaaagaagaaaagttttggaatttgattttggtttaaattggcttgaaaaactgtttcaaaccaagacaatcggaaagccgtgggtaaaggggattctcccattaagaaatgggtaaaggggatagggatagggattcttgcttttgtccctaatcttgatatcgatgacaatacttttctgcatccggaaatgggtaaaggggatagggaagatattcgagagctcttcatggattttgttgatagagtattggcattgcagggtgattctcccattaagaaagtctccatcaactgtgtcggtgttgattcagttagagtggatgcttggatacgtaatgtgatgttacgtggtgtttcagagcttgttcttttaatcgttttggatgtccagtcgattggtaagaagttttgggtgcctccaaaatgtttcgagagcaagaaactagttaagctagagataggttatggagttgatattggttggttagatggaagctttttcttactgatgcttaaaactcttgttcttaggttagttcagttatctgctgataagtttaagattcttcttcatgatttgcctgcgcttgaggaattagccatgggttatgtaacctggagtgaagatgatgctgttgtgtcagatgcaagtctaaaagagactaacaataacttccaaccattatgtctgctattcttattattatttagacactttttcggttgatacgccgagtctcacttacttctcttactctgacttgttgctaaagactaccctgtaattaagatggaaaactaatacacttctcttacttcacttacttcggaatttgatttttgtgtaattggtgtatatatatatctataaaccaataaacccctcctaaatattctgaaattcttagttatattaatcaaaataatacctttttttgcaaaatttaaccaattttttaagttttttattttattttccaaaaccgatccaaatccaacacttatcaatagtcttaaagctgtcccggattatacatgtttgacctcgtcacggggctaatgttgtgatgtccaattcatgatctgcgattctttgcgcgatcaaatctttaacgtgaaaaagcttgctctatgtttttaccaaagtcctgcccttcaacgtgaaaaagtttgctttcttctgcagcctaactcaagctgtcccggtttaccgaaattaaaccagtgatttttaagaaccggattaaataaaaccctaattttgttttcttaaaatttggatgtttcggcttctccgatgcctttttcttcataaaatcaaagaaaccagcgataaagcaactcccaaatctctcttttcttgaaatctccaatatttgtttcttggtaagtatcgaagtttactcaattcgctttttaaggtttcgtagttcacaagcttcctttcggatgtattcctagttgcgttgttaacttagcgtttctctcttttagggtttaccagttataattaattgcttccttctacatgctcgaatttttacatgaatctaaagaccaaacctttctctgtttgtagttgaactgtttggtaatatacgaagcttttctagagaaa

SEQ ID NO: 765 - DNA, 3000 bp, Unknown
  misc_feature (1)..( 3000): cDNA_ID_3058851_gDNA_ID_1620318_Annot_ID_153233 3000 nt of promoter + ATG
aacgtagacaaagatgataacccatgatgatgaatatacttacggttatacgaagataactctgtagaatgatcgaattgaaatttcttcgatatcaaaacatgtcacggtttgacaataatacgaagaaaaccaaaccgatcaggaccaagagaatttaaaccaaaccaaatttcttatggtttgagttagcaacgtgtagtaaccaaaccagtcaagcgtgaaacgcttcgtttccttctcttttggtctctgtcaattttgatgtttcgccgagaaaaaaaaaaaacaattattgatgtttcagcttcttctccgatgcatttgcttgccttcgttgaagctctttcacgttggtcgtagtagtgttgttgtagttaagacttaagaagatggatctctctttgacatcaatgactcttgtctttctacatcccgaagagggtaaatgcattgaattctggagaacttcgtcaacagagtatttgctttcctaggtgttgatttagattgcatgaatcgttggatatgaaatattgaaatgtaacgcgcagcagcgttggtgtttcttaaaactctagtagtttactcagtttggttttctagtgttaagtttcaggtgctactttctggttgatgaggtaaatgatgaaatcaattctttgaactctttcttgtgtttgtaggagatggatatatacactaaagagaataatttatagacctcaaagtctctggaatgtttaacgttgtagcaacaagtttcatagttttgatatttaacaagtggactagtgcacactaatgagtctcagtgtttcttcagaagctaaagttttagttacatattttgctcttctttggtcaacttttgctttccttctctgagttctcttctctttaagcaatacttgtaaatttttgcctaaatctgtttaatcccaaatatcaagccgttccggtttatcgaaactaaaccggtgattttatagaacaggaagaaacaaaaccctatacagtattttgtttgcttgctggtagagccatcgaattcaagggactaagtaaatcccaactctctttttcactgaaacccctaaatattaggtcttggataaagcttttgtaacaaggtaggtttcgaggttttactgattatttttttgggggttccttagtccataagattcctatttgcgttgtgaactccaagtttccctctatgcaaagttcataagattcctgttttaccaatttaacgtgtttcatttgcacttgcttggattttacatgaattgaaactttaaaactaattgaatttttgtcgcccgcggttgttggcggaccggaccaccgcagagtgaacagaagcaaggtccgtcgcgaagtgcccgtttggtcgcgggctcgcctgtctgccacccctattcatctctattacttttatatttagactttacagaatcaattattttggaatttctttatatttccatattttttcttataattttgtagactataaattaattaatattaattactactaattcaagttttcgaaaaatagactacttttttatcagaataatcagaagaaatttaaattaatattttgagaagattttgtttccatataaatgtatataattatatttaaaataagtaatttaacaaaaacatgtagagtatatgtaagaaataaccattgacttgaaaagaatacacaaaataaccttggaccaaatagtatttgtcggctacagaaattttggtaatatttagtctattttagcctttctctttcttattccttcttttgttttttttccatgttctttacgagactttagtcatagagttctctttctctcttcatttttaacacaattcatcttcttcagattcaccatgtcattttctttttctatttctctcttcctctcctaaaataatcttcaccacctttcataaaatatatcatcatatctttttattttgttcacccacatgttctctctttctttttccatagaaatctctctatctctcattctttattttattttttacctgaattctccgtcaatgtcgttgtgatataagagattagatttgattttaaaacaaatgtctgattttaaaatgcatgtattttaagaacaaaacatgttattaacactgatatattaatatttgtcatgctatcccacaaaaactcatgaaataaataaatatttgtcatgttatccaataaaaacccatgtaatattgtaacaattctatatgtttttttaaacttcgcgatcgataagagaattgtatgctttttataaatattttgtgctatttcagaaaaacacattatttcagagaaacatatatatcgttttgtatgtattttaaagaattgcatgcttttttgtaaatatatcatgttattttagacaaatatataaaaactttataactacaaccaccgatatttttgtaaaaacaagaaaatctaaagatattttagtattttatccaccatagaaaatgttatttacctaagtttcctgacacaaggctattgtctcaattcttttcaattccatggttactctctaatattacctttagaatggttttccctacccttaaccttaaaacctttctttcaagcctatgtactatttgtgagtgaggcctcttgtatgaaaatgctatagattttgaaatcttcaaagtattgagaacgacaaggttttagctcttgtttttagctagcttttggaacatctttggactagctactaggttgggaatgaaagatttaagtggttagattgaatacttgggattgggtttgaaaaaaaaaaaaaaaaaaaaaaaaaaaacctctttttctcttagtttttgttgctttgcattcatattttggcatatagtattgcatttgcatttgcatttgttttttttaggtacatgagtggagtttaaagttttggaagtaaa

SEQ ID NO: 766 - DNA, 2025 bp, Unknown
  misc_feature (1)..( 2025): cDNA_ID_2125758_gDNA_ID_1620319_Annot_ID_153255 3000 nt of promoter + ATG
gatctttctttttccgaggtccttgcttccaaggcagcagatctactggacttccataaggatcttcaaagtcttgaatcaactttagaggtttgcctttgtacttactttttccgtccttagcgcagtaagtggctcatcatttgattgtcctgtctattgcagataaatttgaagtctctggctgaggaaatacatgctataaccaaaggattggaaaaactgaagcaggagctcaccgcatccgaaactgatggtcctgtttctcaagttttccgtaaagtatgttgttgtttttctatctatctcgatcttttgcatatcttttatcaaccgtgaatttgagattaggtccatgactgtgccacataacgtaattttccatcacttttgtaaaatctagtttttatgtttttcaacagttattgaaggacttcatatccagtgctgagactcaagtagcaactgtatcgactctttactcctcggcggtaatttttgtcaacctctactagactccaagcgcctaacctttggcaatgtgtttgatcctgagattactttttttttttgaataaatcttatgatggacgacagagaataaatgctgatgcacttgcacactattttggcgaggatcctaaccattatccatttgaaaaaggtatacaatgaacatcatcctcatttgtgctaatacattagaagaaagtggctcattgttatgttgttgctaataagaatacatgtggtgatcgattgcctgcagttagcgcgacactcttgagttttataaggttgtttaagaaagcacaccaagagaatgtcaagcaagaggacttggagaagaagaaagctgcaacggaagatgtatttggtgggcctgaccacaacatagactcagatacttctttagatgattcggaggccaaatcgccttctagaataagacctccgccttctataccaagacccccttcacgtccaaggtatgcatgctgccgaatacctgcagttaatccgcctcctcgcttggtgtgtggcccatatccgctacctcgcttagtgcgtgtaggatccccatcaccaccacctccctcgatgagtggaggagctccaccgccaccacctccacctccaatgcttgttgccagtagaacagctccacctcctcacttgagtcatgtacgttcaatccctttccaaactcgcttggtgatgggcacatctccgctacctcttttagtgcgcgaaggagccccaccaccaacacttccctcgatgagtggaggagctccaccgccaccacctccacttccaatgttaaggtaccagtagaacagctcctcttcctcacttcagtcatgtacgttcaatccctcccattcctcctcccccaccaagtcgtagagctcctccaccccatccttttggtaaaacaattcacctcttccatcgagtcacaaagggaaaccaaaatagattgccaaagagacatataaaaacttgtgtggtcgtacacctgcatatatatattttcttgatcatcttcctccgcaaagagacatactccttcatctgattcttccattcattttcacaactttgtgatagctactggatttcataaaggccttcttccaagactgaaccggttcgaccggatggtttgtattataaaattgattcttatcttctaataaatgaggactagtttgctggaattacagcaaactatattttattcaaaaaaaaaaggacaatctccaatactccgtcgtgcttttaaaaaattgacaatgtcttgtcgtctgttcaagacacatggaatttgggacaaagtcctttgcccaaagtcaactaatctttaacaagtctatgcgatttgatcattctcttttattttctgggactttttgctctgaaaactagtgttatttgatctaaatcggtgaagaaagtgatctgaaacaatctgtttgttgttaaatctactaaatcccctgtttggttcctgatccaatg

SEQ ID NO: 767 - DNA, 3000 bp, Unknown
  misc_feature (1)..( 3000): cDNA_ID_2125772_gDNA_ID_1620319_Annot_ID_153259 3000 nt of promoter + ATG
aacctaaaagcttaatatattaatatacacagtattattatatggactactattgagttttttaagtttgaattttgtttgttaccatcataaattttcaatcttcagtttaattttaataaatgaaatgaaataattcaattattttccttttatgttgtatcaaaagaaatactagatcttaaacatgttttgactaattaatatggtcacttagaataaattgcaaaatcatatggctctgtattaataaagtccaaaactgaaaatattagaagaaaaaattgtcaaaagattctctccttccctctctttcgttcaattaaagatttgttgacctcatttgtttttcttctaatcaaatctaactttctcctttttcttctcaaattctctaatcacactcttcatcctcttctggacaaaactatttagtattttgttcttcagcttcagttctctaagagttttttttttttttttgggaaaataattattgaagagttgggtgatctaaaggtaacaacatctttctatttgtatctcacattttcatcacagttgacttcattgtaatttcttagaactatcttactataacttttttttgttaaaggatcaactatgttactataactctagtcttgatcaaaacttgagatcataaaccaaatctgtttttctttttgtggtaattatgttattgaattcagtcatgatcaaacttggattttttggttgttgttggttgttgatgtaattgcttatttattgacgttggaaccaaagattcaattttgtacttttcattctcaaaatctgagaaaaacagtttaggatcattatgtgtgttgtttaaatgatttaagctcccaaaatttgtgattttgatgatcagtacattatgttctctgtagttgttgtaataagttgcaatgtctgaggagaatatttcacaagttgatgacaagtgttgtttggatgatgcaaacccaatggagatatctgtggaaactatccctgtagtggatgaggaagttcaaggagatgatgatgttcttcatccagctgcagagaccaatcatgcgagtttgaagcggtattcaacacgagttttagataaaaagacaggcaaagctcaggttcaaacccgttaccgtgggaaccaaacgagttctactcatgatctatgtaaacatgggaagaggcgtgaggaagatttggtgatcaaaccatggaaggtggctaagaaaaagaatgttgacagtggagatttggggaagggtgagactttgaggaagtccttggggaatgtttctaaaccggacaagtcatcattgcaggctgcaaagagagaagctgctggtgaggttgtcaaatcttgtgatggtttacacgttaagaagagtgaaaccaagagtactagtccgagtgtttcacctgttgtgagaacggtcaagaagactaatcttgttgtaaataaggcttcaaggatcagccagaacaaaagtcctaaagaggatctttcgaagaatttgaagaacaaagagaaggggaagattgttgaaccggttagatgtgatgatgtattagagaagacagatcttgaagttaagaaggtttcaaggatcagtgagaacaagagttctaaagaggatactctgaagaacaaagagaaggcgaagatcgatgagccagttagatgtgatgatgtattggagaaaacgagtcttgatgctcagaaggtttcaaggatcagcgagaacaagaattctaaagaggaacgtttaaagaatctgaagaacaaagagaagacgaacattgatgaaccggttagacctgatgatgcggtggagaagacattgtatgttgttgaatctagtgttgagaagaagaagaagaagatgagcaccaaaagtgttaagatcagtgagactcagcaatcttctgagaagaaaatcataagaagcaccggcaagaaaagtcttagcttattaccatctttgcctccaccctcagaggtggttacagggtcagatcctaggccaataagacagactacttccaggtccaagactagtttgcctgagaagaaacagagtggttctgctaatcttgttactaatccgaaacccgaaagcaagattagaccgaaaaggattggtttaaaggttactccacctcctcctccaacaaagcagcaaatgaatttcaagaaagggaaagttcttgaaccaaaaccagaagattccactacaacatcgatcaaattcaagaagatagttgttcaagaaccaaaactcagaacaagtgatgtgaacaaaaagaagaagagcctgaaagataaaagagaaggtgttgggaagattaacggtgaaggtaaacgagagaaagttgttctgagacacagaaaagtggaagtgaagaagaaattgcagacacttttcaataatgtgattgaagagactgtgaataagcttgaagaagtgaggaaaagtaaagttaaagcattggttggtgcttttgaaactgttatctctcttcaagataacaacagaacatctcagaagaagaagattcagagcaaatccacatcttcacaagtcgttgaaggctgctaagtccttgagaaagagatcaaagttgtgaattggtttaaaggaaaaatggtttgtttttggttcatgaatctttataatgtaaaattttcaaagaaatcatattttcttttctacgatgctgagtttatagagaggtcttgaagattgtagatgacttgagttcaagatttgtttctcgaaatagtactctgttataaaattggaaatccggtttgattggttttttggtaccgaaccggattttaattttaattcacacgtgtgtagttgacacgtgtggtttcttcgcacccgctcttcacttgttcatgctcttgcgtttcaaaattcaaaatgtcttctcttcacttcttcacacaactctcagattcaatcaatg

SEQ ID NO: 768 - DNA, 3000 bp, Unknown
  misc_feature (1)..( 3000): cDNA_ID_2125786_gDNA_ID_1620319_Annot_ID_153263 3000 nt of promoter + ATG
atggttgattgatcttgaagttttatctgactttttccgccaatctttctctttcggtcgggtttcgggacagcgcgctgctttggcatcgtttaatgggaaaaggggttcttgcggtgcagacagatggaccgccacagctacgggtttacgcacattgttcaaaaggaagagtgagttgctcatatcatcttttatatcgcagtttccaaacgtctttttcggttagagtttgctttaaatgctttggttttttcttggttttaggccggtgtgacattgctactgataaatctaagcaatcaatcggattttacggttagtgtcagcaatggcataaacgtggttttgaatgcggaatcaaggaagaagaagtcattgttggatactttaaaaagaccattttcttggattggaagcaaagcttctgatggatatttgaatagagaagagtatcatctgacaccagaaaacggtgtgttgcgcagcaaaacaatggtcttgaatggtaaatcgttaaaaccgacggcaacaggagatatcccgagccttgaaccggtcctccgtagtgtgaactctccgcttaatgtcttgccattgtcgatgtcgttcattgtgttacctaattttgatgcttctgcttgttcatgatgttaatggggtctctctttgcttattgggaaaaaataaataaaaataaagaatagttgtaatttttttggtaattgtatctaatgctggtgataaatgtatcatttcatatttcaatacaacatgattacaaacctttggttttgtgtctcttcgacttatgagccattgcaagaaagataacaaaagacaagaatcaattcgcagaactgcaagaagtgtctccacaagataaagaagtatcttcactgagtttcttcctctcttcataagcccattccaagccgtgacagtactgaaccggcgggttgaacctactgtcggttatatcatcaggtaagaaagcaccgttccccacaagaaacttgacagcttctcttttccgttctttagctgcagcatggagaggagtccagccacaagcaccagaggttctagcttccatgttggctccacgttcaagaagcaagtccataacttcgatgtgacctcctttggcagcaaggtgaagaggagtcattccttttgatttaggtccacaagctagagcgttcacgtctgctccttggtcaaggagctctttaacagctttgagatcgccttcacgagctttgatgtgaagctgagtccaccccctgtcatctctgtcaacacccgtttccatggaccggcgcctaaatgagttaggccgaaaggacaacgcaaccggctgctcttggagcatcttgcagataaaccagaactgactagaattcacagatgaaagactcaaaggatatttcctaagggaaacttactagacaaggagattctaggagtgactcagatttacataattttggttacaatcttatacaagaatgtctaaagcaggaacactacttgtgggtagaaatcatcaaccaatatcactcagaataagaacttatgggagaggcagattgagatgattcagttggaatggagcaactcaatcaagggaagtgattagcaatgcagtaagggaaagagggattcaaaccagggccaaagacacggagattttgagggatcacaactggagtcatagacagtgaagagaacacgagcatcaactagaaagaggtaggagcttaatggtttctaggaacaaagagaaatcagaaaaagcctggatcaatgggtaaagagagcatcgggccagagtctctatctgcgtgatttttaccagccagatctgccaacaagacaaggatggaaaaaaaaacttagtggattcagataatacaaataagcaaagtgttcattcaaaaaaaaaaaaaaaagcgaagtgctacagaacaagccataaatctctctgcaaagatcgccagaaatattttcagagatcaaaattttaggttaggtaacgaacaataaaaactttagtaacaagtcccaatctttagaatcgaaaactctggcaaatgaacagtatactaagagaattcccaaaataagctgaaattcagaaccacccaaaattcatctaaaaaattctaaagcagcaaagaaactaagataataaaagcttagtgatgaatccaaacaacataaagaccaaatcaatttcacagtaagacgacgacaacgtaatagaattgaatcggggaaagatagaaacctgtaggcgtcgtagcttagcgcggagggagaagaaagagatatggtgaatcaaacacagatttatccttgacggaggatatgaatcaattagtgttttttcgcgggtagagagtgagaatcgtatatcgatttccagatgaagaagaagaagaagaagaagaaaggcgcgtgagtgtgtgtcagagacaaatatcgtttttttttgtttgttactatacttgatccactttaaaatcgaatttgccacctcatattagcttaattaatcaaggcttcttactgttgggcctacaataaaaggcctgaatttggcccagatagattaaaccatatctaatatctttatcaactaatttaatttcaaaaagattttattctattttatcgtacatagtttgcataatatggttagatttcaaattttatatggaagtaactaattttggcagataattggattcataagaatagaataaaatctctatatatttatctatactattaaaagacatcctagaaaatagtataatacaatgtatttcacccattatgcacatcattttgcaatattaccttaaacaaaggctaaaaattacaacaacccccaaaatgataaaacttatataagaatctcatgattgatgctgtaggagaagaagaaaaacaaagaaacagaaccaaagtagagacactcttgttctttat

SEQ ID NO: 769 - DNA, 3000 bp, Unknown
  misc_feature (1)..( 3000): cDNA_ID_2125794_gDNA_ID_1620319_Annot_ID_153265 3000 nt of promoter + ATG
ataatatcaagctctttcttgagcttatacaacaaccatacaagaagtcatctcctcccaaaacacaccctccattcaactactctctgaaccatttgtcccttttgtctcctgatatgttctaacactaagaccagatccaaaacgacacagttctacttttggcaagaatcacgtgacgtccttgtgattgggcttcagaatttgcttgcttcttcttcaaaccctctgtgggaatagtgtttagtgaagttagtagaaacatgcatgtgttatttgattaaagattaatacaaactcctaagactaatgttattcaattagaataaagatcatatatatgatgacatcattgatgatgaccagcatatcaaattgtgcaggaacatacatatagatatgatgacatcattgatgatgatagctatctataatcatattatatgaatatattatttggattgtttatgtaagcgagtataaaccaaagtaacaagataaaagggaagcaaagggaccattgaaagaaacaaaagagtcatattatacacattttttctctttttttttttcttcttgagaaaaatggattcctctccatcagaagtaaagattatctcaaaatgcttcgtcaaacccaaaaccatacctgaaaaatggaaagagccataccatttttcaccaatggatcatgtaatactctcaatccattacatccaaaagggtcttctctttctcaaaccatcgttttctgaatctgtcacaccaaaagagttcatggagactttgctgcagaagcttaaagactctctagccatagcacttgtccatttctatccgcttgcaggtcgcatctcgactttgaaaaccaacgactcaagatctcactcggtgtttgtggattgtaataacagtcctgctggatttatccatgctgaatcagatctaagtgtatcagacattcttggttccaaatatgttcctttggttgttcaatctttctttgaccatcacaaagcattgagtcgtgatggtgacaccatgactctcttatcagtcaaggtacatttcttcattcttgctatatcatattattcaaatatgtcagcagatttgtagtaataaaagttaaattgcttttactaatgatttattgtagtagtgttttactgtgtcatagtgaaaaaaagatgctgaatctttttctggttatacaatgtaacaggtaacagaattggtagatggagtgttcataggattgtctatgaatcattcgcttggagatggaagttccttctggcacttcttcaactctttgtccgagattttcaattctcaagaagataacaacaagtttctctgtctgaagaatcctccaatctttcgtgaagtgtccggtcctatgtacagccttcccttcagtgaacctgatgagtccattagtcaatcagaacgtccggttttgaaggagagaatgttccatttctcatcagaaacagtgagatcactaaaatcaaaggcgaatgaagaatgcggaacaacaaagatatcttctttgcagtcgctgactgcattgatatggagaagcattacaagagcaagaaaactaccaaatgatcaagaaactacttgcaggcttgctgctggcaatagatcaagaatgaatccaccattgccgatgaatcactttggaaattacatctctcttgtgatagctactactacaactggtgatctattggagaatgagtttggatgtgctgctttgaaactgcatcaagctgtaaccgaacacactggcgaaaagatctctgccgacatggaccgttggttgaaggctcatttgaaactagatggatttttcagtccaaatattgttcacatgggaagctctccgaggtttaacaagtacggaagcgagtttgggatggggaaagcagtggcggttagaagcggttatggtggtaagtatgacgggaaggtatcagcttatccagggagagaaggaggagcaagcatagatttggaagtatgtctacctccagagtgtatggaagctttggaattagatcaagagtttatgtctcttgtctcttcttcttcttcttcttgatctaatattcttattcatatgtgctcccatcatatctctatctaaactggatttgttagattggagtattttgtgttgctgttaaaactcaatcaatattatgtgacaatgtgttattcaactgataatgattcatgtttatgaaaatattaatacaaactagtatgtgaggtttagagacgataatgttgaaatctttggggatttattctcactcactctcttgatacaacactttattttataacaacttaaaaatgaaacttgaaaacagaaccataaaacagagtaatcgcagagaagttaattagcaagatcgagagttagtaaagctctttcttgagcttatacaacaacaatacaagacttcatctgctcacaaacacagcctcaattcaactcctctctgaaccttttgtcccctttgtttcctaacatgttctagcactagaaaccatatccaaaacgacacggtttactttaaccaagaatcacgtgacgtccttgtgcttatcacatatgagataggcttgggcttcagaatttgcttgcttcttcttctaaccctctgtgtggaaacagtgtttagtgaacttagttgaaatcatgcatctgttatttgatattgatataaattaaactaagattaatgctattcaatatgacatcattgatgatgaccagcagatcaaattatgcaggaacatacatgttcatgtgatgacatcattaatgatgatagctatctataatcatatgaatattttatttggattgttctataaaagagagaataaacgaaagtaagaagataaaagaagaccaaagaaacattgaaagacacaaaagagtcatattatacacattttttttcttcttggaaaaaa

SEQ ID NO: 770 - DNA, 3000 bp, Unknown
  misc_feature (1)..( 3000): cDNA_ID_2125806_gDNA_ID_1620319_Annot_ID_153269 3000 nt of promoter + ATG
aataaattaaatcacaccttgtttaaatactaacatatactgtataatctagtggttatgaatttaaaatgaaggaattatatacgcacgtgtatcggttcggtatattgcgaagcatgacggttgtgatgtgatcaccgttggattcaacttccggcttgatacttgtcctccatgtcaccttctcacatagttcgtaacttctccggccaaaaactcttctactactagtcggtggaagagtcatctcttggctagggtttggagagtaacgttgaggaagttcttgtgtagactcatatacattagggttagggttaatataccaaagaggataatacacccatattgatggaggaggagggagatatatgtcggagatgaaataaatctgtggtggcgccgagaagtagtaagtacgaggagaaggattgtgaggaaagaaaaaatgtgtcggtgggtttcgagcttgtctagctaagacggagacgtggttgttctccggagctggatcatcggaagaagccattggaggtgttctagttatggagagcagaaatgattttgtgtttggttcattatatatattatcttctaataacaaacagatttgatatcttagtctagaagatccgaagactagtgtctactctctcaggttcataatttcgttttgtcagtaacttgttaaccgtccgatttggtgttttttttctctcttcttatttctaacctcgagatccgtgaggctcagtaccttatgatgatcaagctaagcttatgatgatcaagctaagcatcggtgatatgactatttttttctttatttttggttttaaaagtgactatatttttaggtgttgaaatggaacacactgattctgtacaaatttaccaaatctaaatgtgtacttagatttgccaaatcttttgtgatatagctgtacttgaagtgtccgttttcaaagggacatttatagtttagacttggatcatatgacatattgttgtaataattaagaaacggtagttataagatataattaagaagatttgttctatacgtatttagtagcaatcaaaagtttagtcgaaactgaagatgttcatatcataaacaattacttaagattcccatacatattatgtagttctcatatttgttatctactaaaggtatgatctaaaaaagcagattggtaacaccgtaccaagtgatacaaggtaaattaccaatatcatcaaaaaacacatgtttaggtgttgtatttttgaacttaactgcagtggagtagatcgatcgggtcgagtaccacagatttagtccaaggatcgagcatatataggagaatatatagtgacatatacttcaaagagtaaagtcccatgctgcaaaaggatttcttgctagtaatgccgtatggtcgatggggagtacttggataagatttatagtcaacatttacatattaagttaagaatttgatcaatatgtatctgcaggttgctcgtaaagaatattagtatataaaatattaatatttttgcgtagatatatatcatttttaaaaaaaatttcttaacattaaatgcagtggtagagagaatcatgtcttacacatcaacacttttttttgttacttaaatcaacatcacaatcgcatttccttttttttttgccaaatgtattttagacaaaagcatacaatcaaaaacatttggatgtcaaaaaccagatttggacattttccctttagtgtattgaattaataaatcccaaaagaataattctatatgttttcttctgttttgattgggtcaatgtcacatagtacaagtaatttaggaaccgtgtcatgaaagtaatgggcctgggccctttgccgacaaaaaatgtatgggcacgtggcaactaggaactgtgagattcatatatcctacgtggccaagccgtgtaaaacggatacgatagattaaccctctttttcgcccagaatctttctcctttcacaaatcatattgtatatagtccgatcgaattaatcaaacgaaagattttaattattataagaaaactgaaagagagagcatctctgctttttcaaaatcaaaatttttggatttgggaattttcgttggagtaaaaaagcttcgtgcttggtgcatcatcgattgtgggtttctcttcttctttcgcttttcgggtcgctttctagatctctcttaggcttctgatttgatcatctcttctacttctccctctcgcttcttcaggttagtttttttatttatttgttggtgtaatttacattggatcttcgtggacagagagaaagctgcagtttttgcccctttttttttaataggagatttttggaactttgtgatctgagtttatttttcactagagctcgagttttttttttttttttgtttattaaagtcgaagcttaaaggttttgttttgcctcttatagtattgttggaaatgagcagagtaagttttcatcaatatgtatcaaacttaggaacttgagagcaaggtttcattttgattttaagaatgtgttgtccaagcatgattacgattgtttgattgaagtctgaatccgaggaagaaaatgaccaaacaattaattttcttgtagtaaatttgtttttgtttacattgttcagggcctttgtaatttgggctgcagtgtttcttatgaaaacgattgtttctatcgtgttatgcggttggatgacatgtttttttttcttactgtcagggaagaagagtttgtttttctttagttgaattgtgtttgttgtcctctgcgatatcgctttttctgagcataaactggtttgatggatgatgatgatatggagtttgaggaagaatttttgatgatctgtgtgtggacctgaccaatacaataatctttttggggcttcttattggctcggatttcagggattttcacacttgtagtagagttgcaacatagacaaatg

SEQ ID NO: 771 - DNA, 3000 bp, Unknown
  misc_feature (1)..( 3000): cDNA_ID_1013016_gDNA_ID_1620319_Annot_ID_153274 3000 nt of promoter + ATG
gatttcatatccattactattttaacctttctgtattctttacagtgaggccgaggttgattgggccagagcaactaatcgatttgctgaaaaagtgagtttcctcattacacattttcttgcagggtctctttgtacaatgttgttgaatacgctgatggctttatgttctcacaggtggaatttgcgactttacttgaggatggcccaccaatcagatcaaagagaaggcttatatatacaacacaactcatgcaacaactgtttcgtccccttcctggtagggtgaaatctttagttactagctatgagtttgtggcatattctgctgctagagctgcgctaggagatgcatgtagctccacttctactgacaggattgagggctttttgcttcagaacaatttaaacccgtaaggatatcttctgtttatccctgaaatactgggaaatgtctagacttcgaggtttcgtattgactcgaatggatccactcttgtgtaggttgtctgagagaacggaaactgaaaaaatgagtgaccaatacatctccaaagcagctgaagatttcattagtagaacaaagaaactagagactgactttgcagggtaaaaactgtagatctctcttcttgtatttgattccagtttgaaatggtttcacagttgggctagtttgatctcatgaaaatctggttcttcttgcagactagaaaaaggaactacaattacagacttgagagtcgaagtccaggatctagagaggtttgcagtgatcaatcgttttgcaagtttccaccaatcgtcctcatctatggaccggtccgtgagttcacttaggttaaacccacagagatatgttaccgtagctccagtgcctcggcatattccagatagggtacaatgtctctctttctaactattgatagatccatataattaactttttggccaatcctcccgaaaatgtttgtgtttatgggtgggtaagagttagttggtcggacttctgagaacagtgaaggcctccatcgtcagaaggccggagatttcgtagtagacatgtagcattactgtatgcttaatcacgaatattggatgtcaaatccatttgtatacttagtaaagaatttgccccataacagaaattccacaaggtaacaactccagtgaatctaattttgtttttactcagcgaagattctgaagaactctctctatcaagtcgttgagtgctgtttagaatcagtcattgaaacttaacttcctttgcttcagagtattacaaggtctctaatttaatgagtgtcaatattttacctccggaagccaagtcgacatcattattccatatgtattattccgcaaagaagatttaaatatttgataaggaagttaaaaacataagccaacatgaaatctcttgttcttgattagtttcatataaaagattgaaacaagaaactagagacattcgaactagtgacaatgattgaggagtttgtttggtttgaggagtgtttttgatgttagtccgcgtaacagtgttgtaagaagcagggtccaaaaatcagggagatcaaaagagaaaaagtcggatttcacattttttgcatctggactgaaaagtctttgaactccacaaatgagcaagagctcaaggttctagtttgctactcaaggattagagagtcgaaaacacaaagacaaaccactagcaatctctggtgcggaaacaagagccatacaaggtttatcaaaaaaaagcatactactcttaagacatgaggattatttctttgtcgcgggtctgttaggccctaagtagtttgtaaccaatcccattatagcaaacctgtttttaatacaagaaaaccagattcagagtcaacaatttattgagtagaaacaatcagcttaaatctgatccatgttggattttaacaggaatagagaggttcatttcactattcaatgcttttggcactcttaacttaaaaataagaagaaagaatgagtgaaaaggaacatacatcatagccatggagatctgctttaaatcattttccaagttcctcatgttggccagagattgtgcacagaatataattgcaagccacgagcatatcttgtactgagagatacacaagccacataaataaagaggatgaatttctcactccacatatgatgatcttttaatccactttcacactgactatctcaatctctcgagctcaaatttcaacaagatctaacattttctctagtcttataatatgatgcaatcacacagtcatgaatctgcctatttggggaagtaagctttaaatcaattcaacattcaaaatcactagcgagtattggaaagatccagtctcaaaacatcacgaactagctagagattgatgttgctaaatcggtgagttcaacttataaaatccgacgatctaagtcaccaaccggagtactagtttctacgactgaattgatttctaacagagcaacgatcagaagaggagaaatgaaaatttaccctgaacataacgccggagacgccgaggataacggcgatgaatccggagtagtcaacgggaagatcctccggcgctacaggccgtggaatgtaaggctttgccgccgaaggctgccgtggatcgttcaccgacgaagcgttcccgtgactgtgagacatcctcaatctctctctttggatctctctgaagctccgattggtaaatatatatctgatctactgtaattcttcttagagattctattgatctattatatagacataattgctaattacaattaaaattaatttaaacaagttcagaagtttatgaaaattacaattgtaaccttttcgtatttcttcataaagccctaagctgggtggaaatagaaaacaaactatcgccggccgttcaattcccggcgacgtaacagagtttaggagtgtgactcaagctcaaaaaactcgttttgtattcgatg

SEQ ID NO: 772 - DNA, 3000 bp, Unknown
  misc_feature (1)..( 3000): cDNA_ID_2731167_gDNA_ID_1620319_Annot_ID_153277 3000 nt of promoter + ATG
ttgttttgttttccataacgaaaagagggcccccaaaaaggtactcaaggagctgacaaaaacaataaatatgcatatatatattaatgtaattaaattgtcttaagaaaatatcaaaatagcaaggataatatatatgaattgcaggcttgcagcttcgtgtaagcaggaggctcgcagatgagtttgaaagttgagtaataggatggttaggtaaagatgaccaatgatgacagtatactaggagatggaaatatcttcatggactaataaatgtatcatgtgacatgtcaatatattaattcctattacaaattaaaagtatctctaaaaattaaaataatttgcatgtgggaagatgtggaatcaaactaatacgtcagagaaaaacaagaagaatgacttgccatatttgtcgaggtaccgtaagtaaatgggttaaaccagaacaagaaggtaaagtttggttttctttttcggttcggtttcaggttttaggcaaatcacataaattttagttttatagaaactcaaacctctggatttactgctatagacaacgactatcaatattgaacaacacggaaacaacgtcattcaatgattcaagaattcgtaattctcaaaactctgcagttcatttcaattaacttgattacgtacaaaggggaagacaaaatatcaggttaaagaaagctaccacaaaagtcaaaacacaaactaatgaggctcaagatttaccacaaagatgtcaattgtttgagcaaaactacctaccaaggagccaaaaaatgtacgtcgagatagcctttttttaggaccgacagttaccagttggttcatatgaaatttcttttagcataatcgaatatttacgaagatttttaataatatcagacgagttctttctcatatcatggagacttatatacgaagcttgatcgtcatcatcatccacgaaacgtctaagctatcatataaaccctatgtaataaccacgaaaccctatgatcctgaaccttattctcatttgacaattgaaaattgttgtttctcgatgccttttgtagacctcgaacatggttatatgtagaagaataaaacaagcactattaacaaccaattgtcggttaaactaaagttccaaatctatatcatggaaatcgaaccaagcaaatcttgtaaaaatacttttcgctcaaaataaataaacatagtgctaagatatcaaaatgtgactgtcggatacttttgcatgtaaataaatttcaccttcttatagaaaatatacaaaacgttcataaaaaaactgttgcaactaatgtcatgactcgtcactcatgaacaaacgatgttgaaaacaatatgagatatctcattatgcgtaaaccaccaaaagaatacaaagtttaagggaaactctctccatacttgatacttcaaacgctggaagatgaatgagcagccgagcaggaccgttataaacccaagaaacagaaacggttgcaattaggcttataaagcaaaatctttcggatgaaagtaattatattctacttttcagttttttttggatgaaagtagttatattctaatttatattaaaaagtatttatattatactatgataagagagtgttgacctgaaatttacagtttatcagcaacaatattcggtttattagtttccaagaaagacaaatttcccttataacaattcaaaagtatgtgataatgtggcagtaagttataaaagatgccataatcttacttaaagttagtcaaagagtatctataatttgactaggaaagtcttatgaaaagattataaaaatcggatctaccttttttaataatgtaatgaaaagattgtcatgtggaaacacatcaatacgatgctgttttaacatcttaggtggttccctagttaattaaatggtccgtcacttgccccaaaaccaactagtctaaccttctgtctttgaaagagagttctgatctacgacccatctccttcgtacccgagcctgaaatttatcttccggacccgagcctcggatttgctcctgcgtccgccgttgaaaattttcgtactcccttcgatcacttatctctctttctctcttctcctggtttcgttaattatcggattcgaaaaccctaacttattcttagaaattgaggtcggagaagaaagcttgtcaggctttccaattgttgtcgacgcgacagaacaagtgtaagtctgcatacatctctcttactcttagtagaaaccctagttttgtgtaatgtcccaataggaaaatgatgtgtgaattcccaattctttggagcgtgttggtaaaattgaagtaagataggttctcgtttgaggttgaattctaggttatggtaatgttcgtgttagccagagcttcgattttgggtgaaattgtgttgcggcaattttgatctcagagtaggttcacgagatttccgataaagtctagaaattggtcgaaattagcttatttttcagctgccatagagtgtttatagctgtgaaatgcgagagttccactgtttattttttgtataaggatcttgatgatatttactgcaaatgaatactcgagattactggattaggtgcatttgagtttgttatagtttcagaagttgagttggagtttaggctttggcttagtggaccttggatgtcaatgtacggttttcatttaaggaaacaatgctgattcagctttccttatcacctggtcggcgttgtctcgcttcgttggtctgagggttttcctgcgtgaagatttaaactttcttgtcttaaactgaatcagggttgaggatcttgtccgatgattttcatttgactcacttttgtttcctaatttgcagaaaacaacgattgttttagatcaaaggagacacaagattgaaatatttttcgtttcttttcgaggtccagatatttaaaaataatttctagaagctgaatctatg

SEQ ID NO: 773 - DNA, 3000 bp, Unknown
  misc_feature (1)..( 3000): cDNA_ID_2125817_gDNA_ID_1620319_Annot_ID_153273 3000 nt of promoter + ATG
gtatttgtaatataagtatatataacaatgttactattcatcttgatattattaacttgatcatatataaattacctaaatgaattaaacaggactacaatgaacaaagggtatgctttcgtgaacttcacaaatgcaaaagcagtgtccaagtttaaggctgcttgcaacaacaagccgtggtgccatttctactcaaaaaaagaacttgagattacttatgctagaattcaggctagttccactcctttacatatatatatacacatctttgatctgtgtatcttatcttattcaatcttattgtaacacttgtcggggaaaacaacaatacttttgtgtagggcaaagatgagctggtgaaacgtttccagcatatgacatatccggaggaggcctacagtgcggtatgtttcagcccagctcgtagcggagggaaagatacagttcaaaccacaatggtcggtaaatgcaatgaaccagtgtgctcggtttagtctttccatatatgtaattaggattatgaataataaaagtgtatgcgatggtgaacatgggtctaggatggaaaagaaaagactcagacaccgaaccaaatccaagtaaaattctgaaatgtttagttttggatttggtttttgatgtgtgtgagttttgacttttcataattagtgttatgtttaagcgtctactactctacctgtttctctgatctatatataattttctatgttgttgaactgttgtctggcgatgtttatatacaaaaatatagctatggttttctctttttttttttttgttaatgattattctgatattcaaaaatttggttgaaagttcttttttttggtgaaaatcaagtcatacttcattccagttatagagaagacaaaaaaatctttctacaatgaggattgtttttgcaccaattaattttttaaaggaagtaagccacgaactcttagcttagaaggtgatcgcatgaaaaactagctaacaacataaaaaaaaaaaaaaatgagttggccaaatatcgccggtggatattattagactacgttttcttgtcaacggtggatattttagatataagactttttggaacgtaccaaaaagtttctcttattcctttgaactcgcattatgttacaaaatataactagagaatcttgcatagaaaggtttgcggttttgtcactattttgtatgtgtactactgtactgtacattgaactgttgtgatcttttcaatcatgtaaaaacctactatagaccttagcctattctggcgttacctttacacattccagtttttattgagccgaaaccatcattgttagtttgggtgacgatagattctgcagtaccttgacacaaatcttcgtttcttggggaatggagcgacaagtgtgacgtagatgtgcatcgtaggctcctacaaataatgaccaaaaaggcctttttccatcaacaattgcttctttttcttttctctctttttttgccacttttttccccactatggtcatgagtcatgaccggcttcacataaacgatgttgaatcaaatagctttttgggcggggactgagtggaattaaagatgatggattcagttagggttttgaggtagttcttggcccataatatggcccaatatatgaattttgacttttttcgaattatcgttgaagttcatctcttaacaataataagcaacaactttatgagataatgaattattgcaatacaatgatgtagaaacggaccaatacagtgtcgtgtttgacgtttaggtgggtttggttataattgtcttatcactggcccacactacaacaacaactctcgtctaaaaccaaaccctctgacatggaaagagagttttgatctacgagccaattgctttggacccgagcctcgtatttgcctccggacccgaacctctgtttggctcctccgctcgccgttgaaaaatttccgcactgatatcgatcactttatctctctcccttctctctctctttctcttcttctcctggtttcgttaattcttgaattcgaaaaccctaaacaacttgttcctagaaattgagcaagcaaaggaaagctttttttcatcttcaggtttccatttgttgtaaagctaaacgtgacacaagtgtgtaagttcacatctctgtttccctctgtggaaaccctaattcttgctatatatcctaaaaagaaatgatttttttttttacccaattattgtaccgtgtcgataggtagtgttattgtttgaggttgaattctcggttactgtaatgttcatgttattattaaccatagcttcgatttgcagtgagattgtgtttgcggcaattttgatctcaagtgtgttctcgagttttccaatcaaattctgtatttttttcgaaattagcttaattttcagctgccataagagtgtttatagctgtgaaatcggaaattttcagctggtttttgtttaatgaagttgatgctgtttactgaaatgagctctccaagtttacttgattaggtgttaagagtttctgatgttgactggaacttaggcgtcagtgtaccctaagttccaatctaaggaaacaatgcttattctgtttccttgtaccatgtgggctctgcatcaattctctagtgtctcactttgctgccctgtggtttttgtttcctctttgcagaaacaacacttgtattggctttcttctgtctagtgtttttgtttcacttgttgtgttcaactctaaattttgcagtatctgttttgtttgtttagcaggagaacctatgagtattcaaagcatgccaattggaggtagctcatgaattctggggaaagaggtgtttatatgttcccttttttcttacacattcggaatttagatcaacgaaggcgcaatgttgaacttgtttctgtgtttttttcaaaggctcagataattacaaataatttagaggagctgaatct

SEQ ID NO: 774 - DNA, 3000 bp, Unknown
  misc_feature (1)..( 3000): cDNA_ID_2125798_gDNA_ID_1620319_Annot_ID_153266 3000 nt of promoter + ATG
tttttctattgacattttgttctggacattcctctggttgtttcttctccaaagcttaatcgtgattcgggatagccttgcagataacgttgttgaagagcttcctgcatcactctgcaatctgattcagttaaagtcgctttccttagacaataatcaagtgaaccaggtaaacagattgaaatgtgtttttttttgtttttgggtttattgaatcactatcttcttcctttgaaatctgtaacacttgttgttttccagattccagatggattgctgatacattgcaagagtctgcaaaacctttctttgcataacaatcctatttccatggatcagtttcagctggtaattcaataatccataacctcgaaagaacactttttaaagttgtttgtttgaattgggttttgtgtaacatacatttatataaaaatggatagatggaaggataccaagactttgaagagaggagaaagaagaaatttgataagcaaatcgattcgaatgtgatgatgggctctaaagcacttgatgtaggcgttgataaatgaaaactgtcttcacatctccttactttgtaagttcatttagactagtgcagatagatttggtattagtctctatgtattattcctcactgatgataaaatattcgttttttgcaggtcggttcggtgaatgaggatcatcgtttcgtgtaagaaatattgttgtaaaactctctctctctctttctctcgtctgcaagatttagaatctctgttactgtcacaccaattcttatgaacacatacatatgtacgtttgtatactctatcaaggcgtgtctgtatatgtatatgtgcgtgtgtgtatacaaatcatataggcagaccgattcttggctttggcccttatattgagatgacgattctacttctacatgcaagtcttcaattgttctgtctttaaaacacacgttgggcttgctaatcagctttcctttcactaccaaaattggattacacactagactcttttcacaaagattcatgtctctcagcatctgacatttgataatgaaaacagtcaaaaacaaaagctcagagtttggtgcatcctagatacagattcatcaactcaggcaactcctcttcgtacttgatcacgagcttctccaagaacactttctccactggaaccaacaaagacgtcaagctccaatcctctttcacaagcccgttcgataccaaaaccttagtaaccgaacacctcgggataatcctcttctcaaggctgaagaagagcaccactggacactgtgcgatcgatctaggcgccatattcatctcattcacaaaatattccatcgttctgttaatcttcctctcagacaacatcatacaatgagggtgcttcttgaacgcacacatgatatcatcttccgaccatccccatctctgataaacctcaaaacatttgtcccatatcgatttgtttcctttcccagagagagcatgaatggccaacacaaatgttgatttttgaggattgaaccccatctcttgagcttgcttagcaattgcttggaactcatggttcttctgcatcacagcttcaggaaaatgcgtgagaagcagcttgatacatttctcaggaacaccagtctccgccatatagttgatgtttgggacaaggttcttagtgtgatcctcaaggaaaacccaagtcgtcctccgcaacgccgccacaatcttctcatcggaatcaagaacgcttttaaggaaattgtaagaagggataagctgattaacaagggatctagtcaaaatggttggatcagaagctaaagttcgagcaagtaaagattttgagacaccaattgagagaaagaagctgagtttcgggaggaggacagattcagcattggctaataagagaacaggacgtttcttgacgagagatgagatttgagctgtggtgaatccatggtcacgaagaaggttgagaactgtgttgggtcgttctggtgaatctagtaagagcttacgagaggctacggtggcggaatctggagatagtccacatgagtcgataaggtagttgagggtgaaggagagtttttgctgttgctcatcatctttagggtttttggaggtgagtgtggttactggagaagaaaattgagtctggagagagaatacgaagattggtttccgatgatgcttaggtagtatggtggtgaagcttcctcgtgggattaatttcgtgaggaagacgaggttcgtaagagaagtggcttgaggtattgcgaccgccattactagagagggattgcttactaaaaatctctcactctcacagtacataaaccaaatccgaaataataactagtttgacccgaaccgacccgaccggaattgaccgggttttgttttttaaacaaagcagagagtcatttttacttatctgggctggcatcgcttcgaagaaaccgagagacattttttttttttggaggatcatcaaattcaaacatcatttctccggcaaattcgccgtcggaattatctcagagagggattgagctgcgaaggtaaacgtttcctgggcttgtattcgtgtgtacgctcatcaattttattctcgtgttcgctttttcttttgtggttgcaatttttatccttcgttgttgaaattggctatctagtggtgtgtgtagtactgttttccccaattacttcaaaggaatcgagtagaagcatcaaggctttcatctaattttatgaataattggacctgtgaagttgacgtcttctctagttcttcatttagttgttgtaagtgtttttatagcctaatttgatttccgtggaaagataaactgaaagaaaaatctgatttgatttagggaatgaaaacttggattcgtttgaagttagttgtagaaagtgtttctataggttattggtgctaatgattcattgcctttgcagtggtgatttttgtctctaaatg

SEQ ID NO: 775 - DNA, 3000 bp, Unknown
  misc_feature (1)..( 3000): cDNA_ID_2125790_gDNA_ID_1620319_Annot_ID_153264 3000 nt of promoter + ATG
aatttgccacctcatattagcttaattaatcaaggcttcttactgttgggcctacaataaaaggcctgaatttggcccagatagattaaaccatatctaatatctttatcaactaatttaatttcaaaaagattttattctattttatcgtacatagtttgcataatatggttagatttcaaattttatatggaagtaactaattttggcagataattggattcataagaatagaataaaatctctatatatttatctatactattaaaagacatcctagaaaatagtataatacaatgtatttcacccattatgcacatcattttgcaatattaccttaaacaaaggctaaaaattacaacaacccccaaaatgataaaacttatataagaatctcatgattgatgctgtaggagaagaagaaaaacaaagaaacagaaccaaagtagagacactcttgttctttatatggattctacttcatcggaagtaaaaatcgtttctcaatgctttgttaaacccaaaaccatccctgaaaaatggaaagagccataccatttatcaccgttggatcttgtgatgctctctatgcattacctccaaaatggtcttctctttctcaaatctgatgatgcaaccaaaacaaaagatttcatggagacttggctacaaaagcttagagattctctagctgaaacccttgtccatttttatccgctcgcgggtcgtctctcgactttaaaaaccgataatccgagatcctactctgtgtttgtggattgtaatgacagtcccggagctggatttatccatgccaaatcggatctaagtgtaagagatattgttggatccaactatgttcctttggttgttcaatctttctttgaccaccataaagccgtgagccatgatggtcacaccatgagtctcttctcagtcaaggtacattaatttattcttgtaatctcaaaatcatataattcacttagcctagaagtttagtctgaacgatagtaatacacatatagtactaggtttacttaacttcttgccatttgatttagagatacatcgaagtattgtgtatctatgtagtcttagttgtttgtatatcacgcaactatgcatgcaataccctaaagagatgaatcttttcaggtaacagaattggtagatggagtgttcattggattttcattgaatcacgctgtgggagatggaggttccttgtggcattttttcaactctttgtcggagattttcaatgcacaagaaaccgataacttgcttctcaagaatcctccagtcctttcacgttggtttcctaaagggtacggtcctgtgtacaaccttcctttcactcactctgatgaattcattagccgattcgaatcaccggtcttgaaggagagaatattccatttctcgtctgaaacaataacatcattgaaatcaaaggctaatgaagaaagcagaacaacaacaatttcttcttttcaagcgttagccgcatttatgtggagatgcattacaagagcaagaaacttaccttatgatcatgaaattcgttgtagccttgccgctaacaatggaacaaaattggatccaccattgtctttgagctatcttggtaattgtctttctgctgtaaagtccaagaccgttacatccggtgagctactagaaaatgatttgggatgggctgctttgaaaatgcatgaagctgtgattggaaacactagtgaagtggtctcggagacaatcaaaaactggttgaaatcatcttatgttttccatttagaaaaacttttgggagcgatggtggttcacattggaagctctccgaggtttaagatgtatgaatgcgagtttgggatgggaaaagcggttgcggttagaagcggttatggcggtaagtttgatgggaagatatcagcatatgcaggaagagaaggaggaggaaccatagatttggaagtatgtcttcttccagagtttatggaagctttggaatcagatcaagaattcatgtccgttgtctcttcttcttcttgatcttattcatataagtttgattgattgtttgtgttgctgttaaagtccaattaatattatgtgacaatgtgttattcaactgataatgactgttatttattaaagattagtacaaactaaaatgtgaggtttagagatgataaagttgatgtctttgtggattactcccactcactctcttgattctacactctacttgtaagaacttagataggaaacctgaaaacagaaccatgaaacagagaaaattgcagagaagtaaatgtgtaagatcaagacttttacgttttcaggtttcagtgtgaaagcgcctactcatgccttgacattgttactcggaatccactattaacaaggtttataatatcaagctctttcttgagcttatacaacaaccatacaagaagtcatctcctcccaaaacacaccctccattcaactactctctgaaccatttgtcccttttgtctcctgatatgttctaacactaagaccagatccaaaacgacacagttctacttttggcaagaatcacgtgacgtccttgtgattgggcttcagaatttgcttgcttcttcttcaaaccctctgtgggaatagtgtttagtgaagttagtagaaacatgcatgtgttatttgattaaagattaatacaaactcctaagactaatgttattcaattagaataaagatcatatatatgatgacatcattgatgatgaccagcatatcaaattgtgcaggaacatacatatagatatgatgacatcattgatgatgatagctatctataatcatattatatgaatatattatttggattgtttatgtaagcgagtataaaccaaagtaacaagataaaagggaagcaaagggaccattgaaagaaacaaaagagtcatattatacacattttttctctttttttttttcttcttgagaaaa

SEQ ID NO: 776 - DNA, 3000 bp, Unknown
  misc_feature (1)..( 3000): cDNA_ID_2125764_gDNA_ID_1620319_Annot_ID_153257 3000 nt of promoter + ATG
aatgttattttctgtctatctggttctttggagaaaatatttttggtttcatcagtaactgtagattcttgatcccttttttttttttttttttaaatgatgattactttgcagataacaaaactcactaaaggtttaaatgcggtaaattcagcatgtgaggaggtaagatttttgtgcagtccatttgcgtttctctttcttggaccattaatcgatctcctcatttcttgttcatcagatacgtacttcacaaaagctaaaagatattatggaaaatattctgtgcctggggaacatattgaaccaaggaactgggaggggtgagtgagtatttctattatttttacccaaatatcttttggctttaagatatttcctaacgcaacataataaaatctgtgtgttgttcaatgtgagctaagaaaagaatggcgcctttgtttcattgcatcatatatacttttgttttgtctgaacgtaaattctttgtggttgataaagacccttgttcttttttctgaaggcagggcagtgggattcaggttggatagtttattgatattaagcgagacacgtgctgataacagcaagatgactctcatgcattatctttgcaaggtaaaatacaatgcgaaagaaagaaacatgcagcgtctttgctttagaaatcatgaaaccctcctctttgcttttcccaggtccttgcttccaaggcatcagatctactggacttccataaagatcttgaaagtcttgaatcagcttcaaaggttttcctttctacttactttttccgtcctgctgtaattggctcatcatttgattgtcctgtctattgcagatacagttgaagtctttggctgaggaaatacaagctataaccaaaggattggaaaaactgaagcaggagcttaccgcatccgaaactgatggtcctgtttctcaagttttccgtaaagtatgttgctgtttttctatcttctccatcttttgcatatcttttatcaatcatgattcatgaatttgagattaggtcctgactgtgccacataactaaatcttccatcaataccagctgctaaaatctagttttaatgttttttcaacagttattgaaggagttcatatccaatgctgagactcaagtagcaactgtgatggctctttactaccccgcggtaatttttgtcaacctctactagattccaagcgccttacctttgacaatgtgtttggtcctgaatttgccattttttcttgaatcaatctaattatgatggacgacagagaggaaatgctgaggcacttgcacactattttggctaccattatccatttgaacaaggtatgcctcggaaacaataaacttcatcctcatttattctaataccatagaaagtggctcattgctaataacatacatggtgatcgattgctgcagttaccgcgacactcttgagttttataaggttgtttaagaaagcacatgaagagaatgtcaagcaagcggagttggagaagaagaaagctgcaaaggaggcggaaatggagaagacgaagtaacgagtcagtgtcactaagaaaaagagcaagcggagttggagaagaagaaagctgccttatataactgaccatagtgtggtaactcagatgttcttttgtgttgaaataaacaagtgatgtatatactttcactgcttggttttgttaaaatgtgtgtggttgagaaaaaaaaacagttgaaatttgcattcaattaaaatatttgatactaattcgaacttgggactctgaacagaagaagaagtcctcctcccaagtcaactgatattttatgtgtgggccgatctacaatttcttttattttcgtaaaatggcccatttaaaggccttcaagactgaaccggttcgaccggatggtttgtcttaaaaaattgattttaattctttccaataaatgaggatttggtttgctggatctgtaattctccagaaatagtttttttgttcactttttttctatgtaggaaatgataaaaagagaataattttctctgacttgggaaagtaaggatacattaaatgaataaatgtaataagaaaaagacaagaggaggaagaagaagaagaatcagatagagacgaaaaaaggagtaataatctttttttttctttttcttggagttggagtgggtcttttctctcacacaggtctctctcttctcaactcttcccatgttgtttcgcttcttctgtaagatttctgtaagttagttccctcagaaaattctccattctccattttcctgcaatccaatatctttatctccaaagataatggcccagcagatctcagatatatagaagatccctcttcttttggtccactttcccttgtttacattttcccgagaaaacaaaaagaaagcttttttgcttttttttctttcttctctgctttcccagctttcaagcttctgaagtaaaagaacgaagctttgtgttaaaatctcagaattttgattattcttcggattgaaaaaaactgttccttttcctaaaggtagatcctttcactcgttttgatttctgggtttcttcatcggcagattttttgttctgtttctttctttaaatactcatttaaaatctatactttctttcattactatgttcttctaggaatctagctcaaagtttcatcttttgcttccttcttggtctttaatgcttacaatgtcttgttttcttcttctttttttggcaatcaacaatgtcttgttttaaagcttggtttttcttttaaaccacttatgatttttctgcctacaaaatgttgttaatagtctttgagatcttatcttaaatctcatctttttacatttgcatattttgtttgtatagagaagcagatttgatgatgcattgtggggtttacttttttattttattttaatgatattctttcttggtgcagagtgtgaaagtgaatgaaga

SEQ ID NO: 777 - DNA, 3000 bp, Unknown
  misc_feature (1)..( 3000): cDNA_ID_2125768_gDNA_ID_1620319_Annot_ID_153258 3000 nt of promoter + ATG
actttttcagatagaacatggaatttgcacaaactgcaaattagactgccaccaacttgtcaaacggttaaggcctttaccactggaaaaacgacgtacatacataaacaaagctgctccagaattgtttgcccggaagaacttgtgagccattcaagcccaacttttttcttgtagttctatttgaatatcataaggagtttaattactgcatttgaacatacactttatttttgaaactgaaattcttaattttcacatctaatgttcaaggcttgaaaccctggttaatgatccaacggagggaaatgcatggcatgcggatcatatcattccagtctaccaaggcggaggtaaatcctaatctcatacactagataggcctaacactagatcactcaataaacgtttgaatttgtgaattcaactgacataacaagttttattggatcattggtaggcgagtgccggctagagaacatgaggacactatgtgtggcttgccatgccgatgtcactgcagctcaatgtgcagaacgtaaactgatacggtccaaagccaggaagcaactcaaaaacactttaaacgaactcagaaacaatccgaagcaaaaagatctctcggctgacgagaacacaaaggtatgactgagacttaaatgaaaatgggggaattttacaaaagactcgatgtagcattaaatgtttgttctgtatgtttccaggagactgattcagctaccaatgaagaggaagatgaactaatgattgaagttcctggtagtgcctactccatagatcagaaaatcaatcatgatgcctcatagaactcattttttgacttgtcagtagattgacctctcaatgacaaagcacaggtcctgtttgtatccttgtatctgtaatcacagttttgcttggaatcaaagcctctttcatcggcagtttcttgtcagaaaagcaatgttgtcctaattttttttaaaatggcgtaatactaagtcatattgaaaaaaagaaaaatactcaagactttttctttttatataaataagcaacaaaaagaagttaattattgaaaatactcaagactttttctttttatataaataaattaaagaaaatttgttgtgtaattaacaagcaaggatgttccaatgggcgaaacagatactggagaaaacaaagagacgatccagtgctattacgtatcatcgttttattacataaactaataagtaataatataaaatactgttgacaacaaatatttcaatgtttccatacaccaattttcatggctgctaatcggatgttttgattttttttaatgttttcaaactcttattatttagaagagaacctcattttcaccaactatttaaaagataaacacaagtacattataatttaatctggtaaacttcagagaaacctacatattaaaatttaattgcatctattttattcatttttatacgtaactcccaatacgttgcatgaagatagagtttttatccattttcttattaaattttcatgagataaaaatatcaattatatatatcaaatctgagtttggttttatagttcatgaggggttatgtaatcgtaggaggatgggatcataaagagcccaatgaaataattgttgatgttcccttgcctttaagacttactctttccaatatgtggggacccattttagtcttcctctcccaatttcaataatttggttatctatacttgtaatatttgcatatataatcatatatgtataattgatatgtataacatatcattcatgtttggaaaactattgtagatatttcgttatttttgttatttaaaatcaagtttttatatataaacctatactagttgaaaataacatttaaaagcatttatttgtattatttatcatatttaaatttagtttcactttgattcccatacatatatactatatgtatgtatattatatagaggtgggtaatgtttccaacaaaccctaagcacaacttttaacagcaaggagttttctttgagttggagggacacatagccattattttgtgtctcaagactgtttttcacctttcttttaacttggttcgaaagggtttactaactttttgtctcactttttcttactttaatattaataagatttgatatttgtaagtcggtatatactgagttttcatataaattatcatccaaaattcagaaaaaaatcaaactatacggttaaaattaaaaatagaatataaggcataagtatatatgcaacaaaaatatattaattatatcaatatcaaaacacatgtatctctctccgatatattgccaagctaattatagttaccgtttttagcatacaattaagtaaccaattgccaaagcaatgatatagagttttaaaattgttttctaaggaaaatgatggtttttaattaattatgaatctcttttgccggaagaaaagaaagaaaaaagttttgaaacactagttttctcgtggaaatatgaatttgacctacaaaaatagtcatatcgacgaagaaggtggatcggtcagagtttttgatatcaaatcgggacccattgaattattatttttaattgagtattcaaaatggtaatacttattaggattttgatcagtttgaaggttagaatgtacgtatttattaacaattcatttttttattattaccagtcagtctgatttgtcatgtatttattctgtcaaatatatcatttttcttgaaataagcaaaacaattttatgtaatctgcaaaaagattagaaatgtaataattatataaccagcaaaaggtaaaaaaataaagagatatgaaacatgccatatcgagatgtagtagtgaggaagtcttaaatttctactataaaaacaacctccggtgagagaccacacaaagaaaccaaatcaagaagccattccaaatccatctttcttcaaactaacaagtatg

SEQ ID NO: 778 - DNA, 3000 bp, Unknown
  misc_feature (1)..( 3000): cDNA_ID_3058919_gDNA_ID_1620320_Annot_ID_153288 3000 nt of promoter + ATG
accaccaccgcctccatagccaccacctccaaaaccaccaccacttgttctatcatttgcatagtttactttaacaacccggccatggagatcctgagggaggattaaggtaatggatcagggagagtatcaatgaaagttaaacccaacgagacacgagaaagttaacagacattataactctttcaaaggtttcatagattagcaatggaacttacccggccatccaaagcctggatagcactagatgccgcttctgaagaggtgaatgtaacaaatccaaatccccttgacctaccagtttcacgatccaaaataactctagctgtgtaaaaacacaaaggcttggttagcagaaggcaactaaacaaaccatactcaagaaacaagtgcctaatttattcactaagacactgcaatagcattttgacaagaatactaaatagatcagtaacttactatcgacaacttcaccgtatttggtgaaagcttctcttaagctatcctcatccatgctataagccataccttacaacaagaaaagagaaaacaaaatcataaagttagtaacataacagcataaacaagtaaacagatgaaaagcctatagaactagactcacctccaataaagagcttagaagatgacatacaccttattgcttgaaaaagcgaagggcttgataaagaaacctgagcattgagttgcttgtttgtggtctgcttcaatatgttcccgaatttactcaaaaaagccatcgcaattagatatctagcatgaaaaagacaaatacttcagccaccagatagtcaatttcaaagtaatgatgatatcatttcctattttctatcaagaaattagcaagtttcatactttttcccccttaagaagaagggaatcttaaaaacgacaatcaaagcttttttaactcgtactctgcaaatacatgaactactaaggaaccaaaaagtgaattcaataccgtaacacaaagatcggaacctaaatccatgaaaatgaaaagcgaagaaataacagagaacactcaaaatcagaaaagaaagaaccttcaaaacagctaacgagattcaaagctgagagtgaaatgagcgtgaagagtgaagtacctctacactgacttcgcttcctctgtgatttctcgcgtccgttaaaacttaaaaccctacttctcccagaaagggtttatgtagcgaagttgcaagatctgagtcaatcgtgaccgttgaatctaaaatgattttggaaaatcatattagacacgtacggggttttcattgggtaagtcattcgtttatgtgacagcccagtagctctaagcctataacgatttaatctctctattttggtttttaaacgaaaataaaaaggaagaattcgaagattaacttaacttagaaagatatttcgaaattaaacttttttcttagaagtttggtaaaactacgtataatttttgtaattgaatcctatacattaaacttctagtttgaatattgttgcaataaaattataatatagaagtattaaaagataaaaggaaaacaaaaaaaaaagttaacccttaacaaaactttattctcttttgtaactgggccttattctcttttgttatttcagcccatttgatttgctgaaaatgcaacccgaatcacattattttgacccgaaagtgaatgggttaaacccgaaacatgaaatactcaaaaagttgttgcttttagggttttgtggtctccgctagtcaggcgtttactctctctctctctcacattttctcattctctcctacaacaagtttccgccgctaagccactcactacgcagccatggcaaatcctgaccgtatccttcattatctgtgtctatttgtatttgctttatgagtttttgtcaaagctttcttctaagaagattctttttgttcagagggttttaaatataagctgatttcttcattctagctggatctgttgttagttcttttgacactcttgtttttctacgatggatttagatcttcttctttgtttttatttttttgtaaatcgttcataaattcttaacttttagggtttatgaagaattatcgtggttcttccttgttgatctgatgttttgactcgtgaaaaaatcataaattttgttattccttcattgtttttttctatagatgtttcagatgtgctacataatttgtcgattgatccaacaaccaaggctttagctcctgattctgaaacaaaggtatttttctgtggtttagtgttcaccttttgtttagtgattcagaaaacatgccttttggtttcaataagagtaattttcagagtgaacttataaaggctagtgtccattttagttgcagggggcttatggcggaaacggtaatgacttcttgctcaatgatgagttagtggaggctaccaaaattggtaaacctagtcttttgtctaaagatggaggtgtgaccaaagacaagggatccaaccttaagaaactcgggtaccaaagtgcagcttataacgcaaagggttcatatgggaagggtgcctatgcttatgggtactatcccccagcatatcagtacccaagacatggttacactgggagctatgcttcagggaaaaccaatcttcagtatcagtacctggtatgttcttatttcattcattgagctgtagttataatcacttggtatgtaatcttgacttgtttattcgtttaatttattatcatcttattttgcagactcagcagggaagatcagctggtaatggtcaatcttatggaggatacatggacaacatttactccaattatgggatgtgtggaccttacacgaatggctatgggtatggctcttacggttatgactcatggaaatacatgcccaattggtatgcggttaacaatacctacaagccaagaaacgggtatcatggatatggcaaagaaaacattgaggggttaaatgagatg

SEQ ID NO: 779 - DNA, 3000 bp, Unknown
  misc_feature (1)..( 3000): cDNA_ID_2044917_gDNA_ID_1620320_Annot_ID_153301 3000 nt of promoter + ATG
taggatttgaatttcgagtaagggggtcaatttaatatttgaacccaaattatatactaaataccaaataattaagctattaaatttttttttgtaaaagtcatggggtcaagtgacccccctcctgaagctgtacctccgccactgcgtatcacagctttttttttctgaaatcaaagtttcgatttttcaaagtagggggaaatagattcactgatcatgaaaagtctactaatatttcaaatatggatgattattgtaccccaaaaaatagaattcaaaagacagaatcaatacaaatttgcgtagtacatatagggcaattattgaactagaaataaaaatacaaataagcaaaagctgggatcgattaagaccgtacgttttcagtttccaatccatttgtaaaataaagacagaaaagtatccatctcaagtttcttcaaagagatgccaatctcgacgccaccgataccatctctcctcttggacatagagaactcatcgttcttgtagatagacattgtctcagtgtgaatgggtcttccccacccgaagtccgtttcgtacatcccaatctggttcgacccgtttacgaccaacaactgtgtaccccatttcattgtctttgttccttcctcatacactttccaagttgactctaccccttgtgaagccaaacgtttgaccgaatcactgagaatctcgacggtgttgacaaatccatcttctcccataaactccttagctttgtatttatagaaatccatggctaagacacaagtcccgaagtatgtcacagggactggtggttctaaccggttcctaaaatcagcagcgtacatgaaacgaaccggtcggtttgggtcaccactacgtgccttcaccatgcatgtccacacatgggcgaacgtgactacgaacgttgacaagtgaagctcagcgcgtgttgactctttcttggctctctccttgagtttctcaatgttttcaggacttatctcgatggtgattcggaggacgttgtctttagcgttaatctctttgactggaggtagctttagggttcttccgttctctttgtcgtcctccgtaagatacggcagaagttcgagcatcttttgttcaagtccggctggaacattgacgacagaacgatctaaaaccgttggtagaattttcggtatggtgccatgtttacaagtgtgagcccatgctttgttaaatttttcagccgttttgccgtccaagacgacatggtgggctgtggttccaatgcagaagccttgtttcgggaacaaagtgacttgcagagatacaacagcccccgagtcagaataaatcggtagctcgggtattagagggcgtaactctagctctggacgaagccctctgccagagatacgtgagaaatccgcatcagtctcagccactgtgagagagagtgtgtctcctgagagaacaactaaatgcggctttggatcttgtgaatcccacttaaggtgacccgtgaataggcgaaagtgagtgaggatgagtgaaagagatcgctcgagcttggggaggatggaggagtagaaaacgtcgcgagatgatgatgattcggtgagtttgtaaaagaagacttgctcggtagggttgagtttaagccactgtaaatcaaagaacgagagtgggacaatgagcgggtcgacggaggcggttgcagggctgactcgggagatcttgatcacctttaacgccatttctcacttgtactctcgtcttttagataatattcctttgtacgtatgagtttattcagctgagtatcagatggagttaactcttatactaacataacaagctaccgagtcagccctagtcaaaaacgttggttggaagccaaggcacgtaattaccatttgaattattttggtccctccagaggcggccaggcggcttaagccaactgcgactgccagatatcatagataaaaattgttatatatatatatatatatatatatatataaaatatataattttatttttgtggtttatatttattatttttggtggtaaaaacattcttagaagataaatttttgtagataaaaggctgaaaaataaatttatggaaaatatataaataaacatttgtgagcaaaatgtgtctacataaaattgtaattttctcgagttaaaaaaaagcaaaaagtgaaatttccaaaagccttaaactagtttgagtaatttaaaagtgtccatagttttttcttttttctttttattccataatttcttgagtttttcagaaattactataattctgtttaaattttcaggatttcctgaatattcatgatgtttagttgtcacttaagttttcatagaacacaagtcggttatgcttttacctaatctttgtctcttgttaatttctaaagcagataaaatctataaaccaacaacaatgttttagaagaagacataacatttattttggcaactcaagttatttgatcaaagaagttaataattagtttttaaaataaattaaatataaaaaaataggggccaaaagaatcagttaaaaggatgttgtatcattcatatacataggggccaaggcaaacacaagctcactatcacaaagaaactggtatccataacccaaaatttgtgggccaaaaatattgaattccaatctcaaaaaagcccataaaatcccatcttttttccctctctagtcgtcgttacacgtaaaaaaaatgatttttaataatccggtaatgcgttaaaaaagatatatcgatgaaaatttccttttctttgtaagttgtaacaattgtttttaataataataattctgatgccataaaatcgcgaggtagagatgaaaaaaaaatagcttcttcaacaaaggccgataacagtgaacccttcgtcggagctcagatcacgagccgccgtcaccagctaagaggcagtgacttttgagtaagtgaggcgaagatg

SEQ ID NO: 780 - DNA, 3000 bp, Unknown
  misc_feature (1)..( 3000): cDNA_ID_3058895_gDNA_ID_1620320_Annot_ID_153305 3000 nt of promoter + ATG
cttcaaaatcaaagtgtagaaacagagattaccaataactaattgtgaacgtttcaaagtttttaaaatttcttgtaaacggaggtaaccattaaaaaacgaattacatttattattttgtaatattcaaaacaaaatcaaaatcttgagaatcgaaaccgttacgtatactacaatttatatgatcacattttaaatttcgaaaattgagggacatttcaaattcaagaaaacatatactccactaatttagggtgtctccgttagtttctaaaactcgttgccccttttaattccagttcaaaagctcacgcctcatacacaatctctaaaccctgacctcccatttcagtttctctgtttgagaacacttgatttcttttaaaaatggcggctacagtagcagagtacgcaactgctaaatcattggcgttgctggacacagagaaccgcgaggttctcaatagttttgatgccatttttactcatggcaacaccgatcaagtcgctcctcttgatgagcctctggtctttaaccgctttggactcagtcacatctcggccaaagacacccatcaaccaaaaacggacgtagatgaatcagcgaaggcggatttcgctggtgcaaaaacgtcagtttggtgggacattgagaactgcgaggttccaaagggttgtgaccctcatggggttgctcagagcattagatcagttctgtcgaaaagtaacttctgtggtccgctcactatttatgcctatggtgacacaaatcaaatcccttcctctgtacaacaagctctctcttccaccggcgtatctctcaatcacgtccctgccggttaatctctcttcttgaaacacctgattagctataaattaaagtatgaatattttggagttagtgagaccagtctttgctttgtagtctctaatggcttaattattctctatgttcttgatgatggtgagcatttaacaggagtaaaagacgggagtgacaagaagctccttgtagatatcatgttgtgggcaatggacaaccaagctcctgctaacataatgctcatctctggtgataaagacttctcttatcttcttcacaaactaggtatgaagaggtataacattcttttggctcgacctgagaaagcttcaacgccactcatcgctgctgcaaagaccgtatggttatggacaagcatttttaatggcgattgtcctaacatacctattgatctcactactagacgtcatcatcatgattctgcctatgaggtatcaagacatttgggtcctaaacaagctcaagggaccaagaggggccggagtttttgtgaattatgcaatgtttcttgctcaaaccatgatttaaccgctcacctctctggtagaaggcacagagctaacgtaagctatacatttctttttcttaatgtgtgcttgaatattgtcctctctttaagcctaatcttgagttcactctacgggcattagatgtgaggcacatatatatatatgttttatgttgatatagtcttgacaattgttgttgtacattttctcaacttgtgtaggttgagctagtagcccgtggacgccctcttgtcagtaattcaaccgaaccaaagtatgcatggtgccgagtttgccgtttgcgtttccgcagccaagcaagttatgaaacacacatcttagggaaaagccaccaagaaaaacttgaagaccaaaacgagcattccaaaaagcgcatctgcaggaccccctaatcgtttcatataagattttggagggaagacataatgcgattagagtttgttaattcccaaacttgtcttttgagtctcatctttagttgttggttgaacaacttttggtttcggttttcatttagtctcgtctgtgtttttggataaaagccgagagctgagcccacgttgataacttttttttttttcaaaaattgggaacctagtagatgatgatgtgaagtgataattacttaaacgtgattatatatatatatatatatgtgggaaataatgttttactggaatgttgatataatagttttgacagttttttgtactctttagctgaaaccattttcttaattgatttttgttgtcagtgtgctaatgtcattggtgtaatcaaacccgaagcaaaatcgaaaaccttccgctgtaagctttgccaggtcgattgctcgaacgaagctatgtataatgcaagtcatatttcagggcggaaacacaaaaacaaacttaaaagtcaagctaatctgtttctttaattaaatttagagtaatagatataatgatctttgaggtctatggatttttggtaaggaataatttgagccaaatttgagcaattttgattatcgatcgtacaagttgtagttttgttgctccggaagatttcagattttgatgtaaatttaatcccacaagttataatcatttttgtagtttatggaattgaaattctaaacataattgttctgacaaaacttgtatttttaatacaattttgaaactctgcacatccaattattttctttaacgtgcatgcaccgatttatttagtagccttaattttttcttattaagaaaagatcctttactaattatgacacttattttcgctaattaccgatggggagatacagcccccaaaagttacaacggctattttcaaatgctgattggtgccttttcaaatgctgacgtggcttaaataataattgtcgaaaaagtagaatactgtatttaacttgatcgtactacagaggacaaaataaaaaagcagactttgcgaaaagcgaaaggtttcttcgtcaacatggaaagaacttagtggaaacttcttaaaacttagattgtcagattagcataactcaccttagcaagctccgatcttcgacgagatagtgagaggagtaaagagtaacttttggttcagaaacaagtgtctcttctctctctagtatctccggtg

SEQ ID NO: 781 - DNA, 3000 bp, Unknown
  misc_feature (1)..( 3000): cDNA_ID_2044906_gDNA_ID_1620320_Annot_ID_153306 3000 nt of promoter + ATG
gtgatgaagtaaagggtcaaccaaaagaaatgactgcactgcgtaatgcaagtgctaaatacatttgtcgtatgtgcaatgtggggtgccacagtccaattgtctttgaaactcatctaaggggtcagaagcacgctgccaatctgaatcaatcaaaggcatgtctcttacttttgcatatttgagagcatataaaaaactacagtgtggtagacatatgctttatgtaataccgtaggatcaggcactcattgattctaagaagcttcaagagaaaggtttcggagaaaaagaacaaccaagagaaacaattgtagagccacagttgcagtctcaaaacgctcaagagaatagcaagtgtttcgaaaagcatgttgtcatggtgaatcaatcagaggtcagtttcttaatattggtaatttggtattttaatttacaatttccagtgtagcaaaacatatgctgaatatgagagtcttaactgtggtaaaatatataaagaatgaagcttatatagttgcatcaggtactcatcaatgcgagtaagcttgaagagaaagatgcccaagaaaaagctcaaccaatagaatcaatagccgaacctcagtcgcagtctcaaaacactcaagagcataccaaattctttgagaagcaaaacgaagagttgagaaagatttgtggcactttagaaagcagtgtaaaagaacctcttccaagtactaaggactgggtggagactcttaacaaacagattccaaatggagaatttttctttggtgacctaagatctgattttgaagtacccagggaagcaaggtaatttttgctaacttggatttgcttgcttagtatgtcaaagatgcaattatctaaatgtattctccaacttttgtcatagtgaatgttttgatggcattgtcaagcctgtaaacctttccaaaggagaaactaagcattcatgggaggtaaagaagaagaaaatcgaggtgaccgtacgccatgcaagaccagctgcatctaaactttgtcatctttgcgtagtgatttgtgatagccggggtttgtcaacagttgtttgtgataacaaagctcattggccgaaccaaaaacatactactgtagtgacacttacttcatgttctacctctttatccttgatcaatatcaaacccttctgacttcttatttttgatgtaggccgcctttgtagccagcaatggttctcagtccagcgtttcaaccaatcctttgaaggaaccagagggtttgcagcccgtgtggtgccaagtctgccagatcagctgcaacagcaaggttgcatttgcaagtcacacatatgggaaaaaacaccgacagaacttggaatcacaatcagccaagaacgaaactatgtctactggaccaggcaagctttctaaagattatggagaaaaaacgaagaaagtatcatgcaaaaaccaaaccacatttgattctcaactgaagagtcagaaccattataccatggcgaaggagcttgtagaggtaaatcttactatttaggttttctttcgtgaacttggaatctgcttttagtaatgaatattacaaatcttagtaaaaataatatccttaggtttgattcctatcgaaagtgatgaagtatatattagaccttaactaaaatatcgatgtagaaggcatttgtctccgcatttgagcatgtctccgcattggagcagttcagtattgttgactcaaggacaatccgagaagacaccgaccaagaaaaagaagcaacaaaggagcagacacttgtaaagatggatggtaatgggtttcgaggggcaccagaagataaagtggaattgaaccaagaaaaacatagagaagcactggagcagttcagtattgactcaaggataatccgagaagaaaccgatcaagaaaaagaagcaacagaggagcagacacttgtaaagatggatgatcttgggtttcgaggggcaccagaagataaagtggaactgaaggagagacacaccgtatctgagaacttggtgcaccgtgtcttcactgaacagaatcgagagtctagaatacccaatgaaccgaggtaagagccaacattcatgggagtgtataatatggtctctctctctctctctttctcttgaatctcgatcaatatgtgtgtgtctaactggttgcttggattttgggttacagaggatgtttagatgtgattcctgagagagtaaaactgccaccaaacgtgaatgtggccaagaatttggaagatgagcagaagcataaacccgaaccaaaagcacaggaagccgaaaacaagtctggaggacgcaaggatcttcctggagaggctgccaaaagggaagagattaagggccaagctgataacttttggactcgcctttgggggaaaaaatattaaaataatgtgaattgttaattcatgtttaagttgtcaacaatggatgttttcttttgaatggcagattaacgttttattttggattggcttttgcttatttcttactgttgtttcttatatataaactttacctcttaaaaaagattcaagaacaatagaatttaggcattgtagtatataggttctctcaataaattgggaaataacgaccggtttttccaacagaattttcggcttagtctgtaatgtaatcatcaaaaattgcattatttgctttacgactacagctcaactgggccaccctgattacttatccgacccggcccgacccatccggatcttccttctcttgtttaaattaaagcagataaaaaggaaactggaaaattcagttcaagtattgtcgtcggaatattactcttcaccggccaggtaaagctttcctacgactatgcttgtgttcgtcggaatgtgtttttctttctttttcttatagtctctggtcgctaatgactcgtattcttggtccagttttcagctcttgtgtgtaaatttgttagtctttttta

SEQ ID NO: 782 - DNA, 3000 bp, Unknown
  misc_feature (1)..( 3000): cDNA_ID_2025614_gDNA_ID_1620320_Annot_ID_153303 3000 nt of promoter + ATG
aacttaagtgacaactaaacatcatgaatattcaggaaatcctgaaaatttaaacagaattatagtaatttctgaaaaactcaagaaattatggaataaaaagaaaaaagaaaaaactatggacacttttaaattactcaaactagtttaaggcttttggaaatttcactttttgcttttttttaactcgagaaaattacaattttatgtagacacattttgctcacaaatgtttatttatatattttccataaatttatttttcagccttttatctacaaaaatttatcttctaagaatgtttttaccaccaaaaataataaatataaaccacaaaaataaaattatatattttatatatatatatatatatatatatatataacaatttttatctatgatatctggcagtcgcagttggcttaagccgcctggccgcctctggagggaccaaaataattcaaatggtaattacgtgccttggcttccaaccaacgtttttgactagggctgactcggtagcttgttatgttagtataagagttaactccatctgatactcagctgaataaactcatacgtacaaaggaatattatctaaaagacgagagtacaagtgagaaatggcgttaaaggtgatcaagatctcccgagtcagccctgcaaccgcctccgtcgacccgctcattgtcccactctcgttctttgatttacagtggcttaaactcaaccctaccgagcaagtcttcttttacaaactcaccgaatcatcatcatctcgcgacgttttctactcctccatcctccccaagctcgagcgatctctttcactcatcctcactcactttcgcctattcacgggtcaccttaagtgggattcacaagatccaaagccgcatttagttgttctctcaggagacacactctctctcacagtggctgagactgatgcggatttctcacgtatctctggcagagggcttcgtccagagctagagttacgccctctaatacccgagctaccgatttattctgactcgggggctgttgtatctctgcaagtcactttgttcccgaaacaaggcttctgcattggaaccacagcccaccatgtcgtcttggacggcaaaacggctgaaaaatttaacaaagcatgggctcacacttgtaaacatggcaccataccgaaaattctaccaacggttttagatcgttctgtcgtcaatgttccagccggacttgaacaaaagatgctcgaacttctgccgtatcttacggaggacgacaaagagaacggaagaaccctaaagctacctccagtcaaagagattaacgctaaagacaacgtcctccgaatcaccatcgagataagtcctgaaaacattgagaaactcaaggagagagccaagaaagagtcaacacgcgctgagcttcacttgtcaacgttcgtagtcacgttcgcccatgtgtggacatgcatggtgaaggcacgtagtggtgacccaaaccgaccggttcgtttcatgtacgctgctgattttaggaaccggttagaaccaccagtccctgtgacatacttcgggacttgtgtcttagccatggatttctataaatacaaagctaaggagtttatgggagaagatggatttgtcaacaccgtcgagattctcagtgattcggtcaaacgtttggcttcacaaggggtagagtcaacttggaaagtgtatgaggaaggaacaaagacaatgaaatggggtacacagttgttggtcgtaaacgggtcgaaccagattgggatgtacgaaacggacttcgggtggggaagacccattcacactgagacaatgtctatctacaagaacgatgagttctctatgtccaagaggagagatggtatcggtggcgtcgagattggcatctctttgaagaaacttgagatggatacttttctgtctttattttacaaatggattggaaactgaaaacgtacggtcttaatcgatcccagcttttgcttatttgtatttttatttctagttcaataattgccctatatgtactacgcaaatttgtattgattctgtcttttgaattctattttttggggtacaataatcatccatatttgaaatattagtagacttttcatgatcagtgaatctatttccccctactttgaaaaatcgaaactttgatttcagaaaaaaaaagctgtgatacgcagtggcggaggtacagcttcaggaggggggtcacttgaccccatgacttttacaaaaaaaaatttaatagcttaattatttggtatttagtatataatttgggttcaaatattaaattgacccccttactcgaaattcaaatcctatttttgccccactcaattaccatattttgtgtaaatcaatctcattattcttcttctattaatttcctgaaccctatattaaattttggtaactggttttattattcccctaaaaatacatgaatttagatagacaaaacaattaaataatgtgggtactaatctttacatttagataaacaaaaaacaattttagtaacaaaaaagatgtatatcatttttcaccagatttttagtaaacttttaaatagaaaaatgatgaataacatatgactactcgtgtattttccacaaagaattttttttcggaaaaacaacaataatttacgaaattgtgatattattttttgttctatttttttatctataaaaaatttttttttaaaaaaaatccttgttttaattttctcagaaacgtgggaccacaatattttccaaagggttcagagtttagcgggccgaatatatgtcataggcccataggctaaaacaataagggtagttatgtaaaatccgctcacacacactcctcaaaagccctaatcgtttatcataattcctcaatcccgtcttcaagtatcgccgacgccgcagcacaaaggaggagaagaaggatcaaaggcgcgacaaca

SEQ ID NO: 783 - DNA, 3000 bp, Unknown
  misc_feature (1)..( 3000): cDNA_ID_3058903_gDNA_ID_1620320_Annot_ID_153300 3000 nt of promoter + ATG
atatactaacattaaaaaataaattgtttccgcggtgtaccgcgggttaaaatctagtatatatgtataaatgtaacgaataaaatgagtatataattttatatgattagtgttgaatgttttgacttaacataaagttgcatcaaaatgtataactaatgctatatacttctctttttgaaaaaaaaaattgagtcttggtatattaaccggagacgagataatgtaattatatattaagattttttttcactggcatcaaatctaccagaacagtcaaagaggtaattaagagtaactgcaagagctgaaatcttcttacaaacaaaaacataacatagacccataacacagagacagagattaccactaaactagaccaaaatgtcctcgaaacgataactaagtgcacccacagaaccagagaccattaacatccttagagcatcaggaaagagcagaatccactcgaagcgatcaagagaaggcagatgaacaatttgcttgagttcttgagagcaaacgcgctgctgtctgtcgtgtaatccgggttaatccctgtcccagtggtgcctcctgtgctatttcccccaaaaactccattggttgggttccctgaataaggactgttggtaccactaccaggaagtgtggtggtcgttgggctgccttttggattggttgtgccaggtgtcacagttgtgctgccgctagagccactggaagaaaataagagttatatcagacaatgaagttccaaaaccagaccaagtcttgatgaaagagattgatctaaaggaaagtcttcaaagcaaattcatattctatactcaaaaaacgctaacaaaaagaagagtctcagtttctattaactaaaagggtctttgatgggtccaaaagattaaagatttagagtactattgcttaatacggccatatcagtcaagaacatgatcatgcgttcaaactgtaatccaataaagcatttgattttgattatagatatgaccaaaagtttggttaaagaaataaagaaaattgagtacttttaggttcacgttgaacacttacaattaacagtgtcttaaaataagactgttcacaacagagtcaaaaaatttcattacttactctatttcctttagtctatttaagtaatactaatgatgctgttttctattttaatttaagctgaatgatgatatctctttcacaacaaaagtaaacaagaacaaaaaaagttgtaatttgggacccaaaccaaactttaatctactttttctctttgccacaaacatagaaaacaaattcttggttttggttccataaaatgcaaaacgtttctttcaatttcttgataaggccatttgaatcagaagcatacctggcactagtaggaaaggcacaacctgtataacctgtaaaaaacaaacacagaaaatgttaagccattggttattgtccacaaatttgaaaactagaaatatagtctttattatgcatttggcgtatccattttgtctcagaatcttgaataccaaagtcattcactagtgacaaaaataaaaaccttcaactttctgtaactatcaataattagacaccacatgaatcctaacaagcactccaaaaagagcaagtttctttagcattggcctaatgtaatatcaaagagcagaacaaatgagaatagtttagagagactaactgggatcggagttagtgggagtggcagttccatcgaaattacaagagccaggagattgacccttcttttggaagaagctattgactgcatagttgcaatgagacctaacattgtcagggttgaagcaagattgttttggtttagtaggattacaatctgctccatttccacaagcatagtctagggttgcctgtagcactgtatcactcagccctgtcttacacacacaccatgaggcacctacaaagaccacaagaaagccaaaattagaaaatagatagctgcatcttccttgttctataatgtgagaagccaacaagatttgggtaaatcttggaatcacctttaaaaggcaagatttacaaatattagggtaaaaaaagtaagtaggaagttgagagacaacaagcaaatcagaagaagaaaaaaatcagtaaagttttctagaaatttgtgaactatgccaagaaaaaacactttaagaacagaaaacaattttttattttttcattcttcaaaggaacagaacctttttcagacaagagctaactaagagtgaaagagataagaagactaagctaagaaatctgaagaagagtgaaagttcttactagaatgtccagccaaggatagaaggagaagtgaaagcaccagagcagccatagatgcgttcagacaaaatgtcactgttgtctttctagaaacagagagagaaaagaatggagatagagagatctctagagcaagaagaagaagaagaagaagaagaagagaaagtggagagacacagagagagatagagagcaagtagagagaaagaggggtggtgagatgagagagtggctacttgttctgtgtcttcttgtctcttctcaaaacccttttgaatgcttttttacatcattaaagaacttagctcgtgtagactttttttgtacgtatatttttagatttaaattaaagacacatcgtattattggtacttcaaaataatttaaaatgacttattgtaaaaggcaatttttttattttttgtgttgcaggatgagatgtgaaaaagctgattcagaaaatcttgttcatgcttgggtcagatttgaataatttgttttgcaaaaaaaagaaataacaataatttgtttactgtgtattggccattctaaattttataaaatcgacataattacagtaaaaaaaaaagtataatattttgtgtattttatttttaattgtcttgttattaattcaaaaaaattctctaccaataataataaaaaaagaataatttagtc

SEQ ID NO: 784 - DNA, 3000 bp, Unknown
  misc_feature (1)..( 3000): cDNA_ID_3058909_gDNA_ID_1620320_Annot_ID_153293 3000 nt of promoter + ATG
actttctcaatctgaattgtgtaattcatagattggaaagattctgctgattttatcctatataggtgtttcctagcttggttaactgtttctttatcctatataggtgtttcctagcttggttaactgtttcgttatcctatataggtgtttcataaattgttaacaatgttggtctttccttttttgcagatgtgtggttcttggtggtagtaaagctgaagataagcatctcaaattggttcacacaaagaaacatgttaatttagtgaagagtattagcacaaaaaagaaagattctcggagaaacaagattgcttcacagttggattcgatttatctgaatggaggttcatctgaagctgcatatcttgcagctggatctgttgtaaaggtaatattagattcatacaaattgtctctctcacacaggaggatagcaaactgttagaatgatttgtttgacgattagtaacaaaacaaattagcaacttggtaggtggcagagaaagttgcagaaggagagttagattgtggctttgctattgtcaggcccccaggacaccatgccgagtcagatgaagccatgggtttttgtttattcaacaatgttgccgttgctgctagttttttactaaacgaaagagtaatgacttcttttgacttttgtgatgcttttagtatctcttacttgctctcaaatttctttggtcacattcctttggtgcgtacgtttgttctcatgttatgcggcattaatcgaatgcagcctgatctagatgtcaagaaaattctgattgtcgattgggatatccatcacggaaatggtacacagaagatgttctggaaagattctcgcgtactaatattctctgttcataggtatgtatttgcaacctctgtctattcttctttccaaactactttttcacatgatctttgttgaggtttaaagtgactggaaatgcatttgtgactaggcatgatcacggaagtttctatccatttggcgatgatggagactttaacatggttggcgaaggtccaggtgaagggtttaacattaacgttccatgggagcaaggaggatgtggagatgcagactatcttgccgtatggaaccacatcttgatccctgtgaccaaggaattcaaaccagatattattttgctttcagctggatttgatgcaggtttgtatggtctaaccatttgtttcaaggctttgtgacggtaagctgtgtgtaatcttttcaacttcttcttaacagctattggtgatccgcttgggggttgttgtgttaccccatatggatattcagttatgttgaagaaggttggtgttgaagtgaactgcctcttttctccattgtttctattatgcgtaccatggcttctctaccattgaaaataacaaagctacataattttacttggatatgacatcatttaattggtttctctcagctgatggagtttgcacatggaaagatagtgctggcattagagggaggatacaatcttgagtcattgggaaagtcttcactcgcatgtgtccaagttttgcttgaagacaaacaaattcatggttcatctgaaacatacccattagaatctacacggcgtgtcatacaagcggtatggctctatataaccctaacagtctgaaattttgtatgaattggctacgatttctcttttcagctcagttcttgtgtcataaatattgtatatcgcctatgttactaattgacaaagctcatctgtttcttgtgggtttaggtacgcgagagactatgcacatattggccttcacttgacgcgtcaatggcgtctaatgagaatttaaagaacccaagtgcagaaagaaactccgctgacgccctccttcgtgaagtggaagagttaaagtctctaatggctgcccgagatggagaactggaggcaaggagaaaagagttaaaggccaaaaataaggagctagaagcgaacgagaaggagctagaagcgggactaatgttgattcgcgctcgggaggatgtaatctgtggtcttcatgcaaaaatagagagtttgcagcaggagcgagatgaggcggtagcgaaagctgaacgcatagataaggaactccaagaggatagggcaagaagccaggagttcaaagaagacacagagttttgcttgagtacgttaaggagggagaaggagcttgccatcatggccaaaaataaggacctagaagcgaaagagaaggagctagaagcgcggctaatgttggttcacgctcgggaggataaaattcatgccaaaatagagaggttgcagcaggagcgagatgaggccgtagcaaaagctgaacgcatagataaggaactccaagaggataggtcaagaagccgagttgggaatggatcttttgccttttctcaggagttctatgaagacatggacttagacgagctcgaacctctgtctccggagttcaatgaagacatggactcggaagagcttgaaccgtttcaggtcatcaagaaaaacatggagcgttcccacaagaagttcataaaagatatggagtgtatcaagtttatcgccagtgagagagccagggtactttaggttgggagcttgaggccgtagcagaagactaccacaagtttcgcgagatggttgataagctcgggaagagcaacatatacccttcttagaaagtacaatggtgtttcattgtaaccacagaacctttttgtgattgtaaaccaactgtgtcgtgtcagactttgattggttgcgatacttggtttcccaatttccctccaaagaatctccaaattggtcaaactctcaaacctaaaaaaaaaaaaggagagaatgaaaaaaagaaagaattgaaaagtaaaaaatacttggaagctttagaagctgagagcaaagacttgacctttttcacttccttctcactgatcgtcgaacaataaggccgtcgcatctcccagttatg

SEQ ID NO: 785 - DNA, 3000 bp, Unknown
  misc_feature (1)..( 3000): cDNA_ID_2044944_gDNA_ID_1620320_Annot_ID_153294 3000 nt of promoter + ATG
ccaaaacgtgtcccgccgagtcgaactcctgaagcaccaagatctgtcccggcttgtccaattcctgaaataccaagacctgtcccagctcgtccaacccctgaaacaccaagacctgtcacagctcgtccaacccctgaaataccaagacctgtcccagctcgtccaatttctgaagtacaaacacttgtcccgactcgtcctacttctacagcacccagccctgtctcggctcatccaacttctgtagtaccaagccctgtctcggttcatccaacttctgtagcaccaagccctgtctcggcttgtctaacttctgaagcatcaaaacctgtgttggctaatcctgcagcaggtattagaagagaactcgtttgcagtcttcgagctttgagtatgactactacaccagtgagacagagaaccactccaagtctccttaaatctaagaaagttgagcctccaagtccacgtgcgttgcaaattcgttcaagagttaagcaacaagcagcaaatgcaacaaaaattcaacaaggtgttatcttttgtttctcttttctttctgaaagccaaagatcctaaacttgttttgatcggatcgctaaaaaaactattgatttttcttggtttctctaggggcgatagtggaagttggggataaagctaaagatcatggttccaacgagatacgtcgatcagtctctgaggaagaattatcggaattacttcaatatctaccagctcagaatcctacttggaagtgagtttcttaacacttcataatcttttttgagctaaacatgtgttttgttagaagcgtcaatcagatcacgctatatgctaaattgttgccatcactctttcccagttttacaacttagggaatgttgtgtgactacctttttcatgtagctcttagccttatttgcatttttttcaaggaaatctagtggctcttacttgccagaatgtaaaacagtccctaatctctttcacagtttaggcatatgctacattgttgaaactggagatgtgcaaatatagaaacgtgctgggatttcgagagcatgaccataataagattcactgatgccaatattgcacttttctccttttttgattcctttgatcttttgaccttcacaagttatatgatgaaattttccttttaactactgaaccagcggacgcattatggattctgcctcgccgcctgagtttgactgcgagttttggtctaaaccggcatccaatatcaggaggaaggccctcagacgttcaaaggcaatgcctgcgttactcaaggtcgaactgcttcctacatgccacattctaaatgatgtgtctggcagaagcccaactctattgaatgtcgaaatgtaccttttcccagatgagaagaaaacagaaaggtactcaaaacccctttctatgaaggacaagcttcttattcttgttgtatctctgttatcagaaaacttatcatctcagggcatgtacactcattcttttaggtttacaggggaacatgctactctgttcaaggcaatggtaactcgcaaagtcatggccaaagctaatataaacggcactgaattgttaatattctcctcaaaactattggacaagacctcccaatgtatgtatgcattctgaatttctgcagagcttttagtttgtgcatagattttcgatggataacatccgttttgtgttcagcagttctcatcaatacgcagaagaaaacagaaaacttcctttggggtttttttctccagaccaagaactcactaggacttgttccagaaactgcttctcaaattgataatgattttgatgatgggggtgttgttgacatggacttagacaatgaatgcctgaccccgcgtgtggctctgaagcttattacagaatcacaaaaaactccctcaagatcaccggagaaggtgaagggagaagcaagtgtacctcctggtttcgagaagatatggacaccacccttggtgaaacttaatatacaaggaacatcaaaccctctgtctgatctaaccagatcggctggaatagtgcgtgaccaatcagggaagtgggtgtttgggtacatcaggtgccataagagcatccctgaagtcgtagctgggcttttggctatataccaaggcctcaaatatctctgggacagcggtttccgaagaatccacttggagacaacaagctttgagatcatcaatgctctaacaacaaaatcgtccctgttttgtaaaagtaaaacgcttctaggagcgtgcaaggacatgatattgaaggagtgggagtgtgacatttaccatatctccaaagaacagaactcatgtgcagaatggttagcaaagagatcagaagaacagcctcaagaattagttttctttgaataccctcctcgaggccttatggattttctggagaaagaccgccttgcagctatgtagagcttcttcaggtttgaggtacagtcccagtgagcagcttagaggtacatatctcgattaagtagtctgaccttttgaaaatactagtagaagaagagatgtttggagtgttaatgtgacatccttgcgtagtcgtaagtacagtggagtctcattgtagccacagttcaagaacacagacgtttttgtgaagtgaagaatcgaaataactgtagattttccctccagattcagtgttgctcctcttcatctttcgtttaggcacagtcttaacaattcacaaaaaaaaaaaaaaaaaaaattactattaaacgataaattcgccgtttgcagaaaattcggttcaccaattttaaattggtttatgaggttcaaccggtcattggttctaaatgagtttgaggtgtccgcctttgattggttgagatgctaggtttttcattttccctccaaagaagctctttaatggtccaacaaatatatatttaatcgtaaataagataaagaaaaatatattttgaaaagaaaaatg

SEQ ID NO: 786 - DNA, 3000 bp, Unknown
  misc_feature (1)..( 3000): cDNA_ID_2044940_gDNA_ID_1620320_Annot_ID_153295 3000 nt of promoter + ATG
acaggcacatgcaagtccagtaggtaatgaaaaacattctcttttagcttaagtatcactcagtttctcttccctgctattgatataacatcaagaaactgatgtattattttactttgtttatggatattatgtagctgtgccaatggatacatcttcaagcgataatcagcagccaccctctgattcggaatctgcaatctaaaactgctttttatcagagaggttttggtgtaagctttagcttaaccattgacagagagatatggattttttttttgggttgttttttctttcttgggtcaaaagtcattttggttggacttctctttgatcctgatttgactcatcactctttgtgcattatcttctctcattgtttgagtcatttgctactttgaaccttttttgttgttaccaaaaattggatatatgctttggagacagtttatggatatggatgctatttccaagctgtaattaggggagtgctctgtttttttttttaccgtgtgacagtttttgaaataaattttctcaattttgtgccatgtgaatctcatttttttattagatactaatagtgtgtttgttttgaaaaaaaaaaaaagattctcaatgtttaagaaaacaatacatggttaacaaaatgccacgttggatattccatagatctcggcgataaacaaattttgctaaagcttctttttataaataaacgtgaagttaattcccaatatttaaataagagaatttgaaaaattcgatttcgtatattaaaaagaaaaatcaatattcaagaatcaagattggggattggggagtgttaataaaaattcgtcttggctcttcaagaacacaagaccaaaaaaaaaactgattcttcgatttcaagaaaaaagatcgaaaatttggttacagtcgatgccattgaagaaccttttgattgataacaatggtctacgaaagtgggaacaagcctggaccagaaaatccgacatttagttcagatttaagcctttcagattctcttgtaaaactggtaaatcacatcttcgcttgcagtttattgatatgggttttcgatttcatgagtaaaaattgcatctttacttgatttttcttgaatcttgactctttgtaatcagaaattaatgtgtgttcttttagggtttcttgatttttgagtttttctttatttttttttaaatgttcttttaggctttttttaatggtcttgtgattagcaagatgcgaatttctttttatactgatctttaatatgcttcgatgtgtatatatagaagaagaagccttgtgaagtatgcggaagtgatgccaatgagcttttgatgatgacttgcttcatgtgcagagatactagggagcatacgtaagaaattaagcaacactactcaattagttttctttaattactgttttaacactcaatgatctttaatcctcctttagttttcttgtgtgtgtgtgtcagttattgcgcgagggtgatgtttcaacgtgtgcctcgtttgtggatttgtgaagagtgccgtgatttctcatctgtcgccaacaaaactgctaatgctcaatcatcaagaactattcaagtggaacaagttgtggttaaacaagttcgtattgatcaaactgttccatcaccaagaactaatcaagttgtggataaccaccaagatcctcctattgatcaaactgatccatcatcgacaactattcaagttgtggataatgaaaatttgattgaagctgctccatcatcaagaagtaatcaagttgttgataacaaagattggattgaagctgctccatcattaagatctaatcaagttgtgcctgttgctcctcgtattcatgagtttactacagacgaatcatcctctccggtgtctccatgttcgctagatgatgaaaccaatctctttcacttcaagtatccttcactttctctccctccgttgatgaaaaattgaagaaaatctctttttgactcatcaatgtttcagtgttcaagtccatgtgggaaagatttccagtcaaacgaccatcacattacattgatctgtcctctgattccgaatctgaagagtaaatgcctcatttgagagagattcgtgtcagggtttagggtttttaaaaagacatttgctttaactttttcttgtgtcacaagtcattttgctagctaagtgagattagactagtttgatcatcatttggagtcatatactatatgacttatgtacataactaaattattaaagctatgagtaaaaaaggtatcataacctttttctttttttttccataaagtttaaagtttttgtttatggctcttcccaaaatcgtacgaatctgtttttttttgtgaagacgaatctgtttttttttgtgaagacccatttatgaaaaataggccatgaacacgaagtttcctagaaagatgatagaggtgctatgatgacaatatatggactcattattcgatgttaccaattatagcaaaccttcttctagctagctttttctgtatttgacattgacccgtaatgaaaacttcatttattttctcgttttgttaatagccctgcatttcaaattcgacatgtttatgtaataaatttcacttacccaagttgcataaattttcaaacattttatgaagttttaaacgctataaaacatgttgaaaatcaagagtgacaccaaagaatcaagattagtatagaaatggtcacaactcacaaatgccatgaatgaatcatgatcattgatcaaccattaaccatattatggttgaattttccaataactaaaacattaccataaaagctctaaaacattaccataaaagctcaaatgtctgaataattatcttctcactagcacatgggctttcttgcaaacttaagaaacgttggcaccttttttaataacgatagactataaggggtcttttgaaattaagtaaaagatatg

SEQ ID NO: 787 - DNA, 3000 bp, Unknown
  misc_feature (1)..( 3000): cDNA_ID_2044958_gDNA_ID_1620320_Annot_ID_153291 3000 nt of promoter + ATG
atcattctttttcttttgctgctcataaaccgagttaaacagctttcattttttttttcctgaggtttctcaataactttgtgtttgcagttgcacgctttccgctgttgagaaattcaaatccggtgagatccctataagacctcctgcaaaagcttatgccaacactttaataaggggacttgtggaaggaggaagattatctaaagaagaagctgaggcttacatagacaaggctgtgtctaaacctctctagtgtataattatttactcagaaaccgcccgtttgaacacgatttggagcttcgggtttctgagttattcaattaggataaaaaccacaagtttaggaatattgtgagacctttgaatttgtcttttgaaagagaggactgtgtcctctgttagctgtgttgtgcttgctccctaagcaaactctcaatgtattttagttatcttcgggttttaggctttaccaagaagctgtattcggtaaatgtattaaagaaccctccaaactgctttatattgaccggagagaaacattcttattcttcggaatggtactttgaagtttgaagagttattttaaaaaaagatttaacagcactgtgaagagttctggtcaaacaaacctatttaaaaaaaagagattggaaaacatgtataaataaaaattgaaacgtaaaaatactttgaagcttcagaagcaaagattggaccatttctcttttttctccctgctcgtcgaacgatagactctctcatctcccgcatatggccatggccgacaaaaaatatggaaactgtgacggtaaagtcgccgggaaaagccagcaaggtacactagttgaaaaggagcaagtagataccgcttctacatcctggagaattgatctcgcaaaggttgacgtttggtatgcctcttacggatccaacatgtggaaaccgaggtttatttgctatattcaagggggacaagtaagtagccttgtttcgtttctttttggagtctgagcttgtgtcttaattgacacatctatggctgtttgtgtttattttcaggccgagggaatgataaaagcatgtgtcggttcaatggacaaaagtccaccaaaggaaataatgtggaaaacatttccacatcgattgttatttggccgtgaaacttcaatgttttggggtgtaggaggagttgcttacaccaatccccttactaatctcaatgatcaaactcacatgtgtttgtacagaatcacgttaagtttcttcatctccgtttccgagttttctcttttcatatatctgatcttttctacttattcattatatggttgttgttttcgtgatcaggcttgagcaattcaacgaccttctgtttcaagaaaatgagttgaacgtagattctgattatccgttctttgatctagctgctctgcggttagcagagaaggaaggatccatttcacttcaaactgcttcggttagtcagataacagatggttatttaataggaacatgtagtagtaatcacacttgacccctatattgacatatttttacaggatagtttgtatgggaatgttgtctgcttggggaaagaaggcgtcattcctatacttacattgacgtaagatttcatcattcgttattcctttgctagctcagaaacagagtacttaaactgctaagcggatgctctctttcaactttcatttttttctcaataactttgtgttttgcagttgcacgctttctgttgttgagaaattcaaatcgggtgagatccctataagacctcctgcaaaagcctatgccaacactttaataaggggacttgtgaaagggggaagattctctatagaagaagctgaggcttacatagacaatgctgcgtctaaacctctctagtgtattcaattaggattaaaaagaaaaataaatcacaggttaagaaatattgtgagacttttgattgtgtcttttgaaagagaggatgtgttgtgtgctttgaggttgctctactctctctgtatgtaatttagttatattttaagatattataatgaacattattacagttcacaaaatttggcataagaacgaaaatagaaatggaagaaaaattatgcaaacatttaaacatatttgagaatatttttcttgttcttataactattttgtaactaacttttaagttctgttattgtgtagtactcttgtaaaatatgtaaaacttaagagagggaaattaatttcttagtaaaattgggcaaactgatattaattgtttgtcaatttcattatacaatttttttttattttttttcagcaaccgtttgattaattatttaatgatcagatattttgggaatttaataatataagcttacagtattctcactaagttgccgtatcgtcgtcttttttgtcagctaagaagataataaaaattaaaacacagagccgttcgtttggctgattcgattgtaccaacttccgacaaagattccaccttttccgattgttcgatttcttagaccttgagcttctccattggttcatcgatcatttcttcaagcaaaagtctctcttttttctttgcaaatttcgcccaaaggaaaagggtacacgttgttacagctcctcaccttatctctgacggaaaaatcgaagctttctctgggttttgctcagtagtaattcgatttccgtatagttttggtacaaagtggaagggttttgggcattgctctgtggcctgattcctgcgtttttaggtctctccttgaggttgaattcgtttgggaattttcagataacatttctgcctgaaagtgcctgttaactctggttcgatagagtggggattgtttaaagccctgagctttcaacttctttcattggattggtgtttgaattggaatgaagaaggagagattgtactgttgtatttttgggttgctctcttgattcctcaaggcaagagaggacgaaatg

SEQ ID NO: 788 - DNA, 3000 bp, Unknown
  misc_feature (1)..( 3000): cDNA_ID_3058962_gDNA_ID_1620321_Annot_ID_153323 3000 nt of promoter + ATG
aaatactgtctctacgagggtgagaacaatctccagacacaaagacattcctttgcccatccacttctagccagctacatcccgctggctttttcatttcctttttcttcattaggtttctcaactccatcacgccttcccatttagcatctgcagcatacatattcgatattagaacgtggtttccggtgtcgtcagattcagcttgcaagagatgatttgcaactgagtgccccagatccatcctattataggttgtacacgcccttaacagtgttccccatatatttgcattaggttcaactggcatctgtgtgacaaaagaatatgcatcatcaagtcgaccccctcgagcaattagatctacagcacaagcatattgttccattgtaggtttcataccgtgaactgtccttattgagtcatatatttgcaatccatcctgtattaaccctgcatgacagcatgcagtcaacatagtagttatgaaaacatgatcgggctttatgtttgattcagtcatatgagagtagatcataagtgcttccttgcccctaccatgtacagcatacccagctaccatagcagtgaacataaccagatctctacgagcatctgactggaagacagaatatgcatgcttcaagctgccacatttagcatatacatctagtagagtccccttcaggcggatatcaccaagtccgcctctaataatatatccatgacattgtcttactagatgcagagaggctagctgcgcacaaacaggaaggagattcatgatagtcacagtgttaggcctcattcctcgagcttgaatctcacggaaaacaccaatggcttcattagggcaacaactttcagcatagatacgaaccatcaaactccaagtggtgagatcagtagtagacatctcagtgaagagcatctgagcatcatcatgacttccactattaacatatcctgataacaatgagttataggaaaccaaagttctcctctctgataaacccagaaaaatcttatgagcgtattcaacattaccacatttggcatatgcatcaagcaatgcattgccaagcttgggttcctcttcatcgtgtaaaagaccagccttaactgagtacccatgaacttcttttactttaccaattccctgtacatttatgcaaaactttagtaggcttaaaatagtaacagagtcaagagtgattgcttcattaagtaagtggtgcaagagattcaaaaattgaaactgctttggactgtctgcaaaggcatcaagtatagcattccaagatattatatccttcgtggacatcagtgaaaaggcccaatatgctgcacttgtgtcaccaaatcttgcatagaaactaatgagagcattcccaactgatgtatcctccaaaaggtaagaatggcgcaatatataactgtggatctctttcccagaggccaagtcagttaattgcgcacagacaggaaggatactgataatagttaccgaatcaggagaaacatcccccttatgcaccaagttgtgaaataactgaaatgctttaaaccactcacaatttgatgcataaccagctatgacaacattccatgaaactagatctttagaacccatcctggtaaacaatgaggctgcttcttctatccttccgactctcaaatagaaactaacaagtgaattacatacaaaaacatgggtttgcagccaagacctctgcacaacataactgtgaatctgtctaccacttcgacatgcaatgttcttgtccatagaagcgcaaacaggcaaaacatttgcaattgttgcataatttggctctgtaggttccttcagcattagacaaaacgatctaaatgcatcagccatcatattattctcagaaaacccagcaataatcgcattccaagagacaacatctttatcagctataccatcaaatgcagtataagcatcgggaaaaataaaaccaaatttggcatacatggaaaccaaagcattccccacaagtgtatctttctccaaaccggctttaataatataagaatgcatactcttcccattgtatgaatccccaaggcgaacacacaaaggaagaacaatcgcaaaggtaacagagctcggcttaggttcatctgcaaagtgcattgctttgaaaaacctcatcgtttcacgaccgcaagaaacagaaagtccagtcagaacaatattccaaacaacaggatcaagactgtccatttgcctaaacatcttctggcaatcatccattctcctgcatttcgcatacatgttaagaactgacttcgaaacctcagagcaggctatatgaccaagcttgaacacgcaaccgtgcagagccctccctgatgtgagatcagacactgaagcacaagctttgacaacatccagaaaaaccctgtgatcagttccaaaaccagacaaaagtctgaaattctgaacaaattgccgtaaagggcccatctttcccctgaatatcccaacaacggccctttattagcaaaaaatctacgttacattgggtcagacattttcacaaacacctgatatgcaagaacagtttctctagatataagcgttgtcgagatgtaacagacatagagaaactgaaaaagcaatatctttatcaagctcctcaatttatcaagcaatgaaggtgtctctcagtctccatctcctccacatacaagcgacagtttttgtcttgagtgaattgaaaattatgaatatatatggactattccgatttaattaaaactgaagggctaaaaaagaatatattaatttacttaggtccttacatgaaaatttactatttctattcttattcgaataattagaagaaaaaaaacaaattccataaatatatatatctttcgtcgactctgcttttacacatctctcacacggtaaagttacaataatctcagcttgaatcacactgacgaaggcatcttcctgcgatt

SEQ ID NO: 789 - DNA, 233 bp, Unknown
  misc_feature (1)..( 233): cDNA_ID_2126513_gDNA_ID_1620321_Annot_ID_153340 3000 nt of promoter + ATG
cttgttcagtttcattaaatttgtggtctaatttcggtttaattcacacaaaacaaattcgttattttaagaaaacagatttggatcgaatcgggtcgggtgggttagaatccgatggacaggcccaattggatacagtggcccagttacatagtctgtggctcaggatactttgaatttctctcaaaacagtagagagaggtgtagagagcttagacagtgccatggccatg

SEQ ID NO: 790 - DNA, 3000 bp, Unknown
  misc_feature (1)..( 3000): cDNA_ID_2126506_gDNA_ID_1620321_Annot_ID_153337 3000 nt of promoter + ATG
tccttgaaagcaaacggtttaaactttggaggattatcatctccggttagttccggtaaaggtccaacaatcttttcacggggaggctccaagaaaaccggccacgacatcctcgtcttctctttatccaccgtcgtcctatgcaacacatttttatacctcccattactcaacctctgcaaaattcacaaaaccaatccattaaaaacattttataaattaatctacatttttatacaagaatcataataaagttcagaccagaatctgatcgccgatgtgaacaatgacggcggagggaatatactctgcatcgaaccagtgatcatctttgaaaacttgaagtccaggaacttcgttaggaacaagaagagtgattccactgagatctgtatgagccggtacacctaaagctaaatccggccgaggacacggcggataatagttaatcttcatcatatactccgccatctctccgccgagaccttctttcaacgcatcacgctttaaccctaatccatccgagagaatccctaataacgtctccgatagcttcttcacatgcactgcatactcttcattcacctccctaatacattaaaccaacggttaacttcggtttacaaaatttgaatttttgatgattctgttttggtttacctgtattcaggtggattcttaggccagaatctgtaattgacgcatgacggtggccagattcgatggaagagatgatcgacccaagcttttttaccttctggatctttctgaagctttgttccgtatccttcaatgtctttcgaatcttccggtttagcgacggattctttctccgacgaaggaagctcgaagaattttcttccgacgtcttgtaaacgtcgtatcagctccgtcggaatcccgtggttaaccacttggaatagcccccattcttcactcgctttcaccaccgcgcgcctcacgctttcttcgtcgggatcgcttagatcgacgacgggaatcgccggcgttggacctcggaatgttgtgatcgctggttgttctttctctgatctgatgaactccaacgggattgcttctgttagtagagaagaagatgaaatgtcttggactctttcgacctccattattttttttggtagtttgcgttgccggaaacaatggcggatatgtaatttgggggatggtgttacgagtggttttaaggagggaggaagtgaggacgtggcgaaatcttggccgctggatagagacaactaccacataaagtacgtgttgatatgtgtaagtcgtcgaggcttcgtcactcacgagtttggtaccaagttttgatagatttatggatgaagaatttaattaatttgatttgttgttttgtggtggtagttttaagaaaaggaaaaaagtgatgttattatattttaggccataaaataccatatttgaaatagatattttagtacatatttttggcgggtgttcatgtaaacacaaataaatatcatcttgagtcgttgacaaaaacaaaaacaaaaacaacaaactttggttggccattctaattactgtaaagattttcttctgcatttcgattggtccatgaattttacacaggaaacattatttaatgacttggtttctagagtgggttatttgaagttttctttttttggtcaaacatcatttggaatttaatcaaataataatggtggagagttaaggctttaccattttaaatcgtaagcaatgaataaaatactggtttcaaatccaaccccatttaaagctaaagattcaaggcccatataacaagacaaggcccagttattgggctactatagaaaaaggaaaaactacagtatagggctctaaaacagcaacacctgtataaacaaaaaaaggaaaccgagtgctacttaagatataaaataacaaaaaaaaggtgagaggctaattcgcatattaagttttttttcccgtctttcccataaggaaggacgacgaccaaaaagagctgagagcgagagagagagagagagagcgaagagaaaaacgaagagagacggtgagatctcaacacttgtattctttccttgagagaccacctctctctctcgacgacgcgcattcccaatttcatacattctccgtaagatttttgattgagtctctctaatttcgttgtttataattctctccaatcgttttctttgttgtggcgggaacatcgatcctcttttcttctgcgattttgctttcttcgttgtgatttcgttgcattagcttcgaattttcgttccgttttgtttgttattgatgattgtgttcgtctcttctttgttacatgtgttgttatgcttttttgactgctttttgtgtgttttacttgtccgtttcgccttctggattctccgaaagtggcgcatgatagtgctttctttttctcgatctctcttgggtatgtgttttgattcctcggtttcgttttggttcctttgctctcaagtgtcaattttgtcccatggtttcagatcttttctaatttcgattgggattgcgatttttctagggtttagtgctatctcggtttcttctgcattgcttttcttaacatttttcattggcttttcttttttgcacatgatctcacaagtaccacttgcttttccataggctctgtcgaattcagtagaaattagaatcagctctaggcttgcatgcaatcatttgcattctgtgccacaaatttgtacgtttgctaagttttacttgaccgttgtgtcaccttaaacgccttatgggttgattttctgttctccatggtttacattttccgctttggaacaactgtgacgtcttgcttttgtatacaattcccttcttgcttggatgacctggttctacatttactaggatttcacattagtgaatatgagaatcacttatatagaccattcatttttgtctacactgcaggttggttttgccatttgaaggatg

SEQ ID NO: 791 - DNA, 3000 bp, Unknown
  misc_feature (1)..( 3000): cDNA_ID_2126482_gDNA_ID_1620321_Annot_ID_153330 3000 nt of promoter + ATG
ttcaagctttatatcacataccacttcgactccaggtaaagaaagtgtgaattcaaggtctaaggttttggaggaactgcaaaccttgcttcctgcttctgttataatcccagaaaagaggttggagtgtttagttgagaattcacttcatattcagcgggattcttgtgttttccataatactttggatagtgatttgtctttgtattctgatcatcaatgcgggaagcaccaaattccttctcagactgctcaggttagactaaacactctgctgtgaatgttacttccgtttccttcttgttgttgtatcgtttcttggtgatctgattcatgagtttgtcggtactataagagatttacatatctttagctgagatgtttacagtacaatgttctgcaaacgtttccacttccttgacaggtcattgagaaagatatagaagatgataattgtctcaatctgatgcctattttctttttcggttattccttttccatcattggctatgtagtacattcttttctttttgctgtcacctgtacccatgttcctctgattaactaattacttgtgtggcatctttttctggttgtagtttagtcagacttgcagtgcatgtgtgcttactgacttaaatcacattcgttaagttctctctacgtgaatggttcagatcttggagtcacataccgatgaagtttggttcttgcaattttcacataatggcaaatatttggcttcatcttccaaggatcaaaccgcaattatatgggaggtaattctgactgaccaattaaggcttgcctgaattgagttttggtaacctgttcaagttttgatttgttacctattccaattgaggcaacctgtttgctgattcacttagaatgtacttttcagatcagcgcagatgggcacatttcattgaagcatacacttgttggccaccacaaacccgtgattgccatcttatggagtcctgatgatcgtcaagttcttacatgtggagcagaagaggttatcagacgctgggatgttgattcaggagactgtgttcacatgtatgaaaaaggcggtatcagtcccatttcttgcggatggtatcctgatgggcaggggataatcgccgggatgacagaccgaagcatctgcatgtgggatttagatggtagagagaaggaatgctggaaaggtcagaggactcaaaaggtatcagatatagcaatgacggatgatggaaagtggctcgtaagtgtatgcaaagattccgtgatatcactatttgatagagaagctacagttgagagattaatagaagaggaagacatgattacctcgttctcgctttcgaatgacaacaaatatatcctggtaaacctcctcaaccaggaaatccgtctctggaatattgaaggtgaccccaagattgtgtcgagatacaaaggccacaagcgttcacgattcatcatcagatcatgctttggtgggtataaacaagctttcatcgctagcggaagcgaggactctcaggtaaaatccactcttttattcgcatagtatcatcacaatagcacatgaaaggaaatagctaaatcaaatggtgataatccagtctgttctctgaattattctgtgaattgggtagtggctgcttcattctacattttatcaatttagacagaacatgataattaataaatgatgaaattcgggtctctggtctcagaatctttgcagaacaaggaatttgtttgtttctttcttcgtttaatctatgcagttttaggatttacagtctagacaaaatgtaatcagtttagacagagcataaaccaaatatccactctgtttttcagtatcgaagaaaagttgctttgttatttagttgatccctctgcggcttttggtgacattggtccacaattctgttatgtgcaggtatatatatggcacagatctacagggaagttaatagttgagctaccaggccatgcaggagcagttaactgcgtgagctggagcccgacgaatctacacatgttggcttcagcaagcgatgatggaacaataaggatatggggacttgaccggattaaccaacaaaaccagaagaagaagctagtgcaaggaagtagcagtaatggtgtgattcaccgatgcaatgggaattgattatgataaaaaaaaaaggaatgaccttcttaaaactatttaacagttatgttgtttcttctttcttcatcagcctctttttgtttgcttcctttggtatggaaagcaaacgaaagaaggtaaaagctgtttttttttttcaaattctgaacccataagtggaaggaacaaaaaggaaaaagaaaatgcaatttgcaacataattcttctattgatgttacattgtacataaagtttgaatggtagcatttgcaattgcacttacctttgtttatctcagacttgtattgctcactggtcctactcactagttctaatattggcgttttaaccttcaattcaatgttcatgtctaaattcgttgatttgttatagttggcctacttaactgattgcatgtctacttaaatttgaagtgtccttttttccatcaataacctgcattatgcagatttcgatttagttgtttgtttgtgctttatggtagcaagttgcatttgaaacaatggtttcgatcggtaacacacattaatgcgattattcaagtaatttaccgatcagtaaaaatatttcctcaaacgaatttgaagttgaacaagaaaaaaaattcctattttatttaaaattaaaaaagaaaacaattgtgaaatttatatatttttccttcttaaatttgtccctttttttctttctatgacatacaagaggatcataaaagcaaagcaaaggattagttcaattgcaattctctaattcaaagtttggatccctaactgtaaaatccctaattcgagagagagagagagagagagagagagagaatg

SEQ ID NO: 792 - DNA, 3000 bp, Unknown
  misc_feature (1)..( 3000): cDNA_ID_3058947_gDNA_ID_1620321_Annot_ID_153334 3000 nt of promoter + ATG
tttctttttaccagaagcaagtcaccaactcaccaaggagtgttcttgaagaagaaataaagtaagagaaacagagagcatttttctttttaagctttgtcagactcttgacaagactgtgcctctttgacatgcttctcgtattcgtcttcatcatcttcttcctcttccacttcagcttcaacgtcctcttcctcttcttcatcagctcctgagcccgagcttttgacagcactagttgatggagctggattccttgcttctccaactatcttcattatgtcctctacgctttgaagagagaagcttgtgtctctcttgtaatacgccgcttgagccgactctagcagctcctttggcaaattcttcaagtaccacggatgattcttgatctccttaagtgtgattctctggcaagagtgttaccggcaacaatcagaactgcaagatatcttcctcacaagatatagctagaaatttgaaaccggaattgttaagttaccttagcagagttagtgacgaatatgcgagagagaagatgtttgcattcctgagatatgtgaacatagtccgggatcttgtattgtacagccattatgcgctgcagaataccatttgaattgtgatatcattgagacacttgataaataagatgagaagtaaatcagaattgttgaatggtggagttacctggattgttttcctgaagttttttggatcattagggtcctcaaacgggtaagctcccaccagcatcacataaagggttactccacatgaccacacatccgcgtgctacaaaaacgcagtcatatatatgagagccaaaaccagtgtatgtgctcttatgacaatcatggaaaaaatatcgattagcaccccgtcaaattttttaattaagaccccacttaaatcttattagaagtacaataacctgaaaagtttcacacagaccatgccactaaaaaagatatactagaaggactctatagcctggatctttgagcagtctataactttctatcctcatattttcccttgatgacattatttgcttactttgacaaccaatcaagcgttaatgacaaactgatatgtatgtataacaagacaaaaatactgtaccttgccatcatattctctccgtgaaagaacttcaggtgctatgtaagctggagttccaacagttgatttaggcctagaatgtagtatagatgactacaccatagaaatcaaattgaaaacatgacaaagatataagaatcaagagaggagtgaatagataatacttttgattaaagaacatgctaatctgttttggattgaagattgagaaaaactgagcaaagaaaagaaaagggaaatggataagtgcagaccttagagtaaccaaaatcacagattttcaaaagcggagcagggctcccatcgagcagtgtgttctcaagcttcaggtctctatgacatatttgctgcacagaagcaaaagagaggggaaggttacacaaggacagaggcattaaattccaaatctcaaacaaagactctgggaacaaaaacatcaatagtactccacgaatgcctcattaggcagcacataactttccttttcagcttaatgtatattctaagaactactatatacataccaaggaatggcagtaatcaacaccacaaatcagctgttgaaagaagtacctagcctgaaatgaataagatcaaaagcaaaaacttatacacacacataaataagatcacagaaaatgttgaagaaaatatatggatcaaagtgtatgactttacaaagagaaagcaacctcagcttcactaaatctaccggcagtacagattcgatcaaagagctctcctccagaagcatactccatcacaatagcaagatgagtaggtgtcaggatcacctagaaccgaatcaaaatcagatcccaagacagctcttagataaactataaagagccacacaaaaaagagacttgcctccttgaaccggatgatattaggatgtttaagtgatctgtgattaataatctctctcgccacgttctcatctatctgcaatccatgatcaatatataccaaacaatccaaaactaaattatcatcatcattttgatctgttgttatcaaaaccccaaatttctcaaattttcctacaaatgtatagcaaggagacttcaaataatgaatttgaacatacacactgagctaaaagtaaaaactttaaaccccaattcaaaacagaaagaacccaaaaatagtaagaacaaaaaggaaaaaaacaaaccttgcgacctctctcgatgtatttcatggcaacaagctctttggtgtccttgtgcctgagaaggcgagccacaccgaaatttccagctcccagatccttgacaacgtcatacttgtccatatttccaaatcaataccgtaaatggatagagttcgagtatatccgtagtttatctatctaatctacctataaaacgatttggatggggatctgagaaagagaagcgagttccattgataagaaatcgtgagatccaatacacacgcatgtgtgtataatatcgatgtaggaaggagtaaacgaagaagatggtggactggaccacgtggagtgtaatctgctagatttttcaattattaagctttgattgaaagtgaatccaacggttgtttcaattcttctcgaaatgacaaaattagcagaaattcgtttaatcatttaaattgcgtttagagaaataaatgtacaatattgatgtgtgttgtgggctctctcttaaatactacaaaccatttgactaatttggtcgtaacagatctagagtcaaaatcttctatagatatatattcgcaagactccatctttccaacagatctaatcttcttcacttcccaagtgtaaaaacctcaactttcagccaacaaaattagggtttcaagctgagattttctacttctgttacacaaaaatacccaatg

SEQ ID NO: 793 - DNA, 3000 bp, Unknown
  misc_feature (1)..( 3000): cDNA_ID_2126494_gDNA_ID_1620321_Annot_ID_153335 3000 nt of promoter + ATG
aagctttgcttataaaagattaagcttcaaaggtgttaaattaaacatacagaaatggagaaagccatctataattgattgaacaagatccaaagaaaagtatgtttcttttagctgttcagaatcataaatactcttctaacttctaaatcaccagatgatctacgtgagagagattcgtgctggactctgcagtgtaagaaaagccgcaagtaagtcaataacgaaggtatagaagattaacaatggtgccagatattctcgagatcacctgttttgtgaggaatgttccttgaggatatattgaactgagcctgatgttgtttattcctctgtgttgtgtattgaagaataacgattagtgttataagttaagttgggacatatttcgacaaactgaataagaatagtttgtggcagatgcttacaaattataaaactagcggaattcatcgtggaaaccataatcatcatcagtgtcatcttcatcgaaaatggcactgtagaagacgtatggatgctcaatcatctctgccaaagtcaaacgtctatctttgtctgaatccgcctggacgattagaaaaagaagagataaatcataaatgtaacatggaacaattcagcagctaaatacaccatttatttggaaagttatgtacctgtgatattatataatcagcttgttgctttgcataataatgctcagtaggatggattttactgataatgggaagcaattcaacgtctgataagtacctgtagataagtggcaattatgttaagggatgtatggtattaatggaaatgctaatcatggtgtgtactcgtatattacgaacccgtcatcatttttgtcaagctgagaaaacaactgctttgctgggccttcaggcaagtcatggtaaggatgcgtagaattgtgattgtcttcttcgtagttccttacagtgtcaaagaggccgtggaaaaactcttcgaaactgatcttcccatctttatctgaatccctttctctgggagagggaaggaggggaatccgttgataaacattaagctaaaagaaaggttcctcggaaataatcatatgacaaccgtacattaccttacttcctccttgcataaccataacagtaactttgggttcttggtgtcagcaggatgcagaaagctaagggaattaaccagcaaaaacattgtgagaaatagaaagaaaaaataactgatagtactaaaaacctgaaatagctcggttgatttctatctacactagaagaaaacgcttactcgttaaactctgttaaattcagaagaccatcaccatttgcatctgatgcattaaaatgctcctccttccaccagcccatatcatagccaaacgaattattatctgttaaatttataaccaagtcagctagcagtcctaagagacaaaagtgagatcatttgcttaaaatcgcaatcaaactgtggtccagaataaggaaaggattattatataggtcataggcagaagagctagaagtgaaacacagattaaagcaaatctacttacaagactgtcatcaaatatttctacatggtcatattaagtagcaaacattttagtcaatgaaactcaaagacgaacaggaaacagcagctcacccgacttacggacccaagacggtggttcatattcagagaaagaaataaaaccatctttgtttctatcatgaacatccaggtctcgttgagttctgtgcacaacttccttggcagaagactgcatagtccactcagtcaattcactctccgtcataaacccatcagcaggagaaacatcaatcttcggaaacaacaatatcagcctgcaaagtaccatagcaatcaaactcattccttacaaaaatgacatctttagtaaatgctaaactaaaatcttcaaagatccaaactttgaaggaaattgaagtacacattgttgcaattagcgctcaaaatcaaagattgggaactgaagatatatataagtataaccaaacctatcagtgacattgaacttctcctcatcatttaagtaatcctcagcatccatgaattcttcccactcaggctgcgactcgtgaccaggtgcatgttcatgtccaccaccggttgtttctttctgagaatgagagacaagctccgggtgagaatgctcaatgtactgtcgctcccactccttatcctcgcggcggcgctccatgtcggcgacaagaggatcaaacggaactggatcgtgacgagtgggtttgaaattgaaagaagaccggagttttaagcggtgatgttgattgtgaccaccatggtggtgatcgtggtcacccttcttcttcggtgaataagagacgaggaagagcaccaggattcctaccgtaatgtataggatcaccgaagctttactcattgggtatttttgtgtaacagaagtagaaaatctcagcttgaaaccctaattttgttggctgaaagttgaggtttttacacttgggaagtgaagaagattagatctgttggaaagatggagtcttgcgaatatatatctatagaagattttgactctagatctgttacgaccaaattagtcaaatggtttgtagtatttaagagagagcccacaacacacatcaatattgtacatttatttctctaaacgcaatttaaatgattaaacgaatttctgctaattttgtcatttcgagaagaattgaaacaaccgttggattcactttcaatcaaagcttaataattgaaaaatctagcagattacactccacgtggtccagtccaccatcttcttcgtttactccttcctacatcgatattatacacacatgcgtgtgtattggatctcacgatttcttatcaatggaactcgcttctctttctcagatccccatccaaatcgttttataggtagattagatagataaactacggatatactcgaactctatccatttacggtattgatttggaaat

SEQ ID NO: 794 - DNA, 3000 bp, Unknown
  misc_feature (1)..( 3000): cDNA_ID_3058943_gDNA_ID_1620321_Annot_ID_153336 3000 nt of promoter + ATG
taataattgaaaaatctagcagattacactccacgtggtccagtccaccatcttcttcgtttactccttcctacatcgatattatacacacatgcgtgtgtattggatctcacgatttcttatcaatggaactcgcttctctttctcagatccccatccaaatcgttttataggtagattagatagataaactacggatatactcgaactctatccatttacggtattgatttggaaatatggacaagtatgacgttgtcaaggatctgggagctggaaatttcggtgtggctcgccttctcaggcacaaggacaccaaagagcttgttgccatgaaatacatcgagagaggtcgcaaggtttgtttttttcctttttgttcttactatttttgggttctttctgttttgaattggggtttaaagtttttacttttagctcagtgtgtatgttcaaattcattatttgaagtctccttgctatacatttgtaggaaaatttgagaaatttggggttttgataacaacagatcaaaatgatgatgataatttagttttggattgtttggtatatattgatcatggattgcagatagatgagaacgtggcgagagagattattaatcacagatcacttaaacatcctaatatcatccggttcaaggaggcaagtctcttttttgtgtggctctttatagtttatctaagagctgtcttgggatctgattttgattcggttctaggtgatcctgacacctactcatcttgctattgtgatggagtatgcttctggaggagagctctttgatcgaatctgtactgccggtagatttagtgaagctgaggttgctttctctttgtaaagtcatacactttgatccatatattttcttcaacattttctgtgatcttatttatgtgtgtgtataagtttttgcttttgatcttattcatttcaggctaggtacttctttcaacagctgatttgtggtgttgattactgccattccttggtatgtatatagtagttcttagaatatacattaagctgaaaaggaaagttatgtgctgcctaatgaggcattcgtggagtactattgatgtttttgttcccagagtctttgtttgagatttggaatttaatgcctctgtccttgtgtaaccttcccctctcttttgcttctgtgcagcaaatatgtcatagagacctgaagcttgagaacacactgctcgatgggagccctgctccgcttttgaaaatctgtgattttggttactctaaggtctgcacttatccatttcccttttcttttctttgctcagtttttctcaatcttcaatccaaaacagattagcatgttctttaatcaaaagtattatctattcactcctctcttgattcttatatctttgtcatgttttcaatttgatttctatggtgtagtcatctatactacattctaggcctaaatcaactgttggaactccagcttacatagcacctgaagttctttcacggagagaatatgatggcaaggtacagtatttttgtcttgttatacatacatatcagtttgtcattaacgcttgattggttgtcaaagtaagcaaataatgtcatcaagggaaaatatgaggatagaaagttatagactgctcaaagatccaggctatagagtccttctagtatatcttttttagtggcatggtctgtgtgaaacttttcaggttattgtacttctaataagatttaagtggggtcttaattaaaaaatttgacggggtgctaatcgatattttttccatgattgtcataagagcacatacactggttttggctctcatatatatgactgcgtttttgtagcacgcggatgtgtggtcatgtggagtaaccctttatgtgatgctggtgggagcttacccgtttgaggaccctaatgatccaaaaaacttcaggaaaacaatccaggtaactccaccattcaacaattctgatttacttctcatcttatttatcaagtgtctcaatgatatcacaattcaaatggtattctgcagcgcataatggctgtacaatacaagatcccggactatgttcacatatctcaggaatgcaaacatcttctctctcgcatattcgtcactaactctgctaaggtaacttaacaattccggtttcaaatttctagctatatcttgtgaggaagatatcttgcagttctgattgttgccggtaacactcttgccagagaatcacacttaaggagatcaagaatcatccgtggtacttgaagaatttgccaaaggagctgctagagtcggctcaagcggcgtattacaagagagacacaagcttctctcttcaaagcgtagaggacataatgaagatagttggagaagcaaggaatccagctccatcaactagtgctgtcaaaagctcgggctcaggagctgatgaagaagaggaagaggacgttgaagctgaagtggaagaggaagaagatgatgaagacgaatacgagaagcatgtcaaagaggcacagtcttgtcaagagtctgacaaagcttaaaaagaaaaatgctctctgtttctcttactttatttcttcttcaagaacactccttggtgagttggtgacttgcttctggtaaaaagaaaaacacatttgtcaaagccaaaggctgtaaactacgtgctggttgtttcacttttagattgatgtcgttgtactgagtaatgagcatgaaacagaaggtttatattattatatgatactatactataggttttcgtctttgtgatgatgatttcagttcacctataaaatccgaataaaccgaatctgaacaagatttataaaccgaaaatctgaaaaaccgaaaagaacgaaccggatactaaccgaaaccgggatttgaacacttaaggttaagggtcgagaaaccctacgaaagtgtatctctctcaatctcgacaggtttcaaaacagagacagtc

SEQ ID NO: 795 - DNA, 3000 bp, Unknown
  misc_feature (1)..( 3000): cDNA_ID_2106908_gDNA_ID_1620321_Annot_ID_153333 3000 nt of promoter + ATG
gaaaaaaaaatgttatcatcagaagtttgtatatgaaaacccggaaagaaaaaagcttctccaaagactggtccgccacgtatgacgtatcgtttgtgattccgttggtagaatcgtaatgcaaaattatccaaacacgacaaagacgatacacacgaatttgcttgaacaataataaacaaggttctttgaagaaaagaaagtaataaactatgcacggcactaggagtagaaatgattgaaaccctttaacaaattgaactcatcttgttgccgaagttatacagataacgtatggaatatgaatgggtttgcgattattagtttattggactttcaggccctttttagagaaaattagtttcctcctcccgaaatagtcctgcattatggaccacattatgggcccatattgaggcccaccttaatggtacttatatactattttgtacggaactgattgatagacattagacacggagacattgttgtcgttcttcgcagacatttcgattttgaagacaaatcacaatgggagaagcgcctgcccagattccgacgagtttcggccacgagcttagggcttgtcttcgatgccgcctcgtcaagacctacgatcaggtctggattctcttgtcacttgtgatttgcgtgtttcttctcttgcgaatattttttgcctaatctggtttctccaacagtttagggattctggatgcgagaactgtcctttcttcaaaatagaagacgatcatgaacgcatcgtcgatgttacaactcccaacttcaatgggtatggcttaaattcgaatccttactttgaaaatttacatggcactgttcataagtctgtctctcgtacttgtcgttacattgaaatttctgaacctagtctatacttatgattaaatcgtatagtctatacttattgagaagacttattgttggtcgctaatctctcgtttttttgttgaatgagtcgttgcaaattgtgaaatcactgtggtggatatgaccataaagtttgctgctttacgttaaaatgagttaatagtaacagagatgatgctagtgttgattatacttgtcatttgttgatgtcacgtccatgtaattatgtattgatataatgaatgtttttgcagtataatctctatgatggatccacgcagaagttgggcagcaagatggttaagaattggtatgtttcagctctgtttcctgatcatcctcattgtcttttagagtttactatactgtgtagcttcttctttccgtttcctgttattcttgtctcaccattatactttataaatggggatattagtgctgaatttaactgtgttgtctgcatccatttgagcggtagctgcattctgatttgctgtgtgtttatggcttgatgacctgatgttgtattccctaatattgccagctttgtttcagacagaagagaaataaatctaacacattgcaatatcttgtttccagggaagtttgctcctggttgctacactcttgctgtctcagaggcactcccagaggaaatgcaggtaaacatatttacttctcttagaaacctaagaagggattaataagcaaatccttagctctgttttcgtattgactgttcgtctttttcacatgtatgtggcggaaatccgctggcagttcatatgccaacaagcacgggtgcagtacgttccacccaaacgtatttgaaaccttttgcaggttgcagcaagtgtctccatattagcatctctgcaagtcgtcagtttcaagacaacttagtccgatggaggttatgaatggaagtagttaagttttatgtactttgtttctgatttcaactaatatagagagatttgatcctcttattgttatcaaaaactcttatttgatccggaagatagagatagattacattttttttttcaagtatggaatggatttcttttcctgtgatattcagtacattatttgaattacaaaatgaagaaactttaaattgagcacctagcagaaatgtgtggtaccaataattcacagaaaaaatgtcaactacgcagttgatagaagaagtggctccttaatcaggccaagagggaaacaaggagagatatttattggtttttggaatatgaccattgaaattcccaaagaaccgaagaaaactatgggaaaatgtataaaatgcctgtctttataccaaaaaaatataagacccacaaattcatggatacaaagtacaaacaaacaaattatacacaagaatcatcttccgatccaaggtatattcttctgctagagtaaatcatggacgtaacatgcataattaacaatggttacttaacaacaagtagtaatgaaaaattgaagacgttcagtctatttgggcaagaggcaaatattaattttcgttactatacgtttattttcttggcaatttagtttaattttgtttaggtcaaaggcaatttattttgttattaaaaagataaattagatttttttagaaaatagcctttctatattaattttaaattcgagttcacgtggcggtcgctaccaaacttcgctaaactttagtgctttactccaaaacccagagtccatcacacaagtccaagcccgaaaacaagggttcttgctccgacacgacaacaaatccagattttgagcttaggtaaactcctaactccccttatactctcttcttattcaatctaccttgtttctatgccttgaatccaattcccagacactctggttgcttgtaatctatgttcggttgagagtgaatctgtgttcgatcgtgtgtattaatacctccttctttggttcggacatggatctctgtctataaataacgggaaatctagactttaagtatacgaatttgagaaatttcgattctttcgcttgttttgttgatgggtgtgagtttttatgcttaaattctttttcgttgcagggaaacttgagaaggagaaaaaa

SEQ ID NO: 796 - DNA, 3000 bp, Unknown
  misc_feature (1)..( 3000): cDNA_ID_3058958_gDNA_ID_1620321_Annot_ID_153326 3000 nt of promoter + ATG
aatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaagtaccttgttaaccagaggtttgcatctccagtccttgctcttttaatcttctgttgcaaacttaaaagctgaggtctagagtttacgcagccttttagaatgtatttgtgacaaggtagactgctctgtatctaatttctttgggcatttcaagaacttgagccgtaatgaacagttagtttccgtaactatctttctgctctatccctgtcttacaaaattgatgtttttgcagggagtttgctattattctccatggaaataaaatctgaatgaacaactagtaacggttttgggatgcaaagctacttcagaaggagaagaaggtaatgtaatttgtttgaatggttaatgttaaaactctcttaaagttgtatcagaaagagcgcgatttgctcttttgcattactctactttctttattgtttgcttgttatgtttattcgagtatgaaagcacattttgggaacaaccaaagaaacccttttcatgtttgaaataaagaatgctcctttttgggtttataagtagttcacatagcaaataaattataaatcaatgtttctttttggcattttctgaaaaatatctctaggatataaattggtatatcattgttctgtatacaacttgatatgatagtccaaaattagtttttttggataatgtataaccaaaatgtgattagtcccaacttgatttcgtaaaatcaaacaaagtagaaatcatcttaaaactataaactagaaatttctaaatggaataacttaaagaataaaatgaaatggaagtgatatatatattcgcattgaaatggagaaagagagaaaaaggaaaagagataaatgaaggcaaggaagacctgtgagggtgatggggaccggtctgattggatattatttttggaggatatttatggataagacgtcaacatcttccctaacttctttgtccacctctcccacctttttccccccttttccaatttctttacttaatcgatagaactactgaatcaacaagttgttgtatgatgaaattacataatcacatatttgcataactcggaaagtcgtcatataggcaattagcatctttgttgttttcgattttcgatatgagcttaagtttgaacaatgtttacaaatagtttgatatagtatttcattgccttttataatcaccgtacaaataattattattcatcaatgattgcctccccaaatgtcaccaaaagaaaaatctagtcacatgcgaaagcattatgaaagtgaaaaaagaaaaaactgatatgaaattaccaacgatgaggagtagcagtaataaaatacatatggcataatttggtcaacaaggaaattccaatatgaattggaagtgtaacaaataataaaagagtcaacaataccaaaaataacaacagcggacttgagctgtgaaaactgttgcttatggtttttattcactgtttctttgttttgaacttccccttcctttaacaatggcgttttgacccctccctatctctctctctctctctctcagtcttctgggtttttcctattcctctttctctctctctccttcaagttgctgcaatcccttgaaaacccaataaacccccaattttccatttctcataaagttcacatttttccttcttcttcttctgccaattctctgattccctcgtttcaatctccgttttgctttgcctatcagataaatttcttcttgctttcctttctatctcataacgataagttgaattaatctttgcgtcttagttcatcagtagagagagtagggttttttccgcttatttttagggaatttcattttgttggaggtgagaatctctattcgagtccccaagattctctttatatccctagtttagttgtatggttgggttttgattggaatatcaaggggtagtttttagctaggttcactgatacttggaagatctgagttctttgggattctgttaagtttgtggagatctaaaagacacgaaatttgtagaaatctggttgatatcccagacttttagagggattagggtagattctatagaatttgaggcgggtttgattggaattatg

SEQ ID NO: 797 - DNA, 3000 bp, Unknown
  misc_feature (1)..( 3000): cDNA_ID_2045084_gDNA_ID_1620322_Annot_ID_153354 3000 nt of promoter + ATG
caaatctccagcttaattaatttgtacaaccatttatgaaaataagagaaattaagaattagaaaaattcatctaaaagtagataaatttcctgataataatttaagagtaggaattcaagtaaatggttgtacaatagttgaaaaattcatctaaaagtagaaaaattcatctaaaagtagatgtaaaaattcatctaaaagtaggagtatatgaatcgtagtatatatttttaaaaatttaaacactttgtacgtaattggttaaaatttcatgacttcagatacatttcctgataataatttaagagtaggaatttaagtaatccgaattaaaaggatacaaaacgaatgtaatgaatgattatgttcacatgataaaatgaaaattttgtgtctcttgaaaaatgcatacgatatgcaatttccctttctttcttttgttcttttctctctaattttacgttttataatttctattagttattaaatgtagtaaaacaaaaaaaaccaaagggtaggtaaagaggctaatatataacgtgagagtagatttgctattctctcattaccctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcaggtactcacaaaatttacattttcttctgttaaatttataaaaagtatattgttaattttacttgattatagaaacaagctatatgaacgatgttatgtatatatgttaagacatgcatgcatgatgatataaaccgctctatgaaacagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaaggtaaattaatcatttcgaaatagtaatactgttcatatttttttcttttcgaaatagttttattacctcatttgctcaacatacatgaaaataaatattataattaatgcttaatttggtatatttcgtagatgtataattagtatactaaatttagtatatagcatatatatatcgaatctaatatcatatagttcttaccatatgcatgctggtgttatccaatgtcacatatacatagatatgtacgtacactcatttctcatatttcatatattagtgtgtatatatatatatatatatatgtatatgtatcttggtcataaaaaaaaaaaaggaatcttggtcatatatatatgaattataatacttagataggtcatagattatggtaaataaattattaaattattccatattttggaatgagtaacgcatgcatacgatattttgggaaaaagacgttttggtctttagatttgaccatttactgtgtatttttttgggtaaattagtattatttaattactttgactaacattaattaccaaaatgtgctctattgatcacaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttgtgagttttgtgtaatggtcttaaggtttttgtttttcttgtatgaattgctgaaagcttttgtgtttggttttgcagatttagaagatattgaaaagcaaatgttatggtgctatggataaatattaatataataataaaagatttctgcgatttatttagttattaattatataagaatttcatttcttatcttttaaatttatgaacaatttacaggacatttacattttcgagactttgaaaaataaagaatgaaattaagttacagctttatttaagtttgtttccaatgtaatatgttcatttgtgcatttctattttctttcttttctgaatatatagcttatctagtatgtcattaaaaaatgttaattcttttatatatgtattcataatatttttcattataaaaaaaaggaagatattcattcatgtgagaaaataaatgggccattgctcctagttttgggcttttgggctttttcttagtttcttaatgtgtttgggccattgctcctggttttgggccaatattgagatatcctgagcctaacttatttaggcccattaagaacccattctattttgtgcgtgtatgttacgctgtgttctctcgttcaatcattttcttctctcatttccaaaatctagaaaccctagagcaaaaagtgatctc

SEQ ID NO: 798 - DNA, 3000 bp, Unknown
  misc_feature (1)..( 3000): cDNA_ID_2044985_gDNA_ID_1620322_Annot_ID_153382 3000 nt of promoter + ATG
tattcagatagttctgaggcttcgagatgatgttttaagggatagagagactggttccaggaatcaacctcctgcaagatctgagaataacaatttcttctcttcaagtagtagtaatactggtcttgcacttcctcaatctttcatgtcttctgttccgcaagttgcttctgtagatttcaataggagaccagaaaccgggagcagcatgagcatgcttccttcgagtggtggaatctatggttatggaagttttccggtaacatttccttcttctgctcaaaatggatgatctcagtttctgtgtttataacttaagtttttctaactacaggtgggcaatacaagttatggatccaactcctcttactcatccaatctatatggagggtaagtttgcaagttagtttcgtttgttcagtattatattttcaactcttttccctgttgattatcttgtgaattcacagattgcctcagtctactactatggaggttcgaatcccagcaaatgcagtgggtaaagttatgggcagaggaggaggcaacttggacaacataagaagggtttgtttaatttttatttttatttttccttcctcattactctctgattgccatagcttcattcgtctcttcttccctctttcctatataacattttcacatggtatgtgccctctctctctctctctctctcagatatcaggagccatgatagaaatttctgattccaaaaattcccatggcggtcgcgttgctctcatttccgggacatctgaacagaagcgtaccgcagagaacttgttccaagcttttatcatgtccacttgaataatttgctctgccccttaatccttttccatggaagtgtgttccatcaatctacctctcagtggatttctttgatcgggtttctcaggctttcctccttccatcaagctcatgtttagatatggttgcatctctcatcaaacatttcggtatctcatctcgactcagttacttttggtttctcgtgctagacattttatagtctttcaggaccattcttttcccctttccttgcgagctgttcgtactataactacttatctccgtgcaataaaacaaaatcgttcttatatcaatcaaactttgcttattctccatatgtggaatcagatctgctttgttcttagtccaaagcagcagtcctatcagttatgtgttagtttaccgactctgcaaatcccacttctcagcttcttatgtgatgccaagtgatactcaccatatcatagttcttggtgtttctgtataaatttctgcagtgaacagccataggttattatagcatagtgatcttcaagaacagtagcctttagatctcctcttgttaatgatcgtatttgtttctgcttcttagaagtttgaacttgttagtgctttgatcttacgatctgattatttgaaactccatcggtttatcagagtatcagtagaggaatttctcattcttgatgatcatcccattctctgctacgattttactatctttaggtcaaactccactgattgatcttctttatcttagcctctgttaccatttctgatttattctcttcccagataagctccccggaactctgatcatctatattaaacttaaatcatgatcttatagtgcttgtagcatatttagaacctgccaggctgcgacaagcttttgtgaatgttatgtgttttctggccattcccacatattaggttgtctctccatgaaaattagcatttgtcaaaaagattttctgattatgctagcgtttgcgctcgaacacttcgggcttgggatttgtcctataaagctgaggttccacaacatactaggctgtcaaaaaccagccacaatatagttttttgcggtttgatgatttctctgataagcctgacactcggcgctggctaggttggcaccgtaggattgttgcattagaaccacaatacttacttcttcaaacggttttctgattctgctgtgttttggcttcagcgtttgctctattcccttgagagtggcatttagttgacaaacccaaaatactaggtttttggaaacccacaacatttctatatactgtttctggtttagcttttgcggttgaagcctaacattctaacacatcccgggattttaagcgggtgtgttgatctttagcagatcctatattcctatttcgtaaaaaatgggtttcacgagtgtgatgaataatagtttagttgttgcaattgtatagtaccttgagcatcgttttgatcaaaagaccactgaagataagtttcttagtagaaagattgatgttgatccatttggaaggttttgtatcatatatggtcatgtagtagtttacgttacgcaactttaaagtgcttttccatttttctaatataaatgtgaatttcgatcaagtgtttaccaagttcaattcttctaatctctctattgcatatcacataagtaattaaagtatagcattaaataggaagaaaaaaaaaaaaaagagattatggggaagtcttggattaacttaggagagaaaaacaacatttgacaatttgtaattttcaaactcatgttataaagcaaaaaggttcacttatatccgatttttttaatatacttggaattattcgaataacctagattgtaagctagaatttgagaaataaatttcccatatttggttaatgaaaaaataaaataaaaaattcccatattgaaaattgagtctaaaagtagaataaagttacaacattgttcaaccaaaaagaaaaaccgaaatcaaaccgtaaataaattttataccatatttttagtattcggataaaatttgcccatcccgagaaagtcagaaaacgatcattttctaggaaaacgaacgaacagaggacaaatatattagataaacagagggaaacaagaacaaaaacgtttgcttcattctctgaaagactctaatg

SEQ ID NO: 799 - DNA, 3000 bp, Unknown
  misc_feature (1)..( 3000): cDNA_ID_3058993_gDNA_ID_1620322_Annot_ID_153379 3000 nt of promoter + ATG
tcccgacggttacttgaaagctgttagagaactctgcacaaaatacaatgttttgatgatagcggatgaagtacaaagcggtctggctagatccgggaagatgctagcttgtgattgggaagaaattcgtcctgacatggtggtatgttcttttacattttctaagctctttatttcattttcttaacggtttcctccgtgagcaaagcatcttgacactgttttctgaaagatacttgggaaagcattaggtggaggagtaattccagtaagtgcagtgcttgctgataaagacgtgatgcttcatataaaacctggtcaacacggaaggttcgtattcattactctgctcttttgttgacctgaattagcatatagtggtttgactgctattaagcttcttcttttttctgtttgtgaaatcagcacatttggtggtaaccctttagctagtgctgtagctatggcttctttagacgttatcgtggaagaaaaactcgttgaaaggtacagttttgctttctatatcgattcaggttctttagattaaaatattaagttcacgttttggtttgaatctatagatcagcaagtcttggagaggaactgaggattcaattgaatgaaatcaagaaacagtttccgaagtacataaaggaagtacgaggaagaggcttgtttaatgcgattgagttcaatagcgaaagcttgtccccggtttcagcttacgatatttgcttgagcttgaaggagagaggagtcttggctaaacctactcacaacactattgtccggttaactccaccactctctataaggtaaattagaaacaactgaaccggtttggtttatttagtagcttatcataggtttcttggttgaatcaattattggttttctttcttttgccagctctgatgaactccgagatggatctgaggctcttcacgatgtactcgagctcgatcttccaaatctgctgaaaatcaattccggtaaaactccggtttctcatataaccgagtgtgatcgctgtggaagaaacctctatgcttgaaccggtttgaaacttgattaggttctggtataattagattctttgtatcttgtgatttccataggacacagcaccggtttggtataagaaatatattaaagtataaggccgaaccggattctaccgagcttggtagaaataactctggtttatttctggtttggcattaaataaaaccaacataaaataatatgatgcctgttttcataggtgttatacatgatatctcaattaacaaataaatgttacataacaatatgtatggaagtatggatgtactaatttatacgtacacgtgttggcatgtgtagatagatattgatatggaacatgaaatcatgaataaacatatgcgtgtcttctataattgctcaacccaaacatgttgaggcgtgaaaccccatatgattggttggctctctaatatttaaattacattatcataacctgatttaaaacaacaaatacatatttaaataactatctgaaacatgtaaattatataccacactaatggcctcatgatctcgatttctttctaaatctagtgaaagaatattactcatttcttgttgtcaaaatgcaataaaactatttagagggaagaaacttagatgtttcgttgatgaatctgcatttaatagtcacatgtgtctccattgtatcctactatcattttgcaactaagtcaaatataattaaggaaaacgccgaggcgtgcgaaatgggaaaacacacatgacacaacgtgcatgtttatcgcaaaatcaacacatgacttgtctagtcactagtgcattatgcatatcttctagtattttatgattaaggataatgaagttcggtagaatatgcaatggtggactaaactaagtttgatagtaaccggttgcataaagaagatattatggacatataatattcatttagttactaataattttaaaattacatatataaatttcaagtacaatcggggatgtgcctttagtcaagtggttacgttcatctgactctgttttttccatcggaatttgactccactaaatcgcattatcccacacaataggaagtgattatggatcgggccttgtcgatccaaaaataaaaaaaataaaaaattcaagtacaatctttttacttaagtaatataagtatgctttttttttttaaaaataacaaaaagataagcttttttctaagcatataaaataaaatcttagaaaacaaaattcatgtatttaaaagattaacttcatatagattttataaagaattatttgttttcttttgcgtataatacacaagtttaagcaccgagaatgtaatacatgtgttaatcttaggctaagaaaatgtacaaagtgatacatacaatcttgtgtcaactttgtaaattccttttgtaaacaatgaaattgaaatgtgtctctaataataaagctcatttagaaggagaaaaatataaattactctttagaaacttataatccgtttatgtataacaaaatatcacctacttactatttgtaaatattgttttcctcctatgaatgagtctagcattaggcaaatccaattcactctcatgtggtacagctacctataaatttcattgtctatttttatcaaaataacgataaatacatttttggcaatgtatacaaaaataaaactaaaataattgtcacatcaattgttcattacagaaagaaaaaaaaacagtccacgcgatacacgcgctcatattttttaatacacgcgctttaaagtagagacaaaacctcgtggatctatctcctccgaccatttgatttcttcctctcttctctctagaaacatctttcatgcgttatcttctccaaaagctctgattctgattctgaatcatcctgaaaaaaacctagaaaaattctatcccacaaaatcttcaaagatccatg

SEQ ID NO: 800 - DNA, 3000 bp, Unknown
  misc_feature (1)..( 3000): cDNA_ID_2045052_gDNA_ID_1620322_Annot_ID_153363 3000 nt of promoter + ATG
tctttggagcgttatacacattagcaatcggtacaggcggtacgaaaccgaacatatcaacaataggagctgatcaattcgatgtattcgacccaaaggagaagactcaaaaactatcattcttcaactggtggatgtttagtatcttctttggtactctcttcgccaacactgttcttgtctatgttcaagataatgttggctggaccttgggttatggacttccaacattaggtttggctatttccattaccattttcttgttgggcactccgttttaccgccataaacttcccactggaagcccattcaccaagatggctcgagtcatcgtggcttcatttcgcaaagccaatgcaccaatgacgcatgacatcacgagcttccatgagctgccttctcttgaatatgagcggaaaggcgcctttccgatccaccctactccaagtttacggtaatgtgtatatttatttagtataatctcaatctaaattcatattatatcctaagtatatcagaaagtacctaacatgcaactatgatgcagattcttagacagagcttcactcaaaacaggaacaaatcataaatggaatctttgtactaccacagaagttgaagaaacaaaacaaatgctgagaatgttaccagtcttgttcataactttcgtcccaagtatgatgcttgcacaaatcaacacattgtttgtgaaacaaggaaccactctagaccgaaaggttaccggatctttcagcatcccaccagcgagtctctccggatttgtcacactctcaatgcttatttccatagtcttgtatgaccgagttttcgtcaagataacccgaaaattcactggtaatccaagaggcattactttgcttcaacgaatgggaattggtcttatctttcatatcctcatcatgatcgtcgcatctgtcactgaaaggtattattcttaacgaaaaagaaatatcaaataattttcttgtgttgcattagtttacttaaacttctttatttggtatttatgtaacaggtatagactcaaagtcgctgctgatcatggtctcatccaccaaaccggagtaaaactaccattaaccatctttgctttgcttccacaattcgtcctaatgggtatggctgattcgttcttagaagttgcaaagcttgagtttttctacgatcaagctcccgagagcatgaaaagcctcgggacatcatattcgacaacgagtttggcgattgggaatttcatgagcagtttcttgttatctacggtatctgagataacaaagaaacgaggaagaggatggattttgaacaaccttaatgagtctaggttggattactattacctgttctttgcggtacttaatctggttaacttcgttttgttcttggtcgtggttaagttttatgtttatagagctgaggttactgattcggttgatgtgaaagaggtggaaatgaaagagactgaataacaaataatgaataatatagatttctctatatcagtaacttttattcatggactttgttaagtaatttatatcttccacaactaggatggaattgttagcagaacatccgaagctgagaattgttggtaattaactcacagtaatgtctagataattaatatagatgagcttgcagataattcgacatggcagcaaccaaacttgttttgcaacacgttgatccaccataaaccgatccaattggacccatactagagataacctttcttccacgcttgccccaaatccttgcaacacgttgatccaccacaaaccgatccaagtcaaacccggatccaagtctgtttgaattaagcaaatgggttggcttttttacacaaacaaaaaggtaaaaaaaggagtcgtttaagcttatcctttttttctttctaattgattcgatttcattagaacggataatttttaaatagattaccaacaacaagtcaaacaacacatgtcgtccaatgttttgttggtaggcacacatgtcgcccaatattaaaaaagattaagaaattcctttccattttatttgaaaattttaccaaaaaagagaaacaaattaagaatttaagaagtatattcttaattcaaaataactaatttagtaagaaactgttacattgccacttgccaccatctgtaaataattctcattttggtattacatgttattgtagaaagaaatattttcatttcatgatgtggcattaaatatgtagaaaactcattttgggatagattttttaatactaaaatttacttttatttaggtacaattcttttctttcttaaggccggaaggatatgcttatgatctatattttattttttaaggataaattttgatattatctatttttcatgtttttatttcatctatcttatataaaacgaattttagataagaaattgtatctttaaccacattttgaactcaaggaaagaatagtaattaatacattaacacttgtaaataattaaacaaaaacaattgatgaaagagtgtttcaagctttcaatttgtgcctgatatacgatttgttttagtttgatatatatgcatgaattatactttaacgtgaattttttcggttttcggtttcggctttcaaataagttaataatacattccattcatatgaaatattacaaaaattgttgaagaggtgtcatttctatgaagcgagcttatcttggtattacagctgtgatgataactataatgataataaattgtatatttgaccagttttgtctacatataaactactataaatcaattatagtaattaattaaaatataaacaatttcaactcttactttttaaatggtgatgaaatggcaagacagctcatttaactagcatatatatagatgtatattattctatatattgtgtgaccaaagtaccaactctcttcaaacaaaagatccgtataaaaactatattgaacaagacagaaaatg

SEQ ID NO: 801 - DNA, 3000 bp, Unknown
  misc_feature (1)..( 3000): cDNA_ID_2045038_gDNA_ID_1620322_Annot_ID_153366 3000 nt of promoter + ATG
ataaaaatagttttgattctgctcctattaaatctttatgaaattgtaaatgttttatggattttgattattggaccaaaaatcttttgtctatgcaagaagtgttactcacttactcataaatcgagatgcaaccaaatttatcttgtcattcgtgttgatcacgacaaaatcattttcctaccttttaaatcgcatattttggtctctctcacaaaaataaacactaaatttgatttctccaaaaataatttctgtgtagtctccattgtagtctcatatgggtttattatgaaaaagtcagcgactcggcgctaattttaatttataattcattattagatattagggatttttaaatggaaatcatataaatttatatgatcaagaaaaaggatgtgtttcaaattttgatatagtttaagatatttatttgtaaaatttgtatttgaataaaaaggataaactttttggtagaccggttcgaaataaaaatttgtgtagaattaagggattaatgattcttctttaatgttttaaataggccaagcccgtttctattagcctcgttgtcttggcccatatccaaatctctccacacttcactcttttggtcacaaactcataattggcaacttttataacgttttttttttttttttttttttttgcttctacaatgtttctttgtggcatacgcaacgttactactgaagaacatcctatttcatgcagtttattttaataaagtgttagcgtgtatatataattctcattactattttctattcaaaacagttacatccaaaggcatatctaattatatattaatataagtgaaattaatatataaaagtcgactcagattaaatgaagcaaagtggattattctatacgtctaagattcctctaaatctttatatccatctcagttccttactctttattttatacgcaaaaaaataaaaacgtatccatatatataacatttatgtgtgtgtaagaatatatattataaatcaagacagacattttagcacagaagtagagaaacaaaggaagaagatggagatatttgtgaagaaagagtacttagatttggttcttgtcccatttggattaatcatagttttatcttaccatctatttcttctctatagaatcctttactttccttaccataccattatcggtttcatgaacatcgataaatccatttgggtcgaccgtatcatgcaggcaagttatcatctctctttacgacaatcttttcaaaattatcgatatcgatttctatttaatgttttgtccaacttattacaagataaaaaaaatgatgatttggtaatgccaacatttttctaattattacttttgctatatggatttagatataacggttagctcgaatgattacaggcaagaaaagacgaattgggtggtgctttaactgttctttcgagcagcatatcagcttcaacatttatggcatccattgctttaacattgagttcacttatcggcgcgtggatcggaagctcgccggttagtatgactgtttttaccggacattttatctatggagacacgagttcaatcacaatggtcatcaaatacacatcgctcctcatatgtttcctagttgcattctgctgttttattcaatccacgagatgttttctacatgcgaactatcttatcaccactccgggcgaagatattcccccggacatggtgaagagatttgtcttgagaggcgggaactattggtcgctaggtcttagggctctttatttggctcttgatctattgttgtggcttttcggaccggttccgatgtttattaactcggttttgatggtcatttgtttgtattttctcgactcaaactcggtggctcagcctctttatcaccggacttttgaggcggagcaaattgtcaagaagatgagaggagttttgcctgaacagttgacttttagatgtaattgaaaagaaaattatttgattcttaatcactttgccaacttgggattttccaacgaattatatttgattataataatctttggaaaattcgtaagaagttttagtttatcaattattgcatgagatttgtgaaagccgtacggagcatgttccgggagcgtctcgtcttatgttttataatcatccacacgataaagcattaacggatagagaaaaaaagatgagctgtttaattcatttcttggaagcaactacttagacatattctctaactttgaaaataatgattataaattgggttcactaatatagtattgtaaatctgtaatttaatttccacttgtgctacgaaaacagcatggtcacatcacattttttctcagcaagtatataaatgcatgtctgaatattgatcatgcattttcacgtaagttgacataatttgtttttagataatatgcaatgcaaatatttaaaagagaaggtgaattcaatggtatttttttttgtgtgtctattttcaaaaatagcacaaatacagatttttaaatcatagagcatttaatgtaaaatatttgcaaagttatataaggtttttataagattgtatatataaggttttataaagttcataaattttgataaaacagattataaaatggtattgctacttgctagcacactttgttagcatgacctttaactcaatgcaaactcatgctaccaatcaaagcctttcattagagaaaactggataacaaaataaataaatagaaaccacacatttaggcccataaaggcccataataccttttcttgggcctattattaaaaacttaacccctttaatcgctgttttctctctctcgcgacggatcttcttaggtctctctcttctcctccttttccccactttttcaaaatcagcaaattttggattttcagaatttgagtgaacttaaagtagaagacgaattgtctgaattcgaattttaagaaaaatttgcagag

SEQ ID NO: 802 - DNA, 3000 bp, Unknown
  misc_feature (1)..( 3000): cDNA_ID_2045020_gDNA_ID_1620322_Annot_ID_153371 3000 nt of promoter + ATG
ttgtcttaacatggatgttccaggttaaacgatttggagtaattcctccaagaatcatctcgtcaaggaaattggcagcttcacgaaacttactaatagcacagaacccactgattactttcccatataatccagcatcaggtttcaaaccctgaagattcattctatcaagaagttcaacggcttcttgaatcttctgctccttacagagaccagtgatcaaagtggtatacgttaccatgtttggcctgcagcctctagccatcatcatctcaaatagttccatggcttgcaaagaacgcccatctttgcaaagaccgtccatcaaagaactgtacgtgaaaacattcggctcaatgcctttacttttcatctcttctagatatctcatagcttcatcaacatttttcgatccacacaaaccgttaatcagagaagtataggtaacaacagttggtgcacagtctttctcaaccatctctgtaaacaacttcttcgcctcatctatccttccgaacctacacaaaccactaatcaaggttccatatgtgtaagaatccggatcacaccctctcttaggcatttcaagaaaaatcttaagaccagcatccacagttccgtcatttctgcaaagagctttaatcaaaacattgagagatgccacagtaggaggcaaaccaatctctctcatattcttgtaaaacttaaatgccaaatttaactgattctcttccacgagaatggcaagaacagtgacataagccttctggctaggatcacaatcaaaatccttcattttgtgaaaaacccttaaagaatcaaacggcctatgaacccgaccataccctcgacatatcgaaagcaatatatcttcactaacaacacaattctcaatcttcattctaacaatcagatcttcagctgctttgaacttattagcagagaccaacctcaagaccatataaccaaaagaactctgatcatgtacgtacccatttgcgtattccgccgttgcggaatcaaaaactgccatagacttctccacatctttttcagctcgcatcagtttgataacctgtgaaggcgtgatgttctttgaccacttgaacatcatcactttgctacccattactaaacaatgataccttccaacaatagcaaagaatacacctttttatagagaagaatctcagctacgcattacgtcgaacaggttgtgtgcataaacgatttcgataggctcaaaccaaatgaaagaaacacagaccagaaaaatcatttgatcttcaaaacatacgagttccaaaagtgaaggaagcaacaatgaaactcgttacgaactagaaggttaatcaaattgccggagaagaatcgctcaccagttttggctagggtttatgaaatgggagactttagctgcaaagagaagagtctctggacgatttagagggtgtctctctaacaggcaacaaagtacatattattacagtattaaccaaatttaaacgaattaagtgtcaacaaaagcttatataaaaaatttaaagtttaaaaattataaaatatgtcaacaatattttagtacttaaaattattatgcgaaatatttagatcaatggactactcatctaatatatttgcacctaattttaaagtataaattcaaccaataattagaaaatgatagcttatactcaaattcaacaaattatatataaatgtatagatactacaatatcattaacaaaagtcaccttaaataaatacacatatcttttatgttctctattgttttgcgtacgctaacacaatttctcatatgcaaaaggatgaatgagtaacaaattacctcataagaacaatcatctttgcttacatactaatacaataatcactcaatcaaccaataacatcaatcacataggtttacatacaataatcactcaatcaacttcataagaagaatcatgtttacttaattcatcaattatccccaaaaacactactattaagtataaactataacatatttgtagtgatgggtcaacatttttatcatatttaaactcgggtttcctcaaatcgagaaatagtgaacatgtaatattaattttaaatcgcaattacagaaattaattgaatttggtcaaatggacagaattttataaattgggtggaactagaaaaaaaaaaaaaaagagtatagggtgaattgagtacatgaaagtacatggtaatcctagttaaacgcataatacatgtgggttcatttgtatttttttgtaacttacgagtaaactggctacaacaaaaaaaaattagaagatttttttgttttgtagaaaaccctaattttagttatagttgtataactttgataaaattataaaattgtattacgaaaaaagtaataagatattcaaaaaagcctagaataacgtatatgactatgagcatgaaactgcaagtcaaatgctgacagacaaccataaacaaaagaaattaaatagagatacctttaaaataagtaaaatttcatttataaaaaatctactttcttgtgaatctgtcacgttcaataatttgaagaccactcaacatacaaggtaaataatgaaaaataaaatctaccaaaatttcaattattattatcttccaaaaaaacaaaattatacagatgatgatggtgatatggaacttcgattggctaatattcactgtgtctctaaaaaccatccacttatcaagataagatggaccctacactcatccaatctaaaccagtatctcaagattcttatctaattacatcattctctaccgttagatgaaattgaccattaaccctaccataactccatacaccgcgagatactggattaaccaaatcgagatcatcgtagccgtccgatcaacaagtaccatctcttgaaatactcgaaatcctcataagtccgtccctctttgctctcactatcaaaactctgaatttcgatttca

SEQ ID NO: 803 - DNA, 3000 bp, Unknown
  misc_feature (1)..( 3000): cDNA_ID_2045003_gDNA_ID_1620322_Annot_ID_153376 3000 nt of promoter + ATG
atacactgatttgaagaacagaactgagagggtatagttcagtgatggagttacgccataagaagaagtctggatcataaggttaatctgaagtgggctgcgttgcttcttgttttttctgatatcgacatatataaattagtatatgtaaatatgtatttttaaaacttttaaatcatactttgtataataaaattattattcattattagaagaatcaatagtttatctagtttattgactattcattattatatttaattacaacattatctatgtttttgtttatttgtgactgaccttaaactttagtttattacatatataccctataagtagttaggtaaagctttcaattttagtcctcagtttctgacatttttggttattttctcctttttttatagttcaaactttttttttcctttcaactttttcatgttcatatacttttaattttactgaagagagattaatttacaaattcaaaaaaaaatcttagatcaggtggaatctaccagagagcacgcgattctagatcgatccaccggtgagagacgccggagtttttatccccgcggcggagtaaaccatttcttcttcccgatgtatcagtgaagttaagtagtcgagagaggggataatgatggaagtggaaggatcgatgaatcgtgctcctgatcaatcatccttcttacgatcaagacgatccaaaggttaatcataacactttcttcgaaatcttcaatcaaaagcctttagtttaagctctcacgggtttaagtaagggcaaaaaaaatgctgtgatttggtattcgattttggcaattgtttatagattcatgtaactttttgaactgaacattgaatcatttgattttggcagctctgtatcagtttaagcagcagaaactcccagcttgtaagccagtcttaacaccaatatcggttagtaacattaatctttgtcacctggaaaaaagctaagcttttcttctgattgtctaagaagaagaatcaaatgttttttgcaggttataacagtgtttatgttaatgggttttgttttcattcccattggtctcattactcttcgtgcttctcgtgatgtaagttggagaagttaactcttgaatttgagatgtaagtttctggagcaaactcttaaatcctttaatggcaggctattgaaattatagaccggtatgatgttgagtgcattcctgaagaatatagaaccaacaaactgttgtatataactgattcatctatcccaaagaattgtacgcgctacttgaaggtaattcctttctgctccattgattctcaatcagtgaattaagattctcttcattgttacctattggtgaggttttatacttttcaatatcaggtacaaaagtatatgaaagctcccatttttatctactaccagcttgataactactatcaaaaccatcgccggtaaaatagctagatgccttattgatttacttttcaaatctagtgatgagaaagtcagccatttggtagctgatgattcttttgcaggtatgtaaagagtagaagtgatcagcaactattacatggactggagtatagccacacaagttcttgtgaacccgaggagtcatctaatggtctcccaattgttccttgtgggttaattgcttggagtatgttcaatgatacatttacgttttctcgcgaaagaacaaaactgaatgtgagccggaataacattgcgtggaagagtgaccgcgagcacaagtttggaaagaatgtgtatcctatcaatttccagaacggaactttgattggtggagcaaagttggatccaaaaattccagtatgcattctcaaccactttacaataaaaaaaatttaatcatatattttagcttaggcaatgctgtttactttgtagctaagtgaccaagaggactttatagtgtggatgcgagcagctgctttactaagcttccggaaattatatggaagaatcgaagaggacttggaaccaggaaaagttgttgaagtaaatttgatgaacaattacaacacttatagctttagtgggcagaagaagcttattctctccacatcaaattggttaggaggaagaaatgatttcctgggtatcacctatcttgtcgttggttcctcttccatagtcatatccatcatcttcatgttgctccatttgaaaaatccaaggtaaaaaaggctacattcgcagaaaccctttttctgttcattttcttatatgcatcattctcaatctcaggccatacggtgacaattcttggaacaagaaaagcctttcaagttgagaagctgttacattctttctctaacagattcatattccaggttcatatatattcctacatactcaagagccatactttgtctatatatatatgatcatctaggtttaaggagtatataacgtatgtatgagcctatagttctagaaaactgataaggttcctctgttttctttacgatccttgtgtgttcggattgcgggttctaaagattcaacaaaaagataattgtttgacccttcttttactcttaaacctctaacgtgatgggtttatttgggtatatctgtttttagagccctgtaagtttagaaaatctaacaaaagcattatagagaatgcatcattggctatctgcaaagcgtacatttattttcatccatatcccgaaaaatcctcatgttttctttctcatatttccatatttgtcaccttaagtatctctatttaacctctcccatttgtctcctccacatcatatgcacctctaagttctcccattgaaagatctttcattcatttagtcaaaagcagcacctttcaatcttcctctgccctcctcacccgtagaagatccgtttttttatttctcaaactaaacccgtgttttccttctgctgcattgcattgttgtcggggaaaagaaaactgggtgtaagaaaaaaaaatg

SEQ ID NO: 804 - DNA, 3000 bp, Unknown
  misc_feature (1)..( 3000): cDNA_ID_3059016_gDNA_ID_1620322_Annot_ID_153364 3000 nt of promoter + ATG
gtgattgaactcgtgtctccatagataaaatgtccggtaaaaacagtcatactaaccggcgagcttccgatccacgcgccgataagtgaactcaatgttaaagcaatggatgccataaatgttgaagctgatatgctgctcgaaagaacagttaaagcaccacccaattcgtcttttcttgcctgtaatcattcgagctaaccgttatatctaaatccatatagcaaaagtaataattagaaaaatgttggcattaccaaatcatcattttttttatcttgtaataagttggacaaaacattaaatagaaatcgatatcgataattttgaaaagattgtcgtaaagagagatgataacttgcctgcatgatacggtcgacccaaatggatttatcgatgttcatgaaaccgataatggtatggtaaggaaagtaaaggattctatagagaagaaatagatggtaagataaaactatgattaatccaaatgggacaagaaccaaatctaagtactctttcttcacaaatatctccatcttcttcctttgtttctctacttctgtgctaaaatgtctgtcttgatttataatatatattcttacacacacataaatgttatatatatggatacgtttttatttttttgcgtataaaataaagagtaaggaactgagatggatataaagatttagaggaatcttagacgtatagaataatccactttgcttcatttaatctgagtcgacttttatatattaatttcacttatattaatatataattagatatgcctttggatgtaactgttttgaatagaaaatagtaatgagaattatatatacacgctaacactttattaaaataaactgcatgaaataggatgttcttcagtagtaacgttgcgtatgccacaaagaaacattgtagaagcaaaaaaaaaaaaaaaaaaaaaaaacgttataaaagttgccaattatgagtttgtgaccaaaagagtgaagtgtggagagatttggatatgggccaagacaacgaggctaatagaaacgggcttggcctatttaaaacattaaagaagaatcattaatcccttaattctacacaaatttttatttcgaaccggtctaccaaaaagtttatcctttttattcaaatacaaattttacaaataaatatcttaaactatatcaaaatttgaaacacatcctttttcttgatcatataaatttatatgatttccatttaaaaatccctaatatctaataatgaattataaattaaaattagcgccgagtcgctgactttttcataataaacccatatgagactacaatggagactacacagaaattatttttggagaaatcaaatttagtgtttatttttgtgagagagaccaaaatatgcgatttaaaaggtaggaaaatgattttgtcgtgatcaacacgaatgacaagataaatttggttgcatctcgatttatgagtaagtgagtaacacttcttgcatagacaaaagatttttggtccaataatcaaaatccataaaacatttacaatttcataaagatttaataggagcagaatcaaaactatttttattggagattatcggacataaaggaagaaatttattatagtagctagatttcatcgaagtcaaagattcgtaatgtatctctttgttcacgtcaaatatgatagtgtgaaaatatctctttgccttatatatccaacaatgacaatgacacaaagtaattaaatacacaaaaaaatacataaaataaaacaaactacaggcaggcaaatttgtaagaagatgcagtactattaaaaatattcaaactcatttgtcatgtatatatataattgcttctcaagcaatgtttttggaataatttgtacgcacgttacgacgaaacatagtataaaaatgtcaacatggctaattaagtttcgaaaatattttaataataaatataattaaaaattgaaacctaatcaatttacaagtggacattttaataaggagtttagcatcactcgtgagatttttacttccccaaccaaaaataatggaaacataattatgcaaattatgtaatgacacttatttctttctttaaagaattatgagttattattgtccatctactacaaaatttaaaagtagatgtactgataatttttttttttttttttttgtcgtcgtactgataattaaaaatatcatgccaaaactcataccaatgtccaaaacctgaataaagttgaatattattgccactcaaaatatcaattagaagactcatatttttagtccataattctatagtgaatcttttatctatttgtctttcgttttcatctgaattataaatgagttttggaaataattaccagttaaaattatttcttaatgtccaaaatgttaatagtaagtcctgcattttgtgactctgaatcaacaatttgatgtgtttttcttgtgtatttttctaaaccagtgtttatatatagatgtaggaggatccgtttggaaagtaagacatatgttcatctgcaaataattttccatgtgaaaacacatagataaaagggttgatctttgaatacatatagcgagcgaggtgtatgaaagacaaatgatgacgataagctagcacaacaatcattttatagtctctaataagtcaaaaataaacttacttcgtaataacatttctgcatattttagttatgttattattatgtacataaaggttagtataattttgtaaactcctggacgattaattactaatttaataactttcactttcagacagtaattataagtgttacgttgaaagattcgcattattcatgtgacccatcatctacttaatatgtatatatatgagacaaaagtgccgactctcttgacattaaaaaaaaaacagaaactaccaaacaaattagagagagaaaagaaagaaagaaagaaggtagagaggaaatg

SEQ ID NO: 805 - DNA, 3000 bp, Unknown
  misc_feature (1)..( 3000): cDNA_ID_1385376_gDNA_ID_1620322_Annot_ID_153362 3000 nt of promoter + ATG
aaacaattaaaaaaacaaaagaatttagatacgtagttattaatatagaccattagattgaaaagtaaaaattaagatctatggctgagattaaagacaataaatggattaattttttgatgttataaatctgattagaaaaaggtatctctcttcgtctctagaactaaatctctctctttaaaaaaacaatcgtttctccctttctccttcctgaagatcgatttttcataaatccatagtagtttaaaaaagaagcagagagatgttgaaaatcgtttctcatggaatcaatcgattattctctatgaagttctttaatccacacaactttcctcaggaacatgataatagtagtaaatggaggtttttcctatggttactctagacgaaggaggatctccttgtgttggacaggtttgtgatttctttccagggataaaaaaaatttgattgtttgtttatgatgaacgattttttggctacggaagagtgtcatggagttctggtgaattttttggctatgtttggtgatttcatttttaatcaagttgggaatcaataggaaacaactaagcatacaacatagattagaagagatatcaagatggatctgatttaagtaagatttggcgactaattctagatgattagggttatttgtgatttattacaaggaatttgtgttctcattgatttggcgagtaattctgtatgactagggttatttgtgttttcttaaaaagaatttgtgttcttgttgaaatcttgttcattggaattatttgtgtttggtaaatcttcattggtggctaaggatgtgtttgtagctcttacggcgtttgttattggtgatgtccattatgaatggcaaattatggatggcacattatggatgatgaatcatggatggcatattatggatgacgcatcatggattgtacattatggattgatatggtgagatttgtaaatcttttggtcttacatgttaagagtaaaagatgaagaattggagaagcatgtctaacatcctaaaaacaagctatatccggttgatttgctacgattttgtttttgtgaaacggtggctgtaaagcggtgaaaaactttgctgttctcctctagtataaacattgacctttatgatggttctacgacttagatcgagttggtctccaatgttaatgttcatcgtactattaaaggccacaaaatgttgatcatcgtgagattataccgtgtatcactttcttctataattccagaaattcttatacaaacacatatttaatgtccacgcgctaatgaccatatggtaatattctcgtggcatcaatatattgtcttaaaggtagagatctctgcaaattgaaagaaaaatcaacaaataatttatccagtatagattgtccatttaaacttgtccaaacggttcacttttatatttgcccttaaagtaatgaaaagaaattgtaccaatttgcccttaaagtaatgcagacgcaaataacttataaatgaagctctccttttttagtcatggccgttcactccagatgagatcgtgtctgagaaactatcattttttatcttctctgtcttccatgttttttttttttcatcattttcatttcctttttcaaaatcatcaatcatggtggttctctataattcttacaaatcatagaaattctgagattatctcaaaattctctatcataacttaaaaacgaaggatatattaagaatcaacaacagaacattgctgctacaattgatcttcttacacgctttatatacttaaacttgagtacttggacactcatcaatggacaactatgcttcagatgtgagttactagatgaccacttggactagagtgcttggacacttatcaatggacaactatgcctcaaatgtgagttattagatgaccatttggacttgaatgcttggacactcatcaatggacaactatgcctcagatgaagttacatcgacaatggcctttttgctgctactcgcgttctcaacatcacgaaccgtttcaagcccagattgcttagaaggtaactgatcatggttaacatcctcacttttcattgtaatcgatgacagagattccttaatcaaggagagaaataaatggaaccaaatcaaataattgttgagagacagggaagatgatgataaatcatatgaaattgggcttttagttttgatttggaatattgagattcccgtaaaaaattggttttgattttggaaagagagagaaataaagacgatggagaaaagagttgagagagaaaatgaggagaaagcgttgtggttcagagggcaatttgggaattttgatttggtaaagtgccttctcctttcaaagtgcctaaacgggtaaatagttttctaaaagtgtcttataatgtaataatctcaataaacaattcaaagctgtataccattcaagcccattattcaaaattttgtttgactaatactattcaatcgggtctatgggcctcagaaaataataaatgggccttaaatacttggaaacaatggatagatcgatctcaactttaaaatgcgtccaaaaatataaacaaacaaacatctctcgccgtcaggttacatctatcgccaccgcaaagagaccaccgtctcctccgcaatcttcataacctaaacaacactcatcccctggtaagctcaattctctaatcaattcaatctcctgtgatgtcgatctgtttctactcaagttcaatctcacgaatcccttctttgttctgtaaattagggtttcacgatttgtgtgtctagggattcaagatccctaatatctgatcatctagtaattgtgaaagtattgatttttgttcttttgatttgagtttagcaattattgagatttctttgaagttgaataccttttctcaatcattataaaagtattgatttttatgtgtgttttgtggcaaaggtacttaaaca

SEQ ID NO: 806 - DNA, 827 bp, Unknown
  misc_feature (1)..( 827): cDNA_ID_3059072_gDNA_ID_1620323_Annot_ID_153396 3000 nt of promoter + ATG
gatctaaactattaactaaagtattaattgaaaatggatgacaacattttgaccaaactatttaagccgttttcgcttatacataataaacttcagagtccaaatccagccaaagactcctcatactacatttgtgtttacttacttacactttcaacttaacaaaaaatagatgtaaatggaaatatcattagcattattaacaaacaaaacaaaaattacaaacgacgtcgcattcaaatcctttttcctttcttttttcattaacccttaaataacggacaattgataaatctttgaatcagagaagttgcgcccaaacaaaaagagaatttattgttcagttagtctagtttgcatcgcatgcgatttttggttcatcagatcttcccaacacacaacaaagccctaagctttcttcgatttttagagcatctccattagacaaatctttaaagtgtcttccccaaataaacaaatatgttttagtcaaaaataataatattgtaattgagagtgtctttagatcttgagattttatctcaaaatgtctctgagaagacattttaggaggagtgtctcaaattttgtaaacattctcaattataatattattctttctaacaatatatttcttttatttgaggaagacacccaacaatatatgtgtgatggagatgctcttattgattttctcggtctttgtgtgcgcaaaatcgagacttagatgaaattcggaagaattcgaggttttcactgctagtaagtttgatggaggaaagggaagcgaaaggatatgttagagattaaagattatcgggcccatg

SEQ ID NO: 807 - DNA, 3000 bp, Unknown
  misc_feature (1)..( 3000): cDNA_ID_3059039_gDNA_ID_1620323_Annot_ID_153417 3000 nt of promoter + ATG
ctttgacggataaccaaactatagtgtgcacgtgcattaagcatggaataccttccactgtcctaaaagtgtcatcggacatacaatcaggttaccaccattttgaagtacacttttttgttcaagaagcctcttatcaaagcctagaaatttggttgccttcaccgggggactagtgagatcatctacagaactgctgatcactttgtctccttcatagttggggcatagaaacccagttgatgcagctttccaagaatgggcaagcaaaagggatatggtcattacagtctttccaagacccattgcgtctgctaatatctacaaaagttttaggatataatattattacaaaacagctatataataaagtgacaaaatctaaacaataaatgaaagaaatttttataggtggggtattgagatcatactcctcctcttgccatttgaagtgtgctagggaagtgtattgtagcatcaccagtaaaagaattcaggtagacaaccagttccctcctattgacataaaacagatagtaaatatcttatctgactcgcactaaagttcgaaggcaatagaaatatcactcacttgtctgctaaacagtatgcttcccaacacgggtgaagcattgttgctgcctcatcagtgcaatttcctttctccagttgggtcatccaatgaagtgcctgcttttggtatggacgaagctcacacagaagtgtatgtggagtttccatttcctgttgcaaaaattttcatgcaattttccaaaggaaatttccagtgttggatataagtaagcaagaagtcttgaaaatgagaatacctttaatccagaactgtccccaacaccaacaatgttatcaagatcaccatcgctgatacactgctcattttcatctccgtttgcatcttgattcatattcttgaccttgtttaattgaagcaacgaagtaggaatagcagaaccatcctatttccatagggcagagagcaaatgacaaattttacaggcaagaagtcaaattttaagatgctaatataataagtaatatttaccttggaactcaaaggtcgcttcttagagtaaaaatcctctggagtaaactctgcctaaatatgatgaagaatggaaaaatttcttcgtcatctcaagattattcagtcacatcatatgagaagtatatgggaactacaaactgcaatctataaaagaatccgcatatcaagttataggcaaggaataaccattaccttcttaaaggggatcaaaccgagtaaccgaaagagatttgggagaggatggaacattgattcctctgccgtattactagctgtcttaaatgaagtcgcactatgcttttgaaacatggaactattaatgtacacgctgtttcaaaaacaaactcacaccacttcaaacactaatgcatctatcctgaaattgtaaacgggaacacaaaagttttgtatgcataccttacagacagaagaattgtatccatgatgctcaaagcttcaggcgccgacttgcaactgccttctatcctaattttcttgtctctcacaagtggtagaagacaccgagcccactcgtttggtattctaccaatctaccacaagagcccatcatagttagttaacaattcccatctaacaaacttaacatagcaaataaaaaagatgtgaaacacacctctcctgaatcctttgtagagaacctaacgatatcagaagcaccacgcaaagctggccttccccgcccaaaaccgcgcttcccaggcgtagtctcaggctttaatcctttactatgcggaaacgtgaacaccaattcatcaccagacttcaatttccttcctttacatgtcgataacccagccaattcagaacaaccaacaaaccaccactcattccctgaaacactctcttctcctccaccattaacactctcattttcttcctccacgcgatgattcgctccaacacttccgctgtcaccaaaagtacagccctttaatccactatcaactcgcttccctccattagagccgctcggggtaggagtggctacatcaggtttggcgaaacttggagtgtcgaagattatattgatagcagccgttggatcatgattcgccatgtgtaaagccctgattatatccatatctgagtaatcggaacccacgactgatctgacggtggaaacaagatcgtctgagactttcgttcccatttccaaaaccctaatcctacaattttccagggaaattttgaaactttactgaaaattcagtgagcttgtggctaaagaacgccggaaaaagaaaaccccaatgtagtacagtggcgaattatagaaattgaagtagatcgacgacgacggcgtacgaaatctgccggacccgagaaacgcgcgtaaattagcgacgagtctctcaaattcccgccattatattgttttttttattcaagtgatgaaaatagaaaggtaaattcaaaaacggtgacgttttaaaatccctaacgggtctagatccgggtaacccgcatcccgagttgaactcagtttaacaattagaccacaaaaatctgccattaactcagaagtgagaagtgtagtagaaccattcgacacgattgaaaaagctcatcttttttatttctatgtctctctcttttggttacgtaagctctctgtccatatgcttcattgatggtggtggttatcaaaatctagcaaggttttagcttcaattctgtccatatgtttatccatttccaagctcagacgtgaaaagatttcagatttatcgctggatcacggctttgatttcttttgcttcagctttgaatttgatttcttttgcttcagatttatcggtggatcttagattttgatgtgggtatatggttcgattttataaaaagaagttagatttttggaatcatagaaagggataaacgagaattgaaatctggggattgatttggatctg

SEQ ID NO: 808 - DNA, 3000 bp, Unknown
  misc_feature (1)..( 3000): cDNA_ID_3059043_gDNA_ID_1620323_Annot_ID_153416 3000 nt of promoter + ATG
cacctccaggcagatcccagtattgtgagatcgctttgcatatatacagatattccagtctatggttcgttgcagacaaaagtaccaggacaacttttggaatgtcggtgacattgtaatatttgatatctgcatccgcatggacattaattttaagcctgtgatataagcgaaatattcatcagcatccacacaaaaaataatacatgcaatataagtaaaatctagacaagctgatgagtgagaattattaaagtataaagtgcaaaaacaactttccgtgagatatagaactgagagatcaactctatttccataaatttgaaaagcaaagtatctgaaatgaaataaggcgtcgaaaacatacaccagtaagagattgcatgtacccaaaaagagtcgcccatgtggatccactccaaaatacactgctcccctgagtgacgttttataaacaacagttggccccattttttttatagtgcattctggacaataccacggcccatctggtatatacattttgaccacaccaatgcatcttgaatgatatgctaaagggcatccatcacaacacagcaacgttccatccatgccacagagcctacattcatcactgtttgcatccagatctgggctatctccattaggaccaccatcagtgtatcttgaactccaattttttgagtcgctcaatgaacttatcccatggttcactgcaacaaattcactaagctctttctccttggaagctgaggttttagcaaatctggggtggacccttctaggtccattttcaggaagttcagcagttactccatcagtatcaaatccaacttcagattcttctctgttatcaatttcagctcttaaatctgctacatcaaagacgtcatcacacagaatttgcaggatcttcaacttcattactacaggtgacgagcaatattctttctccacaacaaattcattaaaaaatctccagagaggcccacttgcatgtcccatggcagcaaagtactgaaccaaataaacaggccaagttagcgcatcgagcaagctccaatcaatgcacctgcagatggcaatgcaacaaaacccccgaattgttatccactaaaatatgggataatgggagacctaaaacaagtttcacctaaactatgaataagaggcttatattgcagtccctgtacagccataggcctttttctcccagctgttataaaaggtttgttgcatgtatgcatacataagataacaatgtatatttttactagcttgaaaaataatgtcagcagttctgcttccttgaaattcagatatccaacaaattaattttactgtttcacagaaataactcggaatatatgaaagttaactagaaacatctccaagaagaaacaaagaaatatctgttgaaaactgtaaatgacaagagttgtatgtgcttacctcaagcattttgaagccacttcagacccttctgaggagagtctctcaagatgacctttcagtgcccgcatcaaggcaacatgaacggcatccaacaaagaattaggtcctaaaaaatttaaagctcccacaaaatcatccaatccaaatgggcagatatataactgaacactgaatgatcttaagaacccatatacagataatagatacaccacagcctcctcagggataccaattgttcctgatgaagaaggcaactccactggtggaacaagaggagacatactttcgaaatctggatctatgtcatcttcacactcaggcaaaccacaagatgaataaccactttcaacttctgccacagaacttgggctattacatgtgggcacctcaactcctttgttcttcaggcaatctgttttcttcttttcgtccttcttcagaataaagtcgtctaatttactccttctagcacgtaattcatcatcaaagtaactatccccaataattaactggcgaagataacaagtttccaaatcctcaaaatcaccatcctcatattcaactctgtacaacccagtattgtaagaaactatcttcccaagaaaaactccactgtcatcaacatctttcaacacataacgaccaagaagagatctaggtacagccactttcacctcgaaaaccggcctcttccctcgattagataccccattaagatcctctggtctggggcgtttccttggtctacctctaggtttagccacctttccttccatcagatccaaatcaatccccagatttcaattctcgtttatccctttctatgattccaaaaatctaacttctttttataaaatcgaaccatatacccacatcaaaatctaagatccaccgataaatctgaagcaaaagaaatcaaattcaaagctgaagcaaaagaaatcaaagccgtgatccagcgataaatctgaaatcttttcacgtctgagcttggaaatggataaacatatggacagaattgaagctaaaaccttgctagattttgataaccaccaccatcaatgaagcatatggacagagagcttacgtaaccaaaagagagagacatagaaataaaaaagatgagctttttcaatcgtgtcgaatggttctactacacttctcacttctgagttaatggcagatttttgtggtctaattgttaaactgagttcaactcgggatgcgggttacccggatctagacccgttagggattttaaaacgtcaccgtttttgaatttacctttctattttcatcacttgaataaaaaaaacaatataatggcgggaatttgagagactcgtcgctaatttacgcgcgtttctcgggtccggcagatttcgtacgccgtcgtcgtcgatctacttcaatttctataattcgccactgtactacattggggttttctttttccggcgttctttagccacaagctcactgaattttcagtaaagtttcaaaatttccctggaaaattgtaggattagggttttggaaatg

SEQ ID NO: 809 - DNA, 3000 bp, Unknown
  misc_feature (1)..( 3000): cDNA_ID_3059061_gDNA_ID_1620323_Annot_ID_153401 3000 nt of promoter + ATG
tatataccttttttgtttatcttcatacattaatcaataattaattagtcgcctaacaataaataaataattgtatggctcaaaaaaatttaaaacataaagtgggtttttccttaagaagctagattatactagcctcagaaatcagaataaacctgatttgcaccattgaaggaaacctagtacagcaacccactcgaacaaacctgatcgatctgcaccattgaaggaaacctagtacagtggcccaactcgaacaaccacatacacacaaagaactagagagacatatatgtaggtaatacatctaatttagtgttttatcatatgacaacacataagacatacaaaaatctagtgagacatatttgtggatgtagattatcctaagatatatataatctatatctctaactctaatagaatgtatattgattgcataccctactttttaacccattgattaagccatttatcaatgagaaaaagagattctcatgtgatgcagtgatgctaacaaaaagtttacatactaatttatactaaaaaattatgacgctaatataagtttatgtactaaattataccgaaatattatgtataataaattattagaatgcaggaaataaaagaatcactgacaacttaacaagtaacaacagctccaatatgccacgattatgtaattcgtgtgtcatatatatgtttcttctcgttaaagttaaagatatataggtgtgacctcaggtctcaaaagtgaagcccagcttctaatataaatatttctagtttattttcttcgttttgaaaaaagaaaacacatattcataatatattgaaaataatatcgttttataacataagtaaacaatcaacaagcaattgttggccgtaaaagatttatcgatggggttgttgaaaccttttttaattcataaacttgtaaaggtttaatatggcaaagttggtgaaacccaagtgggactatctaacattgcacctaagcatgctgaattgatcctttctacatttcttttcatctgtcttgactcttgattaacgtttgaaaatctttttttaactttgttgtcaaatatgattagcgactttatttttaccttttttttttatcatgacctatatctcgttctaaattacacctttaattagcaaaatggtaggaatatgcgaaaaaatacataactaaaaaatggcaaatttctttctaccagtttcatgccatatcgaaaagagaatggcatgtttgtctaaattcacctatcagatcaattgtttctcaaacctttacgtacaatttgttttcctaacgttaacatagctagcatgcgcagtgcgcacgatgatctgagaaaacaaaaaagatttggtgggattttaactttgattaatggataagatatatcgttcaattttataaaataaaattataagaaattcaaccatttgtagcatatgattaacgtatatggaaatctctaaaatggaagaactaattaaggggttcgatttcaaattttcggtagtgcttttctcttaccaccaggtttaggttcgcttttgtttcaaaccaaaacaactcattttatcttgaaaagaattaacatttttctacaattctttttctaagtctatagttgatagttttttttcaccacagaccaacccaaagagtaccaaagtacgataggaaaaataaagtcatagttaattacttagattggtaagaatatttccaaacctaaacaaatcaaaccgagaccaaaccagtgaaaatggattataaaaatatttgtactattgactttatttcttgttgacaaaattgacttcatattaacttagaagatgcacgtgttacatgttcacgttagtattgaaggttctacgtctttgcaaaatgtgaataaagtaaccaagtcccactaatacggcacgtgaaccttgttattttcaattatctcgtttgcttctcttttggctacaagagtctctgatggtaagcttcgtttcgtaatacgtaaaaaggtaaaattgtattaccatttgtgggggtttttgtttgttggtcaaggaaaattgtggtttttatgttttagttttttgtcctcaccacaaatgataatatttttatactgagtggtactttatcgaaaaatgataatagacatgttcgtttccatcaaccacaattaaatgttgtttatatgtgtcgataaattgtacgagtctgtgaccaaaattttcatgtcaacccatttaaaatctgacaacatataacaagaagtacaaaacgaacaaaactaatatgcaagatcagcttttggttgcaatcgacaataaatgccaaacgaatatgtttaattgcgtttgataaatgatcgtacaaattcagaaaggggtgatctaaccaaaattcaagaaacaaaacatacaatattacaacaaaatttacctgaatctttaacaagtgttcagaatttagttttaaatcttgatgagattatgaaactatgaacatttcggaataattccagttaaaaatcatatataaaggcaaacaaaaattcacgattttccccaaatgttttccgaattcgtgcaaaattgtgctatttccttttaataacatagtatcattgtattttttttaataacataacatatgataaataacattatttgtttgtttcaccttaatttggtatagttttttgggagtctccatgtactttccctcggcccttgccagtgttttgtatttcaaagtgaattatatcagtgagaagtgaaaaccaaatcattagtgaacaaaaaaaagaaagataaaaaaacttgattaagcatgataaaaattgggtctattgggcctgcctttacggcccaaataaaacccacgataaaatcgaacttcccgctaaatgaaaaaataagaatcacttcttatttctaaaaacataaaacaaaaaataaaataaaatg

SEQ ID NO: 810 - DNA, 3000 bp, Unknown
  misc_feature (1)..( 3000): cDNA_ID_3059055_gDNA_ID_1620323_Annot_ID_153411 3000 nt of promoter + ATG
gctttcagttgtagatttgttcggctttctatttggcaccgttttcgtctttatggcggcgtgtggctaacttcttatccttgtgaatttgttttaatttcattagatgacttcttgtttgtgaatttgatttaattttgtttagttggtaatttacaaaaataagagtaggttttctctaaagctattcacataaccgaaacttcgattgttagcaatcatctgtggtatcatatattcaatccattttatccgatattgccaaatctcaatttttcgacaaacaacaggaatgaatgtaaccccacggctacaaacgaatgaatagaggggttgaagattttggcaatatgtgagtttgatgtattggatatccacttctaactaaatctggagttccttgttaaaaaaaaaaatgccaaatgttttctgacaacgcatgtctatgtgacttctccttgtgtgacacgtgtatgtgggagataaagtttcttttccttcaaggtttaatcagttgggctctatttgggcttcatatgattgtaaacccattatgtaatttttgttgcggtttggttatgaataaaaataaaattcaggggaaaaaaaaacatctctctcattaacggtttaagtttaaaccgactataaaccggaaaatgataagcaaaaatccgaaagaattgatctgaccctgcaaatccatagacctcctccggtcctccctctcgctttacctctggagaacttgacggcgactgcgtcttcctcccccgtcgaaacacaaaaacccgtcaggtgacttcatctacttcgctactctccgattttagaagccttaacactggaatgtgatgatttgtgtctgaattcgtgcgaattgcgtccttgttgtatacttagtattcgaggttgtctctgtggaatcttcggttcaattttgtgagcaaatatgctttacgaaggctatttaaaatatatgaaagcgaaatacggcgaacggtcgcagggaacttacttcatggctggagaggatctgataagcaaattacctgattctctgataactcagatactcttgtatctcccaataaaggatattgttaggactagttctttgtccagtaggtggaaaagtctctggcttttgattcctcggttggatttggactctgaagagttccaagattacaatgcctttgtgggttttatgaacaagttcatagatttctctggggaagaaaaaatatgcttggacaagcttaagctaagtagtcggaagactgtgaatgatctgccttgtgtcacgcggtggatagactttgtggttaggcgtaaacttaaacatcttgatgttgagtgtcttgtgaatcgtaagtttttagaggagatgcctttaagtctttatgtttgtgacacactggtaaatctaagactccatcgggtattgttgggtaagtttgaggctgtgtctttaccttgtttaaagactatgcgtttagaagaaaatgtatatgccaatgatgtggttctagagtcacttatctcgtcttgcccagttctcaaagatttgatcattcttagaatgtttgaagataacgtaaaggtcctacgagtgcactctctgacactaaccagtcttaatatagattttaattttggggagggtgatgacttcgttgatggttttgataaaaaagtctcaggggttttgattgatgcacctcgactcaagtatttgaaattccaagatgatctatcggggagtaaaatcataaccaattcgggctccttagccaaggtcaatgttgtttatgtcttcaatgagaatgattgtgctgatgttgttgacataccaagacgaaatatggtccgtaatttcttaaccagtatctcgggagttagcgatatgaagatctctcagcattttgtggaggtatacatatacatatcatgtagctagcgttcttcatgaaagttttgcttaactcatgtttcttttttttggtgtgcagtttctctattattacaaggacttcgacccactgccacagttttgcaacctttcccgtttaaaagccgagatttctttatactttctggaaattctgccaaccattcttgagagctgtcccaatctgaaatcactcgtcatggtgttggtgatgactcgcacaacccttgagcttttactcaaaatactttgaggaatgtgttatcttatattcattcctttttgtttgtttgtttggaatgttgtctatatgtaggaattttatctgcaggaggaggatgagccaataatattctcatccgtacctcggtgtttggtttcgtcactcgagtctgtagagataaaaaaattcaacggaaggcctgctaaaatggaagtagcaaggtactttttagaaaactctggagttctccaaaaacttgttctgcatttgaggtgttccacgcatgaagatggattttacattttaaaggatctccttgcattgcccagaggatctagcacatgtcgaatcgtagtttgttgacggcttgaaaggttttaggtggggctgtgatcagattaagactagcaatctagcattcccagctgattacttaaattgtacttggatttctcattttgttgcactctattatgatgtctttgtgagcttttggctactagttctggatgatgttgagaattctttgtgtctcttcccttctctgaagccatctttcttgtcttatctgttgtcgtgaatgactaatgggctttgagatgaaacttttgctcttgggccttgacccatctcaatctcttgtcttgacatctctatcttcttaaaacgctctcaaaacgtcaaaacccttaaaagagtcatccctatcagttctgctcatcttctccgctagaaaactgagatcatcgtgatctgtttctgactttcgtgctacatgcgtacttacacttaagtattcgaagctgtcactgcggattcaatg

SEQ ID NO: 811 - DNA, 3000 bp, Unknown
  misc_feature (1)..( 3000): cDNA_ID_3059051_gDNA_ID_1620323_Annot_ID_153412 3000 nt of promoter + ATG
ctggcgcagaaagtgagattctggaagaaagtgtacgtgatatacagcttcttctttgtgaggaaaatcattgcacattgggtcacattttgtttctactgcgttgttcttcctctcacaattctcgtcccggaggttaaagttccgatttggggttcggtttatatcccatccatcatcactatcctcaattccgtcggtactccaaggtatattctgttccttgtatctcaagtcattatctctgtttctttcatagggttgcttatatgtcacgtaactgagtttaaatccttttctatttctgattttgttcaaaaggtcaattcatctgctgttctattggattctattcgagaatgtgatgtcgctgcaccggacaaaggccactctcattggtctgtttgaggcaggaagggctaacgagtgggtagtgactgctaagcttggaagcggtcagagcgctaaaggaaacactaaagggatcaaaaggttcccaagaatcttcaaattgcctgatcggtatgtttacttcctatatagaaaattctatatttgttattagaaactagggatacacactaaatgattatgagttatttgtgtcagattgaatacattggagcttggatttgcggctttcttgttcgtgtgcggatgctatgactttgtgcacgggaagaacaattacttcatctacctgtttcttcagacaatgtctttcttcatcagtgggctgggctggatcgggacttatgtcccgagttagtagttgtgttgtttcagagagaaaagagaatgttattaattttcttgagaaataaagacaattttcattgaaatgacaaaggaaaattgataggggagatagagacgtaccggtaacaacaagtaggaagaaaggagaagacttttatcaaagaccaggaaagaggagaagctccaagggttcttttgatttatttttaatttttctgtgttttatttatatagctatgggatttgtgattcagttgttgtgagattttaattttcgttctttgttttttattttggtttttgggtattttttcgttttgaaagtgttagtctttttgttttgtttttatgatttagaattcaagattctgcgtgagctacaagtgttagattgatgcaaaggttcaaaattccttgttgtcatcaacaattatccattttatagtaattaatttacagtcagtgaatgtatttaccacacttggagctccaagtgttcatttgattttttttattttttcataaatacttagctatgggatttgagactcagtaattgtgagattttaatttctgttgttgttgtgtgtgtttttttggttcttgagggagaatattagattgatgcaagggttcaaaattgctagatgtaatcaacaattacccattttatagtaattaatatacacagtcagtgaatgtatttaccacaattgtacttgcctatcccggtttgtgtttagatgtttgattgatattcttttttttttatcgtagtaaaggatatactgttctattagttactaggtataaaatatttaaaatagtaataattagctgtatagaaaacattttttttttagagtaggtttttgtatcatcatgttggtagctactagctagagggaaaattcaaaaacctctaaaaattaaattccaagtaaaaattataaatagaaaactaacaatatgccaaaggatttttaggttttttttgtcatgatctaagggaaggaggtatacaatttttttcataattatattcgagtaaaagagttttttagtttaaattcttcatacacattcatacttcttttgacattttctctctcttcactttttaggtttttagagagaaaaagcggtgagcaaaactttccggcaacaacgatttcaaattagcgtctttttggctggctaaccgtccgaaatcgtctgctttcagttgtagatttgttcggctttctatttggcaccgttttcgtctttatggcggcgtgtggctaacttcttatccttgtgaatttgttttaatttcattagatgacttcttgtttgtgaatttgatttaattttgtttagttggtaatttacaaaaataagagtaggttttctctaaagctattcacataaccgaaacttcgattgttagcaatcatctgtggtatcatatattcaatccattttatccgatattgccaaatctcaatttttcgacaaacaacaggaatgaatgtaaccccacggctacaaacgaatgaatagaggggttgaagattttggcaatatgtgagtttgatgtattggatatccacttctaactaaatctggagttccttgttaaaaaaaaaaatgccaaatgttttctgacaacgcatgtctatgtgacttctccttgtgtgacacgtgtatgtgggagataaagtttcttttccttcaaggtttaatcagttgggctctatttgggcttcatatgattgtaaacccattatgtaatttttgttgcggtttggttatgaataaaaataaaattcaggggaaaaaaaaacatctctctcattaacggtttaagtttaaaccgactataaaccggaaaatgataagcaaaaatccgaaagaattgatctgaccctgcaaatccatagacctcctccggtcctccctctcgctttacctctggagaacttgacggcgactgcgtcttcctcccccgtcgaaacacaaaaacccgtcaggtgacttcatctacttcgctactctccgattttagaagccttaacactggaatgtgatgatttgtgtctgaattcgtgcgaattgcgtccttgttgtatacttagtattcgaggttgtctctgtggaatcttcggttcaattttgtgagcaaatatgctttacgaaggctatttaaaatatatgaaagcgaaatacggcgaacggtcgcagggaacttacttcatg

SEQ ID NO: 812 - DNA, 3000 bp, Unknown
  misc_feature (1)..( 3000): cDNA_ID_3059047_gDNA_ID_1620323_Annot_ID_153413 3000 nt of promoter + ATG
tttttacatccaggagttagtaacttcgaaccaaaatatccatgaacaaattataggttttaaaggcttggtcaaattcaaggtcgaaaggtcaagatcaagatataatgtaaggtgaatttttatggtgcatatggctgacactgttaaatttttgtagtatagtatgtagtgttgaatattaaattcgcgtaactagaaatggtcaaaagtcatgtaaaagaaagtcagttacgcatgctaatttccaaaatttcatacataaaactaaagaatcatttagctaattaacgtagacatgaccttacttctaagattatatctacagaaaagaaatgaaaattttaagaaccaacttatcctagtcatcactcaaacacgagattgttgccttgctgagccacttttaaaatcatcctatcgaacaaatttcgtgttatatgtcttttctgagataaaagaagcaaaaaaaattaatgacacaactttatcgtgaaaacagttgaagcatcacctgaaaaagtggagtaatagtccgattaaaagacacaaggtaactatagtgaggctacttatgtaattacgaaccatgataccactttggacgaacctaacccttcataattgctcgtagttgtggcagcgcaaggccttctagtcaaagcaatgtcttattattatttatagaaatataactctcacttaaacattaaatatcatagacgaattctcaatgtatatattatttttaatgtatgtaaagctagattggttgcactcaaaaaaaaaaaaaaacagattggtttctcttttacagaaacgtttttgtattgttttctaaactctttcgaaaacttgttcaatattaaaagaacgagcattttttgtatcttttaaagttgtaaatcgctctaaatgaatagagaaaatgtaactttatattcatggtttttctctgaataaccaagaagtcttaacttttaattgaatctcggatttttttttcacataaaagaccactccatgttaatacgtcaacattatgtcggtacttaaaccagtgacattaaagacttcctcaacattgtatttttttcattatgggtactgaaaattcgtcaattcaacaacggtatataatcaagtaggattattttggtagataaaatatcataacagcaaataactctatactcaaatgcatacaaaaaatacacaaacctaagtaaaatatcagaacgctcaaaataatactagtatggggtgcaactggcaatatccgatccatggaaactggcaacttggtctgcagtctgcactcatgcatgttatgataaacactatacgtatatagattttttttttcttttattgcgaatttgggcttcgaccttattcttcctaggtccgacgccactatttagtccttttcttttagaaatacttctcctcccaaaagggtttgaaccactaccattccatctcctaaacacatttatcattgctaaagagtatattagattgtgttctgccttagagcatccacaacaatagatccaaaaataaggatccaaacaagctttatcattttaataaaaataaatttacaatttagacatttgaaagagatctatatttaaagtatgtccaatggtagatccaaaatagagagtctaaaaattcaaatgtttgaaaaaatgtgtcaaattgttttataaagaaattaattatgtctaatacaaagacattcaccaaccaaattgtgccacatatgggatccaaatcagttataaagtatacaaatttggataagtctaatgtttttctcccgttgaggttgatctttctctcatcaaacatatgtattttcctaattaaagtattgaaatattaagaaaagataccacaccaatattctaataacaatgtattgtgttttgatgattttattaacacctatggataaacggcattttatatatatatatatatgaatttttatgtctaagatgaaaatctatatctatatgtaagatatagatttatatgatagatctagtaacatgttgtttcatatgatgttaattcttttttttttataggtacaaatcaaacttaaaattactttcatttatttttgtaagaaaaacaatgatctaaacttaaccaaaaaaagttgactaatcccaaaaaaaggatgatcaaacttaaaattattttcatgagagtaaattgactaatcccaaaaaaaaaaaaggagttaaagtgaattcacaaggttgacaaaatgagttctagaaagttgacctataataagtaaattgttataaaaagctgcaaaatccaaaatcccataaatggtaaaaagttaaaaaaaaacgcataaaatcactaatcactaatcattattcaactgtgtataaaaggatatcattaggataataaattcattagaaatctatatctctctcccttctcttcccattgggcaggcacagattctgaaataacaaaacacagaaactgaaaaaccaaaatctcctctgttgttttttaccagaaatttcattaactgaaaaaatagaatctcataaagacacaaacaaaccaaatgtattttttctttctttcttccttttatttccttttaacctttattactctctaaaaaatctaaataaaaaatcaatcaaaaaaaggaaaacaatcttacaaataaataaaataaagtaaaaaaacaaaattatcaccatttatattcctcgtttatccttctcttcctcttctcccttaaaccacatttctccttctggctctctctcttcctaagtttcctctctctttagaactgtagagagagaaaagcctccatttttctcaaggcaatctctctctctctgcctcatctcataaacccattacaccaaaacctcatcgtagagagagaaacacaccaaccattgttacactctaagagaagagaagagagaaggaaaaatg

SEQ ID NO: 813 - DNA, 3000 bp, Unknown
  misc_feature (1)..( 3000): cDNA_ID_2126569_gDNA_ID_1620323_Annot_ID_153407 3000 nt of promoter + ATG
aaaagtataatcatccatctggtcgtgtatatacgtactatgccaacttccatgaattttcactgattagtttattaaagttctcaactatcttcaggaaattcagttcgagttgctaaagaattgggcatataatttccacgaaactttgcatttgatagataatttaacatgacttgactatttatactagatatgtgtaatttcccacctatcttttagggtctaaacatttttgcatgccaaaagagttaggtgtggtggaagctaccatatgctcttaacatccatcttctagaattataatcttcgattgtaagcctgaacattttcatttttatgagatatttaaatttttagcaaaacaaaaaattggcatatgagtttctttgtacatgtttcttaagctgtacttttaaagttgtagacaatgttacaatatttcatgtacagtttctttatcttcatgccgtggagttatgtttttactttttaggttgtgcaacactgaaaaataagggttctaatataaatggattcatattttaaaatcaatttttgtagcatgtagagcggtaagaactattaatcaagctcaaaattatgaaaatttgtatttgctgcaatgttgaaaatatgatcatcatattaaaatattattattaagaggttcttattaattcacatttccacaagtaatgtttattgttttggcacaatggtgtcagatcttgcgtggtgtcctggtgtcctaatatcgtacatgtataaactataaaagtcttccaccgtactaattaattaatgtttaacttgttaatgagaagacaaagttgccaactaaaaggtaaccaataactaatttaaaagagagtagtcttggtcataagtcataactcataaaaatgaagatcacgaactgatttgagcatttagtgggtccttgatggttatcatcgagatgaagtgaatcttgtcatggcgggttattatactcataaacactaatgatatatttgaaatagtagttaaattacatttcatgagggacaaatatgatgacggtataattatgtcaattgaccgtaaagagtttggtggcagatagaactggtcggaaatctaacataccaaaggattattacaacctcgtcatgtttttgttacaaccttttaattaatgttcttagtttataccctaagttattacaacctcgtcatgtttttagtggtcgtatagactttgttcttagcattttaggtttcatattagtttgatgtaagcttgcattatcatttctcaactacaactcgaaattagatctagttacattggggaaacaaaattctacctgtaaattatttaaacctattcttggattttgacgaaaccagcattaatgttgtcgtctcttaagatattagaaataggattaaacacttccatcgtcatattgtttgaaagcaacttgataatgatcacagacaaagatgattaaaaacacttacattatcacatatactaaattgatgttattataattaattatagaagggttgattaattaagagaaatggcgaaatcaggagtggggtggtaggtgggagaaagagaggtcgagcacactgtggtagttggtgagtgtgtgggggagccttgtacttaggttttgccgacttctttagattccggttaagcttttggttttggttccggtttaagttagagatcttaaattagtgattatacaagaaatctcatgtagtaatattattctatttgtggtccaagatatggcataagatttaacgaaagaattgaatgttataatgtgttgcaagtagaagctttttacgcttttaattaatgttcttagtttataccctaaagttatgaagacaaatagcagcctagccctcgatggctcgatcaatttttatcttatatttctcattgttcattgttattccgttatatttctagtatcgcgaaactggtttcaggtgacaaattgaaagtcaagtgatcaatgaagaaatatttggcttcaatatgtattttctacgattttattttcttaagatgtagcttatctaactactgcagaaaaatgtatacacgtaaatcatgtgatgagctttgttttcaacgtgaaatatctcgttccaaaaaataagaattttatttttccattatgttgtagttgttttcagacagcattttccactccacttaaagagttctcgaacttattcaatgattggtcatgtgaggctgtggcatatggtgattgaccaattaatttaagcagtcaggtcaagtaaaataagtaaattaagcactcctaaacacactaatattgaatcatttgcgttagtttttgtcgtaaattgtgtacatttaaaatatgtttagataaattattaattgatatcatccaagtggtaaatctttcagatagaaatgctgagttcgacgataattgagacggatcttttcttcaaacgagataatcaatctaatactattgatttttgtttatgagacatctaaatctttcagacttgaattttcaaatattatttataaaaaataataattggttggtgatcaattggatccagtataaagctgaagcctgaaagtagacttttgtaacgcaattactaaatatcaaacattgtatgcattggtttcttgaaacggcccatgttcttcaaagtatttgatgttcggcccatataagatttgaaaggtatgggccaatgataattcagataatctacaagacgcatttttaagccttcttaaacttacggggcaaaaataagaaaaaccaaaacaacaggggcgaaatacaaattatctgcaaatgtttttgtttcttctcagtgtctctagtttacacaaaaaccccaaaacctctctcacaacgcttatctgctcaacaacactcttcacctatccacttctcatctcttcgttatcccctctctcta

SEQ ID NO: 814 - DNA, 3000 bp, Unknown
  misc_feature (1)..( 3000): cDNA_ID_2126541_gDNA_ID_1620323_Annot_ID_153398 3000 nt of promoter + ATG
gtttgtgaacgtatatcagattccattggttggtgaacacgtcgtcgatctgctttacaataaccattgattttaacgacattaatgatctccatggcacataaacacaatatcaagacccaagtcaactgacccgcacatacgtattttaagaaatgtattggaatacatttttagtgaaagatattgtaatatataaattataatgtgcatagaaaagtgtatagtgttatttatgatacaatcactaaactttttaataatttatattatttatatttcatttgtattttgcatagtaaatcaaatgttagatttgtttcgaactgcgaaataatttagagatatttggaaaatctgtgtatttttgttagtttgatgtatatacaaattaattatttttgtttaaaatttgatcaattagatgatataatgtgaaatttactccgcggtacaccgttggtcaatttttttgtaactaaaaatttgaattttaagttatagttgttttgtaaatattttttttttttgtttagtgtttaagatttgataattgtgttaaaattgttaattctaagatttcactcgtagattatcgttccgtatgaatatcaatctaaactcgttccaccagataatttcattccgtaaaattaaatattattatgttatttttaaatattctgattgtaatatattaaaaaatattgagggattgacctgtggtagatcttggatttatatatttaagatattgtagtatataaaaccgatttttagtgtatacctttcaataattgtataaagtatattttaaaagtcaaaatttgtataaattgatattgcaacctcatgaaatcgtagtgatttacttgtagggtatcccggactaatttttgctttttataaactgataaatttgttgattttatttaaaaataaaaaaataaattaagttatatttgttttgtttattgtttcagattgtataactatatctatggctagttttttgtaatctagtgttgacccttaaagaaaaatccataagaatacgcataaattgatagtaaaattagaaaataaacatcattagaacatgaagtaatttacttatgaatctctatctagtttttttaaagaatcaatattctagatagattgtacacaaaattagattttaatttggattcaattttagattttctgtaaaaaactaatctgaattacatattttaaatttaggatgacgaaaatattttttttttaaagctaaaatttactatgatctcaacaattttggtatttttaaaattaaacttatcctcttgcattatcgcaaatatgatagtcattattgttcgaatacaattaatgttctgtcaaaaaaatcatattactgtttgttccaaagaaaagtcattcaaatttcaaagaaaaaaaaagaatattgttgtgaatcaatattttctcattttgaatatttgcattaaaaatttaaaacattggtagttaaactttgttttactgtttaaaaaaagaaataatcgaatctagaagaatgaatattccaaaagcttgtaactattataatacgtttaaaaatatattttctattatataattcaaatttagattagtgatatattttaaaaataatgaaaatttcctgttttttaaaaatattttaaaactttatatcatttaaattctaattaaaatgttaaatattttaatctatacagaaacgaattttctagataaatacaaatctaaaatccaaaaattctcttttgaatatgctaaatcataatgtaaaattattttttatatgtactaatcagaaacaattaacatagattgaagttgtaaacaatcaattaacatagattgaagttgtaatcataatgttaagggaattgtataaaatttaaactaaattataatttgttattaaattagattgaagtttccgaattatctaataacatcttatcaaaataaataagtttacatatatacaattcaaattaaaatagcgtgatatgttacggaaacatttttaaatgattttttaaaaaattggatagttattaatttattgatttaattcgatttttctttttaaacaaaatccaagatatttatttagttgtagtagttgttaatttactaaattacaaaaattcatttagttagttttaaattacccttacaatgttgtacttcacacgatgcttcccaattaataatatagatttaaagttgggaaaaaagtattttttgggcttttggcccaagtagaaaaaaaactaaaatgaccgttaccaactagcgagggaaacaagcgagtacgaaaaaaagaaagtaacggatttgataatgcattagcgagtaaagtttgtcataaaaacgaaagactggtttgctttcacatttctactgttcttatttgtagtttataatactttaaattagataaacttttaatcatgtttgtatgatctctttgtaaattatgtttgtctttttttttttttgctataactgttaatatcatagaaaatgaaaatgtttggctattacaaagtaaagttcttagctttgaaatcttggcaaaaatgaataaaaaacaagatttcaagatttgtaaattatgtttcaaaaaagtaataaatgaaaaatgttaaaaaaaaattaacgaaacgtaaagctctttaagtgttatttgacaactgtaatcggtgcccatattgtttgcccataatatctgcatcaaaactctaatatcattatcttgttacatcgcacgcgatcggctctccggatcttccaaagtacaaaaccctagatccatccggtaatatcaccttcttcttcctcactcgtttctggattttctttacgtttattctcggttctgaattctgatgattcgtttgcgtaagatttctaggttttgtgagagaattcgatggaggcaaggaaagagaaaagaat

SEQ ID NO: 815 - DNA, 3000 bp, Unknown
  misc_feature (1)..( 3000): cDNA_ID_3059127_gDNA_ID_1620325_Annot_ID_153463 3000 nt of promoter + ATG
tattcacatctcttgatgatataataaatgttcatttttctttttctttctttgggaatttggtgaataaacaaaattggtaaagcaattacgaatatagctatgtaatgtagaaaacaaaagcaaataatgatttgcatttttctttgtcagtcgtcacgtcgatggcgtcatacactgatacaagagtacgtgaccatagaaaagatagaactccatacaaggaagaaagttatatccacttagccatgtttctttcatcatttatcattttcattcagacgatccacttacataattcatttgaatgatgtttctttcattatttgcaatttaatctaaataatgcatttaaataaatctttatttgtttgattattttgtaattcatctacattctcatttagataaaaatgattaaaatacccatgctttcattttgacaaatgacaaatattcaaaatcattacctatcatcaatacaaaacatattggcaggaaacatgattttacggttttgacggaaaagcgtttttggcgggaaaaacatgattttgcggttttgacgtaaaaataagatttttgcggttttggcgggaaaatatgatttttgcggttttagtggaaaatataatttttggcgaaaaatataattttatagttttggcgggaaaacatgattttgcggttatagtgggaaaatatgattttgcaattttggcgggaaaacataattttgcagttttggcgggaaacataatattgccaatggcgagaaaatataatttagtggtttcggcgtaaaaatatagttttatgattttaggtggaatagcggtttttggcaaaaaaaacgcaattccatgattttacgattttgacagaaaataataatccatgatttcatgattttagaatttttttttgtttcaatatgtaatttgaaaaatataaaataagaaatctataaaaaataatattatttaaaatatgattataaatgaggatatatttgtcttttgactgaaccatatccatctaaatggttcaatcaaattcatccaaataagttttataaatttgtctaaatttaaaaaatcattcagatgtattatccagatgaaccatccaaatatttgttaaatttaacaaacatcatttttcatttccatttggatggatcatttggatgaagaaacaaacagaactacttcctaaaaatctctcgctatcatacagacccttctagaaaacatgcatgcaccggactttgtgttgcaacttgcaatgataatacatattatttttgaatagatttctaatgataatttatatatccttctacaaaaagcaaaaccatatattttttcctctccttttgtaagtcgaattcattgtccacttggaaaaaattattaaaatcatattatgcaaaccaacccttgtggtcccataatgagacgtgcacatctctcgtatttactatgaataacaaaaaacaaaaatagaagaaaatcaaatcagtaatggagtttattgatttatattggttcagtaatttaaagcaaaattatgttttattagatcattgatttaaaaattttgtcaaaataatgtattatccattaattgatttctaaataccagttcaaatcatgatttaatgctggatttcaaaatctacattagatattaaaaggagaaaatagagtgatttaatttatggataaaccatgttatcttaaaatcaatatgtctaatttcaaaattaataaaaattcacaaatcaataggatttttttattattattaataggaattttaaaaactcagtattttggataaggataagagaaagttgtgttcctgggttatctacgaccgggggactttcattggttgtaaaatattatcatttatcaaacataattatcatatgaaatcttaacttgaattttatttatagccaaaattatttttactctttgttcataaaattttaatactaacttatactattgaatattataaaaggacaaacgttcatttgaaatgtgctatcgtaaatgtttcgaagaattggttaggagtgcactgaaacttgaaagtaagatatttttacagttttatattttaatttatcataacgtacggacactcatgtcaaatacgaaacaagatatttgaataatcctttctactaatacggttaataaatttacgtaaaacaaaattaattttaataattttatttacaaaccaaaccaatatcatcaatattatgtcttttattgagttgttgactacttgacatataaggtcttctaagaaaattccacaatttgaaacttcctcacaccttcctcaaaccaaaactagtattacctatttatgacatcacttttatgcttacacgatagctactcagatatataagtgtgtactctatttcttgtttgatggaaatacctttctagagtactcatcagacccagttacatgcgattatgatcgaacttcaagaatccagaccatgaaaaaggtacgtatgatcccattaaattcaattttactttaaatttttgggtactattttaaaacttcatctactctacatattctattattttaaaatatgttgttttaaagttttttcttttcttttcccagctatgtttgaagttagagaacattaaaagtaatgtcattcacggtagcaaaactaccaaaaatgctacaaaacataaatctttccaaatgtgtcataatggtggacaacaattttgtctaccaaaatttttttatgtcgtttcgaatttttgtccaccaaaaatctgttgtttcaaaagtggacaagtttttttcatcccattttttcgtttcaaaagtaatctttattaattacatcccaattttttcgtatgtaatgcggcaggtgattacaattcttacatataagcgataagaagaattgaagacgaaaattggaaggaggagctg

SEQ ID NO: 816 - DNA, 3000 bp, Unknown
  misc_feature (1)..( 3000): cDNA_ID_3059133_gDNA_ID_1620325_Annot_ID_153476 3000 nt of promoter + ATG
aaaatttatatataaaaaatgatattgttgctaacgatccactctcattttgtggcctaggagtctatttttgttatcgtaattacccgaaaaaaatactaaagaaacttcttagaaaatagaaatgaaattctggaggagttgtgtcgggctccaatatatggagacaaaaactaattttactaatatagtaatatggacaaaatttgtgagctcatcttgcatcaaattaataattatattggttatgtttcgctccaaattctcatatttgtctcttacctaatctgtaaaacacacacacgtaacgcgtaaataattaatatctaaaaataatcagttcaagtagtgatattcaaagactttagaccagtaattatagtaagaaaatttgattggtctttaagctttctttataaaaatagcttataaaatatacaatttgcagacttatatatatatatatatatatatattatataaccatttaattttaaaatcaataaattttaaaacaaatcatcccacagtatattgtggattaaaatttagtatacaataaattgtctacatagtaacaaagcttatatgtatctaattctagtaagcacttttgattagattcttcttttgattagttgttttttgttttttgttttgtataagcttggaaaaaacgcattatagataaatcgtatatgcaagcttgaagtacctaacccaccatgatttcattttcctatgaacttttcttatttgattttggttttcaattatttaaccatatatgctatatgcttgaccgttctcaaattctcactaacgttaaccaatatattttttctaaacctaaaagatggctaaataaaactttggcatcataaaaatgtcaactatgagcatatctctctatttgagagtttgcttaatccaatcttaagcttatagctcatgtaagatgttactatcatttgacaagtttgtgcaacatttgatgagtattttttttttttgttttttaatatacttcacataaatgaatacattcagttgataatcagaaaaaggttactagaatcattttaaagattactcttctaactgccgcacatttacttttgtaatttggaaacaacactaatcatctgtctactaccgctagataagcaagtattttcttgtttccccaaatggtttgtatccttagacataaatggtctttttgagagtttactaacatgtgggcagttttttgggatttcttgaaaagtgattgcaaaatgaaatcatccatgtgacatgtgagcaatgaagatgagaaagagagttggttagagattaattatttatcaattctctttgtggagcttgctaacgtattgaataaagcctaatactgtatacaaaccaaactgtagaaatggactttgtaattgtggttagtcaaagttctcttttactatacttctttgaaatttatgcagtgtctctttatctctatacatagatatattgattataacgaaaaatttaaattctataaatcaaacaatcatttttctatttattatgatgcgtaagttgatttggtcaccaaaatcatgttttgagttattttatagcatattagaatgacagatcttaggtaagagcatgtattacaaatttaaattaatttgacctatctaacacctctgaaagtcaattttataagcaaaatattctattgttctttatcgaatgttaagcaaacattctacaaaactcttacaaaatcagtttgatagtagagcgagtaatcatctaataatcaataataaaaactcaaaaaaatactatgacacatcttaaaatttattttactaatagcaattcaagctgtttaaataattatattggtttaacgaatttaaacaaatttaatagtataacattctagtgttaatctaaggaagtacttgcataaccataattcttttctctttaaattaatattcagaagatgtgaattatggtgttttttattaggatacaaataaacaaactcattatagtatttgataattcaacagtctctctctcgtgtgctagatttgttgtttcttgtttgactagattagtaatacaatacctttaaatatagtattcttataatacattccacatttccgtctatatattatatgcttttattgggaaaaataataaaacaaaaaagtagagttgaaataaaatataattaaaatgacggtagagatgataaaaattagaaaaaaggaagataatataattaatgtgtccgcacaaaaaattaaatgtccttcccaaatcagattcggacaatcttcttctaaactataattattatttctcttccttcttcttcttcctctgtgccacagattctctctttttccttcatcaaatctacgcttctttctttgtctgacaaaaaaatatatatcaaaatcaactctttttttttttctcttgtttattccagaatctgtatacataaccagaaaaataaaataaaataagagacaagagtgaaaagaacaagttcttctagatgttgttgttgttgttgtctcatgggttcttcgttttctgagctcttcgacatcataaatctccacatgtaagaaaaattaatacttatgaaagaaaaataacctttttattcatcacgaaatctgcatgtgttttttttttttttttttttgattgatggagctttggtttctggttttaatggcttcgattttgcaaaacgaaaaaaaaaactcaattttttcgattcagattttgatcgggatctatgtttgttcgattgattataatttctaggtttatttttgtaaattccatttttcaatgttcttatcttcttcctctgattattttactaattttctcgggaaaattaattttgaaaattttctcggtttggtttttttctccaggcagctttgagaattgaggacgaaaggagaaatg

SEQ ID NO: 817 - DNA, 3000 bp, Unknown
  misc_feature (1)..( 3000): cDNA_ID_2126715_gDNA_ID_1620325_Annot_ID_153467 3000 nt of promoter + ATG
ctatgtatttattatgtaaaaaaaaaaatgtataaaccaatgacataatcgttcgtatagccgtcgacttctattgtatatttgctcaaacgtcgaccctttcaaaattttaatatcgatgtttgtcaaactcttgcagattttgatgaattcgacgctagattgcctttaacgaaattcaaatgttacatatacatagacgatatatatatacatgcattagatgtacatgattagtgctcatctacattaatatttcatgtatgtatatgtaattaaatattgaatttcattagaaacattttggtaatctcgtgagtttgccaaaatatgtttactttgtttgagtttgaccacaaaaaaaacactagaaaagtcaataacgtgacaaactaaacaagttgcctattattaattgcactcgatcttaattggtttgttctaggaccatttttagtagaagtaaaaccagcgaaaacgaatgtaggattcagtcgaagggtgttttataaaatcatcaaattattaggaacaatgaaatatctgtaaattaaccaagattatttgcgtttggttgtagcgtgagaaaagcaaaggctaataacagttgagagaagggtgtgtttgtatgggctgctctgtatcgaagaagaagaagaagaatgcaatgcgaccaccgggatatgaggatcccgagcttcttgcatccgtcacgccatgttagtttttagtttaaaatcttattagtaagacaatctttaaatgttacaatagcatgttgtagagtttggtaaactttttcaaattttattttacttgtaatgggagggacaatagtcacggtagaagaagtggaggctttgtatgaactgttcaagaagctaagcagctcaattatcgatgatggtcttattcataaggtttcttctttcactctaaaaggtccatatgtagacagcaattaggtaatctatatagcttaattagagtttaaaagtttgatgttgcaggaagaatttcagctggctttattcagaaataggaaccggaggaatctcttcgctgatcgggtacatatagtaactacctagctagaacaagtgacattattgaaaacatatgtaaatttaaacaaagttctgttttataatatgcagatatttgatgtatttgatgtgaagcgaaatggagtgatcgagtttggtgaatttgtccggtccttaggtgtcttccatccaagcgcgccggtccatgaaaaagtcaaatgtcattcttctagccccaaaaattgtttcatattcattctatgtgaatttacttgatattcttttcttaattggctaactaacaaagaattttctcatgaatttgcagttgctttcaagttgtacgatttacgacaaactggattcatcgagcgagaagaagtgagtccatttacggatactttgttttggtaccctccagattaaacagttttactccactaacgtttatgtgtgttgatctaacatgtatataccataatgaattacattttgattagttgaaagagatggtagtagcgcttcttcacgaatccgaactagttctttccgaagatatgattgaagtaatggtggataaggtaatcactcccacaccgatgcacatttgtttactagatattaattccaatactgaagatgatatgataaagaatttataaggaaatggtggtatatatttgcaggctttcgtgcaagcagaccgcaaaaacgacggaaaaatcgatatagatgaatggaaagactttgtatccttgaatccatcgctcatcaagaacatgactttgccatatctaaagtgagttcataatttacaccgtgaccaactttgatccaaaccaactgctttgattgttgcattgaatcaaattgactaatcagaagattcttggtaaatgtagggacataaataggacgtttccaagtttcgtttcatcttgtgaagaggaagaaatggaattgcaaaacgtatcttcctaatataagccatgcaaggaaagataaatatacataaaacgaatatttttgtacaatatcttaaaagaggaagatagagatgtaagctaggatttggaaataaaccgatcttgataacgatattggacttgccttgtgtactgtatatatttagttatttacatagcgactctccatctcacatacataattactaattaaatatttacaaatctagtctattattgcttcattgttgtatataccaaaatatatgatccaccttttgcggatattcatatttttgttacatgaaaatattcgtgttttttttagaataacaataaaaaatttgtacacacatggtttattattgtagataatattaatatatatcaaacgaaattttaaaagtagatgatttatgaaaataatttttgcttattttaattagttcttgagtaaaattatttatacattctagatattaaataatgttgaatttttaattgaataaacactttattatatataaaaattgaaaaacaaagcaagccgaggaatctctctctaatctatctccaagacggaccaaaccagttttagttctatctctcaatctctctgatcagctccatttccaatgtaagcccaccaacttcaactctaatctccatcttcctcttcctcttcaaattcgtttagttcaacaagttcccatctttccagtgtcaatcgacgattcctttttccgttaatacgcatgtatttgattcttattgctgaggaattgaagaaccattttgatcattgttgtacccattgatgtcaaattcaagatataattgattactgtttgttaatcttcgttgacgtgataaagttgactcctttttgtgtagtgcaattcaaaggtaatgaagattcttgttgatggttattttgcagtttgttggaaagtagatacctttgagaatctaaaggatctccctttatg

SEQ ID NO: 818 - DNA, 3000 bp, Unknown
  misc_feature (1)..( 3000): cDNA_ID_2990217_gDNA_ID_1620325_Annot_ID_153471 3000 nt of promoter + ATG
tactatttataacaaggaccaatctgatgattagatagccgataaactaatctcgcatttgtttgctaactaaaaggaaaatggagtctagagacttactggtggaggaaccagaggcagaagcagatgatacaacgccgaggctggtgatggtctcagtgagaccgccgtagacggtgctctttaacaactcaatggcgaatctttctccgtccggttgaatttgtggtggtgattgtgtggtgtttatactcttcctcacatctatatattcttcaactgcatatagtttgcaaattttctttgggtacaaaatatatgtagttctatcgaatattcaaataccaaagataagcctataaacattttttatgatcaaagaaaccgttgttgattttttcccaaattgaaatcaatttgtctagtccggtttaggtgagaggagtaatatttttgtttcaattcacgataacatacctgatttctcaaccggttttcccctgatataatcaagttgtaagaactttgttcctgaaatttaaaatataaaaccagggttgatccatcaagtttacaaaaccaagaaaacctggaaagaattgactcagaaccggtttaattaaggtttgatttacctaaccggatgaagtactttagatcacaaaccaagcaagtaaagatagttccctctttatcttcttgatcatcctcaatccgagtctcagggacataaaccttaactggtgattccatctcctcaatgtcgcttggttcgtccggttcaacaaccggtatatcgggtttcagatccagagatgaattaacgtgcttccctcgttttcttttcttgagaaccacatttctggtgatacatgtgctacagctaggacagtaaagctcgtagttttcttgtgtcgcaagcaaattctctaggtttgacttctcttctgaatctgacgatgatctctcgttcttttcttcatcctcatttccaagctcatagttttcttgtgtcccaagcaacttctctaggtttgacttctcttctgaatccgataatgatctctcgttattttcttcttcctcttctatctcacaatcttctccattccgttgccttttgttctctacatttggcaagtttgtggagctcgactctaaccaattattaccattttcttcgtttgaaccggtttcagattcttcgtttgaaccggtttcgctcacagtactctcaagtactattggatctgaatcggaaaatagcgatgatgtactttcactaacagaattgttacctacgatggcaattaataccaaaaataaacgagagattgatctaccggttaagcaggtttgtgtccggttaaaaattaggatcctaaccaattagtagaggtaccaaaaattaaaagacaaaaaaacatgtaagaaactgacaagttgactaatgtaccttgagcttgagatccatcattatcctcttccaactctatctcggtggtgttgaccggcgccggagccgtcgctgccgccttggatcgaaattctcgggcgggaacattatctttaccaaatctatagctctcaagaagatcaaccaaaaattcagcatcaacgatttctttatctccgtccttcaattcggacaaggttacatgaactggttggtttgacttttccatatcaatccctatgtaatgaatctgattccaatgttctttaaagtgattatgagttaatgaaggagatattatgatttgtgagtctctctctctcttttcttcttttttcttttttaaatttaaaaaaaaaacacagttgttcctaattatcgtgtccaatcatatgatcttttatatatatacataaataatacccacgagggaagcacgaggggttaaatattcgtaacgaggattacttttggattttggtaattagggaaggtgtcatagttaattagcactctatttaaacatgttaatatatgtcagtttcaaaacaaaaaaaaaaaattgtgtggtatagtatatgtcttctttttgtcatcagtatatgtcatgaaattgatccataaggttttagaaaaatgattttaaatgattaaaaaatattagaagtaatacgaaaggtgcaatattgattaaataaatacaaactgtgatagtatgataccacgtaaaataaattactacagaaaatgaatatcacatgataaaaatactagtagtcaactctttaataactcataatgacgaggaaagtgggaaacgttacagttagttggaaacaacgaaccatattcaaaacgtgtatagttaatgacttcttatttattatgaagcccattagacatttgtttcttgggcctatatatttcattcacaataatcggcccataaaattaaccaaaagcccaatccaagtaaatcaccataaagctggaacacataaactggagcccactaatttacacgtggcacaatatgaggctccaatttcggcaagaagtgtgtgatcttttttttactcgttcttgatcttcgcgcttttctgatagatcctcttgggacaataaaaccattaaaatatcggagagtaaattttataaaaccaaaggcaaaaattgcatagatcagaaaatatttgttgcaactattgaaattatttttgttggttcgaaatttttacatatttatgttggttatgactcttatggaaatgataatgtgttttaaggaataaaattaaaattgattctgtttcatactaaaatatcaaacaaaaaaaaaaaatttgttttggcaaagaataaaggttttagtgtactctttctctgtggttaactttaaagttttggaagcatgtcggcgaagctggaaggagattctttacgtagtagataggccacaggtggtttcaatcttccccaacaaccagacgaaatcaaacataaatctgtaacagtcgaagaaactctcactctttaattgatca

SEQ ID NO: 819 - DNA, 3000 bp, Unknown
  misc_feature (1)..( 3000): cDNA_ID_2126738_gDNA_ID_1620325_Annot_ID_153472 3000 nt of promoter + ATG
aattaaattaaagttttaatgaattcagtctagaagcaatacaagtttctgaatttgtgaaattatatatatatttgtttagcagatcacatcctaaaataactaaccattttaaaaaaacttaaaaagttcagaattacagtagagatgattaaaacaatgtgactgcaagtttccaacctactggctgggttataaataatatttacttataatggattcttaatatacatagttttgatatgtttatgtagtttaacgacaatgcgacacatattaatattataatttaacttcttacatatgtttgaaatcagtaaaaccaaaacatgtcttaaaaaaaaaaagagatatatatatatataaaaggttaccaagaacataaagagaaaataaaatataagaaatttaatagtaagtacggaaccctatataaaaataatgaaggaagtctctttagcgatgacgcatcaatatctcttgattaattaattttattctcttcatagaaaaataaatactaagataatacagttttacaaggataacacatcattatctcttagttaattaattttatttctcttgataaataaataaataaataccaaaataataaagtttaaaaattcctttcatcttttatatattggatttgatagccattatgagaaaagtaccaatcagaaatggtgaattaataagttaataatgatgatttcatttcataccagaattggtgggcttaattccttaaaaacaaataatttgatcaagattaatgatagatgtgaatgagtaggagagcagtaacacacaaatgaatgaaacgtgaaatataattaagtccattagacgtgcttaccatattcatatgaatcatacaaactaatctgtcatcgataaaaagaataaataattattctctttttgtttatttttataataatgtttagttgaaatgaaaacgttatcgttagagccacgcacgatcctaaattctctactataagaatatgtatgaatactatatttgtagttcacattcgctttcctaaggtttaccaaccagtttacactgaaaatgtgtacatgacaaattgacaatgattgtttcgttttgtttacgctgtttttttttattattgaaattcaggaggttctaggccgaaaacgtaatccccaaaaacccgaaattatattatgtaatattagtttcgtctcaaacatcactcgaaccgacgacctttaaacttctcctagagtttttaccaattgaattaacgacattataatttatttttcttagaagataaaagtaataatcaataccaaaagccaaataattattcttcgataaaaaaattaatttgaaatgaaaacaacaccaaacgcctaataattattggatgaaaaaacagtattcatacattaattaataagtgaatcatcttacatgtcaaaaaatgttaatggtgtttgtatctatctattcttttcggtgattgattacatcaacaaccatttgaaaattttgacatctttttttctgacatattggatactgccctatttattttgtccaaaacaaaaaaaaaggatactgcccttttttcttctcatagacaaaattaagtatataatttatcaaattttgttagatgattttttttgaataaaagatgatttggttttgaaaaaaaattcaactccatgttaactaacaattcatacaagatgaccaaaaaaaaaaaaaaaatcaaatgaggatttttttttttttttttctgttttttcttggtctttttttatgtcagcactcaattatgtttagagttgacatgtttgaatatatatatttaaaaaatctaaaatagtttaatttgagaaaaagaaagaaataatgaacaaaaaaaaaagagcgagcgttcgttgctccggaaatgatgggcaaaagtgggtaagtgagtgggaaatagaggtctgtgaataccaaacgcttccctttttcttcactttcttccctctaattactctcttgtctctctccctttcctctttcgtctcctacgtgtttaaaccttgcaaaaaatcaagtcttttttggtgtttaaatcacccatttttgtcaatctgtttttcgagcaaaacaccaggaggaaaccaaaaagctagaggctttgtggagtgagaagaagagtctcaggttagtttcttgtattcttctgtgtattctcattatctgtttttttgttctcattcgtcttgtctgcaaaattcagttcacaaaggttgagactttacacgacttggttctctttaaaaccgttttgaggtcataattggtaaacatttgaattgggttttaagagctctgtttatatagtagaagaagttggaacctttcaatgttcttgattaagggttttaggttgaatgtttatagggtttgattttggatgactagtccctttttagattatttacttgaaatggccctttgtctctgtttatatgctatggaacaaaatttgcaattcttgatctcggttggttggaaaatgctaattctttaatcttttatttgtagattttgttaattctttgttgtcttaaaaatagtattgttgaagattcagacaaaaatgtgtttttgtttcagatcaaattgtctggtttctttagagctgtggattctacttcttgtctgtttgttattctttattaagatttagttggcgtgttgttgtttaccttaaacatccacagaatcatatactctttggtttaaattccttaaaatggatttaaaacactctagaccaatattagttgctttagtttcattttgctagcagcttgaaattttcgagtattcttacaaataccatcgctgaagatttgactatttgttttcttcattcttgtttgatcatttcatttccacagtgaaaacagaaagcagcatttgagattccactgttaatctttgaattaaaa

SEQ ID NO: 820 - DNA, 3000 bp, Unknown
  misc_feature (1)..( 3000): cDNA_ID_1007695_gDNA_ID_1620325_Annot_ID_153475 3000 nt of promoter + ATG
taccggaactccattgatgccaaatcggacttttgaaacttacattttcgcgctcttcaatgaaaatctcaaatcgggaccaacgtcggagcgtaatttcggcatcttccgatcagatctgacaccgatttacgacatcggaatcctccggccaacggtaatcaatcaccgccgcaattcacaacattatttagtttcatatatgttaacgaatttgtttttgtgaactgacagtttagatcatcggatccggtttacaatcctcgatcaccggttagaggatcgtcgtcgaagcggtggtgcgtgacaaaggccggtgcagagacggtggctttacaaaggaacattgattacgtatgtgggttgggtttggattgtaggcccattaatgaaggtgggctttgttacttgccgaatacagtgaaagcccattcgaagtacgcaatgaacttgtattaccaaactatggagaaacacgagttcgattgcgatttcgacaacactggagagataactacgattgatcccagtatgaatcattaattaaattataatttagggaaattaactaatttcgttgtattgacttttttttttcttacataatgttttgcaggttatggaaattgtgaatatcaggctaattagtaagttttacactgtaatttgcaataatattcagggttgtttggtcaaatcaacaatatgaagtattggaataatcaatcctagcaaactacacatcatttcgagctgcttttttttttttttttttgttgttgttgttgtaaatattgaagtggaatgtcctttacatacatattaaatagtattgtcctttttatatgcatatgattttggattatgctagtagtattggtcgcgtctataaaagtatgagtgaaactttaaaatttgtatatggtttatacaaaacaaacacaaacctccctcttcatttgggtaacaacgtcgtctcatgcatgtagttttagctttatgatggttgttttgtttaatgaaccggaccaaaaatatgcttctcaaatttggtctaaatagttacaagatattccctcagttttgttttatttttcttttagagttaaaattttgttttcatattacttatggatagtgtatttataatgcagatttataataaattttttagtttgtcatatttttagcttattaattatatatatttaactagattttaacccgcggtatatcgcggggctatatctttttcaaaaaataaaaaaataatttgtttagtagattaaatatatataatttatttttatattttctaaatgtacaactcttatatatatatatatatatatatatatattatttagtatataattactatgtttaatttttactgtttaaaaatataaaaagaataacaaacagtttattaagttaaaatttagattataactaaataattcattttttaattatatttgttttaataatataatgatattttgatttataaatatatatatatataatttcacccgtggtatactgtctcgtattattatcgatccaaagtcgtcatatcatctaatctcgttcagtgaaattaaacatatctaatagatttcacacgtgctatactgtctcgtattacctatcgaccaaaactcgtcataccatctcgtatttttgttttaataatactttactttaaaagatatataattcaaatcaatttaaaagttttatttcaaatggttatttaattgttttaaagttcatatattataaatattctaaacccatcttataatctaatctcaaccgttaaaattaaatattatttttttattttttgttcgaataatagttttattaaaagatttataatcacatcaatttaaaagttttatttcaaatgattatttaatttttatagatttcatatattataaatattataaaacatttttcctaaatattttaaatgtttaattaaatataatatttatcttttaatcaagtatatattaattatgtcctaagatttctcattttttaagtaattgaaattgatggaaatataatagataaggaaatgctacaaattaggaatattaattaattgataataattgatagcaatggcatcttttgtaaataagtttaaacttgaggatttatttgctaaaatggctgcaaaaatgtatatatagataacagtgtattaattaggggtaaaacaataaaaaaattttttttcttaatttgtgtgaaatgaactaaaaggataagtaatataaaacagagggaaacgcgttttaaattccttttaatttggtctcaatagttacaaaatatgtttacttggcgtgaaaagattgcaccaaaccgttttatatcacttatataacaacattcatcaggtagttatgtttgccttttttgagttttaattaaaatcggatgaaaaaagaaaagttacaagataacgttttaaaatgttagtctcaatagttacaagatttaacattaattctttttaatttggtctcagtacttaatattaatggctagatgccaaatgtcatttgaacggaatttaatcaaaagttaaataataaagacgaagaaacaaatctcatattgtctaaaataaaatttcttaaaaatttttttaaacagaatctataactttttattattattttaatctttctagatttagctattgaataccccttcctaaattaaaacatatggattctctcaagagaggaaacaataatggtataacttaattatggagaattcacatattcgtttttgctttgactatattgattgtccatattttagttgattacggattcatctagtcaatgtgatgcgttatcttcataattacgattgactactatatatctctgtcttcgtatatatgtgtatctcaacttatactataaaaatcaattcacatatcaccaaaacaaaacaaaaatg

SEQ ID NO: 821 - DNA, 3000 bp, Unknown
  misc_feature (1)..( 3000): cDNA_ID_3059137_gDNA_ID_1620325_Annot_ID_153470 3000 nt of promoter + ATG
caactatataaaaaccagaagaagagatattacatatacaggtctggaaaaatgtttatgaatttacctgatgagcgaggttatggataatgagaatgcttcttgcatccttataaactccatatgggcgatactttgcggccaaaagtctggaataaaagaagatacacgatataagtttcaatgtccacaaatcaaagcaggattctgcacatccgttaaaagataaagcctagagtataaggtaaagagatcaagaaaaggttacatgggaacaaggccggcatgccagtcattgacaaggaagagtgatttctctccataagtgaaccctccaagaggcagcacgagaggggcttcacatgcagcatggcaaagtaacgtgaaccgaaactgtaatcagaaaatgtgtgagacgacgcacttttgttgttttaagtagaccacatgacttaaaacataacatttacacaataaaagaaagttataattataaaccaaagtctttctttggacaatgtcaacagtagtacctgattgtcaccaaaggctcctttactatctccgtagggattaccaggtctatggtaggatttgtgatcaacaaaaacctaaagacagtttacaaaaacaacacaaaatgttaagcaatggcgtttgtcaaaactccacaataatttatgctagaagagattagtggttacccaatcaacaccatctctatactcatgatagaaggaaacttcttgagaaccaccaaagcaatttactgttacacgtatccccaaatccttagcccgggcatagttcttgtctgcagcagttccatttaagtaccgaggagaaatgaccataacacgatgcccacgaccagctaaagctatcggcaaagaaccacaaacatctcctaatcctcctgttttcgagtaaggagccgcctcggatgtaacgaaaacaaggttattgacaacttcagcttttccactcggaatcccaacctctgcagctccttcttcaacagctctatttccaggtacgccaaagtcagccattacaatttgatcaatagcctctttcttctcttcatgatgtgtaatttctcctgtgctagtgctaactgtttgttgatcacctgtacaaggaaaaatcgagttcatcttcgagattctgagcaaaatcgtgctactttatatcagaattttttgaatatgaaagattctgaaatttgaaaaacgtaatagctttgaatctgaggaccacaagcaaaattcaagagaatcattcactttttacaaattgaaatcacattcgataaaccatcacaaaatccctagattatgcacaaatcagagaataaatcactgttcgttgaggaaattggaagaaacactatgaagaactcaatcacgagtttaacgacatttaccaggaggagtgagctgaaagccaagaacggagccagaaccatctctctctgcgtctgtgataaatctctcttcatcagactcacgagagtcaccggagaaggaagaagaacgacgaagcaacaatgaccgtccgatactgaatctccgtcgaaaacgaggaaatccgagactggcgatcggacggaaatggcggatccggttgaatccaacgaacggctcgaatttaacggagccactgatttgaagagacgccattgatcaattaaagagtgagagtttcttcgactgttacagatttatgtttgatttcgtctggttgttggggaagattgaaaccacctgtggcctatctactacgtaaagaatctccttccagcttcgccgacatgcttccaaaactttaaagttaaccacagagaaagagtacactaaaacctttattctttgccaaaacaaattttttttttttgtttgatattttagtatgaaacagaatcaattttaattttattccttaaaacacattatcatttccataagagtcataaccaacataaatatgtaaaaatttcgaaccaacaaaaataatttcaatagttgcaacaaatattttctgatctatgcaatttttgcctttggttttataaaatttactctccgatattttaatggttttattgtcccaagaggatctatcagaaaagcgcgaagatcaagaacgagtaaaaaaaagatcacacacttcttgccgaaattggagcctcatattgtgccacgtgtaaattagtgggctccagtttatgtgttccagctttatggtgatttacttggattgggcttttggttaattttatgggccgattattgtgaatgaaatatataggcccaagaaacaaatgtctaatgggcttcataataaataagaagtcattaactatacacgttttgaatatggttcgttgtttccaactaactgtaacgtttcccactttcctcgtcattatgagttattaaagagttgactactagtatttttatcatgtgatattcattttctgtagtaatttattttacgtggtatcatactatcacagtttgtatttatttaatcaatattgcacctttcgtattacttctaatattttttaatcatttaaaatcatttttctaaaaccttatggatcaatttcatgacatatactgatgacaaaaagaagacatatactataccacacaattttttttttttgttttgaaactgacatatattaacatgtttaaatagagtgctaattaactatgacaccttccctaattaccaaaatccaaaagtaatcctcgttacgaatatttaacccctcgtgcttccctcgtgggtattatttatgtatatatataaaagatcatatgattggacacgataattaggaacaactgtgttttttttttaaatttaaaaaagaaaaaagaagaaaagagagagagagactcacaaatcataatatctccttcattaactcataatcactttaaagaacattggaatcagattcattacatagggattgatatg

SEQ ID NO: 822 - DNA, 3000 bp, Unknown
  misc_feature (1)..( 3000): cDNA_ID_2126711_gDNA_ID_1620325_Annot_ID_153466 3000 nt of promoter + ATG
catgggaaaggaaaacatatcgttgtgctcgatcaccagatgaagaacttcgttgacattcatgattcagttgattcgcctccgcgggtttctctttgctctctgagtgacggaactgtactcaagattctctacgagcagacatctcctatacagatactgaaaagccttaaactagagcctccagagtttgttcaaatacaagcaaatgacggaaagacaacactgtatggcgcggtttacaaacccgacagttcgaaatttggtcctcctccatataaaacaatgattaacgtttatggaggtcccagcgttcagttggtctatgattcttggattaatacagtcgacatgaggacacagtatctgagaagcagaggcatcttagtttggaaggttctacaaattctttttcttctctcttttttactcaggaaaatgttgaataaggtttactcaaagatgatgctttagaattgaaatgttatcactgatttgtgcagcttgataacagaggaactgcacggcgtgggctgaaatttgaatcttggatgaagcataactgtggatatgttgatgcagaagatcaagtaactggggccaaatggctaatcgagcaaggtctggctaaaccagaccacattggagtgtatggttggagttacggtgggtacctttcagctacactcttgacccgataccctgagatctttaactgcgctgtctcgggtgctcctgttacatcttgggatggctatgactcgttctacacggagaagtacatgggtcttcccacggaggaggagcgctacctaaagagctcggtaatgcaccatgtcgggaacttgaccgataagcagaagctgatgttagtacacggaatgatcgatgagaatgtgcatttcagacacacggctaggcttgtgaacgcgcttgttgaagcgggaaagcggtacgagttgttgatatttcccgatgaacggcatatgccacggaagaagaaagaccggatatatatggaacagaggatttgggagtttatagagaagaacttatgaagatactttcacagaacctgttgttgcttttgctttttgtcacattctttttcatttctttacatggtatataaattatatatcatgcctattgaattggttaacactttttattttacaatcatacatggttcttctcggtttaggtttctattcaattatcattatgaggcttcatgagtctgcctatttcgtgttagaatttttcggttatgttcggttatcaggaatcaaaccaaagcaacccaaaattaaaccgatttagcggttttatagatcggttcgtatcactgatcccaccaaaacgccggtgattgacggatttcgatttttccaacgacgccacgttggtcatcgccatttgtctaacattgactttaatggtgaaaatctgcattttatgctaaatattccattgaccaaaaaattgctaactattccatttacaccaattgtaaacaaagaaatttgacaaatgtattaatttgaaaacgatcaatttcaatttttatagaattcactagcaaaaagtgttgttgtttgaatttggtaatttctagattcgtctgataaaagatttgcgtccgttacggaaacggtatctgccctaccgtgtggagaagttcacggcgttaaagatctcaattaaacttccgtcaaaagtcagcgaggtcaaactctataaatacatccccacaaaattcgccgctgttcaaagaagacttagttaccactgtttctctctctcccttttttttttctttcttctgggaacgctaaaattttctgggggaaataaaattgaagagaggggttttcgaattctcggaaacttggcgagtaagttttatcgaataacaccagttccgattagattcttcgcttcacggatttttattccgaggtattaccatttcttaattttattttctaggtttgttttcgatttctctgaagaattgattaatttcttcttttcgattttcgattttcgattttctcgccggtgtctcttccgatcatggatgatgaattgtatcggtttcgatgatcgggaaatgtgtgtagaaattcgaaatcgggttttgattttggagatttatgtagcgattctctggagatatactcgtttgatgatccgagacttatatttagtgattaaggattgaattattggttttacttcttctttgaatttgtaaaagtgtgagaattagtgtttaaatcttaattttctcataaacctaaattaagattagtaatcagataaagtcttaaaaacttaggccagcctgtttggttttgtgatgattaaaatccgattaagacgttgacttaaaactaattttgtggtggctgttgtttggttatgctttttaagctaattttagctttgaagatttctaattatatatagattgagaacaaaagttttaaaggttatatagtttgctcatgttccaacaaaaaaaaaaaaggttatatagttcatcatctatacaaagaggttggtatttttttaaaaatctttttttttgtgtttgatcataatttttaataccctgaggttaattagaaaatagtgattgttgttgttgatgttccatgactgattcctgtgatcattgtttctctcattcaggttctttgggattgatgtgattacgagatacatttcagctacgataattcgtacgaaagcctaatcatagggggtttagggttgtcttaacttcaatatgaacttttggaaaatattgattggcaagatgtgagttagaaagcttttcagttccagagttcctgaacccgtgcagggacttggtcttttctaaagctcacgggagaagaataagggttgattcctgggatttcagcctttattccctgttgagctctcttcattcccaggaatttaggatagaagtgtacagttggaatg

SEQ ID NO: 823 - DNA, 3000 bp, Unknown
  misc_feature (1)..( 3000): cDNA_ID_2126896_gDNA_ID_1620326_Annot_ID_153490 3000 nt of promoter + ATG
tattcataaacatagaaggagtatttaacaacagtaggtaaaatggtaacattctgattcgggtaaactgggtttaccttttttcattctttggtacaagggatggtttggcatcctagttaagagataagaaaataatcatagttatccataattgaaatcgtaatgagaagacttaaattctgatcttttattcaaaatgaatcagtcatccactagaccaccattaattattttgtaagaataaagtttgttacgcatgatttatagtggattcttgggatttcctaacatgatattaggcagttacacttacacatatctactggttaaatcccttatgtaataaaaaaaaatctcgagttcaaaaacttgaggtcttttccaaacattgatttttgggtgatttgcagaaatgatcatgtttgataatctatttaagaatataacactttaatatgtaaaactaagtaaataacagtagaaagggatgaaaagtcaagtaactccttgttaaaatatgagaatacgctcgtgaaaagagaagaaaagtgacgtgatctttcacactcttttcggttaatggacattcataaaaagacaaaagtgttggctagcgtgatggtggcgaagatggcgatgatggtaatagtaacaatgacagtaccgatggtgatggtgacgacaacagtggcggtgccgatggtaatagtgatgataacagtggcggtgccggtgacgatagtgagacaacagtggcggtgccggtggcgatggtgacgacaacagtggcggtgctggtggtgatggtgacggcaacaatggcggtgtcagtggcgatggtgacgacaatggcggtgccggtaacgaaaagataagtacaaatatatattgatctaagaaaactaaaccttaagatactatacatggaactcaaacaaaaatcattaaacgaaatgaaatcatctcaagtttcaattttcaaaaatctagcagcaaaatagaatagtacaatggtgacgatggcttcggtgacgattttccggtgatgatggctccggtgacgatttttcggcggtggtggcttcggatacgattttccggcgacaatggctttaaaggtagtggtggttgtggtggtagtggaagaaaaaaagaaagaagagagaagatgttcatgcagaagaaagaagaagaagatggtataattgtatttattacatataatatacataatatcaccttatggtttttgaagtgttagtttccaaattactaaatttttttaggttatacttacaaatttcccttgattttatccaacgtcggtgccatatacaatcgttgttaccagatgatgtatgttagtaacttactaacgtttgagcacaaaaatatcatctaagaaatatatggatatttaaagataaagttgttatatataattaggggtgtcaaaataggtaacccaactcaactcaactcataatcaaatgagtttagggttaaatgagttatgggttaatccaactcattttgttaaatgggttgggtcaacccataactcatttaatttgataggttgagttgttaaatgggttaacccatttaaataataatttaattaattattattataaaacaataataaaaattatcattattaataattattaattcattatcatcaaacttagaatatttacagattctaccgtttacggatttacgtttttggcggaaaaattacgggtttacgtttttagcgagaaaatcacgggtttacgtttttggcgggaaaatcacaggttttcgtttttggcagaaaaatcacgggttttcgtttttagcgggaaaatcacgggtttacgtttttggcgggaaaatcacgggttttcgtttttggcggaaaaatcacgggttttcgtttttgactggaaaattacatgtttttcgtttttggcgggaaaatcacgggtttacgtttttggcgagaaaataacgggtttttgtttttggctggaaaattacatgtttttcgtttttggcgggaaaatcacaggttttcgtttttggcgggaaaatcacgggttttcatttttggcgggaaaatcacgggttttcgtttttgacggaaaaatcatggttttcatttttggcgggaacatcacgggtttacgttttttgcggaaaaatcaaggatttacgtttttggcgggaaaatcacgggtttatgttttttggtggaaaaattacgagtttactttttctcaattcatcgcttgtatatttaagaaatttggaaaaatattgattttattagattggtttagatgtgttggttaaacttaaattggcattggtttaaagattttagttggtttaattcaattttacaaaacttgataggttaattgggtaaaccattgaaaacattaaccattataactcaactcattttattcatcaaaccaattgatccaataattcatttgacccatcaactcatttgagtcaaaaaatttaactcattagtgttcaggggttaagtaaagttgagttgacccataaattttgatccattttgacacccctatatataatacgtacaattcaaaaatataaagtctagtttttttttttttcgtatatggatacttcaatagtagttttttttttaataattattacttgaatagttttagattttaaatcatttactttatcactatttgtcgaagtgtgtattttcctagctatcttcccaaaaagaattaattaataaattacgagcacaataccaattttttcgcagttctgaaaatactgtaacccaaatattcgaatctacacagtctcaaaaaacgaaaaggttcatataaaatattaattccttaacggctatatttttctccttcttccattttttttctttctcaattgatatatccaacgacaacaaaaacaaccaacaagaattagttcgtcgagttcacaaaa

SEQ ID NO: 824 - DNA, 3000 bp, Unknown
  misc_feature (1)..( 3000): cDNA_ID_2126949_gDNA_ID_1620326_Annot_ID_153508 3000 nt of promoter + ATG
aaggtaatgggtgaacctcaattatttgatgtgccagtgctagaaggtatcaaaaatacaaccaacgaaatcatgaatcaacttgaagatgataagatgaaaaaaacttatgagaataaaaaggaggcgagcacaagcaaatatttgaagaaaagtgacatcaccaaaaaaagatggacagaatctgaggacatgtaagtcttcattttttttttattctcaaataaatttaaaaactattattcaatttcctccttgggaattctcatataacttttttttattgtatgccttttattttattttttgaggatgtgaaaatatattgtaatgtatatagaaaattgaaagagatggtggcacttgaacccaaaaaatggacaaaggtcgcaaaacattttgaaggacgaacaccaaaacaatgcagagagaggtggcataaccatgctcgtcctaacgttaaggtgttcttttctttcatctgcctatattcttattttcataatttaatataaatgatcatcacagcttatatgtgtgtgaaagcaactacgttcttacaatgttcacgcacacatgtatagagtatagattgaaattcatatagttgaatagtagtgtggctaacgatttaatcacaacaattttaaaaatttatatttaggagttacatgtgatacttacaaataatctcatcatggatacaaaatacattggcaaattttgttttctcatagttattacgaggggttattaaaacgtgcatctttatagtttgtatcttgcttccatcaataaaagtgtcatatacatacaataataagagaatgatttacgtatatgtgatttcagaaaactacttggagtgaagaagaagatcaaatactaattgaagtacacaaagtaattggtgccaaatggatccagatctcagagcaacttccggggaggagctataacaatgttaagaaccattggaataccacaaagcgtcgggtgcaaaataaaagtggtcgaactgtcaaccgtgtcggcaataacatccttgaaaactacataaggagtatcacaatcaacaacgatgatgaatctgatggtgaaccgacaaacattgagaattatcatgatgactctgaagatatgttatatggggagatgaatttgagtccagaggctataacgcagaccaccaaaccattgaccgatgcttctacaatatcaccttatattccgatgccaaaagaaaactatactctggaggtttgtgaatcactggaggactatctagagctgctgcgttggtgggattaatttccagtgaaggaaatttctttgataatatgatattttctcactatcgtgtgagatatctatctatctatttctttttaaattaagcaaattttaatttacaccgttttggtgtatatctctatctatctattatacaagaactatataagttatgttacagtggtgtactattttaagtgagtgacatagtattttcttcatatggttaattaatcaacaacaatttcccagcttactatctatatgtgtactttaaacttatattgatagagaactacaaaattatgtttttgtacaagagaatttggtcttcggatcaataatttctctaaatataatttgtaaagccaaccctataatttgtaaaatccatgtattacacaccaaaaaattcaaaagataatcatgatttgttataattttctttttttaattgtgaattgacagacaaaaaaaacattacattgtgatttaaattcaagactttgacttgttaaggaaacaccatgattcattattttttcttcatttgttacattgtcactagaaatatttgatctaattttattatgataatagactacatacaacatatgcgattacgattttgacatgtaatctattttaagagtatttaacatttaagcgtgttgaagttataacaatatcatataaaatgacatatctaaaagtgattttcaatattatgcgatcgattttggctaaaacttataaaaaaactcatgggaatctttaaaattagaaatcaagtctttttaataacccgaagtatagtgaatcaactgcggaacaaaagtggatttacatcaagcatgtgtgtgaaaccacatacaaggttaatagtacgttagccgtgagccgagtccaaacgaatacgaattgctacttctagctagggatgattgttttgatatgcaataagaacgttcctttcggtatacgaaagtgattgtaatactccgagttgaaagaagttttgattaggaaatgaatctgagtttggatgctagaatagaatctgccgcaccgttagtgtttagttgatgtctctacatgactacatcatctttgtgaactaatatatagtaatggggattggattggcacaaaactttatttacggaatcattttcttaatttgatactaaaagttcgaaatcgaaattttgaaatccaaatgtggtgcaaaactacatcgtcctatcttcgatttcccatcttcttttataatttaacatggataattcaaaagctattgtctagattacatattttggattcgttagtcacataaccaaaaatgaaactcttttgatgaattatgtattttcaaatttgtattggagatccttttagacttcggactcaagtatacatgcataggatagttttcttttgtcttgctttaaattcgtgtcagcggagaaagcgaaaacatcttttaaaatctcatgaaatgaaataaaataaaataaaaactaaaagaagaaaaaagttgaaacttggaaatcatgcaaagccacacctctactactctaacatctcaccgtcttatgtgtcctcttctcatctctccaacttcttctttaaataaaccttctccaaacttttctagttttattacaaagaaaataggtaaaaacaatttctcattagcttacaatg

SEQ ID NO: 825 - DNA, 3000 bp, Unknown
  misc_feature (1)..( 3000): cDNA_ID_2126945_gDNA_ID_1620326_Annot_ID_153507 3000 nt of promoter + ATG
gttccgtatgtaaacatatatatacttcacctaaacggaattcttaaccgatgtgggacaaatacttattccttttcttcaaaacctctcccctccactgcctctgtctctctgttttcgctcagatttatgaagaatctcgtttcaaaccttcgatttttctcctcttattcttcttcgatagttccgcgatgtagtaacatacctaaaccaattctcaatcctctctacaatttacttccccagtctcaaaaccctagtaaaatcgtggatgttatctgttcaacactcaaccacagtgattattccgtcttgttacctaaccttcgtgacgaggtgaaatcgctgattcctcatttgggttatcctgaaatctcgagggttttgcttaggtttcagtctgatgcttctcgagctattacgttctttaaatgggttaaatttgatttggggaagaggcctaatgttggtaactactgtttgttgcttcacattcttgtgtcttctaagaagtttcctttagctatgcagtttctctgtgaattgattgaattgacatctaagaaagaagaagtggatgtgttcagagttttggtttctgctactgatgaatgtaattgggatcctgttgtttttgatatgcttgtgaaaggttatctgaaattgggtttggtagaagaagggtttagggtttttagagaggtgcttgattccggttttagtgttagtgttgttacttgtaatcatctactgaatgggttgttgaagttggatttgatggaggattgttggcaagtgtatagtgtgatgtgtagagttggaatccatcccaatacgtatacgttcaacattcttactaatgtgttctgcaacgattcaaattttcgtgaagttgatgactttttggagaagatggaagaagaaggttttgagcctgatttggttacttataatacgttagtgagtagttattgtagaagaggaaggttgaaagaagcgttttatctgtataagatcatgtataggcgtcgtgttgtgcctgatttagttacttatacatcgcttatcaaaggtctttgtaaagacgggagagttagagaagctcatcagacttttcacaggatggtagacagaggaattaagcctgattgcatgtcttacaatactcttatttatgcttattgcaaagaaggaatgatgcaacaatcgaagaagctgttacatgaaatgcttgggaatagcgttgttcccgacaggtttacttgtaaggttatagttgaaggatttgtgagagaaggacggttactttctgctgttaattttgttgtcgagcttagaaggttaaaggttgatatcccatttgaagtttgcgactttctgatagtaagtttatgccaggaaggtaaaccatttgcagcaaagcatctattagatcgaattatcgaagaggaaggtcacgaggctaaaccagagacttacaataacttaattgagtctttgtcccgttgtgatgctatagaggaggcattggttctaaaaggcaaactcaaaaaccagaatcaagtacttgatgccaagacataccgagctcttataggctgcttgtgtaggattggtaggaaccgtgaagccgagtctttgatggcagaaatgtttgattctgaagtgaaaccggattcatttatatgcggggctttggtttatggatactgcaaggaattggatttcgataaagctgagagactattgagtttgtttgctatggagtttagaatctttgacccagagagttacaattcgcttgttaaggctgtttgtgaaacgggatgtggatataagaaagcgttagagcttcaagaaagaatgcaaagactcgggtttgttccaaacaggttaacttgtaagtacttgatccaagtgttggaacagccttctttgcccaatcatctgcctgagaattgaagcaacgcttgatgcgatgaaatttgtattccttaatcttggccagatgcgtaacttaaagaaaatacaaacttagaggatgagtactgcggatcgttttaagtggtggtgaagtctgtaggatctcgcacaaagggtccagtacttgcttagcatcctggaggaaaatgttgtccttataattcagtgccaagagcatttgcctcagcttttgctgctttgtttgctgttgaaagcttacctcgactccaaaacacaagtcttctctgttgatcaaacaagagccaagcaatgccgatcggtgtgttcttattgatacaggatgcatccagataacaggtttattgagttagttggaactaaaggatgcacctgaaacggttgcagattgccacaattttgtattctgtagtaattgtaagagtttgagaatgattgtctattggaccccttgtcttgtgtcttgtggtttcgttctttccatggatgtgaagttaaagtaaactttgtgtagttgcagcagtttctttgtaactctatgaaacttctccaagcaatttctttgtaactctattactttgtgctctgaaaaagtcactcttaccaaaagagggtagaatcgatattaaccaaaggaccgtgtctaaaaccaaattaaatgttacattggcaaataaatacaagttccagaaagagtctataaactaattgctaaaccgggaaaaatttctgcttctaactctttagcgttgagtttataggccgacgaatcaggttaaaaattctctctttatcaaattatgaggtttggatctgtaattttgtgagcttttaagcttgcacaccaagtgcttgctaaaatgtccaagtgagctcttttaggaattcagtgaatcaaatgaagttttaggtgacaaaagtcaaaagattttaaatgccactgcttaatgagatcaatcagctcagctattttatatagattgagatctttcattcgtgaaaatggatgcaggtgtataggaagatcattttatagtc

SEQ ID NO: 826 - DNA, 3000 bp, Unknown
  misc_feature (1)..( 3000): cDNA_ID_2126961_gDNA_ID_1620326_Annot_ID_153511 3000 nt of promoter + ATG
agtaacgttcgtattttcagaaataacatattttatattcctttaaaaaacaaagattatagtaaagaacattaaattaactaataactactctacttttccatagaatactaaattcctacgctttctattaatctttagtgtttttaccgctaaagatatcactatatcactttgtcaaaaaatctcaattttccatacatacaaaaagattatgtttagaagtcatcaaatccataatttggttcacttaaatacaagttggtgattatttgattttgttcgatttaatgtcattttggtttcattttgttttctaaaatcagttcagtgttggttaaaataatataaaatacttctaaataataattcaaccataattatataaaagcaagaaaaaaaattctgaaattaaatttcaaattattctaggcatgttctccaatgtggctgcatccgtcttgttggttcaagatgagtgctcttctgttaggtcctctatctaaacatcttcaactccatttcgtggatcgatcacccaatccttcccagctgatccgtattttagtggtccttgtcgccgacgagaagtttagtctagtttctccatggtttgtgtagctattgagatgttaactctcatgctttcagcctccttttcgctgtctctatttgagctgctcatgtctccacactacctatgaagtccgatctctacgactttggtgtgagctaccccctcagacctccagatccgccccctcaggccccaagttgaccattcgttccaatttgtgggagttttctccggtgttatgacctatggtccttccttttctaccacctcacctagcagcatctcctccattcacccttgtttggataatgatctttgtgtcttccacttgcctccttgcgatctattattgttgtgtgcagttcatggtactaaatctttcctctagcgcatatgtgcaattaactggatacttctctggtttatctttgtttgcatttcaggctagtctactttgtttctaatctagaatcacctttgttagtttattttctgtccaaatttggcagagtttgttcaccgaatacttctttagaatcttcgtgtctagggttaagaaaaatcaaacttttgcctagatccatcaaaatttgctcaccctatacatctccagcgtctccatgcatatgtctacggttgatccttcttgggtgcatcatcagagatcctttcatggtgcaacgaccacctccgcctcactgttgaatgaatgggagagaatgagtattattttcgtccttcatctatggtggagaaatatctctgattttgaaaacaaattagaaccgaagagactttgcacaagttttaaacagttttggacactaacgattatatgctaacaaaatatataattagtaaattttaagttttgaatataatttacgaatattttttaatccatgaaaaactttaaagaaaatatcttatgttgacttgacactttatgagtctaattaaaaatgtacatacaagtaacatcataagtaatttgattccagaacatcaagaaccaggtttcaggtttcacactttcgcccatcatgaaaagtggacaaaaatcaaatattttatttggcatgttttgctttgattctttttgaatgaatgttattcatcctaaaacatattttgtataataaatgtaaccttatacttttttccgccaatgtaaccttatgctaaaagttcagaacgtttataaataaaaagacaccaaagacaaacagtagggccttcaagcaccaaagacaaacactagggccttcaccaaaccaaattcttaagacatcctcgaatttggttgtggtttccttttgacttgaaagtctgttctagagttcggacgatacgctcaatgaaagaagacatgagtgaaggagacaagttttgttccccatgtctacgtctaggtttatttctttcggaccatatggaatgcacacaaacttggaacacataccgtacgaggtagtaaactgacttttatgttaaagatggtttatgtaattatgttactttaattgttaaatagtttttacgtttccatgaattggatcaaacgtaatcaagtaaaaaaaaaaacctatacttataatccttccttgtttcatttgatttccttgcctttaaaccacaatattatttcttttgagtttcattgatggtgtctcaattgtaaattggggtttagggacattatacagatggttgtaaattcctggaactgactgagaaaaaataaacttatgggcctggaggagatagttgttgggccacttcttaatatatattggcccacgaaaacacaattaactcttcgtttcaaatttacaaactaaacttcgtgctatctaatacttttaaaacggcacgtaatttagttttcaaaacatagaacgacacagggttattgtcggagttgcttcttcagagagaaacattagagaggggtgttcatcttccacatctcaaggagacacccaaaaagaaaaaccaaacctttgaagaacgaaaagggttattaaaaaagcaacaaactttgagagtaacaaaggtaagtttttatctgtaattctaagagttatatcattttggttttgtatgatttttttgaatttgtgaatttgatccgttgatttaattctgaattttctacgattagttcactgttatgttttgtgaattataactgttttattgactaatcacgactttgaatccaattctattgaagggctataagaaaaactgaaattaatttatagaaacttgaaaattttggggacttttcatgttttgttaagtaagaaatcttcttttttagctaaattagtttcttctaaatagaaagttttcgaatttagaaaaaggttggggttttttcattgactcttgtctgtgttacagaaaaagtagttatc

SEQ ID NO: 827 - DNA, 3000 bp, Unknown
  misc_feature (1)..( 3000): cDNA_ID_2126979_gDNA_ID_1620326_Annot_ID_153496 3000 nt of promoter + ATG
tttagatttttatttcaaaattttcatgaacagttaggttaaaatttgtattagtattattttaagttactcaaatggtactacaattgagtacctttttatatacctaaagtttatagtatgcttgggtttggtataagttttgtaaatcaatacatacaatatattattttaatttaggaaaattttctaactgctcatcaaaccatgcatgacacatgaatacatatcaggctctcaagagagtggaaactatattaagcaaaattggacggagaaacctttttgttgtttgatcatgccattgccatacatgcttatttcggtgaatgttatgtgtcaaagaagctaacttgtcataccatgaatatcagtgttatgttccatctgtcaaaagcactatgcagccgatggcctcagctattcgacaatggggtctacgaacatgtattctctctgaataccaattcaattcatatatatctagtaaaagaggatgagttggtggacttaagtcccactctcacacccacacacacatctatgatacttaaaagatctaaacctgatcatattaaaggttctctctctctttctattatgttcacctctatgcaaagtcattctgcaaatttatagtaaatgcctcttaaaaaaaactcttgtttgttccaacaaaactaatccgaaattctagctatctactaagcgcactaataagcagtttaatcctgaccctttctaaaattttaccatatttttctccccaaaatttctagctatatgaccatatgcatgatcagtgttggagagtctacaagactaatcctcatttctcctttcaaaaatttcttcacttactactgtttccagtccacgtccacactcgcatccccgtcaatcaaaatgcacactattcttgagagctttttctgttctcagcaagaaaggttagtcaatgtgctcctcttccaaataataagtcacagtaacgcaccaatcctgctagcccgtggggagagagttatttacacccattggccaaattgttccccctttatccactaaaatccatcaaaacaaaaaaaaagatccatcaacactaagtcaaaaactcagtgagattattgtgtgaaaacataacaataacgttcaagattcaaagtaggcatgatgcatattgaaccgaaaccctaaagtagaaaattgacatgtgtaaggcgtagatcacgtgatagataatgattactctatggttagagcttttacccaattcctgagtgtttccgtgtctcgtaaaagtgtatggtgtgacaggtgattgttgtgtatattttatgtgtaagatcttggtatttgcgatgagtttggctgttgtgaattaaaaatatatggaatgtcattataatttccctgactataaaagaacccttctcttttatatctcttacacttgatgcgttaccatgtacattagcaaaatgtttcgtggtgcgaacgagcattgttttaataactacatctactgtcataatctcatttttttgagatcaaataaaccacagatatagaataagcaaatgatatcttcgaaaaaagagataagataagagctttgctaagaaacagagcagtctggaaaaagaagcaaagtaaaaatgatattttagacatgaaaaaaaaaaaactggcctttacattttatgagttatttttgtaattaaacccttaaaaagataatcacaactaaagccatgcatgccaaagttattagagtaagaattttctaactatattgagagatttttttttggcgcgtaccaaatatatatatatgaattgtgttagatatcacataatctcttagagcacttccattttataagagtttctcaaagaaaaaagaaaaaacgtttgattatataattatttttttatttttatattctaatagctaaatgacgagtgtgataaacgtttctcatttcagaaccgtttctccttctcatatagaataacttataagcccaactccattttaaaaaaaaaaaaagagcattgggatgctcatatttaaagacaactagagcactagctaggggaaatatataggacaagtttgataacgatgtaattggagatttgaaggtttatgtgcttagtgtgaaggagactccgatccgattaagtaggagtgtctcgaagcctttcggatagagatcatagatatatagggtttattctcaagtctcaagtctgttgatgccaaagtcacgtggaagacacaggaggatatattaaggtcgattctcttacacagctttgttatgttttctcttcccctttagataactcgtctttaattagttttctcagtaatttttcttcatttcagttgatttatccggttatcggataataagagaaacgtgcaagttggctgattgaggataaaacctcacactaaaccatatactttcccctatattaagcattatgaagcgttatctattagatctttaaaaaatctgcacacatccatttgaactatatattaaaatatggcttggaataagtattttggttcagatcgaatcaaattgcaatccaagaatgattatacaatcttacacatacatgttaaattatatgcatgtagaaagaaaatagaactatatatataatatgatcatagttaggtcttgaagctgcactagctccccatgtgttatgaaaatttataaaataaagtaaaaacgacaatatgtgtcgctaattagtatctaaaagacatttaagattttggattaaaggttattaacaatgccttaaactcttgaaaaaccttctctataaaagcagtagctacctgcccaccacctcaaaatatcaactctctctctcactttcacaactctccctttctatttctctctctagaaaaatatcatcatctatcaattatatagagtacttatttagattcatttcataaaaatg

SEQ ID NO: 828 - DNA, 3000 bp, Unknown
  misc_feature (1)..( 3000): cDNA_ID_3059181_gDNA_ID_1620326_Annot_ID_153498 3000 nt of promoter + ATG
agaaaggtttatatatatatactatatagttatatgacaattgacattaggaccggccacagtatttgttatatcgttttattacataattcgtttttatatgattcaagaaattcgaataatactgaacaagtgaatatgattgataccaaaagtccatatttgtaaaaagcagaacatattacaaacaaaagactatatatttagattttgatagaactttttttaattcttgattaattaattacaaaactactattcattctaagatattaactaaaaaaaaaagtggattatgaaatgaatatcaaaattttaccttggttaatttttttttttttttcatttgtaaagttttcatcgttgtggcgaaatagattggacgaattatgacccagcatcaaatatttaactaattaagttccaacggataaaaagaaagaagagattacgttgatccagaaaaaaacagagcggtcaccaataggggaaaacagtacgtttcgtttcttgctatagcgtaatatatagagcttcacaatttgaatgcatataatcactcttttaagtaaaaaaaaacatctatttgaatgaattaattgatgatgtgatctaaacgaatggatacagataaacgatagagacatggatgatggatcatgatagagaatcctggagttaaggcgatgtgaaaacgtgtacagttgtaagagtaatagtattgactacaaaattagtgtgagatcatacttcagacattcatactgatttaattgtattgagaacgaaatttgtaatggtttttttggatcatggaaaatttcagggaaaaaatccatttacagattattattttttgtttttttcttaaagttgttattaagattctatttttaaaaaaacattgttacgagttgtgtatgaactattaatcaataaaccatagcataatatttcaaatacaaaagtgtcctgatcagaaatcaataaatgggcggtcctaatttatgcgtcggtggctaactcgttaagaaggtggggtaaggttaggttgggtgcagctaaattcaataatcatcgcctcaattactgactcgattcgtactcatcggatgatcggaatacaacgttacatatgatttttggagtcaaatatataaatgttgtctagaggtttgagacacaaatattgaaaacaataagacttaatcaacctaagttgttttttgtttctttttcttttttttgttgttctagtgttatttatgacttataatgtgtatctattaaagtttcataatataaaatatcctacagtttcataatcaacatagaatagtatttaaatctgttttaaaaagttaattagggccaagaatttattaattctttagacctacggctttaggccacaccaaagtactgataagtctcgttgcaacattaaattccatcacaaattacttcgtttttctagtacaacaaatcaatggacccaaccacaaatagtttttcttgaacgaacatttagcttaagaactctacaccacacgttaaggatataaatctactaaggaaaaactaattgatcaaattgatttttagtgtttgcatggacgtcttaaactatttgtaagttgtaacttcgtttcaatttttttaatagtatgtggtaaatgtttataaaatggtttcattaactaagaactaaatggaaacaatgtttgggtcataactaaggccttacaaaaaaaaaacaatgaacaaaaccaacaactaagactaaagactgatcgaaattaatatttttactaaggtcaattccgggctacgtttgctatatttgatatttgatttaaagtttgttcacgtagattcattttagttttaagtttacattggaaaaaatcatatgataagtttttttattaacacatgatcatatgatatcttgtaagtaaaattgttttggtgttattcgtgtcaatctctcaaaatattactatatatatgtggaaatttagaaacataaaaagttcaaaaatgcttacatgacgaaacatataatctgaaagattgatttctatcacagcctaattaatttgatacttatatcttttttttttttttttttttttttttttttatacttattttttgtcaatccatatcttatatcatttaaacaatgtttagagaatagtttttgccagaaaatcagctatgcagtttggagatatgggacaaacgtacaattacaaaagtttagagaactagcaagtaagaaaatatcagataaaataccatatatggatctctacattgggtgatcgtaaattgatggccttgattgatatttgacaatcagatttcataatcaccggttgagtgcccaagcatatgattgaggtaagagctgtacgaacaccagagatttcgcgagaaacagagacaatacatatttacttgaagcagagtatttttagaaggatctcgttgccttaaagagaatggtccattctatcctagtaatttggtggagagaaaaattttgacggaaactatttttttgggtgaaaataaatttttgtaattttagtttctaattacatgttttcattaaataaaagataatttaatcattaaattcgtgaaaaaattgaaaaaagtatttttataaatcccgcttacaaaaatcagctgttcttgaattagcaaagatttccaatttaaacgtgccagacattcaccaacctgacgatcgaaaaatgatagaaacaaggcccaataaagcccattaaacaaatctaacgtttgttttattttgaaccttgatgactttttgacttttgactcggtttacaaatatcatccatttagcgtttttataaagccgactgattcgcttctcttactacttcaatttcatttctttctcctcaaaatatcagatcgataaccaacaagcgaaactagggttctctaatctcgacgaagatg

SEQ ID NO: 829 - DNA, 3000 bp, Unknown
  misc_feature (1)..( 3000): cDNA_ID_3059173_gDNA_ID_1620326_Annot_ID_153500 3000 nt of promoter + ATG
ttttgtaattgtacgtttgtcccatatctccaaactgcatagctgattttctggcaaaaactattctctaaacattgtttaaatgatataagatatggattgacaaaaaataagtataaaaaaaaaaaaaaaaaaaaaaaaaaaaaagatataagtatcaaattaattaggctgtgatagaaatcaatctttcagattatatgtttcgtcatgtaagcatttttgaactttttatgtttctaaatttccacatatatatagtaatattttgagagattgacacgaataacaccaaaacaattttacttacaagatatcatatgatcatgtgttaataaaaaaacttatcatatgattttttccaatgtaaacttaaaactaaaatgaatctacgtgaacaaactttaaatcaaatatcaaatatagcaaacgtagcccggaattgaccttagtaaaaatattaatttcgatcagtctttagtcttagttgttggttttgttcattgttttttttttgtaaggccttagttatgacccaaacattgtttccatttagttcttagttaatgaaaccattttataaacatttaccacatactattaaaaaaattgaaacgaagttacaacttacaaatagtttaagacgtccatgcaaacactaaaaatcaatttgatcaattagtttttccttagtagatttatatccttaacgtgtggtgtagagttcttaagctaaatgttcgttcaagaaaaactatttgtggttgggtccattgatttgttgtactagaaaaacgaagtaatttgtgatggaatttaatgttgcaacgagacttatcagtactttggtgtggcctaaagccgtaggtctaaagaattaataaattcttggccctaattaactttttaaaacagatttaaatactattctatgttgattatgaaactgtaggatattttatattatgaaactttaatagatacacattataagtcataaataacactagaacaacaaaaaaaagaaaaagaaacaaaaaacaacttaggttgattaagtcttattgttttcaatatttgtgtctcaaacctctagacaacatttatatatttgactccaaaaatcatatgtaacgttgtattccgatcatccgatgagtacgaatcgagtcagtaattgaggcgatgattattgaatttagctgcacccaacctaaccttaccccaccttcttaacgagttagccaccgacgcataaattaggaccgcccatttattgatttctgatcaggacacttttgtatttgaaatattatgctatggtttattgattaatagttcatacacaactcgtaacaatgtttttttaaaaatagaatcttaataacaactttaagaaaaaaacaaaaaataataatctgtaaatggattttttccctgaaattttccatgatccaaaaaaaccattacaaatttcgttctcaatacaattaaatcagtatgaatgtctgaagtatgatctcacactaattttgtagtcaatactattactcttacaactgtacacgttttcacatcgccttaactccaggattctctatcatgatccatcatccatgtctctatcgtttatctgtatccattcgtttagatcacatcatcaattaattcattcaaatagatgtttttttttacttaaaagagtgattatatgcattcaaattgtgaagctctatatattacgctatagcaagaaacgaaacgtactgttttcccctattggtgaccgctctgtttttttctggatcaacgtaatctcttctttctttttatccgttggaacttaattagttaaatatttgatgctgggtcataattcgtccaatctatttcgccacaacgatgaaaactttacaaatgaaaaaaaaaaaaaaattaaccaaggtaaaattttgatattcatttcataatccacttttttttttagttaatatcttagaatgaatagtagttttgtaattaattaatcaagaattaaaaaaagttctatcaaaatctaaatatatagtcttttgtttgtaatatgttctgctttttacaaatatggacttttggtatcaatcatattcacttgttcagtattattcgaatttcttgaatcatataaaaacgaattatgtaataaaacgatataacaaatactgtggccggtcctaatgtcaattgtcatataactatatagtatatatatataaacctttctgcaaatacaatcctatatttaaataccaacatccacaagataagtaaaaacagaaaaaaaaactttaaaaaatgcgttgcctcacaaaaacaagatcgtttcattatgtcatcattttttattccttcttctttttaccgttcttgtcgtcctcctccgacgatcaaagaaccaccgtctccggtcttttctgtggcggacgtagcaaatcctccgcagatccaaactacatcccaactttcgtcgaagatatgcattcactatctctaaaactaactacacgccgtttcgcaactgaatcattaaactccactacatctatctacgctctgatccaatgccacgacgatctctcaccgtccgattgtcagctctgttacgcgattgcacgcacccgcatccctcgttgtctcccttcttcctccgcaagaatcttcctcgacggttgtttcctccgttacgaaacttacgagttttacgatgaatcagtctccgatgcgtcggatagtttttcttgtagcaacgacaccgttttggatcctcggttcgggtttcaagtttcggaaactgcggcgagagtcgcggttagaaaaggagggtttggagtcgccggagagaatggagtacacgctcttgctcagtgttgggagagtttggggaaagaagattgtagggtttgtttggagaaagctgttaaagaagtgaaacgctgcgtttcgaggagagaaggaagagct

SEQ ID NO: 830 - DNA, 3000 bp, Unknown
  misc_feature (1)..( 3000): cDNA_ID_3059167_gDNA_ID_1620326_Annot_ID_153505 3000 nt of promoter + ATG
aatttaaacaattaaataattttttttattgaaaatttaattattttttaattaccctttaattaggtaggtgcagctactttttttcttttccttctttttctctgtgaagctactcgttgattgtactaaaaagtgtaaaataatactctgtttagtcggtgcaagaaatagaaatgtaactgcttcagacgaccgttggatttctttattcatcagttttttgattaagcgttggcttatttttaacaactccacgtgcaattctcttataaacaaatggttatccaaacgcaaattccttgaccaaatctttttggtcggtttgtttattacaaaaaaagaaatagacaagatcaagggaattagatagtacgtggcataatcccccgttggtcctttgaatgttcttacttagctctggagtgacaattcaaatcctttgcataagtcacctcactaacatctctggtcacatgaacgaactcttatttacaaagcagggtctctctcatcatttttttttaaatgacaatgcatatgtggtctctgttcggtcgattacatttgaccaagtgagtgttcatctttgtaatcatgttggcattcaatcccgagtctcttccatcatcataaactatatcaaacaaactaacaatgatcaagcattattttttctctcttttttctgggtttatattgatattgaaacacaattactaaaagtattatatattaaaaagattttttgtatttatcagttaaactaaaaacctaaaatgctcatttctttagttgaaatagtgtttaccagttgcaataaaaatataaaattaaaccaaagtttcaaggttttattttttaatgagttaatctttcgagattctataaattaatatttattagtttgtagatatatttacgcaaaatacagtactatgttatttttagattttttttttattaaaacttttttaggttttgttctttgcatatttagttatgttttttttacttctttaatttctttttctccaacatattatgttaacgtagatacgaggcttaattcaatttttctttacataaatctaagcaatgacttttcatctacaaagttttttaaaatcaactataactgatcaaatacgtaaagagttatgtgaatacaaaagaaatcatatcaattgtactcaaaaggagttataattgttgattgaacagaagttatatacaaaatttagtcacacaatctgaaacagactcaagcgatcagctgaatatctatcataaatgatgaaataaaaaaaattagagattaacttcaaaaaaattcaaacttaaaaaaaaaacaaataacattataatactaaatttttttaaaaatatatgtttaagatttatgattattaatttatgatattattaggagcatatttttatatagagatttcaaaaaaaaaattatcttattatctgatcgattttggttaatttttatatttacacagaaccgataaaatttattaatttatagaatattaatttagagtttctattgtataatactaaatattggaaaatctaaacctaaatctaaggcatttccttaaattaaatataacatgaaaatagccctagtagcatttataaatccaccgagaatcggcataatttttttgtacaatgaagttagttgagttaatgaacaaatttattatgaccaaaaaatggaaataaaatatcataattggttcaatttttttaattggttcaaaattcaatatataaaaattaaaatcttaattaaatcccagaatctcataaataattttgggtccgactagtgacctataaaggaatacaaggaatgaaaagaaacataactaaaaaggaacaaacaagaaaataaaaaaatgataaaataagaatgaagaggaatgggtgtggaagaaaaatagaacaaatgttactgtaaatgataaccaaaacatagaacaaatagtaacaaaaattaataaataaataatttattttctaaattaaatattaaatataagacgaaaataatttaatttttaattaataaatgtttaatttgtttttttgtctgtttctcatcaaatttgggaaggaataattttcttgtacgattcctcaaaaaataaggaatgattaggaatagtgtggggtacacatattacaatttagaaaaaaattattgctgaatggtgaaaaaagaaaaaaaacaataaggaacgtgttgttcctacccattcttttcttaaaaaatgttcaccaattggaccctttattttctctgaagaggaatctgacgatataagccaatcatcatctaatgcctaaaacgtttcaaaacattaaccatccgaatcaattaaattttcagacaataaagttatcttttccaaatatattatggatatatatacccatcgtcacatttcttttctctaatttccatatcaaaactaaaatgaatataacaagttgagtgaggatatttttaaattaataaggaatgattttcattggtcaatccgtggaaattacattgtcggtaggtcaattaaaggcgcaattatgatgcaatatataaaaatttagaaatattaagagccatgtgactagaaccatgtatacaatattttatttcccttcgtattaaatcaccaacgaccaaatctaaaggtagcaaatcaaacagccccacaaatatatcaaaatatataaagaagtaattaaattaacaaaaacgaagaaagtataggtttcactctcttactcattccttacatgtcgaccaataattctataagtatctaatgacatttcctatctttctttcaatccataatcttatcatataatcaaattcgggaaagtttttaagtttcataaactctataaattactctctaccatcttaacctaaaaaacattctcaatcctttgtccaaaatcttgcatatcggcaaa

SEQ ID NO: 831 - DNA, 3000 bp, Unknown
  misc_feature (1)..( 3000): cDNA_ID_2126916_gDNA_ID_1620326_Annot_ID_153497 3000 nt of promoter + ATG
ttaattacaaaaataactcataaaatgtaaaggccagttttttttttttcatgtctaaaatatcatttttactttgcttctttttccagactgctctgtttcttagcaaagctcttatcttatctcttttttcgaagatatcatttgcttattctatatctgtggtttatttgatctcaaaaaaatgagattatgacagtagatgtagttattaaaacaatgctcgttcgcaccacgaaacattttgctaatgtacatggtaacgcatcaagtgtaagagatataaaagagaagggttcttttatagtcagggaaattataatgacattccatatatttttaattcacaacagccaaactcatcgcaaataccaagatcttacacataaaatatacacaacaatcacctgtcacaccatacacttttacgagacacggaaacactcaggaattgggtaaaagctctaaccatagagtaatcattatctatcacgtgatctacgccttacacatgtcaattttctactttagggtttcggttcaatatgcatcatgcctactttgaatcttgaacgttattgttatgttttcacacaataatctcactgagtttttgacttagtgttgatggatctttttttttgttttgatggattttagtggataaagggggaacaatttggccaatgggtgtaaataactctctccccacgggctagcaggattggtgcgttactgtgacttattatttggaagaggagcacattgactaacctttcttgctgagaacagaaaaagctctcaagaatagtgtgcattttgattgacggggatgcgagtgtggacgtggactggaaacagtagtaagtgaagaaatttttgaaaggagaaatgaggattagtcttgtagactctccaacactgatcatgcatatggtcatatagctagaaattttggggagaaaaatatggtaaaattttagaaagggtcaggattaaactgcttattagtgcgcttagtagatagctagaatttcggattagttttgttggaacaaacaagagttttttttaagaggcatttactataaatttgcagaatgactttgcatagaggtgaacataatagaaagagagagagaacctttaatatgatcaggtttagatcttttaagtatcatagatgtgtgtgtgggtgtgagagtgggacttaagtccaccaactcatcctcttttactagatatatatgaattgaattggtattcagagagaatacatgttcgtagaccccattgtcgaatagctgaggccatcggctgcatagtgcttttgacagatggaacataacactgatattcatggtatgacaagttagcttctttgacacataacattcaccgaaataagcatgtatggcaatggcatgatcaaacaacaaaaaggtttctccgtccaattttgcttaatatagtttccactctcttgagagcctgatatgtattcatgtgtcatgcatggtttgatgagcagttagaaaattttcctaaattaaaataatatattgtatgtattgatttacaaaacttataccaaacccaagcatactataaactttaggtatataaaaaggtactcaattgtagtaccatttgagtaacttaaaataatactaatacaaattttaacctaactgttcatgaaaattttgaaataaaaatctaaaatatgaaagatttaaaattgttattttgtatataaaatatatctcacaaaattaatcgactattttaattaaagatatatagtagtttaaataacataaaacaacgacaataggagggttataaataaatgttctaaaatgatgtctaggaagtcgtttagtctccgcctagaatagacagtggaagttaccttacacacattgggattatgtatttttttttaataaatggatttaagttgtttcaagagatcttaagctctcttaggtggtcttaggcggttttacaatttaacggttttagtttattttccaatatttaagtacaataatttaaatttataatttttaactccatatacatgattataaacgttcatatgttatttgatatgaattaaataaactaatttttgtttatgatttactatttttatttttaatagatttttgtatattgtgtatctaaaatatcatatttataatattgtatgttggaaatgcttaaaccacctaaaattgcatatgttttgattagacgttatatgttttaagtattgtgtcagtgcttgcttcgtgcctaacgctttcttaaacacaaacaagtcaatattttatactacacaaactcattaatagatattagtgctaaacttaataaagcatatataactattcaagtccacaaaatcttttaccaaaataaacttttaaaatataaacttttttacatgtctagcacgtatccgaacatttccaaaaagatactccatcttttgaaatagttgtcgtttaacgtttttgcacataaattaagaaaacaattaaatttatagttgtcgtttaaacgtttttgcacataaattaagaaaacaattaaatttatccttaaaagacattgttgctaatattcataaagaatatctaattgtttgagtccaaaaaagatttacccaaaaaaacctttgaccattaaaaacttgcttacatgtctaatacgtgtcttaaaagttttcatatcaaagctcaaaattcctaaatttcaagattcttaacttttgttttatttacaagtaatgatgatactactttaaaatcctaatttgtaagagacaatatattgtgtttaattaaatattttcttattgcaaatgttttcttatttatataaggagttgttgaagaacatctacaataaaatctccttctaaactctcacttatttcgtactgataaacaaaaagagcatcttaaatctcttgatcggttttcgaag

SEQ ID NO: 832 - DNA, 3000 bp, Unknown
  misc_feature (1)..( 3000): cDNA_ID_3059186_gDNA_ID_1620326_Annot_ID_153493 3000 nt of promoter + ATG
atccaattttgtgcatgacaatgcaacatgtggaacccgacgttagcctaactctttgagctgaactatcaaaaccttaaatctttctaagaaatttccattatattagaggatgaaaaaaagacaacatgaatgaaacaacaatttatatactcgatctaaagaaaataatagcataaattaaaattttcagaaaaaaacaagagggaacattggtgtgaataagtgtagttattgtgctaaattaaattatgttggtctataaagtattggttaatatatatcaaaacatcagaatgctataacgtctagattaacttgagctttagcaattcgcatgaagaaataaaatttgatggttaatttttgatccaaaaatcatctgattactaaaaataataaagaagaataatcggaccgacaaggatattattcgtggacgacaaaaagtttggcaagggagtgagttcactacagtaagacggcatatgtatttaaggattaccaaactttttgctttagccaaggaagctttttctcaagagccaagaggcacacttgtaaaaatatataatcaaatatatgtatatatcaaactaaatcaatacatatcaaatgttgtccttgcatatacacaagtaatttcacatatgtgatagtgatagtggtagagatcatcatcttagttgagacttaattaaatatgaacaatcaagttcgctattgcatctatatatgtttttgcctttatttctaatcatgtagattaagatcatttttatgatatgcgtataaatattgtagaaaagattaaggtgcacaatctagatttggatagatagaaaaagtagaggcattggtttagctatcatatgttctcatcacatcaagagacttggatcttaattaatcaatgtttccatatttactgataaataaaaaagttataaagtagacaaaccgttgatataatttttcacgtccaaagagagtacgtagatcacctcatgaccaggttgctttatagtgtttagattgtatagcattcatattctgactgaatctctagaacatatgctcaaatcatttcgtttggagttttgacccatcctcaaatcatattatatatgcattctatgcaagtacaaatatgaaccattacattttgttgaattaggttgcatgtctttttagttttgcccacatgtttttcgtgtgagaattgtgaattccccatgtgaatcataaatgaaaagataacatggtgggtcgttcacaacttacaattcggaattattttaaacgtgtctgaattcccttggcactgtaatgatccgtctgttacgttgccttgggccttgggctttggagatggactaatatttacacaagttgggttcaaggtcattgagctttctttcaaactatgattaagtagtgggaaatatatgattcatatatcactattacttggtattacagttctaatacagattatacagttgattcatattggttcgccgtcgatactacatataatcatgtcatgagaacgtgttgttcgtgtaaaattaacacaacaagaaaattacgtttagatgtatcaaatgttatcctaacagatttcacatgttatatagtctcaacgaaaaaaattaaaacatttaaactgggtcaaaagatgtatttaagcgattttcttatatggtgtaacataagttgaccaaaaagattgaatatgaattagtgtgaagattgattcaatgactaaatctagtttaatcataaaatctaaacatttatctttttttaataaaactcaaaccgataaataattttgttttagtaacaaattagattttataagtaaattaatttttttattattattaaatgtcaaattttaattgaataaaataaaaaaagtgaatataagggttcaactcaaatatttttcaattcaatatatataaccaagattttcgttaccactccacttaagtaatgcagtgaatgaaaaagaaaaaataatcagtgtctaaaatcaaaataccgttggtcagttgaataatgaaaaagaaaagatctttgattttccttttacttggtagattcctactctttaggattgaggttttaataaaagactttaatcaacaagcactaaatttaagatactggtgttgtgtaataataagtttgggccgagcaaaaaaagaaaaggactgggccgagaaacggcaaatatttgtgtcgtttcaaataccaaattcaaaatctccattcttttattactctgcttattagccgtctaagcatattacagctgtcaatcatcgaaagcatgtgacgcgtctctcttatttcatcccactcgcgttcatatacacgtgttatctactctctatccgatttccgccacgtaagaatctagacactgatgttcttatacacatagcgagtaagctgtattttacactctcgtagctagtcagtttattgtgatagcgacacggctgatttagggaaataaattaaaaacgttgtcttattcctggggcaaaaaaaagcagataagtaagcaaaaaaaaaaactcattaattacgaaagtacccttaaatttctccgaaaggaaatttttgcgccgcgtttcatcttctctcaaatcaaaatccagagagaaaaaaaagagaggatttttctcatgagattctgagagtgtctttgttcttcttacaaagaagtgttttttcttgaagattcttcggtcgctgttcgaaaagttgttgtttcgtttctctcggagctcaaaatcaggtaaaaaatttgttactttatattttcgtttttctaggtttttcgtaagagttaacctaatttcaaaatttgtttttttgggagatattgttgggtttgtgtgtaaatagttaggttgatttttttttctgatttgtttgtcgttttgtgattttttttttctacagtcgggaagaaaaatg

SEQ ID NO: 833 - DNA, 3000 bp, Unknown
  misc_feature (1)..( 3000): cDNA_ID_1715938_gDNA_ID_1620327_Annot_ID_153517 3000 nt of promoter + ATG
gaatttcaaatttctgaatcaatcattcaacaggagaaacagaaatcgctcagcagtgactactacccagtaacttaaaaccacctaaatcattcccaaaatagcccactcgtacgagaaggctaattaacgaacgcaaaatcactattcaaattaaagaaacgtgtacagctccaagcacgaaaacacagatgcgagaagagaaaatggctgagagattcaaattcgtcaggagagataccaaaaccagctcaaatgatgataaagaagaagaaagaaggaaggagtgaatccaaaatcttctcaccggatttcaatttatttcggcgactctctctgtgatggttttggagaagagaggtcgaaaaccatatacatatgtgtttatatcgttaagtcctatcgctaatccctatcgttaaggttatacggttagtcatatattagaattttttttttcgtctttggataaaattcattaaattgttagtcctatatttgatatctgtgattttctatatttaagaatacgaaattatattgggcaactttgaaaacgatcctatttatgagttttgtttgaaaaatatcatttttctcttttaattaaaaactacatttttatatttgtaatatgaaaaattttcctgatttaaattaaaagttaataaatcatttaattcgaatttggagaaaaaatgaaaacataaactaaagtcgaaataaatattaattattattatgcattctttttttataaataaaagatggtttattgaattttatactaaaatttaactgattataaagattatagcttaatatttttcatgttatataaaaactaaaaaatctccaaaactttaaacataataacttggaaaatcgaaacaggttatacatcaatgactcgatatttttctagataaatatatatacatatatttttttgtcaatattattttttgtcaaatagtagatattttttatctgtccacgaagaacagttattgcactgagaagctctatcattataaatgtcctgtatgtatcttagtatgttttcggtctgattttataagcatattagtaaaacctctatagattaataatgttgagactaaaatattttattaattaacaaagatattaattattaatctatatagagatttgccttattttgtaattttgaaagagagtttttcgttataatcaatatacttctaaaatcaactaaaaataatcaatcatttatcatgtctaacagatgataaaaaataaattgatatggtgaaaatattagcaatgaattctaacaaaaactacaatggatttttgtaaaaatatattttgatatatttatacaatcattaatttatagtatttgatgggaccattttaaaaaaaaagttttactgtaactataactctcactttaaacaaagaaaagagagggaaaaactaagaatacttcttattaacattaactctcatactaatcaaagaaaaaacaaaaaaaacatatatatagtaaagctgatttaaattagctctagcttttggtaaaatatgtgaaccaaaattttcgagttgaatattccagatacctggataatcgaaagatattcgagtaattgaacagaatttacaaaaattactcaaataaaaaacagaaaatcctaatacatatatcccaaaatagtttggtttttcagatatcttaaagctaaaccgaaaaatacttagaaaactttcaaatcctacttagttattgagtcagtttcttaaacctacctgaaccgaatgaaatttgaataaaaaatgtattttggttccttaatggaaccaaccaaaatactcaaacaccttgagctaatttaataactgaaaacgaaaaaagcatataagtagtatttaaaaaatctatcgtggaaagggaattctgtatatgtattggaagccttgtgtaatgtcgagttcagaccaccaaataattgctacaactctgtgaaatccattggtgcttaaaatacactaaggctacacagtatctcttctttgatgtagccgtgaggcatatttgaggattacacatcccaaaaaacaaacattgagttgatattcgacggcgacgaattcatttattattagtaacaataataattttctctgtctagtttccgtttgtttccatttccatggctagagtaacaagaatgacgaaaaataaataaatagaaaatcgacttttagtggtagaattaagttggcaccaataaaaaaagaaacaatacaaaagagtccaaatagtagcctaataatatagaatgaaatattaaccatccctcttttaatatatagaggatttcaaatattattttttagattctatttaaacgaaaatattattagaagattcagaaaaaaagcaaaaatgttagatgaaaataaataaatttcatattaaataattggaaacgaaaaagcataagtatttgaaatatggtacttcagtaatgaacttttaacaaagaaaaaaaagtattagaaaaatggttttgggtcttggtcttataaaatattgaacccatatcttactttctcaactaatggacaaagaaaaaggtgctcatgaaacgtataaatgaattttgatctcaacttgatatataatattggtgatttgatgttgtttggtcttttatgatttgtcttttaccagctaatttacattccattccatgaaattcccaaaaaagttatcaaatatcatttttaagtccaagaaaatgcaatgcaaacgactataaaaagaaaatcaaatcctggaaatttcgtttcagtcatcactcaatttgatttcagctattaaatccggtttgatttggttttcggtttaaccaaaccaaaattcaggcctcctaataaataccgaatccttctccctccctctctctgccactacgaatttagcacatagccggagctccgatcatg

SEQ ID NO: 834 - DNA, 3000 bp, Unknown
  misc_feature (1)..( 3000): cDNA_ID_2126859_gDNA_ID_1620327_Annot_ID_153536 3000 nt of promoter + ATG
tctttggtttgggttcggattgatccgttcttgccgaaacagactggtccgttactgaagcaatgtggcgtcgactgttaaatgaggaaccgcattttcgttttggaccgctattttgagccattttgcttggcctatttttccgatttgggtgttctttgttggattatatggatttgtaaggaggaaaaaaaatacaaaactttgattcacttgtgaaataaagtagacaaatttctgtaaaatacaaacaaatagaatgaatattactaaatcaaatcacacacaaaacacaacgattttgttatcaaccacacacacacaaacaaacagagtgataaaaataatttcacaaaggcaatgtagtaaccaaacatgtgtggaattctttctctgttgtggaattggagttctaagaacttcgactgtacttgttcgttgccattgagtgactgttccagtaaccaccaactgttccaattatcggtgattcagggcttctacttggcgatttccttggcgaattcgtagctgagaactgctttatctcctctgcagttaacgcgcccaatataggtctttcatcatggcattgaaccagtttcgagtatttcttcttctcggacattgtggtttcaacactgctacaaccgctggtcgtggtttgtgatgtggataaccaagttgaaagactagcatcaacagctatttcttgagttctctgtttctcagtttcatctcttgatttccggttcaagctgaatgttgatgataaatcatcaacctgagactccaagctgaaggaagcaattatcacattctccttccgaggctgtgtttgagttgttgttcttcctttggctttcacagctttccattgggaaagattctcaatcgggttcagtactgcattgacatatccacttctgtctctaacactcacactacccttttcttcaaccctctctatatccataacattatccgcaatctcctccgtataaactactttatcccagttgtgcagcttgtcctcataattgtcatcattataatagtcatcatctagcagcccacaatcatcatcatcagtatcctcaagatcgctatcgtcacaatccgttacatcctcctcttcatcatcactctctctgcaattctgatatctatggttagaaggataagaccctgacgagttagaagtaacatcgctcccttcagacgaacatcgagcctgcctcgacttcacctcttctttcttctcttcaaagagctcaacagattcatctactgcaatgtgttcatatgttttaacattggtgtcaaaagttactctcttacgatttggacttggactcggactctgtttctcctcaaccttgtcactgcagtttaaagaaaagaatcaaataagtcaaatctgttgagctaaaacacaaaacatgaatctaagtagaaagaacaaaaccacaacacttaccagatatcagtgatcggagttacagaaactgtagggactttctcaacaacgttcacatgattatcctttggagacacctccgagattttagggacttccataacagttgaatcttttgcatactttgggacttcttcaacagtaggaaccctaagattcaaaagaacatcctttgcagcttcctcagagattctctacataaaacgaaacaaaattacttcagataaagcaaaacccaacaaaaaattgaagctgaaattagcttaattgcagcaaatcaacactaagaagaagaacttacgtttaaacgtggctgaaaagattctctgcgtctctgacggcgacgattcttccgacgaccgaagcaaccaagtaagcaacccattctcttctacaattcaaagagctaacaacgagagagattgaaggtaatagattccttcgagagcttataaatcgaagattaaagagtcaacattgcaaagagatgatttttaactggacttagagagaagaagaagaagtgttgtactcatggatttgggggtttagggtttccttttttatttgtctcttcagatttccttttttatttgtctctttagatttccttttttctctttctaatttcaggttataatttattaattttggcggagtaaaagtagatgaccgttacaagtctgatttattagactgtgaaattggaccgttgttatgtgggccatggcttttattaaaaaaagaagagaaggtatattatttaaattggagataatgggccgttttaaacccaattattattggtccactaaagtttttatatcctctaacttcgacgagcttgatatagttttggaccttttggtgtgaacggtcacattcaactaaattaaaaagtccaacaaacaaaatctggtcatgaaaagcttggtgtgatgtttctaataagtaaatttactgaggttaattggttggtttaacttaaatgtaatccaaactcctctccctttagagattttcagttgggaatgaaaacctttaaagcttgcaccctaaaatgacattaatggttatagatatagtttgttttcatgtttcttttttttttatattttcctttagttttttctagggttgggactaaataatcggactcggatccgagatccgatttgaaaagctggatacccaattgggatggatccgcttccggatcctgaatttttagattcagatgaatatttttttttaaactaaagaaagcatatcagcatcacatttttgtggtgatactgcttcaagaatctgtcacatatctgtccaaaagaaaagaatttgtcacatattgtataattttaatatatttattgttttagtttgaaaacaaacgtggaaaaaaacatcttacaggtgtcaggtgtgccgcgtcgtcccactcaaagcctatatcatcaattttctggctgttctaatctactcaatttatttttttattgttaatttactgaagatcggcg

SEQ ID NO: 835 - DNA, 3000 bp, Unknown
  misc_feature (1)..( 3000): cDNA_ID_2126856_gDNA_ID_1620327_Annot_ID_153535 3000 nt of promoter + ATG
actccagaagaaattgcaatcacctatggtaatgtaaaagaacatcgaaaaccaaaataaataaataaaaagtaagaggatattaacctaacacatattatatattaatatcaagaaaaaaaaacccaactagtttatagacataaaactagttttccctataattatctcttactttttttttttttttttatgttcatcatgttactcttgttgcacaccattcaaatccctttatatgcccaaataacttgctattaaagatttgaatcaagtcttaacccgaaccgataatcacaagtgtatggtttagttgttcttgcagtgatatgtatagcgagttcaaattccacaaagaaccaggccattaattactaaacataataagctaaggcgatatatttttatggttttttgctaatagacaaacaagataataagcaagaaagcaataaactaataataatagatgcgcacatgatatgaacagttaataaagaaaccattggatcatggttatgcaatcgattaggatagatcaacaactgatctatgatacaaaaacatatagtattaagcttatattcctaggaaaatggagcacatgactattctattcccatgatactaacacattatccgattatgttaaacttcaattaacaaactagaaactcaagaaagattaacaaataatcccaattagtccactaattatgtatttaatagtggttaattcactagtgcgatcaaatgagacagcttgttgttcaacgaggaacacgtggttgaccatttgggtaaatgttatttattcatcaattattggtccaccaagctcgctgacccattcaagtttccaagatttaaaaatgaacgagaaaaacaaacatactatacaaagacattttaggatttctaaatgcaagaaatcgttcacaaacacacacacacaaataaataaaacaaaggaatattgccaaaaataactagcatctagaaaaaatcaattaactttctataataagttaatctaacatcaatgaagaaatggtagttttactcatcaatttcacacggaaactgatcaatatttttgcaaacactgtctaccccaaaaatagagccgtctagttcacaagatatttggactaacccccaccgttgtgaccaactgacctttcaaatcataagttacataccgaatttttaagctggcattggaggaaccggttgatagggaaaaagaaggcaaatgagaaatgtgtaggaatggcccaaacagagatgataccggagagctctgcgatgtcgtcaggctggcccatgaacttaagaatcggagtcgcaaagatgtacattgggaggagcaagatggagaataagaaaagaacaatccaagatcgctgcaaatacactccaaacatgtcatacttctttgctccaaacgcttgaccgcacagcgtttccaacgcagtcgccattccaatctgcatataaacatatatagtttcttaacaaattaaacccaacattataatataagctacataaaaagtattgttgcgtatatatacgaagaggctatagttgaagccgataatgacgttgttgacgatggagatggcagcgagttctagctcgccgaggtggccagcgaaagcctgagtgatgacaaagatcaagttggtcgtgactctagtgaatatagctggtccgacaatacgccacagcttcttcgtctctagccatatctctttctttatttctccgttttcctcctctgccacattttgatcctttaacaaaggaatcttcgccttctctaaaataccttctgcttcgtcgtctctctctcccatcgccgatcttcagtaaattaacaataaaaaaataaattgagtagattagaacagccagaaaattgatgatataggctttgagtgggacgacgcggcacacctgacacctgtaagatgtttttttccacgtttgttttcaaactaaaacaataaatatattaaaattatacaatatgtgacaaattcttttcttttggacagatatgtgacagattcttgaagcagtatcaccacaaaaatgtgatgctgatatgctttctttagtttaaaaaaaaatattcatctgaatctaaaaattcaggatccggaagcggatccatcccaattgggtatccagcttttcaaatcggatctcggatccgagtccgattatttagtcccaaccctagaaaaaactaaaggaaaatataaaaaaaaaagaaacatgaaaacaaactatatctataaccattaatgtcattttagggtgcaagctttaaaggttttcattcccaactgaaaatctctaaagggagaggagtttggattacatttaagttaaaccaaccaattaacctcagtaaatttacttattagaaacatcacaccaagcttttcatgaccagattttgtttgttggactttttaatttagttgaatgtgaccgttcacaccaaaaggtccaaaactatatcaagctcgtcgaagttagaggatataaaaactttagtggaccaataataattgggtttaaaacggcccattatctccaatttaaataatataccttctcttctttttttaataaaagccatggcccacataacaacggtccaatttcacagtctaataaatcagacttgtaacggtcatctacttttactccgccaaaattaataaattataacctgaaattagaaagagaaaaaaggaaatctaaagagacaaataaaaaaggaaatctgaagagacaaataaaaaaggaaaccctaaacccccaaatccatgagtacaacacttcttcttcttctctctaagtccagttaaaaatcatctctttgcaatgttgactctttaatcttcgatttataagctctcgaaggaatctattaccttcaatctctctcgttgttagctctttgaattgtagaagagaatg

SEQ ID NO: 836 - DNA, 3000 bp, Unknown
  misc_feature (1)..( 3000): cDNA_ID_2126849_gDNA_ID_1620327_Annot_ID_153534 3000 nt of promoter + ATG
ttaaatagcatgagctggaatggatgtttctcaacttatttctccaagttgcctatttcacatcaagacatggtgcccactttcctccaactctagatttattgtatatctatgtgaaaatgtgctgtcgttcacattcatccccaaagtattttaatgtatattgtatttgatcacatgaacatgacaaaatttatctgtaaatgtcttataataattgaactaaaaatgttatatttttaatctttttgtttgtttctattggataaaatgcaaataattatttggtagctatagacaaaactaacgtcgtgcaacaaaagttaaaaccatctttaacaaaagaaaaaaattgatgacaagatatgtataacaatatcaatgtctaatgacattctatctttaaatgtaagaaacaaaactagtattttggagaaaatattttaaaccttactttgtgtttttgttgacatttcacaaattatttaaggtgatttgttaattaacaatatcaaaaaaatcttcctaaaaaaaattaacccatacatgtgatgctatagttagtagtactagaactaaacccatccagtagtaaatctaataaacttcatttttttttgtattttgttgacttgcacttcgacatactctatataaacacaaccatattagagatcagatcccaacaccactaataaactcaacatggctagatccttgttgctctcgctaaccctcacattcctcttcgccggaattgtctcagctcgtgactggaacatcctgagccagctcaaaggaaccacaaccaccacgaagactagccaaaccggcgtcacatctttgaaagctcccaacctaaacggatactgtgagagctggagagtcaacgtggagcttaacaacataagggactttaaggtggttccacaggaatgtgtatggttcgtccaaaagtacatgacctcatctcaatacgaagatgacgtggagagagccgtcgatgaagccatcctctacctcggaaaaacttgttgcgagaagaagacatgcgatggcatggatgcttggatctttgacattgatgacactcttctctcaaccattccttaccacaagagcaacggttgtttcgggtaaataaactaaacttaaccatatacattagccttgattcggtttttggtttgatttatggatattaaagatccgaattatatttgaacaaaaaaaaatgattatgtcacataaaaaaaaattggcttgaattttggtttagatgggtttaaatgtctacctctaatcatttcatttgttttctggttagctttaattcggtttagaatgaaaccgggattgacatgttacattgatttgaaacagtggtgagcaactgaacacgaccaagttcgaggaatggcaaaattcgggcaaggcaccagcggttccacacatggtgaagttgtaccatgagatcagagagagaggtttcaagatctttttgatctcttctcgtaaagagtatctcagatctgccaccgtcgaaaatcttattgaagccggttaccacagctggtctaacctccttctgaggttcgaatcatatttaataaccgcattaaaccgaaatttaaattctaatttcaccaaatcaaaaagtaaaactagaacacttcagataaattttgtcgttctgttgacttcatttattctctaaacacaaagaactatagaccataatcgaaataaaaaccctaaaaaccaaatttatctatttaaaacaaacattagctatttgagtttcttttaggtaagttatttaaggttttggagactttaagatgttttcagcatttatggttgtgtcattaatttgtttagtttagtaaagaaagaaaagatagtaattaaagagttggttgtgaaatcatatttaaaacattaataggtatttatgtctaatttggggacaaaatagtggaattctttatcatatctagctagttcttatcgagtttgaactcgggttatgattatgttacatgcattggtccatataaatctatgagcaatcaatataattcgagcattttggtataacataatgagccaagtataacaaaagtatcaaacctatgcaggggagaagatgatgaaaagaagagtgtgagccaatacaaagcagatttgaggacatggcttacaagtcttgggtacagagtttggggagtgatgggtgcacaatggaacagcttctctggttgtccagttcccaagagaaccttcaagctccctaactccatctactatgtcgcctgattaaatcttatttactaacaaaacaataagatcagagtttcattctgattcttgagtcttttttttctctctccctcttttcatttctggtttatataaccaattcaaatgcttatgatccatgcatgaaccatgatcatctttgtgtttttttttccttctgtattaccattttgggcctttgtgaaattgattttgggcttttgttatataatctcctctttctctttctctacctgattggattcaagaacatagccagatttggtaaagtttataagatacaaaatattaagtaagactaaagtagaaatacataataacttgaaagctactctaagttatacaaattctaaagaactcaaaagaataacaaacagtagaagttggaagctcaagcaattaaattatataaaaacactaactacactgagctgtctccttcttccaccaaatcttgttgctgtctcttgaagctttcttatgacacaaaccttagacccaatttcactcacagtttggtacaacctcagttttcttcacaacaaattcaaacatcttacccttatattacctctttatctcttcaatcatcaaaacacatagtcacatacatttctctaccccaccttctgctctgcttccgagagctcagtgtacctcgccatggaaccaaacacc

SEQ ID NO: 837 - DNA, 3000 bp, Unknown
  misc_feature (1)..( 3000): cDNA_ID_3059207_gDNA_ID_1620327_Annot_ID_153533 3000 nt of promoter + ATG
tagccattctaaaaataagatgttcaggctcagagtctgtgaaccgaaccggaccggaaccgtccataaagaatttgacaacaacaaaaaaaaaaagagagacgaaaatacggataatttttttttaattacaacaacaactttcttattatatttttgacatcacatgtgacgaaaatggcttgtttgtttaaattttttaataagaccaaacataattggacaaccaattataaaagtgacaaaacacgattaatttttaaattttttatttacaaaaacaactattttcttattaaattttatttttgacatcatatgtgacgaaatggcttatctgtttgtttttcaattaaatccaaaattggtaacactttggttttatttgttttgtcaactgaatttatgaatttgattaatcgtatgttttcggacttcggagtagttaacatgacatctatctaataaatccattgttaatcaaatgatttctaattaatatataatgaaaatctttgaagcaaataagatcatgtatttatattcatccctacactaaccagaaagccaatcccgtcgctcacacatggataaaggacagacaaagtcaagagacccgtcaattattatgaacgaaagttaatatttattctaaatttgtcaagaagagttgtaattaacgaaatggtcctaaatatgtataaatgacaaataattttcagtacttacattaaaaaaaaaaattggaattgaagtattgaaaaagcaattcatggttgccgattgtgtggatccagactgatcaagaactgtatgagttgtgaatgcaatcacttggatttggtacaagatacatatatcttaaagtcgcaccatatatgtaatgttaaacaaatcaaaatatattagaacgtgggaaatgttcttaaggatgtaatgtaaacgaatgaggactaggttaacaatacacatgagttcagccattcacatataaaataatgttaatgtttacaaacaaaattcggtcaataatttaagaacttgcaagacatatctatatatacatgattaatatttgttcaaatctgtaatctcttcgtcttaatctgttaccaacaaaaaaaatgatttctgttagacaaattctaataattattatttcgatccgagatactcatatatattacaatttgaaataaagtatatacaaaatggaacatagatcaaagattgtaaactttgattttgcataccatatattatttatttattttttccaaatatttattattattatctcacaagagcgaatgtgtaagtattaactgtagatagctctaccaagttttaaaagtttcaaaagataattactaattgattcatgataaatcttacgatttttagtcttttgagactaattattcttatatcgagaatcgaagaatatgaatgatatcaaaagctgaaaattgtgttttagagaagaaaatatatttaaacatgtagagaaagttggctagtccaaatgtgtatccattatttttagaaggtctatgcaatctaaaagattttgatttctgaaaaaaatgatgatttatgtggaaacacataatataattgatttccttatctatgtcattaaaatatatttattttcctctaatgtatccaaaaaaaaatctacagttgaacacgttttagctgaaacgaagtatgaccaaccaaaatcgccaagagagagcagtcattcatcgcgacctccaaaccctctttatacatgttgaagcgatggaatccatacatactgatcttccagaaagtcgaatagtttcataggtcttctcaaaagagatgattttaacaaaataattgtaatagttgtgtgaaaatgacttctaacaatcattattcaaatgacattaggaattagttgtgttaaccctagaaattctacaagttttttaggcccaaagactaatcatacgaagctttgtatttgtgtatacactcgaaaatattctaaatttaaagtgcggctaagtggataagaagacgactcgaatccaagactctgtactggagaattaccacaggaccaaggtaattaacttgattaatcgatttacactaatccatcaaccttttaacatctttttggttgtacatacacatacatatacatagatatgtatatagttatacttatttatatctttttttaatagaattgatcatatccggagtataaattagctaagaatacatttattcagacagccaacacagctgattatattaaatagcatgagctggaatggatgtttctcaacttatttctccaagttgcctatttcacatcaagacatggtgcccactttcctccaactctagatttattgtatatctatgtgaaaatgtgctgtcgttcacattcatccccaaagtattttaatgtatattgtatttgatcacatgaacatgacaaaatttatctgtaaatgtcttataataattgaactaaaaatgttatatttttaatctttttgtttgtttctattggataaaatgcaaataattatttggtagctatagacaaaactaacgtcgtgcaacaaaagttaaaaccatctttaacaaaagaaaaaaattgatgacaagatatgtataacaatatcaatgtctaatgacattctatctttaaatgtaagaaacaaaactagtattttggagaaaatattttaaaccttactttgtgtttttgttgacatttcacaaattatttaaggtgatttgttaattaacaatatcaaaaaaatcttcctaaaaaaaattaacccatacatgtgatgctatagttagtagtactagaactaaacccatccagtagtaaatctaataaacttcatttttttttgtattttgttgacttgcacttcgacatactctatataaacacaaccatattagagatcagatcccaacaccactaataaactcaac

SEQ ID NO: 838 - DNA, 3000 bp, Unknown
  misc_feature (1)..( 3000): cDNA_ID_2126839_gDNA_ID_1620327_Annot_ID_153531 3000 nt of promoter + ATG
caacaaaaacacaaagtaaggtttaaaatattttctccaaaatactagttttgtttcttacatttaaagatagaatgtcattagacattgatattgttatacatatcttgtcatcaatttttttcttttgttaaagatggttttaacttttgttgcacgacgttagttttgtctatagctaccaaataattatttgcattttatccaatagaaacaaacaaaaagattaaaaatataacatttttagttcaattattataagacatttacagataaattttgtcatgttcatgtgatcaaatacaatatacattaaaatactttggggatgaatgtgaacgacagcacattttcacatagatatacaataaatctagagttggaggaaagtgggcaccatgtcttgatgtgaaataggcaacttggagaaataagttgagaaacatccattccagctcatgctatttaatataatcagctgtgttggctgtctgaataaatgtattcttagctaatttatactccggatatgatcaattctattaaaaaaagatataaataagtataactatatacatatctatgtatatgtatgtgtatgtacaaccaaaaagatgttaaaaggttgatggattagtgtaaatcgattaatcaagttaattaccttggtcctgtggtaattctccagtacagagtcttggattcgagtcgtcttcttatccacttagccgcactttaaatttagaatattttcgagtgtatacacaaatacaaagcttcgtatgattagtctttgggcctaaaaaacttgtagaatttctagggttaacacaactaattcctaatgtcatttgaataatgattgttagaagtcattttcacacaactattacaattattttgttaaaatcatctcttttgagaagacctatgaaactattcgactttctggaagatcagtatgtatggattccatcgcttcaacatgtataaagagggtttggaggtcgcgatgaatgactgctctctcttggcgattttggttggtcatacttcgtttcagctaaaacgtgttcaactgtagatttttttttggatacattagaggaaaataaatatattttaatgacatagataaggaaatcaattatattatgtgtttccacataaatcatcatttttttcagaaatcaaaatcttttagattgcatagaccttctaaaaataatggatacacatttggactagccaactttctctacatgtttaaatatattttcttctctaaaacacaattttcagcttttgatatcattcatattcttcgattctcgatataagaataattagtctcaaaagactaaaaatcgtaagatttatcatgaatcaattagtaattatcttttgaaacttttaaaacttggtagagctatctacagttaatacttacacattcgctcttgtgagataataataataaatatttggaaaaaataaataaataatatatggtatgcaaaatcaaagtttacaatctttgatctatgttccattttgtatatactttatttcaaattgtaatatatatgagtatctcggatcgaaataataattattagaatttgtctaacagaaatcattttttttgttggtaacagattaagacgaagagattacagatttgaacaaatattaatcatgtatatatagatatgtcttgcaagttcttaaattattgaccgaattttgtttgtaaacattaacattattttatatgtgaatggctgaactcatgtgtattgttaacctagtcctcattcgtttacattacatccttaagaacatttcccacgttctaatatattttgatttgtttaacattacatatatggtgcgactttaagatatatgtatcttgtaccaaatccaagtgattgcattcacaactcatacagttcttgatcagtctggatccacacaatcggcaaccatgaattgctttttcaatacttcaattccaatttttttttttaatgtaagtactgaaaattatttgtcatttatacatatttaggaccatttcgttaattacaactcttcttgacaaatttagaataaatattaactttcgttcataataattgacgggtctcttgactttgtctgtcctttatccatgtgtgagcgacgggattggctttctggttagtgtagggatgaatataaatacatgatcttatttgcttcaaagattttcattatatattaattagaaatcatttgattaacaatggatttattagatagatgtcatgttaactactccgaagtccgaaaacatacgattaatcaaattcataaattcagttgacaaaacaaataaaaccaaagtgttaccaattttggatttaattgaaaaacaaacagataagccatttcgtcacatatgatgtcaaaaataaaatttaataagaaaatagttgtttttgtaaataaaaaatttaaaaattaatcgtgttttgtcacttttataattggttgtccaattatgtttggtcttattaaaaaatttaaacaaacaagccattttcgtcacatgtgatgtcaaaaatataataagaaagttgttgttgtaattaaaaaaaaattatccgtattttcgtctctctttttttttttgttgttgtcaaattctttatggacggttccggtccggttcggttcacagactctgagcctgaacatcttatttttagaatggctaaacatcgtgtagttcccagtacacaaaaacgtcacaaagttcttagttagaaaaccaaaaccttattattcagaataccaaattcttctagggcaacgaacgcgcgggaaagaacccaaagacagaagcttatcactgattcacgatcatgcctcacaccaatcagtcaattcccttgtgcttttatgaattagggtttgtatcgttcgaatcgaatcaaaaaataagaagaaatg

SEQ ID NO: 839 - DNA, 3000 bp, Unknown
  misc_feature (1)..( 3000): cDNA_ID_2994165_gDNA_ID_1620327_Annot_ID_153530 3000 nt of promoter + ATG
tttgtcttagagcatttgatgaataactcgacattgaaggataaacaactccaagctattctagttgctgcggtggaatcaggtgacggtattagagagataattgatgggaaactctgtaagaggcaatctgttgtgtcctgtgtatcagcacttgaaactggtttgaagatcctttctaagcacatagagcctaaagagtccctacatagagaagacaatgatgcaactttcttggggtatgtttggctttctaagtattgcaataatcttggtgtacttgttgatgagcttaatttgattcctttttttgcttagtttgggacaacagcctattgagcttttaagatggaatatctggcagtcgaaagcgatatcttattttcttagtaagagaacgttaagattagtatcaggagccagcttgatattttctgcaccaaaagctcagtgggtagaaatgttgagaaggttgcgtgtttcagataagaatgatgacgatatattcatcgaaaagattgtaagttgatctgattcttgaactaggtatattcatattggactcttttggtttgtaagaaatggtggtcactcttacttgaacacttgtggtgatattgtttaagggcaggagctattgttactaggatgtgtaacaagcagatggacccatttaatcgaaggtatcatgtcagtttcctacaaatctgtcactgtgtcagaagaatacgaggagttatgcaagcttcttcttcaaagatctaaatgcttaaaacagaacgagattgctttgaattctaaggtcactttttcaattagaatcatttattgaaagttttagttttcttgctatatgtaaatcaggtttctaactttcttggtttgttcttatataggttgaagagattctagagtatctaacagaaatacttgagagtcgttttcatcagctctggaaattgccttctgcccttaccgcagctgcaattccatcatggtaatttcaactctatagttcatcatcttaacattggatctaattataggtctgatgccacaacatagattttgtattctggtcctggttaaagtaacattttgttaaagatcttgaaccatggtatcacaggtcaccgctgtttggtctgtattttggcggaatagagaaacagttgaaactagaccactcaacaacaaggtcaagtttctctctaaagatcagtttcacattgttcttgaacccaaacagttagaaatcgacatccatatatctacctgtttccttctcttctgcagattttgcagctgcgataaagatctaaacgagcacaatgactgtaagttacacaactacatagtactttccttgagttttacaagttcccttgagatatcttttcattaacttagatggcattgtgttcatacacgtaggtgagctcgcggaaagagtttggtgcttgtacgtattccatatctgcatatgccactagaaaaactaatggtcattgatcaatacaagaagatcagtttcttcaaggtaagatcacattgatgcagatgttttgtcaaaatatcttatgaaaactctgttttcttgcgtttgcgattagatgataaagatacaataaatggtatgatggatgagtaacagaaagatccagaaatgaattgatttctagttcgagatatttccttagctttattttggttgtttaaaattgaattctctttgtttataattgttatacatcgttgtcgttttgactcatgtatctttacttttacgtcatgtaacaagaaagcaattacgcgtggggtcttccttttaggcataatcttgtcattttggtatatgctttgtatcaatccatgtcatgatctatcctaaaacgtcgtcgtttatgccatggacggtgtagactggtagacactcatatctcactttaaccgaatgtttccgaagaatttcagacaaaaaaaactgatgaaaaaaatgagtttgcatcagataatgctttttgataaaggggtttcaaaagtggaattcttattattttttcgccaatagtgggattaatttagtcgttgagatttttgcttcaccgttggtttattggttctaataaaagttgtatttgattctccacccaaagttgggacgggtttatgacccataaattaggcttgtgatgtggagctgacactaactaaattttcaaacatatcttgaaaatttatattcattcattagaaatttatattcattcattataaagactaaatctcaataaatgggagtgttaatttgacatatgaactatgaaacgtatcattttactatattttgtattaaccatttggtaatgtattgatgtcctatcttaagtcatgtcatagtgtagctcttttaaaaccttttgtaggtcgtttataaacttgctagatgtacgccatgattttgcctatagatgatttcatttagccactacaacatagagttaatgtgcaaatatgtcacgaggtagtttatttaagtggtaatagatgatgaaatagattgaattgttttttataatattaactttttcatactagtgtattagacaaacaaaaaagaagtggatatatggtgatgaatgacgcactttggataattctttggcatatgaatcatgaatcactctactatatttctttttgtattgaaatatgttaatctactgatgatttatctactaactcatgtcattatgttggtcgtttaaacccatcttttttttttgttaaaagggtcgtttaaaatcttgctaaaacaccatgatttgcctattaatgatttcatttagccactaaaacatagaagtttatgtgcaaatacgtcacgaggtagttcactaaagtggtaatagatgaaatagattgaattacttttataatgtttaattacttagctttttcatatttgtatattaggcaaacaaaaaaaatggatatatg

SEQ ID NO: 840 - DNA, 3000 bp, Unknown
  misc_feature (1)..( 3000): cDNA_ID_1394384_gDNA_ID_1620327_Annot_ID_153522 3000 nt of promoter + ATG
catgtggagtttgaacccaccagataaatgactcgagaaaccatccaactacaagctcccaataactttacattatttgaacctatcagatagtgactgggcaaataaaatcctactacaatctccccgtatagttacatgtcccctttttcttttgtccactgctttgcaaaaagctagtttgaaccaaacataacaaggaacaaaaggcactgtcaaatagctgaagtagtggcactttcatgggcgatgtcttaccttcacaaccttggaattggacttgtgatgttcataagtgacaccaaagcattgtttcaggcgttagaaggccatcataagtggcttagaccggagggtatcacgacatagatcttagaggcaaaaggatgacacatcataccatcttagggagcatctctatcagtagtatctcatagagtatttggagattaaaaaaaaaaccaatgaaaaagtaggagtgagagtgtttcttgtttgagaaactttatacatttttatttttttggctaatgattttatacattcaaaagtacgtccagaagggcgccaatcaaattacggatactgtagccaaaaggacctcttatttcccgatttattaatgctattttgtaaagttgtactcccgtagttaaatccactagttgatttggatgtagacaacatttgtattgatgagtaatcttaacgataattcggtaagcacgagacaacaaaaatatatataacaagaaatgataaatatgaaagaaaaaaaacagaaatgaaaattctcatattcatgtaacatatacgaattacaccacgtgatcattacaattcctctatttaaacatctccaactgatcaacgtctaaaaaaatcaaatattggagaagagagagtgaacaactatgaacgtcgaaagagaccaacacatatctccaccgtgtctcctaaccaagaagatccctatcgttgatctaagcgatccaagcgacgagctcgtggctcatgcagtggtgaaagcgagcgaagagtgggggatttttcagttggttaaccacggcattcctgccgaattgatgcggcggctgcaagaagtggggaggcagtttttcgagctcccggcttccgaaaaagaatctgtcacaaggccagccgactcccaagacatcgaaggtttcttttccaaggatccaaaaaaactaaaggcttgggacgatcatctgattcacaatatctggccaccatcgtccatcaactatagatattggcctaacaatccttcagattacaggtattgaacatcattgaaaagccgatatatagtttatagttataaaccttaacattgtataagagctcatgtaagttatataatatccaacaaaatgtatgtaattaaatagtatacaagttacatgaaacttgattgcgttatttcttaccattaaaaaacattcatcaagtttttacattcttcatgatacttaaaatgtttttcggctatatagattattatgtagctgaaaattaatagtattatttgggagtggtgatggtttcagggaggtgactaaggagtacacaaggaatgttacaaatctaacggagaagattgttggttacttatcaaaagggttagggttacggcgtgaggccttgcaataatgtctaggtggcgataaagcacagtatgtgatgaggatcaattactatccgccatcggattcagccatcggagcaccggcgcacacagatttttgtggactcgcacttcttgtctccaacgaggttccagggcttcaagtgttcaaggatgaccattggttcgacgttgagtatatcaactccgctgtcattgtcctcattggggatcagatcatggtccgtttgtgtttggtttttaacttttggaaatgtttttggggtttggtttttaaaatgtgtgaattgcatgcagaggatgagcaacgggaagtacaagaacgtgctacacagatcaataatggatgcgaaaaagacaagaatgtcgtggccgattttggtagagcctaagcgtggtttggtcgtgggacctttgcctgagctcacgggagacgagaatcctcccaagtttgagtctttaacttttgaagactatgtataccgcaagatcataaaggttcttcgtgattgatgctaaacctcagcaaaatcatgtgttgtgataagacagtggcattagccaatagcttaaacaaaaaaaagtactagagtacaacctcttattattgttttcaatgttttgtttttatatttttttcagaataaaatatataatggttcgacgcatatttttcaattttcttttggtttaattaatgataaaatgattgcaactctataaatatacataattgtgaaataaacctaattgctatgttcttaattgtcaagaatttatcttcgaatgacacgaaaatcgaatttgaagtacgagacatgatttgatctgtgtatattgtacatgtcctggatcgataaggttcccagtctagctacgtacactagtttggtcagggatagctttatggtaacgagaaagaaaggaagtgtatccaatcacgatgaatcgttttctaatctatttctttcagtcctattcaactgattacacatgtcacatgtgcgccaattggatgctgttgaaactttgaaaatgcaccactatagtgttaacaatgagccggcgtgataccatgttttctttattttcgaaaggtgtatccattattgtaattttggaccaaagcatatgacattgatgtgtctctgggcctactttaaatcaaatcggacttttctcactcgattattaacgacccgacccgactcgacccggctcggaccggataattacatttgtagctatgagaagaaaaagaagaccacactactctctctatctctctttctctctatctctctctatctctctcatttcttcctgcgtca

SEQ ID NO: 841 - DNA, 3000 bp, Unknown
  misc_feature (1)..( 3000): cDNA_ID_2126813_gDNA_ID_1620327_Annot_ID_153523 3000 nt of promoter + ATG
agttttcatttcgtaaattgatttatggattcttaagctattattattggctaagtgattgaatcggtgtcatactatgtgttgcaggtgggttcgtactttgtggggcagtattatcaagtgttgcagcagcagccagatcttattcatcagttttattctgagcctagtagagctattcgtatcgatggtgattccaccgagactgctaattctttgctggtacacgactctctccttctgtttctactaatcccatttctcaagatccagtatttttctagaattcattaggttctagtggattagtggaacttaagttgataaaggtttgtgctttacttaattagtgaaagtttttgatttttcaatttctatgtgattgcagcatattcataacatggttatgtcactgaatttcactgcgattgaagtgaagacgattaattcagtcgagtcgtgggaaggtggtgttcttgtggtggtttcaggatctgtgaaaaccaaggaatttagcaacagaaggagttttgtgcagaccttttttctcgctcctcaggaaaagggttattttgttctcagtgatgtatttctgtttgttgatgagggtactgtttactatcatcagccttcttatttatctgaaatcaagcatgaggctcagcttaatcctcctacccgtcatccagatccccaaggtttgtttgtcaactttgtcatgttttgtttcgactgattcagtgtgatgaatttgttaaaacttaaaattgatatcactggttttgacttttcagtttctgactatgtgctggaggaagaggcaagcgattatgtgaacgcagtccaaatcaaagatgatcttgttgataagtacagtctgcaagaggaccaacatcaacctcagcatgaagactatgaagatgaagttgcgattgaggaaacacctagggaagaagttgcagttgatgtggtacatgaacatcgggctgcaccagtagaggaaccagttggtgaaaaatcaaagatgagttatgcttccattgtaagtgcacactctctttggtcttgtttagttgttcagcatagtaacaaaacaacatatctattgaaaaaaacgacctggaagcacatatcttacagtgttcatagttcatacttcatatatatgtgtgtcatggtagtcagtcaatagttgactgtatacttcctttgaaaagataatgctgtgaattggggattactatctcgtaccatgacgaataaccatgatctggtcttgtcatttgtacctaactttagtattgtctcatttgagatatagaaaattatctttttaattggagatgtgctgattctctttttctcagttaaaagttgcaaaggaagcagcaactgtacctgtagctgctacacaaccatcatataacaagagctctcaagatattaatgagtgggatcaaccaatgcggactccttcccctcagctggctgcgcctcttgcccctattcagcaatcaaactcatccacatatgtttccgactatggagcagaggcagaagatggctccggttttgaagactgtaagtttcttggaccattaaaagttttgaaatttctcatatgctcaaactcgcactaggatatgctatttggagttatttgtcatatattcatttctttctggtgtgccttgtttcagttgagttcaaatcagtgtacgttaggaatttgccttccgacatatctgcttctgaaatagaggaagagtttaagaacttcggtacaatcaagcctgatggtgtgttcctcagaacccgcaaggtaaataatcttcatttcgtgttttttttaatccttttctctatgtttatcttaagtgatatgaagagccaaaactaacaatcttatgcaactaaacatgtaggatgttatgggcgtatgttatgcatttgttgagtttgaggacatgacttccgttgagaatgcgattaaggtctagattctattccacagttacctcactagattaattttcatcttctgttcccctttcgctttgttcttatcattttccgtttgtgtaataataatatataggcttctcctatatacttgggtggaaggcaagtatacattgaggaacgaagaccaaatcccgctggtgttcgcggagcaagtaagtcttcttttgaaaccgtgctctatgaccaacaaattttgtatcataaaacttcttaagagcgtcttgtgaaagcctcataagaaagaaagtgtacagcatgtaactcattctgactttgatgtgtattgacttggtcaggaagaggaggaggacgtggaaggggtggttacccaacagaagcaccaagaggccggtttggtgggcgtgggtctggcagaggaaaccaggatggaggtgactacaggccaagaggaaatggttactaccgcggtggtggtcgctaaaagaaaaaagaatctcgtcaaagttttagtgctaccaaagaatgaaatgattcagttcttcttcctttatctacggaagaagtagtttgtaatttctattttgttgggtttggtttttggctcaaagaaacaaagattttggcttatatatgtttttctttaaatttgttatagatttagccatttagagcttttgactgttatctccctttgggaatggtttagttttggtataacatttcaatttttggtttccttactggattgaattccaaacttcatcaatgtgcttctgttcctttgtctccgagctttatgtactgctctgagacatcagcttttatggggcgacagaacatattttcactctgttttttttatgaaaaagaaattgaagaattattatcagaaaaatcgaaaaaactcgaagattaaagaattgggacccaacaaggtttttgatatatgtcggtgtttgattgtaatggtttcgcgaagcatcgtatgaatctttcagagagacagagggaatg

SEQ ID NO: 842 - DNA, 3000 bp, Unknown
  misc_feature (1)..( 3000): cDNA_ID_2126817_gDNA_ID_1620327_Annot_ID_153524 3000 nt of promoter + ATG
ggtaacataaaacggtaaataaaaactttagcgcgaaacagagtaatagaaaaatggtggaatttagtagtattggtatataattagttggtatcactgtttatgtttgaggtatgaattagtacggtaatatacttgatatgaatcgaacacatatatgtatctttagttgaagtatgaaaaaacttttttccattttagcgacatattttatctctacggtaaggagttatttaatcgaataatagtgagtgttagattttgtatacaaatattaatagttcggtgatagttacacacacatgaatctcgtataagaatgtgtatatctttatgtagtttcgttgtcaagtagactaaacaaaaactaatggagacaagacgaaaacaaagaactagtagtggaagaagatattaaaaccgaaaaactagtggggaaatagattacttcgttatagaaaagaagagatttttccaaatgttagaatattgacacatcattcaggttacatgtgagtgaggctagctaatatttttaatttaattttctttgataattaaaatttgaaataagtaattataatgggaatggccattaatgggtgtttgtgtgtgtgtgtaggtggagagaagagacaacacacagaaaggacgatagctttggcggtgggaggagtttttgttttagggtttgtgattgtttgtttgttggttttgaggtctgccatgaagaagaagagtaataaatatgatgcttattgattcttatttttacctaccaattcttattttcccaattaaaaatttaacaaggtatattagaaaaatgattagtatagcatgtccaattgtatattcaattatgatattgatttaaatacaaataaattttgatttttttggaaaattttggatgatataaatacaatatttattaagctattggaataatgaaggattaattttgtcatttttttcttttgtctctctgtcacttagtatctaatttctttcaaatctttcattttatttaattgcccattgaaagatgaaagtgattcctcaacttactgattaatacttgttgttctatttatttccaatgatttagatcagataaaaaccatacccactattgaaaacaaaatattaaaagtaaaatgaagcatcaaaatagaaaattgatgaaaacgagaaaacactaacaagaagtaaagcagcagctttttctagtgaaatccagtttcagtcgttttcattgggaaagagtgaagctttactggtatctcactttggaagtttggagttagtgagattcacagtatccaactatacatttcactacatctataaaacttctatctatagcatataaagtgattgtgacactattcaaagatatgcacgattatggtaaatgaaaaatctttctacactagattgtaactctgattgatttcaaaatttgcaaggcgcagcaaatacatggaacttcaatgaccgttcttttactcaatactcaaaccgggttaggtatgtttcaaagaaaaaaacagtttgacggctgataatctgttcttccaccactgttatggttaagttagatcatgaacatgatttcccaaaccaagaggagacgtgatagacttcatctttgaccctagacataagctgaaatatcttctttcagcttaaaccctttaacgaaacaaacacataacaatttgacaatcacatcaaaacatatcagaaggaactaatcccagaactcaaacttcatcgctcaagtaccacaaactagaagaagactagtctgttaaaggtagaaccattcaaataaagtgaaaattaaccatataaacaagcttcagaactctagagcattgaatacgcttctagcatcacttaagttagaacctgaacatgatttcctaaaccaagaggagacaggactcacacacaaatcatcttacatatagatctctaaaccaagacaggacacacacacaaacatatcagaaggaagtatcccaaacttgtacaaaactccaactccatagctctcaagtagatgatcgccattcatacaaagtgacaatcaaccatacttagacgcttgagaactctatggaatcaacttcatagcctaaagatgctaaatttaactaacttcttgcaatagaaacaatttcaactgaatgatgaatccgagaaaccagaattattgattgccaaatcaatctcaagataatatataaaacaacaaagcctgaactttatgaatccaacgatgtgaattaaaccactcttatacgaaattcaaattcaaacaacaacatataaccaaaaaaactcgtaaaacagaggaccctaatccataataagggattcttacaatcccctttgcattggagatggtggagctccgaggagactggcctgttgaagctcaatttcgttgatttgtgcctctcgatccatctcgatgatcaatggaacaacaagtatgagaaaagttgtcccagcgatccacgctgcttttccggtgctccggagcagtttcttcgatacttcgacggcatctcctgctgcgcgtcttccttgggacacgatctcggagtttgaaatcctcgctaatatgtttggatctccgccgccagatttaccggctccgattctcttcgccgccatcgagtgaacaaaagtttttttttttttgcttttttgggttaaaactttctgaatcgcttcggagagtgagaggatagtaacgagggtttcttctatcagtaggatgagttttgtttaccatgatttgggccattaaagtccaatatattaatcagctcaatgattgggccataaaagcccaattataatcactgcataatacttatatcaagggctctagatcagaatcagaacttaataaccaatgcaatatgcaaaagatgtctccggaggcaatactataagcgaggaattcaaagcttggtaatg

SEQ ID NO: 843 - DNA, 3000 bp, Unknown
  misc_feature (1)..( 3000): cDNA_ID_2126824_gDNA_ID_1620327_Annot_ID_153527 3000 nt of promoter + ATG
catttttctattactctgtttcgcgctaaagtttttatttaccgttttatgttaccaattcgacctatacgattaaaactctttaataagagaactaattttctaatcatctgaaagtattatatcaaaaggaaaaatataacagtgatttaattagtgtatacctgataatggctctatgttgggaacaccatgagagtagtaactatagctaacgaagcacttctgaaggtaaacttgtcccgagttcgactctccacactcactctttgctttctcaaatccatctttcacacattccccacaatctgaatttcccaaactaccctcacactgtcccaacacatacaccgactcatactgccccgcgtaaaaacctcctccgccaccaccaccaccggatgatccagttttcacgccgttctccgccataccaaacgccgtctcccttttcccgacaaacccaggatcgttagaatcttttttcccacagacacggaacaacatctccgtaccggaagtttgccggaatcctgaactctcataccggatataacatccagcgaggtgaacacgagccgccaccacattaccgtcatctctgccgccaccgcagagtttagaaacgagtttagggattttggagacgcaatcgtaacactgagcgttttggagatcgccacggcactgaaaaacaccgatcacggcggtggtgttatcagttccggaggttacggaagcgaaagagctttgtgatgattgagaaactaaagaagtgaataagtttttgagattctgagagaaaacaccagttgggtctggagatttctgatttgcacaacctttaaagatcagatttttataatcatcatcaccggagattgcaaagaatggtaaaaagaaccagaagatgaagaattgataggtgagtttcataattgagaaagacagagagagatttttgtttcttgatgttcaaaatctttttactagtttgtttctgtctaataaagtttgtgttgtttttatgtgtccggaaaaaagaaagttttccgttttttttttgtcttttgttttgaggtttaaagacaaaaaaatgtaaataagagcaggttttgtagtatgaaaccatgaaaaataaaggagtatacttttctttggatcttgcttcaagggtaagataaaaaagaaagaaactttgagacgacaagtgtttattatatagatttggtttaggagattatgtaatacagtatcaaaaaaaaatgattactgtttcttcttttttgttgttgaatttagtgaataacctttaatgccattaaatctgactttattgtctgaatttggattttgttttaggacattgatggaaaaacaccttttgtgtatatgtattttttgtttaaggcactaagatatattttgatgagtttgatttaaattgtaggctgatacgagaaggaaaataaaatcttagaccttgttgtaaatgtgaatgattgattcgattttattttgtgtccaaaacaaaacaaaacatgatcgttttgagtttacataatttcagaacataattgcgtagtaactggagtaaataataataaacctgtgtgtttttgtaaactacaaaagatattatcactatgattattttgagttaatgataagcatgattgtttttgcaggattttggatttcacattctatatgatatattttgagttggtgagtgtggaagatttgtcaacaacccttgatctcacaagaaccaaattgcctttgtgtgtttggattatagctctcttggaacctttgttgatgtattttacctatgcttttgcttaccttttatggtattggggaatgcctatctttgttgtatgttaaaactttgtgatcttagaatccttctacctttgtacttgttttctcttgtagatgaatgaaaacaagcatttgcccaaaaaaaaaaaaaaaagattgctcggagaagtagaggtgttccccaatgtttcaaaatcattaagagttaaagactacaaaaggaaagaactaatactgtatactgtaaaagatatgtgaaactcttaattaagtatagattccctatacaatattagtgaataatttttataaaataaggttaccagaactgcctgcattggatttaaataccggagaatttgagacatacatagttacatacacatgatagtagtaagatcaaaaacaaatcttaagaggtcaataagattcgcttatttattgagtttgacccgacccaattaagcccggcccattaagcagagaagaagaagaaagagagagggtcaacaaaaagtcacagtcgaacaagatactgagaaagaaacgaaatttcacctggcactgtcctcgcgtgtactctcacgcgccgacgtaatactctgccgtcgtcaccgacattgtctctacgccgttgtcatttgcttattacggccaagattcttcactaagtaagtcaaaatcgtggaatcctttctctgtaccgagctcgctttaaaccctaaccctctcgtctctgtacttagtaagttcttctaatttccgacgaaagtcttctcctttttgagtctcatcgtcatctgaaaacgctattagctctctggaagagaaaaaacaacgttttgttagagtttctttgtgcgattgtgttttcttaagaggaaaggtttcaactttcttaggatattcaatttctgagtcttttctgctacttgtggttagtctttgctgctaggtagatgtctgtagtcttggtttgttgttgatttgctttaggtctgtctttgcttattgttgtaatgttttgagttctggccacatttatttccttactgaacggctcttcacatcttgtttcttccgcattttgataggacgaggcaaatgagaagttacaacttgtttcacgaaagcaatcccacaatcagttttagttttgttggtgcagaaacg

SEQ ID NO: 844 - DNA, 3000 bp, Unknown
  misc_feature (1)..( 3000): cDNA_ID_3059237_gDNA_ID_1620327_Annot_ID_153525 3000 nt of promoter + ATG
gcaaattcctaacgtacactgatttgaactcaactgaaacaaggcacaccagaaagaaatgaatatatgacaaataactccaaatagcatatcctagtgcgagtttgagcatatgagaaatttcaaaacttttaatggtccaagaaacttacagtcttcaaaaccggagccatcttctgcctctgctccatagtcggaaacatatgtggatgagtttgattgctgaataggggcaagaggcgcagccagctgaggggaaggagtccgcattggttgatcccactcattaatatcttgagagctcttgttatatgatggttgtgtagcagctacaggtacagttgctgcttcctttgcaacttttaactgagaaaaagagaatcagcacatctccaattaaaaagataattttctatatctcaaatgagacaatactaaagttaggtacaaatgacaagaccagatcatggttattcgtcatggtacgagatagtaatccccaattcacagcattatcttttcaaaggaagtatacagtcaactattgactgactaccatgacacacatatatatgaagtatgaactatgaacactgtaagatatgtgcttccaggtcgtttttttcaatagatatgttgttttgttactatgctgaacaactaaacaagaccaaagagagtgtgcacttacaatggaagcataactcatctttgatttttcaccaactggttcctctactggtgcagcccgatgttcatgtaccacatcaactgcaacttcttccctaggtgtttcctcaatcgcaacttcatcttcatagtcttcatgctgaggttgatgttggtcctcttgcagactgtacttatcaacaagatcatctttgatttggactgcgttcacataatcgcttgcctcttcctccagcacatagtcagaaactgaaaagtcaaaaccagtgatatcaattttaagttttaacaaattcatcacactgaatcagtcgaaacaaaacatgacaaagttgacaaacaaaccttggggatctggatgacgggtaggaggattaagctgagcctcatgcttgatttcagataaataagaaggctgatgatagtaaacagtaccctcatcaacaaacagaaatacatcactgagaacaaaataacccttttcctgaggagcgagaaaaaaggtctgcacaaaactccttctgttgctaaattccttggttttcacagatcctgaaaccaccacaagaacaccaccttcccacgactcgactgaattaatcgtcttcacttcaatcgcagtgaaattcagtgacataaccatgttatgaatatgctgcaatcacatagaaattgaaaaatcaaaaactttcactaattaagtaaagcacaaacctttatcaacttaagttccactaatccactagaacctaatgaattctagaaaaatactggatcttgagaaatgggattagtagaaacagaaggagagagtcgtgtaccagcaaagaattagcagtctcggtggaatcaccatcgatacgaatagctctactaggctcagaataaaactgatgaataagatctggctgctgctgcaacacttgataatactgccccacaaagtacgaacccacctgcaacacatagtatgacaccgattcaatcacttagccaataataatagcttaagaatccataaatcaatttacgaaatgaaaactcgcctgcgtcgctccaggataaggagtcgccattatttaacaaaacccaagatctggatttaaacaaaaccctaagatccgatgaagatcgagtaaaagcttccaagaaactcaaattaatcagaagaacttcgcacagaaggaactggatagagaaaaagaagaagaagagagtatctctcaattgaatttgaataagaagagatctgaggaaggattgatgaagaagaaggaagtgagatttataaagggtttacagagaagaagggaaatggagagtgatagatctacacgagagagagattaaaagggtttttgtgaacactatagatagggtatggcaattaagaggaggcgctctttattccctttttatctacaaatgtatcttttctttccttttccctttgatttgccccataagttttgaatgcgtagaaaataaccctgaattcttataataacaatatgggtcctttatcttctttttattcatgattttaaccccaaaggttttgacattaccaaaataaaccataataacaaactgaatatttatattctcatgattttaaaccccaaaggttttaagattatcaaaccctttatattgccattacttactttttgttttctcgttttttttcaacatctagctttgattaatatgaaaagtagtcctgatgtttacaatggaacttgaaatgtaaaagtatgatacaaagtttgtttgatcaatgagagtttcttttaccaaacgatctgcagctttgttgttgtgccttcttgtccaaacaaagtcaacactggagaatttttgcctccaatatttgatctctctgatccaattgtggactttaaagttttgtgtttctcccttgactagcttcaagactatacgattatccccttcaaataacactttcttgtgtccttgtatccatgtgtgttgtattgccattaccaagctttgaattcctcgcttatagtattgcctccggagacatcttttgcatattgcattggttattaagttctgattctgatctagagcccttgatataagtattatgcagtgattataattgggcttttatggcccaatcattgagctgattaatatattggactttaatggcccaaatcatggtaaacaaaactcatcctactgatagaagaaaccctcgttactatcctctcactctccgaagcgattcagaaagttttaacccaaaaaagcaaaaaaaaaaaaacttttgttcactcg

SEQ ID NO: 845 - DNA, 3000 bp, Unknown
  misc_feature (1)..( 3000): cDNA_ID_2126804_gDNA_ID_1620327_Annot_ID_153520 3000 nt of promoter + ATG
ccaggtgctgttttctgccttagggaaccattggttttcattttcataaactcgttagtggttcttatagtttctcaatctcttattatcttacagattttggtggcacacaaaaatgaagtgtggtttgtgcaattctctaatagtggcaaatatctggccactgcatcaagcgattgtacagctataatatggaaggtaaatatcttagaccatttggtttctcttatttttccctaaagtcattgagaaagagaccagatgaattagctctgatgtgtaagagaaccttatgaggtttcttcttgtataactcttcacgctgtgaggtggaaaaaaatattaaggaaataacatttggatgtcttgtcttgaagcttggtatataaggtagaaagccattttgtgacaacaaaaaaggacaagaacttttatgttgtaattcatagtgatttgtcgttttgagccatgtaatgtaactagttcttagtacttcagggttgataaaatttctgtgtatttttctatggtagttttgagaccgtttctttaaggattaaacatggtaatttctaattgataaaatttggtattggactaaaacttcttgtttcaggtactggatgacaacaaagtcgaactgaagcacacacttgagagccaccaaaatccagtttcttttgtctcgtggagtcctgacgatactaaactgcttacatgcggaaacgctgaggttcttaagctatgggatgttgacacaggtgtgttgagacacacatttggaaacaacaatactggattcactgtcagctcttgcgcatggttccctgactcaactcggcttgtctgtggcagttctgacccagaaagagggattgtaatgtgggacactgatggaaacgagatcaaagcctggagaggaacgagaattccaaaggttagtaaaggttaaaagatttgcttatccgttttggtattcaaatacttgaaattcgaaatgcacaatttcctaataggtggtggatttggctgtgacgccggatggcgagagtatgattacagtgttttcggataaagagatccggatcttgaatttggagacaaaagtcgaacgtgttatctctgaggaacagccaattacttccctttcaatttctggtgatggtaagttttttatagtcaacttgagctgccaagagatacatctttgggatcttgctggagagtggaaacaaccattgaagttctcgggtcacaggcagagcaaatacgtgatacggtcatgttttggtgggttggatagttcgttcatcgccagtggaagtgaggattcacaggtaagcacattattttcgaccaagacagttgttttttggttgctgttgactgacattgatctgttgttcacaggtttacatatggaatctaaagaacacaaagccgcttgaagtgttatcaggtcattcgatgaccgtaaactgtgtaagctggaacccgaaaaatcctcggatgctagcctctgctagtgatgaccaaaccatccgtatttggggaccgggcaaaccgaacaaaccactgaactgattagataaccagaaaccgtagtagctttaaaccaggacctagttctagtagttccacatttgtgtatagttcatttctggttttttcttttttggtggtccttattggctttgcagaacaatctcttgctttttgagttttggtacactggttttggagaacttgatttgagatgagccatgaattgaaaccaaaccggtttaggcggtaaactgaaccaagctgtgttgaggagttaggtggcaattgtttggtgttcagagcaaaacttagctaactacttgtttcgttggtcatttgctaccatgtgggttccccgttattttaaacagaaaatttaattataatataaacttcggaaacgcccctaaacttatgatatttaagaatctgccaatattgttactttttttccttagtacagagacattattttttctaacaaacctgtttagaccaaaacttctgaaataattggcaatgcgtagattacaccaaaaaaaaagtttgaaagaaaatgtgttgcaatgattctaatatcttgaaaaggtatatgagtttcaattatagaactcaagaagattaataagtaattgcgagttcgaacatttgtgggtttcaattatataattaacaaaaaaatctactaagtgcatacataagaagtatttcacctaatacgattaagaatatacatgatttcagttttagtatctactatataaatatgaataccaacgtaatttaatcatatatttaaactacatatacatctatttgaaacatggaatttacatctttctatatttaaaaatatttgaaatgaagtttcaaaattttcatatgtaaagtatacgttatacaatctaaactagtattcaaaagatgataacatctacacaaaacaatcacatgaataggttaaatcaaaattaaaaatagaactgatataccctcttagatctcgaaatatttatcagtatgggccagaagggctatagttattcttagaaaaaaaatggaggtaatgtcgaaattgacgaaattaataggcgtatttttaaaaataaaggttgtttaagataatcatgaaaaattagcagccactgagtaacataattacataaacagagacacacttacttgaaatagaaaacaaaataagatccttttaacaacaacaacaacaacatctcacaggtctcgctaagacggtcctaaacaaaaaccaaactgtttaggtttcgtcgtcgacgcgctctcatcaacaaagtcccatacgaaatttaaccaaaactatatatcgagggacgaagcgcgtgacgttagatcggagatctcaccgagatcgccggtgaattagggtttctacttcctttgttcttgttaacgttatatgaaagtttggaattcaag

SEQ ID NO: 846 - DNA, 3000 bp, Unknown
  misc_feature (1)..( 3000): cDNA_ID_3059242_gDNA_ID_1620327_Annot_ID_153519 3000 nt of promoter + ATG
atcaccaatattatatatcaagttgagatcaaaattcatttatacgtttcatgagcacctttttctttgtccattagttgagaaagtaagatatgggttcaatattttataagaccaagacccaaaaccatttttctaatacttttttttctttgttaaaagttcattactgaagtaccatatttcaaatacttatgctttttcgtttccaattatttaatatgaaatttatttattttcatctaacatttttgctttttttctgaatcttctaataatattttcgtttaaatagaatctaaaaaataatatttgaaatcctctatatattaaaagagggatggttaatatttcattctatattattaggctactatttggactcttttgtattgtttctttttttattggtgccaacttaattctaccactaaaagtcgattttctatttatttatttttcgtcattcttgttactctagccatggaaatggaaacaaacggaaactagacagagaaaattattattgttactaataataaatgaattcgtcgccgtcgaatatcaactcaatgtttgttttttgggatgtgtaatcctcaaatatgcctcacggctacatcaaagaagagatactgtgtagccttagtgtattttaagcaccaatggatttcacagagttgtagcaattatttggtggtctgaactcgacattacacaaggcttccaatacatatacagaattccctttccacgatagattttttaaatactacttatatgcttttttcgttttcagttattaaattagctcaaggtgtttgagtattttggttggttccattaaggaaccaaaatacattttttattcaaatttcattcggttcaggtaggtttaagaaactgactcaataactaagtaggatttgaaagttttctaagtatttttcggtttagctttaagatatctgaaaaaccaaactattttgggatatatgtattaggattttctgttttttatttgagtaatttttgtaaattctgttcaattactcgaatatctttcgattatccaggtatctggaatattcaactcgaaaattttggttcacatattttaccaaaagctagagctaatttaaatcagctttactatatatatgttttttttgttttttctttgattagtatgagagttaatgttaataagaagtattcttagtttttccctctcttttctttgtttaaagtgagagttatagttacagtaaaactttttttttaaaatggtcccatcaaatactataaattaatgattgtataaatatatcaaaatatatttttacaaaaatccattgtagtttttgttagaattcattgctaatattttcaccatatcaatttattttttatcatctgttagacatgataaatgattgattatttttagttgattttagaagtatattgattataacgaaaaactctctttcaaaattacaaaataaggcaaatctctatatagattaataattaatatctttgttaattaataaaatattttagtctcaacattattaatctatagaggttttactaatatgcttataaaatcagaccgaaaacatactaagatacatacaggacatttataatgatagagcttctcagtgcaataactgttcttcgtggacagataaaaaatatctactatttgacaaaaaataatattgacaaaaaaatatatgtatatatatttatctagaaaaatatcgagtcattgatgtataacctgtttcgattttccaagttattatgtttaaagttttggagattttttagtttttatataacatgaaaaatattaagctataatctttataatcagttaaattttagtataaaattcaataaaccatcttttatttataaaaaaagaatgcataataataattaatatttatttcgactttagtttatgttttcattttttctccaaattcgaattaaatgatttattaacttttaatttaaatcaggaaaatttttcatattacaaatataaaaatgtagtttttaattaaaagagaaaaatgatatttttcaaacaaaactcataaataggatcgttttcaaagttgcccaatataatttcgtattcttaaatatagaaaatcacagatatcaaatataggactaacaatttaatgaattttatccaaagacgaaaaaaaaaattctaatatatgactaaccgtataaccttaacgatagggattagcgataggacttaacgatataaacacatatgtatatggttttcgacctctcttctccaaaaccatcacagagagagtcgccgaaataaattgaaatccggtgagaagattttggattcactccttccttctttcttcttctttatcatcatttgagctggttttggtatctctcctgacgaatttgaatctctcagccattttctcttctcgcatctgtgttttcgtgcttggagctgtacacgtttctttaatttgaatagtgattttgcgttcgttaattagccttctcgtacgagtgggctattttgggaatgatttaggtggttttaagttactgggtagtagtcactgctgagcgatttctgtttctcctgttgaatgattgattcagaaatttgaaattcacatcgaaaccaaatcttaaatcatattggtagctttttttttgttttgtgattagatactgtttttttatagtattaaattcgttttggtgtgagtgatttagtgtttgggaaattatttaatttagtggttattttctgatttagtgatgatttgagaattttgtgttgtttatattcttggtagcgggaaatttgtactttcctttgtggacctttcaactattgaatgtggaagatttgctgagaatcttagaaagtcatcatcatccatacgtaagagaacttttttttagcttgagagtgattttcag

SEQ ID NO: 847 - DNA, 3000 bp, Unknown
  misc_feature (1)..( 3000): cDNA_ID_2126983_gDNA_ID_1620328_Annot_ID_153557 3000 nt of promoter + ATG
aaatgcctcttgttgaattggattatccctactatattacttggtttctgattataactctagttggagttgaattgcgccttgcaatagtggtgacatttttgcatgtggtggtggtgacaggtcggagaagccaccaaatgcagatcagggagacaatcaggtatcaaacccgaggaaaattctggaggaggagtatatagactatgagaccaaggtaagaattgctgcttagtaggttacgattgattatttttattgagaccaaatatgactctgcatggtcgtgctctggttcgttgattttttttctttttctggtttctattcttcctcgtctcttatttggttttatcaaaaacttagatcattaccacattcagcattgtggacaacgtgaaagagcaattccaggttctccaaagcaaactggataagtgagtggaaacataattatgtgacctttcagtaatcggtatagatttattgtactaaagttctgaaatcctacattataccagaaaggacgaccggcgtgtgaaagagctgtttgatgacatggagaaaatgaggcagcaatttgaatccatagcgaggccaacgttagagatagagattccatcacctagaagcagtgttacgtcccctaaaagcagtgctacatcacccaaatctcccaagcctagcagtagtagcatgaatgcttcaactgaatctactcagacccaaaagccagagctgagcaattctcctcaggcacccaatcctgcagctggttccagtcaagagtttaaccctgaagccgaactagccgagctggaatctgaatttggtaaggtggctcgtgattactctgcagatgaggttgatggatgggaattcgatgaactggagaaagaactgcagtagtatgatccatcacacgcctgcctcacatacactgatatgtttttcatttactttctttgtttgaccataactccgaagttcctttgttaatctgtttggtaatttatggtaactgcctgttgacttttgtatgtctacttttttttttttttgctcataagtgttgtctcttatttaaaccaaagattgtaaagattacaaaagagtggaaacctccgctttcagtctccagacaaaaacaaaataaagataaaagtccaactaaattaaagcccagttgaagcaagaaacccttttaggaagtaattgatgtagtccaccgccgatttggttagtcattgcagggaactccaaaaccaccaggaaccaccaagacttcaagcttgtccgatggagcaacacaaaattcagagaatcccatcaatcttcttcatcttcgaattcgcaaaggaaaatctcccctgggtagtcatatcatcatcttcaaacgacatcagcgtagaacttaagccaatgaaacttccatgaacacctaaaagtaaaataaaaacactcgtttccaaaaaccaatatgacaattgactcaattgcataaaacccaactcaaaggcattagagaaaaccccaatccacaactctaatttgttcttatataattgaaatcgataagcttgaaaaacaaattgagccctttaaacaaaggaggttcaaggaattgagccctctaagagttagaacacaaaggagcaaaatcaaactggatctatagaaaacgagaacataaaacaaaaccgaaaaagaaatccggccaaaagctagcctaaaccgccggagacggacgacggagaagctagacaagagccaaccaccgttggtagaggaaccaaccgatggaggacggcgacaccggacaattctgctaaaggagccagaagattccgggaaagtaaccgaccaaccacatcacaagaggcatatggatgtcgggctgaagcctgtcaagcggactggaccggcccgctagactcacacatcacagtgggtttaataatgttttactgttaatgaatgggcctctcaagacaatgtgctaatccattccttgctagtttttgctcaacttttagcatgtagtgtttaacgttttccttgtgtatgcgtatctaaattggaacttatgtgaccatcaagacagtttggaatttcatcaaagcttgtcttgtgatgcctcttagtggtatggagcggatatcaattgtccaaattgtcctttggcagactcgagaaatgttgaaagcaaatgaaaccggtgaaaaggaaaaggttccttttttctcaagcttttaaaatcaattaaaattgtaatggcaacaaaaattaagtagattatcttctaaagttaagaaagtcatctaaaaaaacaattttggaattaaatccctagttaaacattttgcctttaactgtagtgtttcatttctgtgcatcaaaggttttgaaatcatcaaaactgttttgtgaattctcatcatggacacatacacatacacacaagagccaagagttgacccactcatcaacatcatggatctagacggcttaacgtccctcttcacacttttttcaacacatgttttattccctcccaatttctggtacctattaaaataaagaatagtaaacaaatcatcaaaactagcacgcaagccacttgtattggattgacccctcatgaattctattctattaattagagatacgtgacgaaacttacaagtgacaacaatttatctaattactaattaacaactaattttaaaaatgttatgtgattagcaaaatttaaatgtagttacgttatcgtaattctggatctattactataaactaaattatttttgacgtatgattagataatgtaatgataattgtaaagtttagtttgaaaaaaaacaaaattgaccagacactagagtaaagcttatgagcattgatggaataaatgatacaaagctctttaacatttgagtattccattctctcattaacggattctctaaagtgcgccaagcgtgcgcaagagccatcatg

SEQ ID NO: 848 - DNA, 3000 bp, Unknown
  misc_feature (1)..( 3000): cDNA_ID_2109090_gDNA_ID_1620328_Annot_ID_153568 3000 nt of promoter + ATG
catgtcacttgacaatgaaactgggttggatccagctggtattagagttcgagctgtatcaggactcgtggctgctgactactttgctcctggctactttgtctgggcagtgctgattgctaaccttgcacatattggatatgaagagaaaaatatgtacatggctgcatatgactggcggctttcgtttcagaacacagaggttcttttctcatcgttctttctattattctgttccatgttacgtttctttcttcattacttaaggcttaaatatgtttcatgttgaattaataggtacgtgatcagactcttagccgtatgaaaagtaatatagagttgatggtttctaccaacggtggaaaaaaagcagttatagttccgcattccatgggggtcttgtattttctacattttatgaagtgggttgaggcaccagctcctctgggtggcgggggtgggccagattggtgtgcaaagtatattaaggcggtgatgaacattggtggaccatttcttggtgttccaaaagctgttgcagggcttttctctgctgaagcaaaggatgttgcagttgccaggtattgaatatctgcttatacttttgatgatcagaaccttggctctggaactcaaagttattctactaaatatcaattctaataacattgctatattatcgctgcaactgacattggttgattatttttgctgcttatgtaactgaaactctcttgagattagacaaatgatgaattgataattcttacgcattgctctgtgatgaccagtttcttagcttcgacgataacatttgtcatactgtcttttggagggcattgaattttgctatggaaagcgctggagcttccatgcttgcattctttaccaattagcgttattctgcttctttcaattttcttgtatatgcatctatggtcttttatttcttcttaattaaagactcgttggattagttgctctattagtcacttggttccttaatatagaactttactttcttcgaaaattgcagagcgattgccccaggattcttagacaccgatatatttagacttcagaccttgcagcatgtaatgagaatgacacgcacatgggactcaacaatgtctatgttaccgaagggaggtgacacgatatggggcgggcttgattggtcaccggagaaaggccacacctgttgtgggaaaaagcaaaagaacaacgaaacttgtggtgaagcaggtgaaaacggagtttccaagaaaagtcctgttaactatggaaggatgatatcttttgggaaagaagtagcagaggctgcgccatctgagattaataatattgattttcgagtaaggacatataaatcataataaaccttgtacattttgtgattgtatgatgaatatctgtacattttatctggtgaagggtgctgtcaaaggtcagagtatcccaaatcacacctgtcgtgacgtgtggacagagtaccatgacatgggaattgctgggatcaaagctatcgctgagtataaggtctacactgctggtgaagctatagatctactacattatgttgctcctaagatgatggcgcgtggtgccgctcatttctcttatggaattgctgatgatttggatgacaccaagtatcaagatcccaaatactggtcaaatccgttagagacaaagtaagtgatttcttgattccaactgtatccttcgtcctgatgcattatcagtctttttgttttcggtcttgttggatatggttttcagctcaaagcttacaaagctgtttctgagcctttctcaaaaaggcttgctcagtaatattgaggtgctaaagttgatacatgtgactcttgcttataaatcctccgtttggtttgttctgctttttcagattaccgaatgctcctgagatggaaatctactcattatacggagtggggataccaacggaacgagcatacgtatacaagcttaaccagtctcccgacagttgcatcccctttcagatattcacttctgctcacgaggaggacgaagatagctgtctgaaagcaggagtttacaatgtggatggggatgaaacagtacccgtcctaagtgccgggtacatgtgtgcaaaagcgtggcgtggcaagacaagattcaacccttccggaatcaagacttatataagagaatacaatcactctccgccggctaacctgttggaagggcgcgggacgcagagtggtgcccatgttgatatcatgggaaactttgctttgatcgaagatatcatgagggttgccgccggaggtaacgggtctgatataggacatgaccaggtccactctggcatatttgaatggtcggagcgtattgacctgaagctgtgaatatcatgatctctttaagctgtcctgtcagcttatgtgaatccaatactttgaaagagagatcatcatcaattcatcatcatcgtcatcatcatgatgctcaactcacaaagaagcctgagaatgatactttggtgcgaaattctcaatacctctttaatattcttattgaatgtaaattatacaatcctatctaatgtttgaacgataacacaaaacttgctgcgccatgtttgtttgtcttgtcaaaagcatcaatttgtgggttatacgtagtgtagaggatgattcaaatttgtgataaatttggtaatcaaagttaattctgaaaatgcaacaccacatgaactatgtcactaaggcctagaagatcgttatcagtaatagactaatagctcgccaccatgtatgtgaagttgggaatcgataagtcggaagagtgagagacgtggcttaacctggtccctctaaatccatacgatcgcttaatgaaatcctcggaataaaacagcagcttctcctctccaaccaaataaaatcctttaagctcccctctctctcccattctcttctcccttttctctgtttcgcggcggagaaaattgaa

SEQ ID NO: 849 - DNA, 3000 bp, Unknown
  misc_feature (1)..( 3000): cDNA_ID_3059262_gDNA_ID_1620328_Annot_ID_153571 3000 nt of promoter + ATG
aattctgtaacatggttcaaattgtttacttgctcaacaaatgctacggctgactgtagaaatgcctgccacccatatagatccacgataacattaaagtcgattctatgacgccttaccaagttaaatgcatctttgaaccgttgctgagctaacgcattcgtaatggaagagaggaccagctttctgggatatatgcattcgagattcccccgcatagtttgtaatatcacagcagcttcatctccattgaggactcctatcacttttgcacctctttcccaaatattaacatagctcatattttcctcgtctcgccttctaccatcaataacaaagaacacatttccaagtgccacatctccattcagtacatccttggtatcgacaataaagagaaaatcctgtttggtcaaaataatcagatgggtaactacttcattggccaactctgaataaaatgagaaactgctacagttattacataggttcttcccgttgatggacagtctacccatatcatcaagcccacatatcaagggtttatgcaccccactagcatcaacctgtgccaccctcacccaaggacaagtcgatggaaaacatacactatcatcactactacgagtttccataatttctgaccttgacgcatatccaagcactttcccaccctcaaactccacaaaggctgaatcacgcttactaggattccaggcaagagccaggaccggtgattcgagaagtgtctggaaagtaatgctagccttaaagccagagcaagtcacttgatcaggaacatgatcctcatgacagactacttcaacttcttgtaaataagaaccatgaagctctgtgtcataccctcccgaagagagacacttgttgtggctagaaccataagcggagacacacagaagtgagtggacatccaaccatagaagatgtacaaaagagcccagtgctgttttacagtctgaaatttccacactgaagtctttgccttcgagatcttcccaagtattaggtgcagggaactcaacaaaagacaggtttccatctgacaaaaacacagccagacaattcttagaattccttgagtaatatgctatatctctgacagcagaagaaaaactaaggctgaacaaatacataggaggtggcatcaaggacaaagatagtggtgtcacgagtatcttggagttatctatgacaaaggctgttgagtcctccatgaccgctgttacccacataaagtggcgaacagacacctgccctgacagagtccaacatattaactgcagtggctttgttggatcccacatgactgttaccccagcttcccttggatacctaatctcctgtttcaggtaccagtggttgttgctaaagaaccacaccctaatggcatcatatgttttacaactaacaacccctgcaagaagatctgatgcagaattccatttcagattttcacatgattccgtagcatcttctggttcaccaattctaaacgagcttctctcaagtccattcctctcaaagaaagcaatcgatggactgctatcatctgacttcctcttataaacagctgcgattttagcaccactcggcatccattcaagaatcccctgcgtaaattcttttgtttctgaagaagactgcaaagcaccggaatcactttcccatatcttaatcttcttagacatacaaccagactcataaacctcacccatagtcgcaaaatactttccatcacccctccaggaaatggaaatacccccacaatttacagacaaatcattcgtttcacctaaaacagtatttaattcagatggttagcaaataaacaaaagctgttcacgataagtttcaactcaaacccataaatttaacccttatgcagtcaatatgacaagaaggtaaggggtccttacgtacgtaaccaccttcaggaacctctccaagcgccttctcgtacatcaaagcccaatcataagtcattacaagcaactgcccaagaccagtaatcaatccaagtagatctccagtcggattaggcgagatacacttgacacctccttctatatttccaactagctcagtcacatcactctccacattatgcactagcaaaagcccatgagaagtcccaattaatagagactccttctccgcgagataatcgaaagccgtgatgaaatccccaggctcaatatcaatactgcagacctccacaggcatagcactctttgccccagcgctttcattctgccacaagaaatacataaacataaagagaaagactttcgatttaaacagaccctactcgctaagttcacttgcaagttcatccacaagaaacttgaatcaaaagcaaaataaaaagaaaaatccatctttagaccaaagtccccaacttttttctcactcgtttccttattaagcagaaacaggattaaccaaggaggaaacgaattctctcacagaaagcaattcacttacttggaaggaagagagctgaagggcgtaaacgaaattagcagaagatgcgaaaaataagcgactttggtcgatgtcataagctgcgaactgtacaacttcttcagtcgaatgcaattggatgttctgaggaacctccgagaaaagcttcaaatttttcattttcgaagaagtaagaatcagtacaacatcaacgaactttgcagctacagatccaggaagcagatttaaaccccagaaatcactgatataataatatttagggtttaacctaaaacacgccttcttctctgtttttcttttcttctctgtttcctctctttcgttttgctataaacttgaaaaactgacccggtttattttaccacaccggttatcttggtttataccggtttagtttgtaagaaatataatattattatccggccactttcttcagagatcagttttctatgcctttccttgctgattctctcactagtgaggaaaagcatcatc

SEQ ID NO: 850 - DNA, 3000 bp, Unknown
  misc_feature (1)..( 3000): cDNA_ID_2127027_gDNA_ID_1620328_Annot_ID_153570 3000 nt of promoter + ATG
gactcaggcataagaaggaaactgagacaacaatataccagatataaggagttccataaaattgggcggacttgttccatatcggtttgacttcagcatataggtcaagaactatcattttgccaaagggaactgaatgtaagagtgcctgcagaaagcaagcgaggctgtgatattgaatcaatcagcattcatcatatacactaaattggatgtttactttcaactgaggcggcttccagaatttggagtctgaactaaaaagccaaccctgcaaaaaggtgagtctcaagtaagaaaacattcataaatagagaaatctctgccccgtcattctagattgttgttacttcaatactaaaatctgtgtctgtgtgtttacagttttctaaagtctaaaaagcatcctaaagtacatacgccactgagaataaaatggaaaagaaggcatacttgcattaaccatacagcattcttgtttccttttgacatagctttgtacactgcagctcctagtgaagatatatattcaggttcacttgtgggaggagtattctcattgaatgtatcactgcattaacacaagtaagattcgtatcatcattccaaacaaagagagttgatttttcttgaatcgtgcatttttgcggaaggttgttttcaccaatacctgcgtccaggatactggaaaaacttgtaagaaataatttacctcttaagtgcaaattgaagataattaccagttatatatgtttgtaatctctccatattctgagacagtaacaaggtaaaatcaaagacatataaacgtgtaattatatcgaaaagactgtgatcaggtgggagctttgttagtatgtatctaatttgagaaaatgctttcaatggatcacacaatttgccaagattaaaaaaaaagaaatagcttcagggtaccttcagtttgttgtttaataaaagcctctccaatttcaatgaagagagggtcagagggattcagaaggtaagtgcagcaccagcgagaatcaccatccaccgtgttcctgagaatacacaaatggtaacggtaaggttattgtcaatgtgaagacaaggcagtaaaaaaatagcatttttttctcatcacacaactcaaaaagtttcatccattggattgaaaaaagtttccggacatgatttacggaaggaacacataccagttatcaagtcgagttatatttgcctcaggatatatctttctcaaagctgatggaacattgcctgagaatgatgggagtactaggaaaggaggaaacaaaagaaaatataagatgctatgagaacaatcaatcgagtatatgaaaagagaagaaagtgattgttcttggacctggagtcatgccaaacttcaacatccgagaaagtatctgtttctgcaaaagcaactggtcatctaaccagtttttcgataatggaccaccccaactgtgatgtagatgtagttagagatatgaattatgtgagcttcaagaatgaaagataaatcaagctcagaaggagcactggagataggagcctgaaaatatcagagatcaggttatttacgcgtgaagatttcccatgcgagcccaagcaagaaacgctggtccaccaaaataatcatccagatcttctttgctgatattgaacctctaaacaaaattgatatagaacttggttagcggtatatatcaacttatattaaataaaaaagttgcaatatctaatcatgtcacagcaaacaattactaatgcaatctgactttttaccttgaaaaccttttgccaaatagcttcttgtccagtgaatgctagaggcaggttaattccttgcaatgccatccagtcaatctctctctcccatctctcccatccccaccaaacatatgaatctggaaaaaacaagaaagcaggcagtagcaggagtgtgattctagtgaatcatgacatgaggaaacttttgattccaagaagtgtatatatcttacagctagatgtaacaacattttggtaatagttccaagggacaggacgccggataaagatgcgtttagaatctatacgaggtagatgtccaggttgtggaacagaggcaacctgaattccaccagttttgtcccaagaaacatgagcattacatttatacttcaaataccaatggagcccagaagcaatctcaactccagttgtgcctttaatcctgagacacaagatggcaaaactaaaagagaagaattttaagtaaaattcgatccctcatcaggaaatcagaagatacttacagaatttcaggtccaattcgtcccgggccatcatagttttcaattacaaagcagctggtaccaccacaagcatcctattgtaacaaaaaacaatcagtactgaagaatcacctagcatagtggggcctaaggaaataaaaggaagaacctttgagataattctgagctcaaagctctgagaatgggtgggaagcagtctctgcaataaaccctttgctgctgattcttgtacagaagaagttggtaataaagaatccaaacggtcaagcagaccatcaatagttggatgatgttttgacacagtttgagagtgaaaagaaattatcaacaaaaccaacaaaaccaatttgatggaatgcatgatgatgcttttcctcactagtgagagaatcagcaaggaaaggcatagaaaactgatctctgaagaaagtggccggataataatattatatttcttacaaactaaaccggtataaaccaagataaccggtgtggtaaaataaaccgggtcagtttttcaagtttatagcaaaacgaaagagaggaaacagagaagaaaagaaaaacagagaagaaggcgtgttttaggttaaaccctaaatattattatatcagtgatttctggggtttaaatctgcttcctggatctgtagctgcaaagttcgttgatgttgtactgattcttacttcttcgaaaatg

SEQ ID NO: 851 - DNA, 3000 bp, Unknown
  misc_feature (1)..( 3000): cDNA_ID_2127039_gDNA_ID_1620328_Annot_ID_153575 3000 nt of promoter + ATG
acacaacaagctaaaacgatgtattcactaattacttcacttcccagaacaacattgcattttatttttctatgtaacaatagaagatgacttggttcacatatagttaacatctatatatggtagcaactatacaatgtaacacatattcatctcaaactgtaagaattggaggctcaccggcaatttgacaagtctagatttatgcgctatagcccttaagatggcctgtttgatccaccagtagacataagttgatagtttgtatcctcggtcgggatcaaatctctcagctccacgaagcagccctatgcttccttcctgaataaggtcttgcaaattcaaacctttgccttggtaccctgttgcaatagaaacaaccaacctacggtaacaacgagtaatcttttctctcgcttcttttctacggcatagtatttcatttgcactacgcttcttcttccctctgccactggctaacaaaactgataccatttcattctcttcaacacttgttcccaaattttcaagttttgctccttcctattaattaccagcaaaggtattattaccaacaaggatacacaatgtttgaatctttccattaatgggccatgagagatattggataagaaagaaatgatataccttgaggtacaagcaaagctgaacctcctctaaacgactcaaaaacccagatcgtgaagctccaacaacaggaacactaattgtctctgcttctgcttctacgccagcattttcctcttcttcaggctccaaacgttcgtaacctactcttcttcttcttctcctcttccttctcttttctgactgaattccccatttctcaggtttgatcatcacggagctatcaaccactctatccactgtagtgtcaccgcaaaccagagccgtactaagctttatagaaaatggggatgataaagaaggagatggttgacattggtgagtcgttctgagtaagggagagattgtagggacaggaggagacggacacatagttgcggtagctgtagtgggaatcgtcgtcgccatggatggatgagctgcagagcttcccacaccttagatttttctatttttgttatctatcttctttttggtccaataaaaatggaagaagaagataattctctcttgtgttacttacttatatcatagagcctctctctgtgtcatatcagttatccgcaattaaatttgggtggagttgctttctttttttgtaattaaaaaaaaaaaaaaatcttttcgatatgcaacaattttggaaaaggaaaccaaaaatgagaaattacagcttataaatgttttcggattgcagtatatacaaacccaaagctccatagttttcggacccttaattattaatgcaaacccaaaattcgagtggtttcggacccataaaaaggcccaataaaattggattcctagtaaattgacgcatatgatgtcacatgtacagtgatggctgaacgagagataatggaccaagtgtcacggtctagaccccacgtgcttgagggtgggagcaacgcgctgttccaaagcttgtctgtggtgaacacgcgtacctctctgaatcctcgtgatcttacggtgggctccactaatttcgctgacgtggaattgtccacacacagtactcttcttggcactgtacgctcaacacaagaggagtcaattatgccaccactaactatatattaagattagactttaacaacaaaaaacctatttaaaattagatttttatatggaattagtaaaagcagtatattcgtacgagttccaaagcactcagagcctcaaccattggacgtcattcatagatgtacgaattaataatcattgtctttagaaatagtctgtaaagccgtctagatggtaagtgtttgagtcaatcgtttttgtagacggtttcatacgaaaatgtaattcaaaaagctgttttgtaaaaagattatggattaagtttggacgtagtttaattagacgtgtaaagtatacgaatacgcaaaactaatgatagagaatcaaaggtaaaacacattttgattccgaagcgggaatcaatccacctttatccatacgcatatgaataacaaagtctatcttcttttttgttctgatgatttaaagtttcaatactattttgttttttggatcaaaatattttttaattcactttttaaacaataaagtcttttttgggtatatagtattcttaaagtatctgctgctttaattttggtgatgcatctgtacctaacaagacaaatgaataattgttgatataatttcattaaaatagacacacgtgaagcaattggatttgctaaatgagataaccattccaagtcttaaaagatagatcactagacaacattgtttagtccttattctattctctccccactttcaaatcaattgtctctttcttcctgtatgcattatcccatgtgccctcaaaaaacattcctcctaagattgattagtctctcggactatacaattaatatcttaaataccagtttttaattacaaattactttctcactaactaaactttgaatcttttttaaaaaaaatatgtaaccacatttggatggattggtgaaaaacaaaattgcgggtggaggaggtccgtgaacatgtgacgagattaaaatgacacttgggtgaccacctttttggccctctttagctccaaggctatatatatatatatgcatacatccatccatttgtacatatatacgtgactcatcgtctttttcactcccacacgttctgctccagcgatactgtgagagaatctctgtgtggtactctttcatttttcctttcccattttcaaatattccgttacgatttcgaatatttcccccattgattatttcctttaattctcacgcttattagcttaatattggaatttttaggttctgaattcttaggctggaattgaattctgaa

SEQ ID NO: 852 - DNA, 3000 bp, Unknown
  misc_feature (1)..( 3000): cDNA_ID_2990406_gDNA_ID_1620328_Annot_ID_153574 3000 nt of promoter + ATG
ataataagataggagaagatgcaactgacaatctggtgtgcagaacaaaaacataaaccaagagtaatagcggtaacaaagaagccaccttcattgttccaagcaaacagttgaaactcccaagaagaaaccttgtgccaattgccatccaaaaatttgagctcaagccaaaaagagcgttgaaaattgcactgcagtaaactacctaatcagcatctagagacgaagatggatacaaatcaaaatcatgtttaatgatactaacattgagatagttcccaagagtataatgggttttcttccataacgatcagccacaattccccagaacacagaagtcagtgctcttccaagcataaaagagcaaccttccaagtaataagagatatcattagaacaaacggtatagatatggagattcactacagaataacaagtgacagaggcaaatgtcttatcagttctcaccaacaaaaccagcataaaacccaatatctttctccgtctttgcgacaccaaaatcctcaatctatgaaaacaaagaagacatgtcagacttactattaagagcctgtgacaaaagaacagtacagtactcgatcaaaaactcaccatatagtagaggaagggatagagtgaggaaattggtagagctgcaaacacatgatatcaaataagaacgtatgaggaatcgcataacgaatcattactttcaacacaagaagccaatttcaaaacatttagcagtaaaaccattaagcaaatcaatttccggaatctcgtcaaagtagttgacaatgacgaatagtcaaaaacaacactatagccgaatccgattgacaccaaaaatctcaaggaaaattgacacaatagtaactgttatgagaaggcgaagaaggtgttacaagtggagaggacgataatccaaacgaaggaaagctcgaggtaaggatatcctcgccggagctgcttcatctgctccaccttacagccgggacatccgtcgtgatagttctgcttctccaacaacgcttccttgtactcctccgccatttcagaattcaattccagcctaagaattcagaacctaaaaattccaatattaagctaataagcgtgagaattaaaggaaataatcaatgggggaaatattcgaaatcgtaacggaatatttgaaaatgggaaaggaaaaatgaaagagtaccacacagagattctctcacagtatcgctggagcagaacgtgtgggagtgaaaaagacgatgagtcacgtatatatgtacaaatggatggatgtatgcatatatatatatatagccttggagctaaagagggccaaaaaggtggtcacccaagtgtcattttaatctcgtcacatgttcacggacctcctccacccgcaattttgtttttcaccaatccatccaaatgtggttacatattttttttaaaaaagattcaaagtttagttagtgagaaagtaatttgtaattaaaaactggtatttaagatattaattgtatagtccgagagactaatcaatcttaggaggaatgttttttgagggcacatgggataatgcatacaggaagaaagagacaattgatttgaaagtggggagagaatagaataaggactaaacaatgttgtctagtgatctatcttttaagacttggaatggttatctcatttagcaaatccaattgcttcacgtgtgtctattttaatgaaattatatcaacaattattcatttgtcttgttaggtacagatgcatcaccaaaattaaagcagcagatactttaagaatactatatacccaaaaaagactttattgtttaaaaagtgaattaaaaaatattttgatccaaaaaacaaaatagtattgaaactttaaatcatcagaacaaaaaagaagatagactttgttattcatatgcgtatggataaaggtggattgattcccgcttcggaatcaaaatgtgttttacctttgattctctatcattagttttgcgtattcgtatactttacacgtctaattaaactacgtccaaacttaatccataatctttttacaaaacagctttttgaattacattttcgtatgaaaccgtctacaaaaacgattgactcaaacacttaccatctagacggctttacagactatttctaaagacaatgattattaattcgtacatctatgaatgacgtccaatggttgaggctctgagtgctttggaactcgtacgaatatactgcttttactaattccatataaaaatctaattttaaataggttttttgttgttaaagtctaatcttaatatatagttagtggtggcataattgactcctcttgtgttgagcgtacagtgccaagaagagtactgtgtgtggacaattccacgtcagcgaaattagtggagcccaccgtaagatcacgaggattcagagaggtacgcgtgttcaccacagacaagctttggaacagcgcgttgctcccaccctcaagcacgtggggtctagaccgtgacacttggtccattatctctcgttcagccatcactgtacatgtgacatcatatgcgtcaatttactaggaatccaattttattgggcctttttatgggtccgaaaccactcgaattttgggtttgcattaataattaagggtccgaaaactatggagctttgggtttgtatatactgcaatccgaaaacatttataagctgtaatttctcatttttggtttccttttccaaaattgttgcatatcgaaaagatttttttttttttttaattacaaaaaaagaaagcaactccacccaaatttaattgcggataactgatatgacacagagagaggctctatgatataagtaagtaacacaagagagaattatcttcttcttccatttttattggaccaaaaagaagatagataacaaaaatagaaaaatctaaggtgtgggaagctctgcagctcatccatccatg

SEQ ID NO: 853 - DNA, 3000 bp, Unknown
  misc_feature (1)..( 3000): cDNA_ID_2106965_gDNA_ID_1620328_Annot_ID_153573 3000 nt of promoter + ATG
aattttacgtaccgcatcaggtgcatggcaagttgcttctattgcataaactgcatcgaaactgttttccgggaatggcatcttcatgaagtcagcctgcaagattaacaagtgacagcaaccttcatcatgttgtcctttgcaaggtgttttcttattcaaaacatgatttatagcttatgcaataattacaagaactatgtactcaactgaccttgacaaagttacatgtcttgtcgacacctgcaagtcggtttagttcctgcaaagagaaagatgccaatatgaattataatggacatagcaggaatgcatcatctttcacaaatgtagatacgttaccttgcctctggtgatctggtattcgttattgttgagcccggtaacaactgaattgctgcaacagagcaaacacaaacacacttcataattgaacaactatgttcctaaccataaaatctatttcaaaactcatgtatagtagaagcacatgatgaaaagagtgtgtgtgcgcttttggtatgtgtagtcattttacctgaatcttgcaatttccctcaacggtccaccaattccacatcctacatccagtacctactcagaaacataatggcaatgagcatctgatggcgatggcgaagggtccattttcaagtgttcggttaaggtttaacaaaccttttgtcctggttggatgccaagctgaagagcaagaaagtgctcgtgtcgcttaatactctctcgaagcgattctcctttccatctacaaacccaaaattcatgtcaatcaatacatatataactatagtatcagtagcatctatggctgtaagaaagaaagtatattgaaagtcaagaattacctttgtgcaaaatggaaggattctccccatccgtactcataaaagctagtagcaaggtcatagtacttattaacctgaaaatttaatcaggaaatactcattccaacaggcaatgatttgttaaagaaattcaatacctagcctagtgaagtagtactttaactattttaaatatgatctcctggaacaatataggcttttttagttgtcgcatattctcaaagtcaggagacacaactacaaggaacaggcgtgtctcaaggtggtgaaaattttataaaatgtaaaaaaaaaaaaaaaaaaaacatttttgaatttaccatgtcagtataattggcttttctctcttcctcgtttcctccatggaagacatgatattgctcatacctgaatcaccaaatcactaaaaattaataatgtccaggacaaaaaaaaaagtccaccaaataacattttttttttttttttaattcatagaactctgaaaaactttggccaaaaaaaacaaaccaattgttctatatagatagatagatgaagtcaatgacaataagattggtggtcgggccctcaagaacgtgacagtagtgaaatacacgtcaaatggatcttttatagagccaaaaacgaaactagggaccatctctcactcatcatttttcttttttctgctgtattgaaagctcagttccatgaagcattaaaaaccaaaacaaacataaaaacagaggcgaaatccaatgccatcatggtattcgtggaattggtaaaaagcgtaaacgtatggaaatagtaggctcaaaatatacgttgattccaaaaatatggagatgctacacaaaacaacaatcaaatcttaatcttaggagttgattatagataaaaaccaacgagatcaatatgcatgagacgaaaaaagcgaattgtaagtgaatcggagatggaaactacgatcaaagaagaagggagaagaaattacttttcgacggcggtgagaacatcggatttatcgatcttcccaccaagattcgacgcgagatccatagcacttatgcaacaacggacgagatctgcaaaaagtgagactgaatcagaataaggatcaaggagaaaagagaaatcggaatcggaacacacattggaggagacttacgagagagaggataaagatgaatcggagtggtggggaagagctaaagaggcacctgactggctttagtttataactagtaagatagagaggtcacaagccgtcaatcccagcttggcaatgagagtgtattaccattatatcctctctacttgtccaaattaattatgaaataattagagcctatataactctactctctagtgttaagcatattctccactatctcgtaatttattctagtataaaataaaacctttactatagaatctcaccacctaccaagaacaggcgcgacattcgagtggttaattggttttaaatctagatcaaagattgaatctacctactacttccttgatcttctgtttttgccatcctgattcctgaatgtttttaagtgtttgtagcaagaatatttgactttctactaactccaaacctggtttaaaattttgtgaaatattcaatggtttcaagagaaaaaaaaacttagaatttttttactagtccactacttcactcctactttaatctctaaactccaaattctgattcttaactcatactgtatggtctgtatatgtttatagtttatacacatgggtatctcaggaacaattgctatttttatttttatcaatattatcggatttgattacatgtaaaacacaacaacaatagttagtctatgtcaacaatagttaattagaaaatgactaatctacctatcatttaattaaaaagttatagattacgttgtgattaactagagtagtactaatagttagtctatgtcatgattaacgtaggaaactaggaattgaccgtttgggttaaaattccaaaggaaaaaccaacttcaaccacacaccacatatttctctcccgcctaatcctccgcgttcccaagccgacgcgccgatctttcttctactacttgtcctccggcaataacaaactaaccatttcgaaaagtaattatct

SEQ ID NO: 854 - DNA, 3000 bp, Unknown
  misc_feature (1)..( 3000): cDNA_ID_3059258_gDNA_ID_1620328_Annot_ID_153572 3000 nt of promoter + ATG
tccttgttggtaataatacctttgctggtaattaataggaaggagcaaaacttgaaaatttgggaacaagtgttgaagagaatgaaatggtatcagttttgttagccagtggcagagggaagaagaagcgtagtgcaaatgaaatactatgccgtagaaaagaagcgagagaaaagattactcgttgttaccgtaggttggttgtttctattgcaacagggtaccaaggcaaaggtttgaatttgcaagaccttattcaggaaggaagcatagggctgcttcgtggagctgagagatttgatcccgaccgaggatacaaactatcaacttatgtctactggtggatcaaacaggccatcttaagggctatagcgcataaatctagacttgtcaaattgccggtgagcctccaattcttacagtttgagatgaatatgtgttacattgtatagttgctaccatatatagatgttaactatatgtgaaccaagtcatcttctattgttacatagaaaaataaaatgcaatgttgttctgggaagtgaagtaattagtgaatacatcgttttagcttgttgtgtgtagggaagcatgtgggagttaacggcaaaagttgcagaagctagtaatgtgttgaccagaaaactaagaaggcaaccaagctgtgaagagattgcagagcacctaaacctcaatgtatccgcggttagactagctgtggagcgtagcagatcccctgtttcgttggaccgagtcgcgtctcaaaatggccgcatgacattgcaggtacttgagttttccatgaaaatagaaagctaagagagactttggactgatttatcatgttcaggaaattgtacggggaccagatgaaacaaggccagaggagatggtgaaaagggaacacatgaagcatgagattgagcaactcttaggaagtcttaccgctagagaatctcgtgtattgggactttactttgggctcaacggagagactcctatgtcgtttgaagagataggtaagtcgctgaagctttcgagagagagggtgagacaaatcaatggcattgctttgaagaagctacggaatgtacataatgtgaatgatttgaaaatatactattcctctagtgaataaaaagcaaataaattggttcttcataatcattaatagcaaattaaacaaaaaaacagagtaaacacatatattggatatattgggtctgtacataatatgggttcatgtctctcctttgtggagattatggaggatatacagagaagcagaggacaagaagatgcaaacggaataactaagcaaatctagaccggtggcgatagtaaccatcttgcttctctcgaacatcttcactagcagaatcataacaatgacatgtcccactttggttttaagctcatcaagtgagctgatcttcatccattttggtctctccttcattgcaaacataccaaagagggaagaggatctaagggcacgatcggattccggtggaacatcatgaggcgagtgactgatgaagagtccatacaaacccatactaaatattaacatcacagtcccagctagataaacatctgcaatcaaatttcacacacaagtatatatgagtattataactaaacaaacaggcttatatcataatcatatatatagcaaattagttttaccgatagcttcgactaggcgtaaaaccatttggccggtatggatgccttttgaacagttagtccagtagactttatatgcctccactatgtagacacacccctacacaatgagccatgagattagtactaaaatggtgtatgcgtggcaaaacatttcagactaaaactagaccacaagttagttacattgagaaagcagagtagcgaaccagccagcgaacctcctactgccaaaagcgctaggaaccggaaatcaaatattatctgctccatccaccaagaaaccagatatcagaacaaatattctaaagtctcaaaatcaatatatagaagaagaaagagacaaacaggcttgattgatattaccctctcaacgttggattcggtggagcgaaagaactgagcaaacgggctgtcgtctttgcgagttccgtaagaactaggtaacgtgtttccgttgacgggaatcgaggtaggaatcgatgatgatgcggatgactctggaggcgatgagtcaagagttgctaacggcaagtggaaacggcggcgcgtgggtaacacgagatatctcggcaccgaaagggagagcggagtggctgagatcaacgaggagagagccatagataattacttttcgaaatggttagtttgttattgccggaggacaagtagtagaagaaagatcggcgcgtcggcttgggaacgcggaggattaggcgggagagaaatatgtggtgtgtggttgaagttggtttttcctttggaattttaacccaaacggtcaattcctagtttcctacgttaatcatgacatagactaactattagtactactctagttaatcacaacgtaatctataactttttaattaaatgataggtagattagtcattttctaattaactattgttgacatagactaactattgttgttgtgttttacatgtaatcaaatccgataatattgataaaaataaaaatagcaattgttcctgagatacccatgtgtataaactataaacatatacagaccatacagtatgagttaagaatcagaatttggagtttagagattaaagtaggagtgaagtagtggactagtaaaaaaattctaagtttttttttctcttgaaaccattgaatatttcacaaaattttaaaccaggtttggagttagtagaaagtcaaatattcttgctacaaacacttaaaaacattcaggaatcaggatggcaaaaacagaagatcaaggaagtagtaggtagattcaatctttgatctagatttaaaaccaattaaccactcgaatg

SEQ ID NO: 855 - DNA, 3000 bp, Unknown
  misc_feature (1)..( 3000): cDNA_ID_2127019_gDNA_ID_1620328_Annot_ID_153567 3000 nt of promoter + ATG
gaatcgctctgatgcagagttgctccactctcttgtggagagcatgtgacttccctgcagcaattggtaaaccacctccataagaaaacattcccactcttgcgtaatgacaatcatgaaaaatgcaatatggtcataagtggactaacctgttctagggtcacgaccagcgaaaacgattggctccatcgctccatcaagctcagggagggcaacctgcagagccacctggatgggatgcagaccaagtgtgctgtttagccattcctctgtcgtctggaacaccagtggtactgccacaaggtaaggaacatcgagctttttcagggcttcgatagccctgggatgatcctgccttgcaggtccaccaacaagagcaaaaccagtcaaggagacagcagagtttacgatgggctgtttcgacaccgggtctacgaaatatttctctactggaccagagaaatccaaccctcctgcgaatataggaacgaccttagcacctctagcctcaagctccatgataacagccacatagtgactatcatcaccagtcacaatgtgactcctctgcaagactaaaccgacaaccgttgcatctttcctcttgagtgagtcattggtgtcccttctagtgtcataccagttccagtactccttcacatcatcgtacatggttggagcaagtggatgccaaattccagtatccaagaacaaaaccggatccgaatactcgattttgacacctttcaaagccggaacataagatccagaaatcatcttaacaaaattctgaagattatcaggagagcctccaagccaaaactgtaaactcaagatgtagagacgagcatcttgagccttgtcactaggtaagtacttcaaaaccttaggcaaagtcctaacaagcttcaacatactatcggcaaaaccagcagagccttgtttcttcctcttgaagagttggaaaaacggagactttgactgacccaattgagacatactaaaagatccaagcttgttcagtctcattacctcaggcattgaagggaagacaagaactgcgtccatcctgtctctctccttctccaccgcatccttaactttaatcgccaattcctcgacgaagatcagagaaccaatgaagatgttggcgtctttaaggtcttcgcagaagttgttgtaagtgttcttgtctctaagctcctcgaccaagtatccaaccacttcgtaggatgcgaatctcgaagtcttgttgagagattgcacggcttcactgagagaagactggtactgagcctcgaggacgacgtagacgattttcaccgtcggaacgttgtctctcttgatcggaactatacgacggacctccgggttcgtctgtgtgaagaggccgtttccagatacagcagatttcaccttgaagaaagatttggctggtttggttgatctgtgtttcttccggaggaaagaatgtttggtactgttagtgagcgaagagagatgctctgctttagaagtggatagagtgaatggagaatacacaagcgaagccattttgcggctgctggattctccaaacgttgaattcgaagaggagaggataggagaagagatgaatcgttttttgttggttgtctcttacactttttgagctccaagtgggagtttatgattctctcatcggtaaacgcttcggaccaaggaactaaaaaagaagcgttggttttgaaggtaagtggtgagagggaaggacacgtggacgaatagttacggaagaagggagagtctacttgtgaggttgagttttgtcggatgtatatccgcttgggacaatgagatggactttgctggcctctgattggctcattgagatttctattcatattttcatggtttgggagtgtggatattgagtgtcttattttctttacttatttgacaagtatttttatgttgctctcttgaagatcgtatttgcggtttcagccatgtaaaagattcttttccgatgacgacacttttactaggcatattcgtcgggtagccggtttaatccggtctagattttgtataatttttggttcagctaggtctggtttgatatttttctacttatttcttaaaaactggctttaatcttttaaggtaaactcaggatttttctttgaaaacgaaatttgaaatatcagactcataacaattgtaacaacaaatgtaaaagttaaaacactctaaaatgtactcaaaattttgatcatcatcatcactattttttttataataaatggatgtaaaaacttatcatgtttcaatatttaaaacttttttttttttcaatatttaaaacttacataaaatatataattaaaagaaagtttatgaattagaatattaagttatatgtaattaaatggagcaatacatgtagcctactagtattgttgttgcatgagttgcatcatattcgaagatatacaatatgtttttttgatataagagtaccgcttcattctcttttttttttttgtcatttcccaagtgtaatattgttattaatacatgggctatactaaaagccccacgaaaagtttactgaactatttgaggcccaacaagagcctatcggattaacgcctactgcagaagaaaatctgtctgcactccacccaagaaaacgcagactaattaatgaaatcaacgaaacggataggtcgggtctaaggttgaccatgaaccgcaacctgaaccaggagcaaagtggtcaagttttgccatccggtccgagtcccttggaggaataataccagaacagaaaaaaacagaaaagtcgacaataaacaaaagagacaaatttgatttgattggttccagaaattcgcagagaaacagctctttgtctctctcgactgatctaacaatccctaatctgtgttctaaattcctggacgagatttgacaaagtccgtatagcttaacctggtttaatttcaagtgacagat

SEQ ID NO: 856 - DNA, 3000 bp, Unknown
  misc_feature (1)..( 3000): cDNA_ID_2126991_gDNA_ID_1620328_Annot_ID_153559 3000 nt of promoter + ATG
aaatcagaagcttcagcatcaattctgaaaacatgaattcaatcaacagtgaggcaagatgagtagtgccctatgactcattattcattaataaagagaaacaagagcaaaaagcacatcattatcttcatttatcacctcagcatttcagcattaatcttcaaccctgtgatggcattttgggcaaactgaagcaattcgtcctgcttaacctgtccaaaagcagccaaagcaacacagaagaatagaaaagttaggaggagatccaaacgcccataaattaacatatgctgacttttttactgatcaagcgcttaccaaaacttcatccttgtaacttgaaaagactgtagcaagatcctgcatactgctaactatggcatcatgaacttcctttcctccattcaaacaaaggctgaaaacaatgttaagttctatgaataattgcagtacgaatgaaaatagcaatgaattgtgttgactttccaagaaacagtttaagactccttttggaatccaaattttggcaatgcaatatggaatgccagcagactcacccaaacatctccaggagtagcgtgatttcttcgtcatgtggtggttcaataatctgtaataaaacagtcaaacctttaacccccatagacggcacatatgttttcacatcacccaaatataaaggtaaaatggtactacgtatctgttatcacttatcagatagccaccaaaagatcaaatttaggttgcaaaagaataccatggacagaacgatcccctccagagcttgactttgcagaaaaacatcacggaagttaagtggctcaccgcctatatctggatcgtaatacaaaacctacacatgcaaagggatcttcagaaagaattctgttggaaaaaggtcataaatacaacatatgaaattcgacgcagaatagtaatgcaaaagtcactgttaatgaaaaaccctttagcagaaaaagttaccctatactactacagattagcaatcttatctacttaagtaatacttttttttttatattctaaaatgcaggaggatgatatgatgacatcttcctctttctctttgacaaaaccagttaaggaacatataagattctaacgcagcaacactaaggatcacaatcatctctacttaattactagtcttgatattttacgatgtgggagaattgttaacttcttcttttcctcttatccaaaaaaaaaaaaagaataaaaataatacccattcacgtttctttgcttcatcagaagcaagttgttcctctgaactcaattgtttatcctttagagaactgtcagtagctctatcaatctccttaagcacacttagccatctagtaatcagcaatgccctttcttgacctctatatgagactgcagcttcttccaatctctgaattgtctgatgaacactcttataagccccaacaccctgcaaagttacagtccggattattcactctagtcctaaagtaatgcaactgttgtgtcataattacaactgtattgtaataaaagcccttaataccaaaatcaaaactggaatctagaaaaataagacccaaatactaattagaaatgggaataattaaaaggaaaggagaaattacaatgcggtcttggaacaatttggctccttcagcgacggcttggccagcgtgctggacgacggagtcggcatagtttttgacggttcgtgtgatgtttttgcggtttccgacctccacagccttattcacggccgttcgcagccacgacatattctcagcgatcttatggtctactagggaagaaacctcctcggggaacgaaaaccaattttagagacgactaattactgaaatgagagaactcggccaccgtccatcaaagtttttttttactcggtttaagtttgacgatttgcaggcgactaatatattatttcttttctgaaatgtagcttatttttactatgtaacgtttgtatattaaaccgatttaaataacgagtttatgtataagtattttgttaaaaatgtaaaaaaaataagatcaaaaacctaaactatttttgtgaatactataaaacctctaaaacatttaagtcgttttcttcttcacataacaaataaccataaaatgaagttaaaaaaacaatatgtgaaaaatatggaatttggtggcaaagaaatgaatagtggagttgagaaaaaaaatgatcttctaaagaattttctaactattgaaattaaacttctaattttcgtagtagattacatgatcgagaatatataccaaaaaaattgaagaaatcatagctttcatgacatgaaagatccttgatgagaattaaaattctaatttaaaattaatttaccaatgaaaaaaattaattaattagtttgtcatagttgtgaaatgcaatctcaattatagatagtaaacacaagttttttcttataataattttcttatgaagatactatataaataattaattatttttaaaaataaataatattaatttagattatatattttatagttggtaaatgttaaaataaaatcttcatatctatttttttggtaaaaaaaacaaaacatgtaaatgtttttaaacgttgcccaaaaaaaaaaaaggtaaatgttttgactaaaaaatatccaatcgaaacttgggtcggatctcggatagttttatccaccctaaacagagacggcagctcataactcaatcagccataaaggccaaagaagggcccaccttttagatacacacaatcgtcgcactctcagattcttctccggagcgatcagatttcaccgacgacggttgtttttgcctcctctttcaatcagaggaagccaaagcttagagcaacagttgtaaatctatatatagagagggagagagagagagagagctcctctcgtccagtattagggttttaaaggcaagaactactagaacaagagaaggtacaaaaaaaa

SEQ ID NO: 857 - DNA, 3000 bp, Unknown
  misc_feature (1)..( 3000): cDNA_ID_2126997_gDNA_ID_1620328_Annot_ID_153561 3000 nt of promoter + ATG
agtatttcatgtttggtattagtaaatcctctagagcagcttcgtctagctgcattccaattctcttctccagagtctcctgagtgacctgactcgcgtgcagaaccattgatgtcctaagaagcctgagcaagaattttgtcgatgtaacgcactttttgcccgggagaagttccacgatttcctcaaggagacttcgttgttcttcatgtgaatagtacatgtcatctccatagttagtcccttcctctgaaggagaaccagatttcctagaacaaccaagtaaaggaagattccgtttggcgtaatgtgtgacagatgctgctatgatacccgcatttacgcctctggattcaacagttttgatgaaccttttgtacattggtaaatctaggaacgatgatacatcgttgaaccaccagttttcgctcgtggcctttgtttgtattccgttccaatatatagtagtagtagtggttccttcaggtagtgagattggccagttgaaaaaacttgtgttgtcctctgcacaagccttcatggctaaagaaccaatgcacctagaaacaatgtgaagctcttcagcgagaggcaacacttttggttcgcatgatttctccagggccttgatggaatcttcccagtttacgaatacgtgatcgttgaggaaactctcagtgagatagatgagatttgcatctccatagttttcactcatttggagatactctgctgcacatctgagactcacagcgttttcaggtgtgacctcaattcttacaccgtaacaaaacttagctacaagcaagaatgtttcaggaccaccgggaatgtcatgaagctgagcaacacaagttgtctcagaggctttgctgaacagagtttctagatatccacttcttgacaacaaaggaaactgatgttgaaaacaagacaagttaaaaaagtgaacgtatgagtttagaaattcaaaagagttttgagtcgattagaattggtaccttatggagatggaagctttcgtctacgacttggatcataacatcgggcttaagaccagtcttgcaaagcctgatcagattacaaaaggagatgaaacgttttgttttgttagtgaatgatttaagcgattgaagaagaagaagaagactgaccatgtgtgaccactaagatgaaagacttcagatttggaacccagtttcaagctagccatctttgttctttcacttcaactctttggtttttccgcaaatctaaaagtgttgcaaaatggttgatcatcaaaaccccataaacatatgggttgataatgggaataaattaattttgggttttggttgtatcggagaagtaggggtgagaccgagtctgaagggagagatagatacagacgaagcttttgttttgtttgcaggagttagctgttactaaaattttgcaactttcgtttttccctttatttctgtaacgcctgactctctctctctctttcttcttttcttttgtaactttgtgtttacggtaaaatatctggctcattttggtaaatgactaaattcttgatattatttttcaatattccacagtaatactaataaatgtaggagatatttgactggtcaatatagtagttgctctcttaaatgtggagctagctcttttcaccaaaaaatattttattagtcaaaacccattacggaaagaattcataaggcccattatcaaaaccatggaccagagcagaaaaagtaagtgagttaattccggattagtgtgaaattaaacctaggcatactaatcggattaagccggcatgaccacacccatatatttagtccggcgacggcgcaataaagtacagtatatactcaatctttatttatttttcactttagaaataaatataatttcttaattttcaataatcataagatttaatatttattttgtttgagtcctaactaattttggatgacaaaaaaaaaaaaaaacatcataattataaaaaaaatgaatggattttgttttgagacaaggaccacaactgtttagtcagcaaaacttaaatgagaacactaaatttaaacatatagacatataaccatgtaataatgattttcaaaaattctgaaaaactacagtcttatacaaatctttattataattcgctgaatcgattttataaatccgaatatttataaataattcttgaaaaagccgtgtaaaaaaaaaaaagggtggatgagtcaaactgtgttataaagaggcaaagttgctgctgcagagttgtgtggcccttgtcaaagtttagcatctctctctttctctgtgtagccttctcttcatatatttcatatctaaactgtactttttatttaattttcctggaaactgcatcatcatcctcatcatccattatcactcaaacctctccatcactcttccttcttttggtagattcttctctctcccctaacacctttctctttcttccctaaatctggatttcttattctctttcacacttattttgtttttgtcggtagatttgcgaacctctaattctttgattactcttctctctgctctgtgagtcttacgtaactagcttcgatcttgtttttacgtattggattcaatccttttttggatactttttcagatttttctccactaaccatattactttctgatttactttttttgtaatcttatcgttgacttcatttttttcttcttgattgttcttcctttctataggggccttgttgatctctggattcactgtttacttgcgtctattagggtctagttagatagataccttgtgggatttatgtttgtttcatctgaaatccatttgaatttgaattcttcttttgcctttttctctgctttataatgatattgatcttgtaggtgtgttagttggagttagcctgtaaaaaggtacaagagtgaagttttgatttttattaggaccctcgaagttcaactatg

SEQ ID NO: 858 - DNA, 3000 bp, Unknown
  misc_feature (1)..( 3000): cDNA_ID_2127013_gDNA_ID_1620328_Annot_ID_153565 3000 nt of promoter + ATG
atgaagaaagaaacgtaacatggaacagaataatagaaagaacgatgagaaaagaacctctgtgttctgaaacgaaagccgccagtcatatgcagccatgtacatatttttctcttcatatccaatatgtgcaaggttagcaatcagcactgcccagacaaagtagccaggagcaaagtagtcagcagccacgagtcctgatacagctcgaactctaataccagctggatccaacccagtttcattgtcaagtgacatgtgttccacccaacatagaggcctgaatcaaagagataattgattagttaagatactatcaactataccactgttaccatcaacaataacattgcccatctctaccatagcaaaaacatgaacactgagccgaaagaagaagatgcagatcgtaacaaagatgcaacccacaaaacactttttttttaatatatccatagcagggtcgggaggagttcaaagctggataacagaacgaggatggacgaaattcaagacatgtgaataaactcgatgtgaaactttgaaattgagaaaaaaattgagaaaagcacattgagctgaaagatcaaaaaggaactagctttaattacacatatacatagttgaataataaagcaacagtcctctatcacagcctgaacacactttccacagatgtagttagaacttctctattcccaacaaaacataaaacactacttcattatacgctacacaaagctaaatctacacgcaacgacagtaaaggaagtaacttgttatgaacggactctagggcatgtctagcaacagatttggcaataagatgacttgaaattccaaggcagctattttatatcctaaagttaacaatcaaacagaaatagtccaagccaattacgtccttggaacgcttaccttacacatacagaaatagtctcttaagaaaatagcgtttcacatcaaaaaaaaaaaaaagtaaagagtaagacagacaaacatggaattaaagtttgagtgatgttgaagaagcaacaagtgcgtgatctcatcagatccaatccaaatcccaatataaaggaagagtgagaattgttgagctcaccttttgtagacttcaccaaaagttccaccccacaaacgttttctaaataaaccatcagcgcattgtttgccttcccaaagctcgagcccaccggtgacaatcccaggaatgaagacaacaggatgtttcgccttaagaccttcttttttgagcttaacaccgggcgggtcaggcaaaggacccgtgattcgctccgttacatactgagggaagctcgcaggcattgcgttgtaaaggaagagaagaaaccaccaggttacacacacacacccaatgaaccaacaacaagaatcgatgcacgaccacttccctcctccgttcgatttcttatggtgggatttggaagattcgtgtggtttcttttgcgaatcctcatcgtgcaccacctcttcagatggcggcgtcgatggtttctccgtcggctttttccgatgaataaggggcatatctgtcacttgaaattaaaccaggttaagctatacggactttgtcaaatctcgtccaggaatttagaacacagattagggattgttagatcagtcgagagagacaaagagctgtttctctgcgaatttctggaaccaatcaaatcaaatttgtctcttttgtttattgtcgacttttctgtttttttctgttctggtattattcctccaagggactcggaccggatggcaaaacttgaccactttgctcctggttcaggttgcggttcatggtcaaccttagacccgacctatccgtttcgttgatttcattaattagtctgcgttttcttgggtggagtgcagacagattttcttctgcagtaggcgttaatccgataggctcttgttgggcctcaaatagttcagtaaacttttcgtggggcttttagtatagcccatgtattaataacaatattacacttgggaaatgacaaaaaaaaaaaagagaatgaagcggtactcttatatcaaaaaaacatattgtatatcttcgaatatgatgcaactcatgcaacaacaatactagtaggctacatgtattgctccatttaattacatataacttaatattctaattcataaactttcttttaattatatattttatgtaagttttaaatattgaaaaaaaaaaaagttttaaatattgaaacatgataagtttttacatccatttattataaaaaaaatagtgatgatgatgatcaaaattttgagtacattttagagtgttttaacttttacatttgttgttacaattgttatgagtctgatatttcaaatttcgttttcaaagaaaaatcctgagtttaccttaaaagattaaagccagtttttaagaaataagtagaaaaatatcaaaccagacctagctgaaccaaaaattatacaaaatctagaccggattaaaccggctacccgacgaatatgcctagtaaaagtgtcgtcatcggaaaagaatcttttacatggctgaaaccgcaaatacgatcttcaagagagcaacataaaaatacttgtcaaataagtaaagaaaataagacactcaatatccacactcccaaaccatgaaaatatgaatagaaatctcaatgagccaatcagaggccagcaaagtccatctcattgtcccaagcggatatacatccgacaaaactcaacctcacaagtagactctcccttcttccgtaactattcgtccacgtgtccttccctctcaccacttaccttcaaaaccaacgcttcttttttagttccttggtccgaagcgtttaccgatgagagaatcataaactcccacttggagctcaaaaagtgtaagagacaaccaacaaaaaacgattcatctcttctcctatcctctcctcttcgaattcaacgtttggagaatccagcagccgcaaaatg

SEQ ID NO: 859 - DNA, 3000 bp, Unknown
  misc_feature (1)..( 3000): cDNA_ID_2127001_gDNA_ID_1620328_Annot_ID_153562 3000 nt of promoter + ATG
tttcagtcctttaatagatagcccgattggagaaacttgagtactctctgttgcctgcctaacactctcttcaatgatttctgacttcacagtcctaaggttcactgaacacacattcccagctcttgcctctgatgtggtagctggtagagaaggagatttctcaataggaggatatgaactgaggcctagactaagtgagcatgtgggattaacatgattatcaaactgcatcaacgtcaccttaggagaactaaatcctacactttccttctgtctttcagaaacagactttgtaatagcagtcgtatcacgacaacttgatctctctatgtcacgaagacttctgttactgtttaagaatgcaccacttgtgcgatctagagcatcttcccaaacatccatggtagtattcaaatcccaattttctctgttcaggccactgttgccagatttggtagaagtagaatctgtgttatgagcgggacaaactcccttgcttaatgacaaattcagttctgtaggctcttcattcttccaatatggagaattgtttttagtgttacaacttagctgtaaggaaacagtcttagcaccagaagatgcttctgtttgacactctcctctgagagtttccttgtcacctgtcttccggactatatcatgagtcttaagaacagttttttctactttcatccgagtttgatttgaggggacaacaagaccagcatgttcagcaccaacaggaagctttcccataggaaaatggattgaactgccaagtacgttagaactagaagggatgtcaaagcctgccaatggactggagtgaattggagaacttggcttctcaaatttcactctagtttggtcaaaaactatgttcccaatgctcttccctttaccagaaattcccacaggaacagatggtaatgaagaggttggttctcgaccagtcattttctgagtttcgtcagcatgagcactcctagtatcaccttgctcattaggttgtggaatctgagtggagacagcttcttccatttgcggctgaacaaggtacttcctcttcttgattggaatatcactgcagctccatgtagatggtctgatcctaggctgaatgagacagaggaaaaacacatcaatatgggaatctcaaaaaaatgtccgaagagttaaagtggggaataaacacctcttggcttccagacatagttgaacttcgagggtcctaataaaaatcaaaacttcactcttgtacctttttacaggctaactccaactaacacacctacaagatcaatatcattataaagcagagaaaaaggcaaaagaagaattcaaattcaaatggatttcagatgaaacaaacataaatcccacaaggtatctatctaactagaccctaatagacgcaagtaaacagtgaatccagagatcaacaaggcccctatagaaaggaagaacaatcaagaagaaaaaaatgaagtcaacgataagattacaaaaaaagtaaatcagaaagtaatatggttagtggagaaaaatctgaaaaagtatccaaaaaaggattgaatccaatacgtaaaaacaagatcgaagctagttacgtaagactcacagagcagagagaagagtaatcaaagaattagaggttcgcaaatctaccgacaaaaacaaaataagtgtgaaagagaataagaaatccagatttagggaagaaagagaaaggtgttaggggagagagaagaatctaccaaaagaaggaagagtgatggagaggtttgagtgataatggatgatgaggatgatgatgcagtttccaggaaaattaaataaaaagtacagtttagatatgaaatatatgaagagaaggctacacagagaaagagagagatgctaaactttgacaagggccacacaactctgcagcagcaactttgcctctttataacacagtttgactcatccacccttttttttttttacacggctttttcaagaattatttataaatattcggatttataaaatcgattcagcgaattataataaagatttgtataagactgtagtttttcagaatttttgaaaatcattattacatggttatatgtctatatgtttaaatttagtgttctcatttaagttttgctgactaaacagttgtggtccttgtctcaaaacaaaatccattcattttttttataattatgatgtttttttttttttttgtcatccaaaattagttaggactcaaacaaaataaatattaaatcttatgattattgaaaattaagaaattatatttatttctaaagtgaaaaataaataaagattgagtatatactgtactttattgcgccgtcgccggactaaatatatgggtgtggtcatgccggcttaatccgattagtatgcctaggtttaatttcacactaatccggaattaactcacttactttttctgctctggtccatggttttgataatgggccttatgaattctttccgtaatgggttttgactaataaaatattttttggtgaaaagagctagctccacatttaagagagcaactactatattgaccagtcaaatatctcctacatttattagtattactgtggaatattgaaaaataatatcaagaatttagtcatttaccaaaatgagccagatattttaccgtaaacacaaagttacaaaagaaaagaagaaagagagagagagagtcaggcgttacagaaataaagggaaaaacgaaagttgcaaaattttagtaacagctaactcctgcaaacaaaacaaaagcttcgtctgtatctatctctcccttcagactcggtctcacccctacttctccgatacaaccaaaacccaaaattaatttattcccattatcaacccatatgtttatggggttttgatgatcaaccattttgcaacacttttagatttgcggaaaaaccaaagagttgaagtgaaagaacaaag

SEQ ID NO: 860 - DNA, 3000 bp, Unknown
  misc_feature (1)..( 3000): cDNA_ID_2126987_gDNA_ID_1620328_Annot_ID_153558 3000 nt of promoter + ATG
aagtattccacaacaaaagaagataagagactcatcatacatacacagacaagatcagatccacaagttaattgttaaatacgcacactgatttccttctttgtaagtggtgcaaaaactgtatcttctgtcaccccagcaacaatgtaaagtcgtactctttgctgcctgaaaacaaactctatatattcttctctcttgagtagctttgagacatcaaatccagtttcctctaagacctgtaatttagcatggaagaacaatacataagaagtgtgacaaaatattcagttttttttcaacattaacccatattccaagtctatacaaacaatcagaagaagaattacagcacctgaaatgctacattcaccaggagaatagcactagagagctacaattaaacctttgaccatttccataccaatgaaatagtaaaaagatacagagagcctatatagttgaccattgacagcagcactattctcatttgcaaaagattctgtctactggtgacctaagaacattttttcttcctcaattatcacgtaggagaatctattttcagtacgtaaggtgtatgtgttatgatcaaactgttaaattagtgtgaaaatgagttactctgtttcaagagcagaagatataagagacgttctatttgctattctttgacctccgtcatctatactaaaaaaaattcatgcgcacattatgttgacacattttcatatgtcaacaaccactaaagtagaaccaatgcatccactaagtgaggttaatctaacccaataagcggtcttcttctaattacatagtgttctttattaatatgcactatgatcaatgagtggcggttgttggagatatcaattttgctacaaaagtgtaaaataaatgaaacacaaaagagacaggaaacaacagaattgatactaacctcacgtatggcacaagcatggtcttcttcatccttgctcttttttccgcggggaaagctccagctcgatcctttccatcccttcaccaacaggcactgaaaatgacaatgaaacaaaaagggtaagcattaactaataagtaaacctaaatatcaccccacagggttcttaccctttcatatgtctcatccaggataattgccccagtgactggaactcgacacttgtaagaagtgaagtctttaaagatatcatcaatgtgagtaacataaggtctcaacacatcacagctgttgaatactataggccacgtcaaggaaaaatatccacagaaaacaatggaaaagacaaagagaagcccagtctatgtggcaaacacaaatcatttatgcttcgagcatatgagatcatagtcctatcattaacgagcattgtactaaacagtgaagacaagaaattgaacacagaataatgaatcagaaggcaatgaaggatacagagcgaagtaaactctttcaaagacagggacttaagctttggatcattctctacagcattatcttcatagtaccaataagcatactccaccagaaacaaaattctctcgaatgactgttgatcttcttcagggacattcaaaacaaatcgactgaaacaaaaccccatcacaaagcatcagttaccgaaaatcaattcgagcccaatcgcttcactatccacagaaaaaagaagaaaaacactcgattgatgaaattacctgcaaagatcatcaaggagttctttggagggaaggcaatttccgatgttcttcgatgaacttgatgatcgatggaggcccgacatttttttttgtaccttctcttgttctagtagttcttgcctttaaaaccctaatactggacgagaggagctctctctctctctctccctctctatatatagatttacaactgttgctctaagctttggcttcctctgattgaaagaggaggcaaaaacaaccgtcgtcggtgaaatctgatcgctccggagaagaatctgagagtgcgacgattgtgtgtatctaaaaggtgggcccttctttggcctttatggctgattgagttatgagctgccgtctctgtttagggtggataaaactatccgagatccgacccaagtttcgattggatattttttagtcaaaacatttaccttttttttttttgggcaacgtttaaaaacatttacatgttttgttttttttaccaaaaaaatagatatgaagattttattttaacatttaccaactataaaatatataatctaaattaatattatttatttttaaaaataattaattatttatatagtatcttcataagaaaattattataagaaaaaacttgtgtttactatctataattgagattgcatttcacaactatgacaaactaattaattaatttttttcattggtaaattaattttaaattagaattttaattctcatcaaggatctttcatgtcatgaaagctatgatttcttcaatttttttggtatatattctcgatcatgtaatctactacgaaaattagaagtttaatttcaatagttagaaaattctttagaagatcattttttttctcaactccactattcatttctttgccaccaaattccatatttttcacatattgtttttttaacttcattttatggttatttgttatgtgaagaagaaaacgacttaaatgttttagaggttttatagtattcacaaaaatagtttaggtttttgatcttattttttttacatttttaacaaaatacttatacataaactcgttatttaaatcggtttaatatacaaacgttacatagtaaaaataagctacatttcagaaaagaaataatatattagtcgcctgcaaatcgtcaaacttaaaccgagtaaaaaaaaactttgatggacggtggccgagttctctcatttcagtaattagtcgtctctaaaattggttttcgttccccgaggaggtttcttccctagtagaccataagatcgctgagaatatg

SEQ ID NO: 861 - DNA, 3000 bp, Unknown
  misc_feature (1)..( 3000): cDNA_ID_1399202_gDNA_ID_1620330_Annot_ID_153608 3000 nt of promoter + ATG
tcacattctccatgaagcaatgaacttgaaattgacctgagagttgattgtataagtatttggcaatcgtagttttcccaactccacccattccccaaatccccaacattcgaacatccttgtccactatagatatcatagactgcagaaagtccatatgagaactcattccaatcaaaccttttgaatcatcccatgaagtagaaaccaatttatcagaaatgtctttaacaatcttcttaatcagctttgagtcatccctcctaccaataccatacaaaagtcatcactttaatactaactttgaatatacaccaactaaactgttttagaaacttaccaattccgagaatcttcaccagaaatggcagctaatttcttcaaagcttctttccatttccccactttctccttgtcactgtgactctcaacatcttcaccgaaacttcctctctgtcttctcacatccgaaggatcaacctcgtagaaaatgggtacaatcgtatctttattacattccatgatcttcaagagctcgtctaagcaccagcttgaagctgcgtagttcctagagaccacaacaatggcaaatctggagcctttgatcgcatctataagctcaggggagatggattttcctctctgtagatccaaatcgtctctgaaagctttaatccccatccgatcaaactcgcagaatagatggctcacgaatgttttacgcacatcttctcctctaaaactcacgaaaacgtccgttttccacactgttgaagaagaagaagaagaagaagaaggaagagaagccatggattgtctctgagctctactaccacatagattccatcaattgcagttaaagtcgacaattcttgtccttcttactattttagctcaagcaggtatctatcatcatcatccagtatctccaaaaccttggaaccatgaaaatgatacccagaagtcaaaggttccaacttttcaatgacgcgtgacagagacagagtcaaaatcaaaactttttgaccttgtttgcaatttagcagtgattctccgaaatctagcagcttttactcaaatctcttcttgatggcattttgatagaattggatcattcaatagtgaaagaaatataaatacattatgtgattagagtttgaattgcgagtcaaaagatagaaacaatgaaacgaatcagtgttgtaaaatcactcaaggaggtggtgaatccagtcctttacaataaccggtgagccataccaaggtctggtttcatcgtctgaaccaacaggtgaatggtaaacaccgtcgaagctaacattaagtgcaccttcaagatgagctgaaacctcaggaactactccatcaccccacacatcagctcttccacatacttgcttgtatccttgccctacaaaacgagcacggaaagtaccactcttcttgttgcttgctatagcaagttctgaaatcccttctccactgtcgattccaacagttacatcagaatcaatatctgcatctgcattgtcaaccaaacgagctccacgaatgtatctacacatgaagtactaaattcagattggacagaggttccacacatatatggtttctagaagaagcattacctcccggcgatacagacatatttcagctcaggagtgtaaacagcttttgcacaattctcttcgacataatagagaagacctcttgtttgatcaataacccccggaagtcctctcggtggtggtctaaacgggatacaaaaccatacatggtcaaaacatcgaagcaatatctcttgaaaggtctaaaaaatgtaatcgacatgtatgttacctacaagtgaggcgtaccaagtgtcaacaacaaggagatatcagagtttccgtattcttccatgtaaactcgagcaagccatcctccagctgagtgtccaatcaaacacaatccttgacctataaatgacgcaaaactaccgagttttatggttaccgcgattcacaactgaaactagcagctaagtctgatccaagaacaaaaagcttcaaatcaaatgtgagatttaccttgagctagctcattggcttcacggactgcatcatcaattctattcaagtacctgatcaaccatataaaagactcatcatttgaaaccagtcaaaaaattcaaaacacaaaacaagtgatacattcattgagcaatcagtaccaatcaagaacaggacgagggcggagcgtgccacgccagtaggctggatcaaccaaaccggctgcatttctaaaccaatcaagccttgatacagctgcaaccacagcaggaacaccgtattcacccaatgttacctccagcttcttgtagtctcctgtattattccctaaaccctaataaaccaattccacaaagcagccatagtgacactaaacccaccattgaatcatataacacaaaaaccaagttttggactttaaatatgtttctaaaggaaaatgcaggaaaacacttaaaactataagaaacagaaaattcagtgaaaataataaaaaaaaattttggaaccacacattttccgccatagttgtctcaatcaaaggacggagattatttaccgggagaattacggcgggtcggtacttgacatttccggcggaagaagaggaggagggtgacgtggctgcggagaagtttggcctcagcctgagcgatgtaaccatcgccgaggccatctttttggttagtggctatgatgagctcaagcggagaaagctggagtttttaaaatccacaagttcttaagcattttaatgtatttacacaaacaccccatttatttcgattcttatcacattaagtacaaaactcttgaacgttttctagattgagatcacagctttcttcttccttcattgggtttaagaagcaggagaagaacactaaaagaaaacatttttatggtctggaattgaatccaatcctcctctgtttctctaacaaaaatg

SEQ ID NO: 862 - DNA, 3000 bp, Unknown
  misc_feature (1)..( 3000): cDNA_ID_2127170_gDNA_ID_1620330_Annot_ID_153618 3000 nt of promoter + ATG
aaggttgcaacctccaaccgaaacgagccaaccgctaggtgctgtccaggtttggtctccacgatggatttagttttgagttttatatcattatttttcgtacaaacaatacatgagccgatcttaaacatttttttatgtgaataggtatcaaaaccattgacgttatcaggacttttaaattgcattgatgggttatggtcaagttgtggaaacgaacgtattataatatttacgactaacaacaaggagaagctggatccggcattgctcagaccaggccgtatggatatgcacatttacatgggacattgtagttttcagggatttaagacattggcgtctaactatttaggcctgtctgacgaaaatgatgatactcaccctctctgtccggatataaagcatttgattgatggacacgtgttgactccggctcaagtcgctgaggaactaatgaaggatgaagatgctgatgcggcgcttgagggtttggttaaggttctcaagaggaagaggttagagccaaagaagtgtgatgatgaatctaagatgaagaaactgaaagagggagaggaggcaatagctgacgctgaattagcagtgttgactccggctcaagttgaggacaaggaggaactagttgctagcgaatatgctaatgtgatgcccgaatggctcccgagatcgaggttggtgatggttctgccagggttccatagagcaagaggaataagaagaggtctgggggacgaaatgtaggaagatgatgaaggaaattgaagaggtaaaggaagataatcactcgacattgaggagacctgatgaagatttgttttacacatgaaaattttgaataatctaattttattaaatggcgacaagacaaagttagtatgacataactttcttaagtttttagtaaacaacaaatcgatgtttgtggaaaatcagcacaactttctaaaacttgcttcaagtacattagtcacaagtctttgtcaacttcatcaattttatttgatattaaattcttcctcaccaagccttcgaggtccgggtagagacaggtgtggggcatcattgtcatgaaagaggcctaagtaggtatacgccaacattatgaataatccatcaaaacagcaatgtcccatgtgaatatatatggagatccatacatcaaggtctaaggagagaatcatctatatcatccttgttatttgtgatgaagattatgatcctttcttcaccacaagatgatcatataccatcaatacagtttagaactccagccagagataatctcgtctcctgatatcattaatcgctacaatagtggaatactacaaataagtaaaaataagagggagccattcaaagatataatagattacttcagttcctccatgtctgttctgtctatgtcttcaatcaccaagacagaaccgttgatagtgagcaatagtttttcaaggcatgatcataaccaaacttgtctttcctgtcggtccgtaaaataaacttattttaatttaatattttattgaaaaatttattaaaatatcccatttaaaaataaaaagtggataaaaaaataccgtaaatctggtggatgacacacatgtaataacttcgcatttaaaagaatgttatttactaatttttctcaaattgtttttccccaattgcgcaaacacatcatttttctccgagactttaatcttctattctctctctcgaaatcgaagaaactaaagatgaagattcctcctccaaagaaaatgttcaaatcatgcaccaaagtaattgcctacgtcacgacgatgaaaacaatcttgattgtggtagtgcaactattcataaattgtattcactttcttctggtctcacttttggaaaaccttttttcgtcatagcgttctctcatcataagggattaataccgtattgtatctaatttatgtaaatatatgatcatatcattattattatcataaattaatttatataaatatatatacatatatataattgatataatattataatatatgattttagagaaataggactgaaagatattcatttgtctctatcaaaagatgatattgttaaatgatgaattataagggattaaatcgaacaaaccaataaattggcaaaattcgataaaataataaaacaagaaattttcagaactttaatgtaaatatatgatcctattattattattattattattattgttattattattattattattattattattatcataaattaatatatatatatatatatgatataatataataatatatgattttagagttttaaaataataaactcattagaggtcgtctctaactctaagttttattgtataaaaatttgatatgttgtattttaatactatcgtattttatttaatttttttttttacaattgccaaaactttttaattatcattttaaagtttagatagttagtagtacctttttaaaaacaaaacctcaaaagtgataatttaaagaatattttttagttatgtacttctttccattatatattatcataaagaaaacttttaattctttcaaggaaatcttaattttattaaacttatgttctcaaacattttatgatatatgtgttgaatccacaaaaaaattgtaattataattacagcattattttgacacgcatgtgatcttatcaattataaaataagatattaatgacattggtattgaaaaatccaaatttaattaataacatatgtaaattagataggggttgtcaactactaaggacagaaaatggaacttcgttttctttgtgaagataatccatatatcatatatgacttcatatttacattaccacaaatattattgaagataaatgattagctactccccacacatgtattaacaacaacctcttctactttgagtgtttttggtacatttggtgcgtttcaaatcatcagcgatg

SEQ ID NO: 863 - DNA, 3000 bp, Unknown
  misc_feature (1)..( 3000): cDNA_ID_2127200_gDNA_ID_1620330_Annot_ID_153629 3000 nt of promoter + ATG
agaaaaacacaattccattaactttaatcgtacaagtgagagtgttagaaattgtggttaaacaatgatcaataaccactaaccatttcgtaaaattcaccgacgactttatcaaatgacgaacatgatccgatggatccacgaactaccgaaagagaagtaacctcagaactatgtagaaaaagcaatcctattattcattcgaactaattcaatatgcagctagttttttggtctaacgacttcttatcgtaccatttttcatctcttatcatttttaccatattcaaccataccaccatttttatcactattttgtacagttacaaagctcttaccgtcttgcgctattaatcggaccattaaacaacttcacataaaattttatattagacgtttgaatttaagtcgaagttttgataatcttaaatgtaacccctaaaatacagtcgatagtatttgatgaaacaactccctcattaaaaatcgattacttttataaaatagctgtaaaataaatggcaacccaaacgaaacaaaaaatatctatcccccgaaacatattacatatactccacatctttcatatatgtttgtttatcggtatgtctttaatattatctcttcttaccccaaaattatacaacaatctttcaaattacagaccactttcatggtcgttggaaaaaaataattcttccatagtcgagaatatgatttgcaaaaatgttattaaataataatcattcaaagtatcttaataaaaaaacaaaagaaaagtggaattggtccataacggttcggggaacttttctatgaaccggaaactgaaattcgtgaggacggtacacgtgttaggtaagaacacgatccgctcgtgtgtaacagccaatgatgtcgtcattccacgtcggtacaagactttttttttgtcgtcaacagaagatttcaaaattaacgaaaccgttcccataaccgaaactcacataaaaacaagacacaataaataaaaaactttaggtacttttctgtcgtttctttggtttctaacgtctattcgtgttatatttgttttattcttcatttattattgttgaatttaattctagttcgagttcagttacatgatttctctctttaatctctagtattttaatccatcaaaattatgtggttgcatactcgatcgagtttagtacaattactaaaatatgtagctttgtttagtcatatcaagactatagtaagttgttacgcatgaaagataattattacattcaaacgaatgaccactcaattcttatatcaaaaagatacaaaaaactaaagtctacaacttataggttcaatgggagcataaatagtccatatcattgaataataatggtcttcaatagagttggttgttcaattattatttttggtttataagaaatgaattgaacttttgtttgtcaccattcacattttcttctcttttttgtacttttagttttcctaaaaattaaaaaaactatgttcccttcgtacctaaaacttactttaaaataaccaatttgatgatagttttttttaaaaaacttcaacaaagattatatatttcatcctgaaacaaaaattacagcaaaatttaaatttaaactagtagcaaaaaatataggatgtgcatatgttttctgtttgccacgtctgttttccattaaatgtacgcacaacattgtttgagttcaattaactatttaagtaataaacaaaaacaatgcttgaatttcactgaatatagtatataagtaaaaatgtatacaccccaaacgacgtcgaacccatcgttcaaaagatattgaagtacttgaactagttgttgagctaatcatcatattactttataatttaactacacaaaacgagttctttgaaagatgcgaatatatatatacacacttatacgttatggagagaacagaaagctcataaaagcaatttatttctctccctttaagatcttttcttgctttgtgtccgaaacagacaaaaattgattctgttgttttttcccataattaactcacacacacacacttaacgtacgtgcaatatctgtatgtgtgcatagtatatactatagccacacgagcggttcaaaaatgttttttggagtttccgagactgttgagactgtggggcctatggtcatcgaaccctcccacacgcacgagcgggtctcgttttgcatgcatctacactacacgtacccaccgacttttccaaatcccttacttttgcacgtgtagagagagagagctttgtactgaaagtatctcattattcgaaatttttcgtgtaagagtaaaaactaaatcgcaacgtacgtgaaggaaaacgtgaaccttgaatatttaatgttttcgtgcggtttcattttaactatttaattaacacaatattagtacaataacaagcagctcttatgaagatagtgatgaaaaattgttatagatctatcttggaattttaatgatcgaatttcgattttgtacgaccaccatcgaggcatcgactataaatatagttaaaatgtggttgctgaaaaaaaaaaaaaaatgataaataaaatgaaaccgcacgtaattgtataaaaccattagcatgggattattaggccacaatttggtaattaacacttgtaattcatttgaatatgcttttacaaaactttcccttcaatttcttttggtgtgtgaataaacagctatcaattttgtttttcatgtacattaaataaccactctgcactcatcatcattttctaaaatattcttctatatatattaactagcttgcaaataaatgtaaataaaaatataaatttcaataattttttttagagaatctctctttcctcttccaccatataaacagtgaaaagccattcaagtgctctctccctctatctctcttctatttttagtttctcttcccttaatccctaaacccagaaac

SEQ ID NO: 864 - DNA, 3000 bp, Unknown
  misc_feature (1)..( 3000): cDNA_ID_2127215_gDNA_ID_1620330_Annot_ID_153632 3000 nt of promoter + ATG
tatattacaatgtatatgatatgctgaaaatttgatccagctaagtcgataatagtagaattgtaattaatgttcatcgtaatctatttcgatttcatattcttggcaacttcgattctgaaagaaatgtaaaagtaaatttaatgaaatagtaatgatttaaaacggggtttctctaaaaccacttgggtctaaaatatatattttggacttttattgattgacaagactttcatatgattgagaatgttttgaaggacttaagaaaaaaaaaaggatttaaattttaggcgttatctttaaatgtatatgtttcacttaatattagttaaggtcacatgtacaacaaccacatataattgcacataacaacttattagttgaggcaatattttaattttactagtataaactattattctgaatttgtttttcattaagacaaataaccaattaagtatacctcaatatgtggacattgcaacaattgctccattactccttatgtagtcatctatccagactccagaggttcgataactgattactttagtcgtcaaattatctatccatgaatagtgaagacttaaaactactgatttaatttgttaatccgtcatgcctaatgatgatcgacaaaaaataaaagaagttggtacatatatactatagtcttgactctagctagggtcctgatttcttaatcgtaaattttaagacacaatttagttacgatttttattttggatgaattgaaagtagtgctaaaattattgtgtgatgactagtcgccgtaactacatttttattatcgaagttttgtaagatcagttaataaaatttagtgttgttcatcgtaaaagtaaagcgaaaacatttgaacaagatatgtgtagcgataattttcagttaattaaaaaagtaagcatgcatgaacagtagacagattttgcaatcctcatatttacaagtacagttatttttccaaatataaacttgaaatttatctacacttagattccaaatttcttaacacttttttttttatgttacatatctttatcatctttatcatttttcaaaatttcgacaaaatttacgtagagatataaataggagaaaaagactaaaaataacaagaaaatcaacttataacctaacacaaacagtaaaaaatacaagcgggaacccaaacgaactttgaagtttcgaaatttacgtgatttcctcaccttcaaatttgtttgaaccatcattattacggaagttcaaaaattcttaacattaaaaaaaaaaaaaaaaatcgtaattgaactccaaaagaatatgtaacactaatacccgaaaaatgatttgatatattattatgagtactctacaattaataaatcattttcaatttttttggaacgttcacaagagatgtttgaaaaacatttgggaatgatatccaaaaagtcaaaagttcaaaaaatcaaaagcggacgaaggaaagtttgttacttgaggaaagcgaggatgaggtttgggaatattattttgacgctttcattatatcattttaaaaattacgtctaagtcggtttcgtggcgagttgtgtaaagaagctggcacaacactaatgatttggttgatttgcttgtaagttgtaataatgtgacattttcttcccttacattatacttgcattgattatattagaatatcacgtaccgtttatgcatattattttagaaaattaagacatatataacacaatagtttttgttatagtatcctcgtcgtaccacaatctatatttaaacacgcataaaacgaatttttaacattttttttctagtcgaatttaagtcttacattttaatttcttaacattttgaagcaatttcaaacatttaaattggtctttaccatgctacagaaaaagtttcacaactccttcctctcaatcaagatcctcacaaaatgatgtggcttatagtgtccttaacaataatccatttgctgccttcaaatctagaattaattcaggtctagaatctgtttgtgatgtagcttagagagttagagatcttgagaaggatgaccaataaaggcagctcaaaaggttcaagagatgtaatatactcatgtcggtggacgcagaaaccatggtcgtggagggcctggaggctgaggcaatcgtggaccattcaattaaggatctctagtgagtatatatggaggctatttcttctttagctcctccctagtttcttgagcttttgatgtttttaaaagctagcaacttgtatgcttatgcttatctctcaaatttattttgcattttctgtgacctttcatgtaatctctttgcattaaaaaaacaaaaaagattttatctatcaaaaagaagaggggttagttttattaggaaagaagaggaactcatgtggacaatatctcctaatgaaatactgagataaaagattaaagataattatttaatctaactacgaaactaaacacctcctaaagtgagaaaacttgaataacgttcacacatgtataatgaagacaattaacccttgttaaaattttatatttactatagtgccattttcatctaaatttagcaatggaaaaacttaaataatacagaaataaaacttgactgtttattgtaatgccattctctctttcactgcagagaaaaccaatcgtgaatgttgcatcacttgcatttagagcctgaccttgagcattaatttgaaagctatatccatttagagccttaattatcttcgtctacatatgtacaacactaattacatgcatacatgaacttggacaaaaaattaataacatacatgcacacatgactacaaattgttatgttaatgtagtaacgagtcaaaaaaaaaaaaatacattaatggaacgaagttacacagattaatcaatttcagattaatacatgattttgatttggaaagttgtatataatataataataatac

SEQ ID NO: 865 - DNA, 2396 bp, Unknown
  misc_feature (1)..( 2396): cDNA_ID_1028388_gDNA_ID_1620330_Annot_ID_153633 3000 nt of promoter + ATG
caatcgatttcaggtaagcacactttgatttgtagtcatgaaagtgcttcagggcactacaatcatgctctgatttaggtcttagagcacttgaatcaacaggattcgtgaagaaacccaacagaagacaagagataacgagaaggaatgtgactgtcaagtaaccaaaacggtttgaagaaaatgaaaatcccatcaatcagctaagacctggaaactcaacaaaaaacgaaaagaaacaaatcagaacagagcaaacgaagaaacagataaagtttggttttttatcagagagtcaaattgaaaaagaagatatttgggtttattgttgagaatctataaatgggtttactccataagaacagatcatgaagaaaacagattagataaacacgaactatacgcggaaagagaaagataaagcactgaccttttttaatatctggaagatgaaaaagcaaaaaagggatcgaatttcgaaacgaagcttttaaaggagacgaagcgaagaaaacacccacaaacacacaaaacaaacactttaacaagacctgacgaagacaaacgtcagagacaaaaaaaaacagaggattgaggaatactatttttttatataaagaatctgaaaaaagtttgtcactttgtcattgccgttttggggttagggtgatttgggttttggaaatggcttatgtgtcggcttcacgatgaactgtgcgtcattttctctttccattacgtatgcgaagaataggaagacgaaggagggagggttagcgaaaggatacataaatttagaagctttttccacaaattaaatattactataaggagctgacccagcaatatttagtatttagtgctgattccttaagccactaactatggaaaaaataatataaatattccggtttggttcgtaatcagttaccggtttaaggttaacttacatataagaaactaatttaaaggatgtggtcagtactgaattgatgtttgtttattccaacaagtaaaactctaatctataacagtcattttaatctaattttattagttgtgaaatagttattggtaattgagtataaaccacaaccaccgcctttattctgttacttccagtttacacaaggcagaataacttgaaatgtaattaagagaaaattaattcaataatttggctttctattagctcaaaattacttcctttatataagctgaaacatcttaattcgaacgtattttaagaaataagtatacatggatattgaatttccaaatagattgagacagccacgatcataaagagaaagttcccaaaaagaaaagacagaaagaaacaagtagaagaagctaatataaaaggaaagtatagtgtgacaagataaagttaataatgaggaaactaatagtatactccacacagtcacacaaagataattgtataatgaggtcgactgaataaagaaaagaaaaaaaagtgtggtcgacttttactactaaaacgagaaagtcggtcgaaggattaggatttaggacacgatttttgtaaaaatatttagggaatttttcaaataaaatcgaacaaaatataaagataagaggacttattacgagtgtgaattgcaaatattaaaaaagtaccgagtcatttagagcaacgcggtcttcaaacgcgttttgtttttctttacttttgtttacatctttgcatttattttgtgatgttattcattgcttgagagctaagtgagtagaagcgatccattaacacaagaatcagcacgtacgtgtacgtccccttcgacggtgatatttgtttttaccttttctagttgatataaaaatcttcgtttactcatggagatcagatactatctaacatcaaaccaacaaatcctttaatctatatattgttagctatcatttaaacttatgccttaacatataaagttgtagactagtgtctgattgtttttttaaaaacactctttttaattggagctgaaatatcttaaaagtgaacacttttagccgacgtccacctttagacaagaggctgactccaaaaagatgtcccaaaaataattgatgatgggcattcattatgataaagttggcccataatcttttttatggatccatttgtccaattcaaatttattgattactgtcacgtcccatcctttttgatgtttatgggctcggtttagatacccggatatcttaccggtatagtccggttatgggacctcaacgaaaactgagacatatgaacggcgatccctccaaagttatcacctaccttctccaatctcttttcgatttcgaattttccatctttcgattctcagtagtttcgtctcaatttcataattccattgtagccgataatg

SEQ ID NO: 866 - DNA, 3000 bp, Unknown
  misc_feature (1)..( 3000): cDNA_ID_2127207_gDNA_ID_1620330_Annot_ID_153630 3000 nt of promoter + ATG
ttttgaggattttaatatatcaatttatctgtttagtttaacaaaacatatatataggtccattactaagtgagttttggaccagtggcgagttttcggatcctccaaacattataacgttattgagcttcctaattcgattccacttgacatgaagacaaaaaaaaattcaacgagaaaatatagggattttggctcataactattcgattaacacgtgttcagaaaaaaaaactaatcgattaaccgtagttagttataaaagatttaagtgcatcaatatatgtaatatgtatatattgggttttacttcaagtctccaacgtcccaaaagcaattttgggattgtggttttggatgatgggaagtggatagagatcgtataatttgtctgtgtatggttacaatggcccttaagaaattcaatagaacgtaacataaaaaaggaagaaaaaaggacaaggagctagagaagttataaaagacaagtaatacccagttgtatcaaatcagtcgcactcggtaatataaaaatgtgtttttaaataattgcataatcttttaccgcttacaatatatgcatgatgtaagaaaaaaagaaaaaaaaaaacagctgtgcagcagacgtaagttatttagctgttttgattccttttattttaaagaagtcacgggatgattagttcacactactgctagtagtagtttggctgtttcctcatgggcatgaattctaaaagggaattctaaaacctagcaaaacaaatattataaaaatttcagtaaaagtgtgtatatattaagagtggtaggtctaatttatgagtatccgattaggttgttgtagatcaagattagactaccagtacctattcacggataaaaaaaaattcattagagattcttaaccaaaaatatcactaacaatttaagattagagaattttgaaaaaaaaaaaaaaaacacgccggataacttgatggttattattttaaaaggttgccatgtgaaaaaaaaaaaaaaaaaaaacaagataaagtaaaggtacaaagaaaacttgttttttttttgttaatatcagcatatattatatgcatgtttgaatattgatgtaaacacacaataacaacattaacacacatgacatatgtacttttagtaagatataagatcttactaaaataaaaaaaagtatgaaaattaaatatacagatacttgaacttttttagagaattaaaaaaaaattgaaacagctaagcaattaacataaatcgtcaaaaaaccagaatgcatctgaaagaaacagattgtcgcctcttgtatctttcaacactcttaaaacttttaacgtatattatatttgcatacgtacatgcacactaaccaatacgtacacatacggtacacggacagctttattatcaaataaaaggcggtagttaaaaaataaatattattaatattgtactctaaaatcaaacgttaaatgttattgtcaaaaaaggagtataaatcattttatcaaatcaatttttatagagttgattcgtgacatagcttacaatttttattttcttctttaattcgagttttggatttaatagtttaaaacacgttaaaaagacaatgatttgagttaaaaaagaagaagacaatgatgctttaatcatgaaacagatacaacgttagattttattatttttacatctgctcgtaacgaaaaagttctataaaattttagctgttttatctttcttctgaaaaattatcgtataatattttaatggatttaaatatacaccagctaaaataaggtctatccgatcatatagcgacgtgatcaggatacttaagttccattttaatccagtatttaatttgtattctaaaataaacgcaaacgaattctaaaatgtaatggactaaagatatattgattgctgtaccaccttgaactaataagtaattctcgtggatatactagtaaagtacttttcattggtcattggtcagatacaacgcaaacgtaacttggaacactaaattcaaaggtgaaacaaaatcctaagtatctatttcttgtcatttttattgttagtttataaattctcgctcaactatgatatatttaaataaattctattatattaattattacatgattttttcgagttaaatatttaaaaatgactctacgtagtacgtacatagatttttgatcggctaatgttgttatatatgtgcatgaggtattcccaaacttgtcatatcaatcaaaatctcaatcaaagacaagttctacttgacaaacaaaatctttttggcctctgtaactctgttgcatgacgtcgataatctattgtccacatttatatctaaaaagcaaccagatcgcccgaggtttgtacaattatttgctatttaataaagataaatttatgaataacttgctaaacatcttgatcatatctacagcagaaagcaagacaaataataaccggtgttttcacaattgcatgtataatcatattttgctatacgaatttgcaaattttatacattttttggggtgtgaatattatcaatccgagaacacagataaaagttgtattgtaaattcaaaactgagaaaaacgttaaccagggtttgtttgtgagttggtccaataatgcaatggtggaagcatttcttgttagttttgttatacaatcaaatgatatacaagaacagtttttaaccctctgcctctcggaatacgtgttaacatattcgaccgtgtcctatataatatttaattctaagtgagagcactaaaatagtgtaacttaatatttaaggaaaacaaaaaagaactcattgagaatctctcttctgtatatattcaatacatattacataaatcttccctcaagtaaccacaacatctcctttctctttttcttaaaatccataatccaaccaaaagaagaaaaaaaaacaagaatcttgatagcaaatg

SEQ ID NO: 867 - DNA, 3000 bp, Unknown
  misc_feature (1)..( 3000): cDNA_ID_2127180_gDNA_ID_1620330_Annot_ID_153621 3000 nt of promoter + ATG
tttaaaagacaataatattttgggttcttttggtaatcgagtttcagaaaagcaaaactagttttgagtatatataatggctatttacgttaagtgtgtattgtacaagtcatctcccacttcaacaaacataatccaaaaaccatttgttttttctgtcaagcaataaacgtttcaagtaataccatagttaaaataaaatcttgtatctaaaaacgtcactgatccaaatggttaaataatgggttagtatctctacaacgttatcaagacgaagagaacaaaacaacaaaattgccacacaacaactgcataatataaaagttggaaacatgaatgtttttcgagtcttcattggtcaagcaataactattaaataagactgttcatattagataaaaatggaaaatgaatggacatgctcttcgtggaaagagacgtggaaattttccatgagtttcttttgtcttctttcttactttttctattatttcttttccaattctcagatttttctaataatattgtggaaaaaacaaacacatccattgaataaagacaacaaaagattgtattaagacattgtgtgactaataatgtcttctaaccccaaatgaaaccttcttccttaaggttcttctcttcttctttatatatctctttcacctctcactttcactctctccatctacatataacacagtgagaaaacagagcaaaaacagagagatattacgatgtttttctctaaggatcttccttcacctacttcggttttcacagcttacgcatcaatggcgggttacatgatgatgataagatcaatggctcacgagctaatcccagctcccctccaagatttcatctacaggactctccggtctctcttcttccgttcttcttcctccactttgacgctaaccatcgatgacgacaacatgggtatgaacaacgagatctaccgagctgctcagacttatctctccaccaagatcagtcctgatgcagtcaggctcagaataagtaaaggccataaggataaacatgtcaacttgtatctcagcgacggagaaatcgtcaacgatgtgtacgaagatgtgcagctagtatggaggtttgttactgacggtggagacaagaaaggaggcggcggaggagtaggaggaagaggaggaggaggaggaagaagaggtggtatggacgatgacggtaaaagcgagtacttcgagctgagtttcgacaagaaacataaagatttgatattgaactcttatgtgccttacatcgagagtaaagctaaagagataagagacgagagaagaatcttgatgctgcattctctcaacagtcttagatgggaatcagttattcttgaacacccttcgacctttgagacaatggctatggaagatgatctcaaacgtgacgtcatcgaggatcttgatcggttcataagaaggaaagagttttacaagagagtagggaaagcttggaagaggggttacttgttgtacggtccaccgggtacggggaagtctagtcttgttgcagccatggctaattacctcaagtttgatgtttatgatcttcagcttgcgagtgtgatgcgtgactctgatctaaggaggctcttactagctacacgtaaccggtcgattcttgtcatagaagatatcgattgtgcagtggatttacccaacagaattgagcagcctgttgaaggcaagaaccgtggcgagtctcaggttagatttctactatgattggttttggtttaggattggccaattgaaccaaatttaccaaatcgaaccaaaccaaaatccgtatcaaccaaattttaatttagtgtaacaagactgactctgattagtatagagaattttagtatatttaaaattgtatttttttttgttttctatgaaaatgtgtgtttagggaccattgacgttatcggggctgctgaatttcatagacggactatggtcaagctgtggagacgagcggattataatattcacaacaaaccataaagataggcttgacccggcattgcttagaccaggacgtatggatatgcacatttacatgggacattgctcttttcaaggattcaagactttagcttctaactacttgggtttgagtgatgctgcgatgccacaccgtctatttccggagattgagcgtttgattgacggggaagtaatgacgccggcacaagtagcagaggagctgatgaagagtgaggatgctgacgtggcgctagagggtttggtgaatgttttagagaaaatgaggctaaaatctaaggaatcgaatccggtgatgatgaagcagaaagagagtagactggagatggaggagatgagactaaagagtgatactgagggttctccgaggaagaacagcaaaagatttaagaagcttgtattgttttggacataatccattaattagttcaaataagattatgaggaagcaaacaaaaatagacgtataagaggctaattacaactctttaagtgttttttaaaagaaatttcttgtatgtttattttctagggttgtgaaccattgtaagacccattaagagatatggaactttatttttccttaaagtaagaaactatatattgagatagtctttggaggtacattaccaactaccaagtatgttatactctacctatataaaggaagaaccaaagaaaaaataaagcatatagagtggagagtctcttgccttgttacagagacttttgagaagagtaaaatctttaagtgttgatatcttcttttatttatgtggtaatgaatatcccaaactgcgtaatagcttgatacgtactttgcgttattagcctaatgggctggcctttgtggcccaaatgatgaaaaagatgaataaagagagagaattatctcccaatacaaatctctatataataaacccaatttaccaaaagagaaaccaaaccctaaaagtcgaaaacaatg

SEQ ID NO: 868 - DNA, 3000 bp, Unknown
  misc_feature (1)..( 3000): cDNA_ID_2127147_gDNA_ID_1620330_Annot_ID_153611 3000 nt of promoter + ATG
aagttaccaattgatctttcgattctcattaacttttacaatgagttgttgttaattatatctcaaatctcttctgctcatttttcgcctattctttttgaataactcttaacaacaaaatttaataatcttagcaataatactgaccggtcaaagtttcacacaacacaacaatgacatagagaaattgaattcttcttttataatctgatcatcatcttgatttaatattttacatagagaactaaaatttggccggctatactctctcgaagagacttttggatacaatcgttatacgagttcattaaatcctgagctaggtttgatccatttcccatgttattcgatttaggaactagaatcgcaacacgatattgaaagaacatacaatagtttatgagttcatgcacttcagaataatgatacgctacgtctcaaccaatcttatcgtcgggaaattcactatcaaatcatcgctggatggcacagaaacacgagcttcctaccaagagatcctctgtcttatgcggagtctcatacttaaatcaaaccgatgagataacctcccaacactccaattcaattcaattccggttaagtcttcgtaaaccaaacccatactagaaatcatgaaaattccgaagaaaaatcataagattaaatgattaatagattactatctacaagatatatgaaaaaagaacataaataatttacagaattaccactctttctgctattagctcaaaaggccgtcgtcccccatgtcagtggttaggtgagccatttattttcatgaaaactatagaaagaaagttatatttatgtttcatgaaaatagaagaaaatggttattactttttttttttttagcagggaatttggtttacaaaagcgaaagtagaaaatatatattaaaatataaaattatatcgaagtgcataggaagatgaaactgtgatcaagaacatacaaaacacaatgacggtggttcttctgatactactagtattactaagtacattcacatggatgcctgcgccaaacttacaaaattcatttttttgttggatacatctcatattgccatttaataccttgttttttcacttctttttccaattcttgacgatgacaaatgttagttatacctctggccaaaaagttagatagatgagtcataagtgacatagtaaataaacaaaaatatataattaaactaaatatctcaataagtatatcacggaaaaaagtaggattaaggatttgtaatagtaaattagtgatataaagcgttgaaatgaaaacaaaacagatggaagtatccaataaaaacgtggactggtaggaatgaattgtcaaaattaaatcatataacgtgtagctagtatgggtccccgtcgtgtcctcctatccagtcgtcgaaggtgtctgtctttaaaacatcgccgatcgatagttatgagtctgagtttcttctgaggaaacgggacgtcgtttgcgtagtttgtaactatgaaattgaaaatagtaaaacacgaatacataaaagaagctaaaacattttttttatcatatctataatctatagtagtagtatttctattactcggttaaacgacacttgaaagtcgaaactttgatttgtttgaggttgtgtcagagagagaaaggaagagagagttccgtctcttattagatgctcatttactccaaagtctgaagtttgatttatttgaggatggatgcatagcatttgcatggattaaatgattgtttttggcacgtggagtcgtggacaacaacacctccacaattcaccctccacaactgtatatacgtatgtatttttactacagatttgtatttttctttgtaatttacagcaacgaaattctttgggcgtaactatttttccactaggtgaaataaaactagagattttttaacagaaagtagtgatgtttttctaaaatatatcgttttccgtgtctaacttacatgattacatcatttttgcatgatgtttacatacatcatttttgcatatgagtgatattcataagcaacgaaacgcataattcattaaaagatgatcaatatcataacatacatttatctcgaaatatagtatagatgtatcatgtactatacaaaatagaagtttcaatttatatactttccaagtataaattaaaaaagggttaatcattcgcaataataaattcgtaacttgttaatctctaattgacgtgaaacttcacttaaaattaatcagaagtaacacttagtatttaaaaattgcacgttgttaattcccttaaacaaacaaaacgacgcttttactttctaaaatgtttccacatatgagtgtatatatacacttttctattacgttgtcccaatatacacgtctagacctacttaacccttttcttttctctcttctctctttctctttctctttctctcagtcagtatatatagccaagcgttgtagtttaagtcgaccacattctcaaagagagagagaaaagatcatatcacacttattttctcttgccctcttttctttttccttttgaatatttctgggttactaatatttaatttgttggttcttcggtttctccgactctttccccttgaacctagcttaacaggtaagtgaatcacctccatacatcaataaattctttaagaaaatatgtacatatacatgcatatttagggtgacttatccgtgaagattttgtcaagagaaattaagcttttggatttaggctgaatttaggatatacttagcttctctgatcactcactggtgtttaatatttacatagtagtcttgacgaccctttgtttttcttaaacctggatgaaactttgaattaagctcaagttatctttgtggcatgtctattacagtagtaataagttaaaattctacatgtattttttatttacttagagaaaatcaaagagagaggaaaaatg

SEQ ID NO: 869 - DNA, 3000 bp, Unknown
  misc_feature (1)..( 3000): cDNA_ID_2127140_gDNA_ID_1620330_Annot_ID_153609 3000 nt of promoter + ATG
tgctctaacagaacaaagtgcattttaatgtaaaacaacagaaagattctcatatcacaagattgaatgctattcaacacacaaaacctagaaaaaaaaatacgactctaaacaaaagattaaagatttgtgtaccacaagcttaagggtttttgattctttctttctgattcccgctaattcgactctgcgacggtctttaacaacgagaactgatttgatttcgaaattctcagagtgggataacgctaagaaagatgacaaagagtcgtctgaacatatatagttctgccttcgtcgaagcagaggaaacgcctgagacgctgctaatcgagccgtagtttccacgctacgcgtttgcttttattcttcaagataatatatagtattaattacagtatcttcagaaatgaaaacatatgtcttctattgtttatatgaggaaagaaaaattcgaataagttctagatattgaaaaatgttattacgataggatctgattccagtcaaattaatacacctaatccattacagattttactaccattttaaagtcacgtgacttttacataatctaaaatcaaaagagcgaaaaataaaacaagaggtcggtacggttcggtttagcattattagaaagtagaaaccaaaccaaactgaattggataacgttcattgatcagaataggtaataggtcatgtttctggtaatagctgacgtttctggtaaagtcttctgtagattcttgcaccttcgaactctgcgtggatctctcgttctgttcttatacccatcgggttttccgttaaccacccatcctctgtgtcaactgtgtccatgtgttgaagaacatttgattcctcgtccaactgatctctcatgtcttgagccacatccagcacatcggattgcacaaatatctgtgcacaaccagtaacaaagaaaatgtatatagttaagtttaaactgtaaaagaaccagtagtgttggtaggcagtaagcaaaacacttacttttccaccgggttttaggttttgaagaatggaattcaccaaaggcttttgaacaacacgtctcttttgatgacgtttcttgaaatgaggatccggacactgcatttttacacgtcaaaacaaataagttggattatcatcaccacctgaagaaagagccggtaaatatagctttctcggatgcttacaactttcttttatcacttaccaagattgagacaatctccaatggtccaggatagctcgatataagatgttcaaaagaaaccatggcgtttgcaaatatgaagtgtctgaaacccatccatcaaagaagttatcaacagagtatataacataggtgtattcaaaaaatctttcctaaggttttgggatgcagagattacacgtttgaaagtccgagctcattcacccaaaagttggcgcgcttgaccagctgcaaagaaatgtgacaaattaaacttcattaggccaaagataccgaaagatacatcagcttaagtagatgaatgatcagctggaaaacatcaaaacagtcaaaaggagatagatccttactttctgacgtatttccagccccaagtaatttcttgattcaacattcttattggcttgccataggagaaatctgccactacctaaaatataatgacgtagccacaggttagtagaagaatccaagttcaaaaaccaattacaaggcagagaggcaagaacggaaatcaaatgggaaacttttggcctttaaaagttgaaacacattcaagcatgaaagaggcgcaagaccaggaacgatataaaggagagctatttgactactcaaaattcaaattcagattccagggaattataccaattacgcaaccaaaagtctccaacaactagtgtataatgtaacttaactaagaaaacaggatctgcataagtatatatcaattttcagaagaagatataaatagatttgagttgagacaaagcataagtcccacaagtctaagcaagctcacaagttaccacttccaatatccaccataagaggaagtgatggatccttataaacttcatcccaaacaggaactggagctggtttctatcagaaagaagaacagtataaatcagttttagtgtttcacatatcatttcaaaagtcacaaactttgcaacatcatcaacttacagagaaagaggaactgagaggattaacatgctgtctgattcttacatgacccacttcctgcaaataaaacagagagaaacacaaattatactcaaccactaattagagatactgatagaccagagtctatgaagatgaaaagctatctacttggaacaaaaagagaaaagaacactaatcgaaacaaaaacaatacccagaaagcaaagactggaaaaggaaacaaatttagggtaagcaaaaacagagggagagagaagaaaggaggatacttcagatatcttatgattgaggttaagttctgcatactccaattccaccaattcattgcttctcagatccttaaaatcgacacaaactgaggtagacgctgacgaagacgcagaaacggcattaaatgctctaaagctgttacaatggcgagggattttgtgttccctcatgaagataaacggagatgatgctaaggagaacacccttttcgccaggagcaatggtgtagctgaagacgaagagcaagcttgacatagagaagccatttttgttagagaaacagaggaggattggattcaattccagaccataaaaatgttttcttttagtgttcttctcctgcttcttaaacccaatgaaggaagaagaaagctgtgatctcaatctagaaaacgttcaagagttttgtacttaatgtgataagaatcgaaataaatggggtgtttgtgtaaatacattaaaatgcttaagaacttgtggattttaaaaactccagctttctccgcttgagctcatcatagccactaaccaaaaag

SEQ ID NO: 870 - DNA, 3000 bp, Unknown
  misc_feature (1)..( 3000): cDNA_ID_2127144_gDNA_ID_1620330_Annot_ID_153610 3000 nt of promoter + ATG
ttggacattgcggccacgtggtggtgcgtaagcgtgatggggatggggatccatggtgcgcttctagggcttaatataagctcatggtcggtggccatagccgagtttgtatatgtgtttggagggtggtgcccgcatacttggaccggctttagcactgctgcttttcttgatcttattcccatgctcaagttatccatatcctccggcttcatgctttggtaacttgcttttatttgttaatttttttcgcgggattaaaacatgattattaagcgtggaccactactaataggctaatacaaatttctaatgactcttcttttgcttctcttgtttatttattgcctcaaacagcttagagtactggtatatgagcatcattgtcttgatgtctggatatgcaaaggatgcgaatatcgcaatttccgctttctccatatggtattacttaaatccgaagaagtttttttttccatatacatatgaaaactaaatacttaattcaaaatttgcagccaatatatctactcatgggagatgaacatatgctttggcttgatgggtgcagcatggtttgtaactatatacgtactctcattcacagtattttgtttttgatgtatacatatattatttgtttaatactaaagtgaatgtttctctatctatgaatccgaaaatgtagtgtacgagtggcgaatgaattgggaaaaggcgatgcggatgcggtgagattctcgataaaagtggtgcttgtggtatcagcggtgatcggtgtgatatgttccgctctttgcctagcgtttggcggtcagatttcgtatttgttctctgatagccaagcagtttcggatgcagtagctgatctctccatcgtccttagcatatctatactcttcaacatcatccagcccattctatctggttacaaaataaaacccttatattagacataaataaattataacataaacttttagatttcactaatttgtaaccactaaatttgtttgaacatatataaacaggggtagcaattggagcagggatgcagagtatggtagcattagtgaacttagcatcttattatgcaattggtgttcctttaggtgtcctccttgtttacgttttcaattttgggattaaggtacatcatatatatgaaaactggtatccagtacttcattatgatcaatcattagaacttttagaattttaacttgaataaatgatattgtatgcagggactctggtccggaatgttggctggagttggtatccaaacgttgatattgtgttatgttatttacaaaactgactgggaattggaggtaatttacttttaatatataactcaaaatttttattagaaaattcgtcatattaaatgtataattttatctaattacaggttaagaagacaaacgagcgtatgaaaacgtggactctaaatttacctgctgtacaatcgactactatctccacaagagatgaagagagaaagtgaacatacaactaagttaatttaaagaaatcttttaagaaattctttataaaaaaagaaagaataatttatgttgtattgtggttgtgttttgcattccctaagaatgaagtatcggtgttgagattgcattattaggttaatgcaactctcataactttgaaaaaggttaagaaggatgaactttttcttttatcagagaaaaaggttgttctcttgttcttcggatatactctttctaaacaaaaaaaaaattgtgggaggtttgaaattttaacttctttcttgattttttaatggatgtatattttgtgtgtggggaaaaaaattccatttgtttgagtgcttgtaatcgtgaatttttacaaaaaaaatattctcatatatatttcgaggaaacgttacaaactttcataagctcaccatcaaataaaatactcatttatttatgttgaagtcaaaacgttccatttttccccctatttatgaaccgatcctaatgaatgttttttttcttcctttttacttctttcatatcaccattttaaataataatagtaattattatttttctaacgtttaaacaaaaaaagaactgcaaattttatagtaacaattcaaatttaacaaagcgatcaaaacatgcatcatttagtgtacaagtactaatcacaaagaaacaagttttggttggacaaagtatagaacaaacacactaaactgaagaaaatagaactttagcccaccaaaagttgaggctaaaactcgagcagtaatcacatagttactatcaagataactatactttggaatgaaagaatctgaatctcgatgaagtttatcttggagaaggactttcttttctgttggtttggatgagatattgctgaaaattattgatgatgatgttaggagatccaactaagttgtctgcctttgcagtgcacttggagacttggagtgagaatcttagtttatgagacttattttctgatttttcaatctcctttgatttttttttaagttgtaataatgtcctagttgatttccttgtaaaaggagcaagagcacgatgttcttttatttctaatttaaagaaaatgttttcagtttaatatatttttcgatttaatttaccttcacatattttcttcagtagtatttattattttcatattagtaattagaaataatctcttctaattagattataaacgttaagaatttgctgtattcaacttttcctattgtgatattaaaaaaaaaaaaaaaaaagagaatccaaaaaagtgaaaaaactggtctttgaggtcaggtcaggtcttcttcctgcaaaaacaaaaacctcagaaatagagaaaaagtttcaatctttcttcatcttcttcctccaaaatccttgatttctaaaaaggagaagaagagaagagaacgcgattaccttgattcaccctcctccttcaggtttgggaggctcgaatactcaggaaatg

SEQ ID NO: 871 - DNA, 3000 bp, Unknown
  misc_feature (1)..( 3000): cDNA_ID_3059365_gDNA_ID_1620331_Annot_ID_153647 3000 nt of promoter + ATG
ataacctataaacaagaattaccaaaattaaaacatctagaagaaaaattatcagttttgtctcgttttttattcacagaagtgaatctaaagcacaaactctaattcttaatctccgtttttttgtagacgatttgaaacgtctgtacacaaacatatgtatatcaacactgacatgtttcgtaaatccaactttgtgatcagctattagtgtattcttacccattttttctttttaagtttttctcttgttctccaatttctttcttctgatacagagagaattgagccttctaagatgcggcatttgcgggttgctagtcaagagtagagtcaaataccatttcctgcagaacaaacggatcctctcagacatatcccgggaattaaaatgaatttgtaaacaagctaaattggaactactcattatttacggtttacttagagattagagtttttcgacatacaccaaagagaagtgaataaaagaatgtaccttgttgcagacggggcaggtttcacttctctccatccattctagaatgcatgcaaggtgaaaatggtgatcacatttggctacaagtttcgggttctcgatatcatattctgaatcaaaagcacagacaatataataaataacccattctcgcagtcatgtaaggtacgattatgtttatatgtttttgagatgtgggaaaggcaaacaagcttttaccttccaaacatatgggacaatcctcctcttcctctattggtataaaaacagcttttgatagcttcgggtctatttcttcagtagattcaagatcaatctctgtttggattttgctatctgtctctttatgtgagcatgtagttggaaccccgagagtaataccatcaactgtttcttgagcagactcggtattagcagagtccaccgaaacctctcttatatcaacacaagtagcctcttcaccactagctggtgtttgaggaatccctataggcacatcgaaaggggtaggcagtggcggtggtatataagcatcaggagatgatgtctctaagtttgtgtctactactacaacaccagtagagattgcagaggaagtcctgttatgagcggaagataaaggcacacgctcttctgttgcccttgggtactgcaaaatacaagtcataaaacaagttatattcccatatgaatctcgaagcccgttggggcttttaactcatttagtgtcctgaagcacatcaagattgatttatttgcagcctatcaaagcaaggacacccaaaaaaaacgaggaagtgggagaagtatcagactaacgtagtagtacgcaggtccattatctacatcagctcttcgtgaagaagaacaacaacagcaacctcccatctcttcttctctttttttttttttctgttttacaaaaactacaaaacccgaagactcttcatctatgctaacctacaagatatgtgaagaaacaaattacattctgagatcagtaggagaatatttatcatctatatgcaagaaactcaaacaagctttatcgttttcgatatcagtttgagctgtctactaaagtctgatcagactcatcatgctagtagcaacaataaaacaattcagctactaacagttcaaattcactctcaataatcaaagatacaataaacatcaaccattaaaatcgagacaacagtgttgcgactacaagcctatgtgaatctcctacaattctcattctctttagcaccatctacacacaattgcaataaattcaaatcagttttacactaaaccccaaaaacttaaaacaattctactcagaatttaactccaacacaaacaatgaatccacaaaaagaaccaaagctccattaagagcaagctaatccgtaaaaccctaaaccgaaacttataaaagcaacaataaacatcagaattctcagaatctagcataaacacataggagaaatacggatcaaaacagtaaaaaaaaaacccacagaatttcacacaaaaatcaagctcaaaacctaaagaaaagcgatcactagcaagaacaaacaccaaagaagaaccgatcatcttctcgagattgaatcagagaagaggaattaaaaatctcaaaatcatagagagaattttactttttgttcttgggggaagctttttttgttttgtcttcgtctttctctgcttctgtgctttttgcggtgctgtgtttatcgtgcgctctatcaaaatgactttcctaagaaattacaaagactctttttgggctcaatattatatttacttacctgatttattaaattcattaatacaattattaattagctgattaattattttattttttccgttacaatgtatttttcaaaatttcaataatgaaattacataactgaaaatcggctgaaaagtgtcgaccaaaaaattataaattgggaagtaccattttcagtaaaattattactattttttttccggcaaataatttatcgatgtttaaaaaagaaacatgggctcaaacttaagaataaagcccatttaaagaatcctattaaaagcccatatttgatctgttactgcagcctttatatatgaatcgtgttcttacgtttctgcttaacaatttccttcctccgcttcaaacgagtcaccgactcgacacaggaatccgaattcgccggagacgcagcttgcttcgttgaatagcttacaacgggaaattaccacgaagacggttgtatattccctccgtcgtacaatttaggttatgtgcgaattcacaaattgaaaatacaagagaaacaatccctaaaatcgatttgattaagaggagcgaaaagaagaaaatcaatatgggaaacggtaatggtctcgaatctcgatcgtactgagttttgattcgtttattgaattatccggtgaaaagagtatgctaatactggggaaaatgttgatgtttagatgaaagaaaacgacctacaaagaag

SEQ ID NO: 872 - DNA, 3000 bp, Unknown
  misc_feature (1)..( 3000): cDNA_ID_2127366_gDNA_ID_1620331_Annot_ID_153658 3000 nt of promoter + ATG
tttggatattcttatcctgtacttccttgatagtttcagttaacagtttgtaattaacacatgtatttaatttggaaacaaaaaaatgaatgtatagatgattttttttttgaattgttggtaaatatatgaacttgacgtatatagcaatagtatactatatttaagcaactgaatgtgaatattctataacacaagtaatatcaattttttgtgatattgttggttataagttatattcgaatttgtcatttataagaaaactcactggtttatccatccaatgaaaagaagaaagctttttgggtgactctaataaatattagcggttaaataactacaaacacagtgttgtttttgtctcttctatgtatctttttatgtcctcttttacaacttggctttgatgttaactaatcaaagattatcctacttaaaaactatttaattaaataatttttaatttctttaaaattaattaatttcttgatatgtttttgtaacgccaattaattatacgtttttcataatgtggtgtttgacttatggtttgaatgttaagatgtcgtatatatctaaattctaaagaaagaaatttgcaaattttgtaataaacactatttttacaacaattaataatacatgtgccaagcagaagaacgactatattagttttctatgtcaacatttaagaaacatttatttaaaatttgaatatttgattttgtatgtcagcaatgtttaagaaaactttgattttttgttttccttcttttgcgtacatattaaatggaatttaatagaaaaccattaaatcttgatataattaacttcttcgcccttgcagttactaacaaggagacttttgttttggtactttctcgattagtttagtgaccgaccaacaacgtattttaaaactcaaaacacaatctctttcacgtactgtgcgaagtgcaagtcgaataatgacatcagtccatttgtgttgtattacacgggactacgatctctattctactatatataattactattaattaaaatgtttatatagttatgatatggttgatagtaatttaatagtaattgttaaacagtagagaagtgacactgagacatatctgagaaaagcctgaactcaactcctacttctggtttgatttcttgggattcgttctctttcatttacttacctctccatctatacaccaacatatatatatatatattggtatgttaattctccaaaaaaaaaaaaaactattttaggagcaaaactttttcacagttattcattttttaagttaacttaacttctcttctttgtttgaaaattcatttatcatcaaataattctgttataaattagacctgataataattctttaacaaagaaaatatattttaggagcaaaataggcagagccgcagaggcatacatgtattatatataacgattatttatgtatagaaagggacaccttttgtacaaaatactagttaaatttgtacattcacgtgactggttggctaaatttagaatattattattttcaattaaaaatcatcgtcaatgttcaaatattgcttgagatacgctatgcttcataaaaatgtttaaaaagtagttccaaaaaatattttcaccaaaaaaaaaagtagttccaaaaatattcatttaataacaaaatttgcctacataagcttagcaaacgacactaacaccaaaattgatatcattttcttagataacatattgtatacatatctacatacatactaaatacatatacacgtagattacacgtatggattcagcaataaaaatcaaaatactaaatacatatatacatatatatatatatatatgaacatttaaatactaaattatgtttaataaataattaaatcaacgtagagatatgtcatatgaagatggcttgtataattagtttgtgtaccgggcaaaggatctctaatttttgttttctttagttcagtttaattatttgttatctatccaatcaattttttttctaaactgtttggaccaatgtacgtacgtaccatcctttttgattttttttgtaaactaaattttcgaattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatatatagatatatatagagagagagattaaaacattgatggctagctatagagtctatggcagggtcatgatcacctgtcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagac

SEQ ID NO: 873 - DNA, 3000 bp, Unknown
  misc_feature (1)..( 3000): cDNA_ID_3059344_gDNA_ID_1620331_Annot_ID_153660 3000 nt of promoter + ATG
ttaagaattttgaatgaaatgtgatatgtaaaaataaattaatattgaaaacttacactcagctccttttggaaattcgtcgaacaagaaggtgatgttctttaacaggctctgaacaaaatattatcaataaaaataaatgtaaaaatatactcaaaaatacctctcatctacattattcatttgtaaaaattgaaaataactattttaccaatgttattcctcccggtttaattggcgattcaatcaaaatcctcgcgtttctgatttttttttgtcaaatcaattacaagattatttgttaattagtatagatatgaaataaataaaaactgagatattttttcactaaacatatcatttatgtatgcagtgtaccatcctacatatataaatgcttgttgttagaaaaaaaaacaaagcactatgttcatctcctacttattagtacatatatatccctccaaaaaaacaagttaccttataaccagtcttcctccttcatctataaattcatagaagctacatcctcttgtaaagggaatttttcgtcctttccattcttcatacaataaacacaaaacgaaaggaagaccaatgcgactattaaacataagtatgtataattaggcaataagcatgagcgatatatgtactaaaacgtaccaagatgccaattaacagcagcactatgtccatcaccttcacacacattttcaacacaaaacttaacgttttgtcccatactcttcacaagttcttcgaagaactccatagcttcctgcaaaaatatgtcaattcattcacaaaacaaatcttgaaatgtataatatgtatacacatcgtatagatttaaaagtttgcggagagatcttatagaaaaaatcttacttgtttccctcgaaaaggctttggaaaggagaaatcatcgataaaacaatcgctggagatgcaactacttaattggtcttgattcttctcgtttatagaggaataaaatttcataacagcatcatacccagagatttgattcggcctagagttaggtcgatccaaacatgaaaccacgatatttctccttgaagcgtacttatttatcatttttattggatcattcttgattgcattcaactggctagaatgttgtagagaaggtagatctagtttgagccgtggagttttgaatttggtgatgagatttctcgtaactattatactcgtaacattaaccatggaggccattgttgtaatatgaatcgcttcagcaagcgacaaataaataattttgttatttttggtggagaattttaattatggtaaagagaatgtgaagatcattggaggagtttgcgaactatgcttcatatatgatttgttaaagttgtttcttgtaaagttctttacttcttgttgtaaccttttaatgttcttagttactttatgtagcaagaaatcttagcatatcccttactatagtaatacgattaacgtatcaagataactaagcatatctcctccaaaactttccggttcttttgattgcatcacatggttaaattttgtagacttatttattttaattttgaagttatccatagttagatcattcaatcaaaagcaaagttcaagatcagtctcaggccaagatcacaacttcaaaaggccaatttttagaccatgcaaagtaattaaactcgaacatctctaatcaaagaatgaaaggttaaaaaaaaactgctttctatttttaccctaatctggtggtcaaagtttactctttgccgcaacgtcgaagctcctgacgtcgtgtgtcattgtcggcaaaaaaaattgaagtctctttatatcggacatgtcatgccccaaacattattgaagggcagatttcaatattctttttaataaaaggataataacattataacaataacgaaacatctcatatctaaatcactgaagtatcacaaataatttgactaaaaacgtcggtacatgcactgtaattaaagaaaagaaaaatgcttaacaatcaataatgttttgggccttcaattagtaacagaacccattgattttttttgaatgtgatttccacaaaagtagatagaaataggcaaaaaagaaaagagctagaaattttaaactctctgatgaactcagaagctcctgaagagtagcagcatggatgtaataaaattgtctcgtagtctgcaacaacaagttgtcaacaacaccacccatgcccccccataatttatcattttcataaattgccccaaaaattatagttttatttctaaaccaacccctataataaataaaatagtcctagctcccccaccacctccaaagttctgctactaccgacacatattttccactacaatccatacacgtgtccatgcaaaaatacttatcatagtaaaacgaaaaaatactagtagttataattgtatttcttgtttcccacctaattaattcttaaatctccttaagcaaaatttgattgactgtatattttgtttgtcggtttgagtgtaaaatacagtaaatgacaacaaaaaaaaaaaatcaaacgcgaggatatatcaattgtttatcagagctaaatatgacaaatatcgtataacgttttttgttaattactctactcatacagataattccaagatcaatctaagagtaacaattagaatctaacctttatcatatcgaaacaaaatagattagattttttgctaactaaaagtataattttctttttgactatgacattttaatatattaatatataaactaagtaaaatgagtctctttcacaagacacttttgtcttctcttttagaaaatcagaacagagccactgcatgttcttcttctcaatctcactttcttcttaaacccataaaatttgtttccatcgaaatatttattaccaattatttatatttcttagattttgatttcgtttccttttcttcatctttggttcttaagatg

SEQ ID NO: 874 - DNA, 3000 bp, Unknown
  misc_feature (1)..( 3000): cDNA_ID_3059340_gDNA_ID_1620331_Annot_ID_153661 3000 nt of promoter + ATG
attaactaaaaagcattaaatacaatgatcaaataaaatctagttgtagttaaaactacttactactaattaaccaactgaaacaaaacacaaagattcgtattaatcaatcaaaatatgttatttagttagaaaatcatagaattttcatttacagattgtgtttggtgtaaaagaaagtaatattaataatctgaacatgttttacagttaattaaccaacttaatttaactagattcatacgaatctatgagaatatttctttactaataagattatagtaaaaacataaaataaaagtgataattactgacctggtgaaaaccgagttctttagtgagtggaacaccgagttcagccatgcaagcttgcatccgatcatcggaaccgtacaacgccggataccttttaatacaccgatcttgcattttgctcaaagccaccgctaatggataacttatagcaaatcctccaccgccataagccattccataagagaaataaatgttctgaagatgactctccgataaactgccgatgtaatacatttgattatgatcgtattttctcaaaactctgattagattctcggcgacaaagactgtatcatcgtctcccataacgaaccatctcacatctttgagtcctaatttaagtgtctccgtaacgattcttgaaattctaatcgccgatctgtgtccttgtttgtttttatacggaaacttcgatgtatcgccggagattttcaccggcgggaggctaatttcgtcttcttcgtcttcttcagtaactggtttttctaaccagacataactacgcatttggtttggtttgtaccaaatcttgatgtactcttttctctgtttccatagtcttgccgacgcggcgataccgaaaaccacgtgttggaaaccggtttgcggtggcggaggtggtggtggtggtgaaggtggtggagaggcgtatgatttgattacagccgtttgatttgtgtggaagagaatcaacggttgagatgagttgacaatgtcgttgagacgacgaacaacggcggagaatggctccacttgacaagcacgtgagtttgagataagctttagtgtgtagacaacgtaagtggcggagacgaggaggaggagcgttaccataagtttggatacgggtcgggtcggtgaaccggatccggataaagtccgttcccacattagcttctctgctggatctttctggttattcagcttcatcttaagaaccaaagatgaagaaaaggaaacgaaatcaaaatctaagaaatataaataattggtaataaatatttcgatggaaacaaattttatgggtttaagaagaaagtgagattgagaagaagaacatgcagtggctctgttctgattttctaaaagagaagacaaaagtgtcttgtgaaagagactcattttacttagtttatatattaatatattaaaatgtcatagtcaaaaagaaaattatacttttagttagcaaaaaatctaatctattttgtttcgatatgataaaggttagattctaattgttactcttagattgatcttggaattatctgtatgagtagagtaattaacaaaaaacgttatacgatatttgtcatatttagctctgataaacaattgatatatcctcgcgtttgattttttttttttgttgtcatttactgtattttacactcaaaccgacaaacaaaatatacagtcaatcaaattttgcttaaggagatttaagaattaattaggtgggaaacaagaaatacaattataactactagtattttttcgttttactatgataagtatttttgcatggacacgtgtatggattgtagtggaaaatatgtgtcggtagtagcagaactttggaggtggtgggggagctaggactattttatttattataggggttggtttagaaataaaactataatttttggggcaatttatgaaaatgataaattatgggggggcatgggtggtgttgttgacaacttgttgttgcagactacgagacaattttattacatccatgctgctactcttcaggagcttctgagttcatcagagagtttaaaatttctagctcttttcttttttgcctatttctatctacttttgtggaaatcacattcaaaaaaaatcaatgggttctgttactaattgaaggcccaaaacattattgattgttaagcatttttcttttctttaattacagtgcatgtaccgacgtttttagtcaaattatttgtgatacttcagtgatttagatatgagatgtttcgttattgttataatgttattatccttttattaaaaagaatattgaaatctgcccttcaataatgtttggggcatgacatgtccgatataaagagacttcaattttttttgccgacaatgacacacgacgtcaggagcttcgacgttgcggcaaagagtaaactttgaccaccagattagggtaaaaatagaaagcagtttttttttaacctttcattctttgattagagatgttcgagtttaattactttgcatggtctaaaaattggccttttgaagttgtgatcttggcctgagactgatcttgaactttgcttttgattgaatgatctaactatggataacttcaaaattaaaataaataagtctacaaaatttaaccatgtgatgcaatcaaaagaaccggaaagttttggaggagatatgcttagttatcttgatacgttaatcgtattactatagtaagggatatgctaagatttcttgctacataaagtaactaagaacattaaaaggttacaacaagaagtaaagaactttacaagaaacaactttaacaaatcatatatgaagcatagttcgcaaactcctccaatgatcttcacattctctttaccataattaaaattctccaccaaaaataacaaaattatttatttgtcgcttgctgaagcgattcatattacaaca

SEQ ID NO: 875 - DNA, 3000 bp, Unknown
  misc_feature (1)..( 3000): cDNA_ID_3059358_gDNA_ID_1620331_Annot_ID_153649 3000 nt of promoter + ATG
ccttagggctaaggtgtgattttaagtattataactcatcacattttgcgtctctcctagagttcctcttggttgttggatccaacacgttttatttctccgtgatcaaaaacagggtaaacttgaagatagaatggctggtggaaaagaagagtacaatgcattcttctactcgcttgtttctaccgatacacaggtaaatcactttattgttgaagtagccataaaaactgaaattcatcagaccaaatcagaaccaaaatataattcagttctagtccgcactcgtttccaaaacacagaaaaaattttgctttccagaacccgtgacttgaattcctgaaccgataaaaatcgaatgactgattgaatggagaatgactgatgtaaggatcgtgaatgttgaaatgcaggaaatgtattattcaacgaaaagacagcagtttttgatcgaccaaggttatagcttcaaggtaataacaagcctcccacctccggacgcgggttcaagcttgggctaccacagtcaagaagaacagttgtctcttctcggaaaggtgttgaatgctggagacgatatggttggtttagaacaacttgaagaagacacagatggaaaggctctaaagacgcgacgaagcatgggatcgatgagtgcaatgtccggtgcaaatggaagggtctacatggaatacaactcaggtcgtcaaaaatctggtaaccaatccaagaaacctaaagacccaaccaaacgacacaatatcttcaaaaaacgttatgtttgagacaagagaactcatattcggctatatgttttgagttgtaactttggtgcaaatttgtttcaggcacaaaatcaagaaaacctaaacgaagacaccctaccttaaaagaccgttaacatttgatatttgttttattatgtgaattgattaattgatattagaaagttctttccttttttttgatatttgttttctagcatatcatgatatcgcctcgagaatacctttgaaaattattttgttattgtcaactgtcatgatatctcgctgaaccaacatataaaacacgattataatttggttgacagatcctgaacaacagtaaaacgtacttagttttcgaggttaaaaaataattacttgtcatgatttcgaattaaaaataataatgggctcaatttgagattaaagaaagcccacgctaaaagaggcctactaaatgcccatattggatccgttattgtagcctttctatatatgaatcgagtttgcatttctgctataacgttctctgcattcacatgatcacatcaactcagtaacggactcgacatacccggacctggacccgacaccgaatccgaatcataatgcgacggagacgcagctcgcttctcggtctagcttacaacggaaaatatttacggtaccgtttgttttccctctgtcgtagaatttctgtcttcgacaccggattgatataatcgattgaaaagacaagagataatgtctaaaattgattcgatgaagagaaaaagatcaatatggggaacgataaaagtctcgatcttactgattttggttaattttcatattaccctgcaaaaaaaagtattgtcaattctggggaattttgttgttcaggtgaaagatgaagaagacccgactctgtgtgttttttcttttaagtgtcgtactgatgaagaagatctgggtcaattagtcatccgttatggcccagttgttaagatgttatccaaatcgtaagaagaaggcccgacatgtttttgagacgttggtaagaagaaggtcttgcttcttttgtgcatccagataatgtctatatgaccaaggtaagagcatcctcattgcacatcctccaatgaatgtctttcatattaaataatattaaatttaaagaccctctctcttttgacaggtaaaatgtctactattaagacacatccatttattattttccacttttttaagtagtttaaaagtttaaagacacccataaaagatatgcaatgaggatgctctaagggaccgagattatatactgctgcagatggggtaatgtaatgctatttgtcttgtgcaggagcgttggatgtacattggtctcctcttggttcatactttgtgtcacttgagaaggagaagaacgtggcaactctttgggcattgaatcgtctcccattctcagaccatgtacattgcacaatttttatgagtatcataagcccaaaaatattaaattaatgaataaaataactgatttgggtttaagtagtatcactggagtgatttctttgataccagtctctgataacgtggcgggttatgattagttgggaaaacatgtttttgtgtgaaaagagagaaattttttttttcgattagtcgggaaaacgcatcttttcgattttgcaattttttttttttaatgatactaatacgatttcaccggtggaaacagatttattatcaatattataaaaagtttcaaacaataaataaacattaaaattaatagtaaaatattattaatggtactctatgagtaccaactatgtgcatgctctcatgcgctttccttcctcatcctatggtttgtctttcatctcccattttgcatatgtaagaataatcttagaggctaaaagaaaaaagaatgggctcaacgtgagaataagaaagcccacattaaaagaggtctattaaagcccatatttgatccgttatttatttgtagccttttgaatcttctactttacatttcccttccttgacattaatgattaaaccagtgatacccgaacccgacaccgaatccgattcaaaatccgccggggacgcagctactccctccgccaaatagctttcaacggtaaattttcacggcgccggttgtcttccttctttgttcttctcaggaatcgctaattgataacttcaattggaagatacaagacaaaaaaagaagatcaat

SEQ ID NO: 876 - DNA, 3000 bp, Unknown
  misc_feature (1)..( 3000): cDNA_ID_2127224_gDNA_ID_1620332_Annot_ID_153667 3000 nt of promoter + ATG
attaaaattattaattataaaaatacataaatttattacccaaagttcccaacaatattttcccaacaaaaattttcgacaatagtttcccgccaaactattttgcaggaaatataaattccgtaaaaaatttcccgccaaaaacaaattacacccatattttcccgccaaacaaaaggaaagtcaggaagaatattaaaaattaaggaaagattctacgcaattcagtaagggttcacgaaattcagattttttttttttgtaacccttcctgaattttatagaatatttcttgaatttggtgaaatctttcaaataatcatttctgaaatttataaagaattttacaaaattcagtaaggatttcaatacagattttttgcgaaatctgtcctgaatttcgtagttaccttcttgaacttttttggtgggaaaaatttgacggatattttttggctggaatagttttacggatatttttggcgggaaatttgtttgcagaaaattttttggcgggaaaatttgacgaaattgttttgcgggaaaagtttgacaaaaaaaattggcggaaaataatttcttttatttacttttttaattaaattacttatttatttttgacatataattaaattttgtagtgatatttttgaaatatttcaaaagagatgatatttttggaagaaaaatttattagtgttatttttgtcaatcctcctagaatatatatactattttatatagatgtagttttcctaattctgaaaaatttaaaatttcttataaattaaaacggatggagtaattaaactatcatttgttgagattaattttaaatttttattactccatccagtttttcttctcctttttactttaacttagtatatattctaattgaggcagtaaaagtaataaacctaatttgttgagccaaaacagcttagataacttctaagctgtaattgaataatataatgaattttgtatttgggttagttattagtaaaatataaaaagcataacagtaaaaaaacaaggatatgatcaaaattcaaatgcttatggaaactgattcacacgtaaaaatatataaatgtatgaaaactagatgtatttaaaatagaaattaattgtttgatctaaaaataagaaattgattgatatatcttttaacatgtgttacgtagtttttaacaaaaacatatgtgttacgtaatcttaaaattctcttaactgcaaagattgattatagtcatttgatatgttataatgttaactatattttttttgtatgaatgtaaacctatattcaacacaaaaacgtttttctcattaaatgtaacatagagagtagaaattttgaataattgcaaagcagcttagaagttatcggtacgacgggagtgaaaccaaaaccgcagtccgtcgtcaagtttagagttgcttagttgttgaatggtgctgaatctgttccaaacattatttttctaatgatttttgtgacttttggagccgggatttgcaggctcaccgtggcgtctagcgttctctccacatgatatggatcaatgcttgaaagacatacctgagagtgaagacatagaggttggcttggaagaatcgagtagaagggaagtgattgatctccagctctcgaagtgttgactacatttatatcgtgcaacatggttactttgcaacggcactgcatcagggtccaatttctgcccccaaatacttttgttgaagtactgctaaggatttgtttcaccatcaacagacaaaaatatctgcattattatgaagctcgcttagcaaaattctctcgattcctctctcacgatcacaaaacaacaatcacgaacgcatactcaattgtacatctcttgaaatgttgtcacttctctattcgattggtttgtaactccattttcctcgtttgtgaaagcaaaaacaatatttatttacaaatgtatgcatatcgaataaataaaagtataatattaaatcatactaaactgaagaaataccatttgtgttaacgttttcatgctgagtttcaatggtttttgataatgtgatgagagtttagaactggaagaagttatacttactctcataagaataatgattaggattacataggtttatatagtaaagagatttcataaactagatgaatacaaatatgtaaaatatcttatatcataactatacaatatttgattatatattgagaatcttctagatacttccatacccttctatagttttaactcaaaaatcaattggcaattggatttaaagaatataatgtgggattccattacacttacgatggatttgctcaaaaaaagaaaaaagaaagaaagattccattacatttaggatgtgagattcgtaacacgattcaaaataatagctaagaccttttatcttaccgaattcccttttaaaactgcaatataccctacttggatcaccctaaactaaagtctaaactatcattttatggttataaacttaattaaaaccaactgacaatgaattgaaaaaataatgtgagattccaaacattatttaatttttggttgtaaaatcccaaaaggtatatttaccgcctttaaaaaaaactaatgaaagcaatttaaattgtttctgtgtattctcatcatttcccgtcacttttgtaacaattccaacgttagaacgatcattcactcgcgtaaattgtttttattttattttaaagcgttttaaaccataacataaaaaagtttaaggatattataattttttatcaaaaattaatgatattaggttatcaagtggtcgagtaaatcatctggttatataaaattggagaaaaagattttctacctatataaatatagatatcatctgtacatgcactccacctcattgcaaaacaatttccccactatctatcctccataatatagtattcttcttttctctcctactttctctatagta

SEQ ID NO: 877 - DNA, 3000 bp, Unknown
  misc_feature (1)..( 3000): cDNA_ID_2127272_gDNA_ID_1620332_Annot_ID_153677 3000 nt of promoter + ATG
agttgttggcagtaaaagtaagatttttttttccaacttttcctggtaaaaaacgcaagacaataatttggcacaagcggcttgacgtcactatccttatattactgtaacaacacttactaatacgaaacttaaatcgtgcatgttagataatatagtaattagtacacatattatccatacaaccactacaggtttccaacaatccgtcattaaaaaaagttaaacatacaacaagactcgatatcaattggtacatggatacttaagtttatgctttatagataggttcaagtaattgtctaacacttatagtatggtttatcatggaaagatgaatgtattcaattatacaactattcattaatagtctcgattcagtacgaaatattctcaaataaagattggtgtgacgggccattaagaggaatacaacattcgacaggctttgtctttgtatatcaaagaataaaatcatactgttataataatacaaaggaatgtataataatgttacaaataaatacgtaagttatatagttaggatcaattgacgtcataaatagtaagatatgaaataggtctgttctgattctcttattagttgtcgggtgcagagtaaacagaaacctgcgaactgacacgtcactccggtgatggtcctgctagtaccttccccttcttcgactctccctcactcctcttacctttttttttggggtcaaaagtcatcctaccttttacagtatatactttaattaatgatgtcataattcatcagtttatgtacatttttagtaagaaactaaaatattaatgaaccatttgtcttttgctttgtaaggaactatatatttaatgaacaaatcagttatttagtacgaacagattaaaatttgagactgggaaaactagagtctattaaataatttcatcagtttatgttttttctactaatgacaaagacaaaacatacaaaccaagtcagttttccggttatcaattaaccgaagtatttcttctaactggttaccgaaaagaaattcaatttggtttggttttggttccttctttattttctaaaatcggttcgtaatcatttgcgaaacccgatcaaattttggtaaaaaacggtctaataatggtataatccgttctttaagaaacaaataactatctgagaaaccaatgtcgaaccgaaccgaaattcgcaggttactgaaggcaaattgaaagtacgccaatcggttcagcctagagaaccaaaacctagccgaaaaccaaaaatctatgtttggctcagtacagtattctcggttcgcgtcagaatcacagggcaaatgttaacaacactaaacaatgattgcattgtgtttatggaaaaacaattacaccaatcaccaaatttatccaatctacaaacattaagattcctgtaagtcatcgaatcagatgctttgtgtagacctgacccaccatgcttagtcaagacacaagtaaacacaaaacaaggaatgcttactaattacatctgaatcacaagtgtttttagatcgtgaaacactaactaacatatatcatactaagagcatataaacagagaacatacgcatttgcaacttacaagggaatgttaaaaggatgttgttttttcttgcctaacacttacccttacggtttcagttagctttgcggacttctctggtcagtttctggatgttcaggttgaggaaccgaaacacctccattcattcttgcacgtgcttctgcaaacatacgttgttgctcagctgctgcttcctcctcagtcatttgagctccagggttccatttcacgctcctctgtgtgtcctgctatagagtcacaaatgtaggaaacggttaacattaatcgttttttcgtctcctcgttatcaagagtaggagaagaaagtagagaatcattaccattgtttcatacttatgttgctcatacgcagcatagacttcttcaatgtattctccaaaaccaagaacctgtaatgccttgagaacatgctcaggagcaatcgtccgtttatcctctttgttacaaacatcattagattctgaagatacaagatttataaactctgcaaaaaatgttttaaaccacagtaagaaaaccaagaactctcacatatatagatgaactcagagagaaactatatgatcttacctacacaacattcaatgagaagatcttgagcatctcttgcaacacgaacatctggtggtaacatctcctttataattttagtcatcgtagctaaaacaatagagaacaacaaaacatattcttagcaagataataaaaaaatgaagtttatgatgctcatgaatcctataaccttcaagcagagttatatatagctaggtttacaaatcctcctatttaatgatcaatgagcaataacactaaccttttggaagagaagcgtcttccttggatttgccgactatatccattggatccatagtttaatctacagaattcatcaggttaaaggtgcttgtacacgaagatctgcataaagagcaaatcaaggggagatcggaaaaaaacgagaagatagagataatcgactcaccgtaactgagtcaacacgaaccaaatcggaaagtagacgagtcgcggtgagatctggcgccgggaaatcgatcggattgtacggaatataatcggagggattttctctctccttcgtcttctctagcagagtcgtttagggcaaacggaagaagcaaagcgcgtgaatcacactttcttttacaacgcttagagacggcgcgtgaagataactttaacttccttatagcaattggattttaaaacaaaactaatgggccgaaaagagacccgaaccaggcccagatatctcctccataattctctgattctgcttcttcttcttctctctgggactcgttcagaatctcgaattgctgctgctcctctcggtctcggtggtgaagacaatg

SEQ ID NO: 878 - DNA, 3000 bp, Unknown
  misc_feature (1)..( 3000): cDNA_ID_2127299_gDNA_ID_1620332_Annot_ID_153684 3000 nt of promoter + ATG
tactacaaagaacattaacacttcaagaagaactcaaagactctaaagtcgcattcttacttgagcaggttcgatatacaattaaatcctccttacttaaaacacaaccatgatcataatgttgattagcaaaacatgtatgtctggttttcttgcaggagagagcagaggcttccatgaaggaagcagagacggcgaaatcacaatggctgtgtcagatatgtcagacgaaggaggtggaagttactattgtaccatgcggacatgtcttgtgtcggcattgttcaacatcagtctctagatgtcccttttgtcgtcttcaagtcaatagaaccatccgaatcttccgaccgtaactaacaccaaaagtcaaatattaattacccaattcatcaaaggttttgtcctctatacattacaacagtttctgctaattcatttgtaaatacgtttaggtgttttcacttttgtatatttaagtaaagaaattttttattttaagccgctatcaatctatcatcattttaagcattgagtagactgggtattcaccctatcaaatatcaatatctcaaatcaaatttgaaatgagccaaactaggcaaaatcttcagagaccatcacaatatcagctaacgagtacaaaccaaaaaagctttggcttatcaagttttttctgacacttttctttttctagatgacatcaattgtttcttgttgtttatctacttcttctttgaatttttcttcttaacaaccaacatttgagcttccactgtttcttctgcatcgttcattaggttattatcatcaacattcaattcattttggaaatgattcaaaaagttgtatgtctccgaaatataggtatcgctaaggattctttcttcacctagggacaagactctcaccctagacaaaccaggggagtctaaagcttggtggatttgaagctccagacaccatccatagctatttttggtttgtctacatcaatgcttgtaggaataatttttttttccggagaagctgatcaccgttgtgatagagagacttgccaatcatatgtaagcatatggtctcatcaatatcataaattaataaatttataaatttatcagaatatattatgtatatgtaagaaaagttagtgaaatatgattctagtattgtttgtttttcttaaataatattaagttttgatcaaatattcatttttaatatgtttactgtataaaaaaaagttgtgctttttttaaaaaaagagaatatgttcttttacttgtatttgtatctaaaaagatgttggttatgacaaataaaacttcttttcatataggaaagttaaaaaaaattacaaattaaccaaatctctctataaattaataattcaacaaattaatatctctataaattaataaaatttcacgttcccgacattattaatttatagaagttttactgtattcctttgtgaatttccttttcataatttaaaactaagttggcaaccttttcatatcataaataagtaaattatttcaaactatttttctggatttttaatctgttcattggagtcatatcaagtcttgcttcgtatgatttgttcttcctactcataagagctttgtagacatacttagatttactagactatgaattgtgcaaattttgtaatgattaattttaatcatcttattactttctcgattcaagatgaattacggacaaagatgaatgtctgaacctttagcgttcaatcttttatttcttatcttttcttagtgatgcatataatgctaaaagaaaaagatgttagcaaaggagagacttttggattatgtatgataatggaaaaaatgtcacatggattcatcacagtgaaaatgatgaagatgaaagtatgactcaaaaggattgagtagttaaaaatttgagaatgaccagggagaaaggaagaaaatcaaggaggaaaatattttagtaaatttagatgattacatttgagtttttttttttttgtcacaagtgtgttttattgatattatagagccaaaagtaacaggccaataattcacaaagactaaaataaacaagcccaaagaaaaaaaaaaaaaacagcccaaaagcccaaatgaataaaccctaaactgaaggaagagaacaaatgattgttgtgcgccgcatagaaaacacgtgtcagtgggaaacattttgaaggacacataggaactggaagagaagggagtcgccgtcagaagcttcaattccggccgaaacaccggaaaacttgtttaattggcatagctcactcgtcgctcaaaagattaatggcgaaatttcagttgtagcttggacgagaatttgactccacgaagtgcaaatcttcttcttcttctttttctttttcttcctcttcttcttcaatcaacatctttttaactcttagggttcatcaatctttgaactacaagcagaagataaaaaaaaaacaaatcaaatctaaatccggtcaaaaaaccggagaaaaaaccggctaaagacgccggagaaaagcccgacgaaacaagaaagagggtatcttgctctcgggagataagccagccaccaccgctaaaagtagccggtcgatgccggaagctgagccagccaacgcttctaaggaagccagcgatgccggagtagaagccgaccaaacactgctgataaagccagtcattgctggccaaaaaagctgaaactctctgaaagatgaggagagagaagagagagaaaaccctatcaacgtgaaaataattacatttgagtttatatactcaaaacttggaagtaaaggtaaattaaaatatgattgttagaaacaattacaccaataataaaacgacacgtgtacactacgtagacgttagataaccacagcaaaaggatatgtattctcgaggcgggagagagaaagagaagagagtgagagagatcgaagaacatttacacacatca

SEQ ID NO: 879 - DNA, 3000 bp, Unknown
  misc_feature (1)..( 3000): cDNA_ID_4359744_gDNA_ID_1620332_Annot_ID_153686 3000 nt of promoter + ATG
tttttatttactatttaaaaattgtcaattactacatataaataaatttggtatgcggtgggttgttgtccgtggaacggtgactgaaccgaacaatgcggtgcggttcaaatagtaacgaatgtttttgcatatatatgtttttgttattatttgaactgcactgcactttatccgcagttgaacctaattgaacctaatgaaacttaaactggtttagtttgctaatattatttttattttatttttgaataacttttttttcttttcttttttgtcatctgatcatttttcttttttgctttcgttatggataagctgtaacgcggtttttgttttgaacattaataataattaattctattcttcgaaaaaagaaaaatatataatagtgtgtcgttttccggtggcgacgagagggagaaccggagaagagatctctcgttcgtttttttcccggtaaatccggcgagaaaaagttcacattgaatctacgagaaaatttccttccatttcactccacgagttttcacctctcttgttcaatctctcaacgtctctccctcgtttctcgttttcgctttttccccttttcctcttctattttaccggaatccgagaatttttgatcagatctagtttcagaaataggttagttccaacaatgttgacggaacgaggaaggcgaatttctggtttcaatgggagtttcgaatttagcaatagaaaattccgtggttatggattcgtagatcgatctcaaggtttccatgaaaggagtccttcaagatcatgttctgtttcgaaaatccttcgtatcacgccaccaacctcgtctccaccgtcttcggcttctacatgcgctggttatatcgaacaccgggtctccaagttcgatactctcgccggcattgccattaagtatggcgttgaggtatgtattataatatatgagtgtatatgctttggatgctggattagttttttttccttgtgttcttagaaagtgctatttcaggttgcagatatcacgaagctgaatgggcttgtaactgatcttcagatgtttgctcttgagtctctccgaataccattacctggaagacatcctccttccccatgcttatctaatggctctctaaatcatgggtacttttaagcctctttatcctctcttcttagatgacaaggctgtagtctgttactttgatttttatcttcagtgatggatttattcatatgttacttgagttgtgctactgtgcatttcccaagttcattcaaagaaacatagaccaggttatagaaagaagtttacataagatggaaaatgcttagtgagagttgtttatgctggaaaatgcttaagggagacatgatagaaaaccaagtgggtacaacaggtccttgtaaaagagcagttttgacgtttcaaattctggtttcctgcacagccaaaactcgaaagtttctatgcgcaatagtttgtgcctaatgggctatgaaccttaagtttcttggttagtgcatacaacctacgtcctagaatttttttcacattgatataagaatgaggacgtaggtaaggggacgagtaaagatgtcgagaattgagacagttaagtagagccttgaatgatcatgatggtagtatactgatttgcattaaagggcatccacatatcaaagtgatcctatccccatgactgacatatgaaatctttttgcagagaggattggtccgagcaagcttcatcctcagctagcaatggcaaccaccaggacgtatttgactccttccagtctttgaggttgaaccattcagaaaagaagatttctccagccatgaactccttgcaaggttattatggactgaaaccaaaaaacagaagagcttctgaaggttttgggatggcagtctacaagaacgaagcttctcaactccaagacaatgatcagtatctcactcccttccccgccaccagtactcccttatcccaccacagaaaatcaagaagcttggtagatgcagttatcgccgaggttaaccaatcacccaacccttcaaaagcaggaggaggagaagtgaactctactgataagccaatgagaagacgccaaaaatctgaagccgattttagttcacgagctccagaattgctgttgaaggaagagaacagaagcagcagtggcgcgttttctgcaatagctggaaaaaatttagcactgagatccaaagcatcaagcagagctaacttatcagcagaaaccagacatctcaattccataccaatcaatttgatggatgctcctgtgggagacagcttctcaagcgtgaggaaatctgttagcgcatctagtctacaagaaccaaactgtaacagcaacggttcatcgctatggccaacctcaaagtggaccctgaaacctgagttactcacacaagtagccatggctagttctatttttgacggattgcctaagccattaactggtcggagaaacaaaaaggctgtggactaaggttagttaggtacttaggttccgtcggtctcgttatcgactgtccacttttggtttttgtaatccaaaagcaagaagtcaatggcttttataatagattgaggagtaaatagaaagtaaaaagtgtattgctgcatttcattcattcaaaacaataaggcaaaataggttgtgacattgagagtcaaaattaggcattaaggttttgttgaatttaatttgtacgttagatgaataatcgaatatcagaatactgtattcaaagtttcaaagtatttattggttaagtagtttgcaaaataatcaaaaaatacaaaaaacaaaattttgttgtctaactaattttccactccaataaacaattaaaaaaagaataaaaaagagagtaactctttaataaatctgaaatccctaagctcaagacgagttttcatttctcgagcaatttcactcttccgagaacaaccctagattccg

SEQ ID NO: 880 - DNA, 3000 bp, Unknown
  misc_feature (1)..( 3000): cDNA_ID_3059382_gDNA_ID_1620332_Annot_ID_153682 3000 nt of promoter + ATG
caattacactttgaaagggcattaatgtcatttgatggacagaatcagttggacgtacaatgtttttactggtgagctcgtatgtcttttccctagttttaaggctttaccttttctagctatcaaataccaaactctatttttagtatttaaatcccggggagcctctgctttatttacattttcattaagttttaatggaaaaactgtaacaacaattcataactcggctctacttgtcgggttatgaagtcttagttacttgatgtcgagaaatcatctctcattgtgatgggaggaagcagttgttactattggttggctatgcgcagctttggtaaatcgcattcacagtttcttcaaaaaaaaaggtcttctttggtgcttgggtcaagtgttttcttcggattttagtttgtatgtttctatgcttaggttttggtttcgatctctttcgatttcggcttttaaatttctgtttatgtttctctttcatacgattttagacttcgggaaattcacgtttttctccagctttagtttccgaaaacttttctctcgtccgtcggctttagtttccgaagatttttctttcgtccgtcagcttaacttccgttatttgggatttgtatttcaccttagtttcaaaacaagtttcataaataaaatatttcagatgataaaaaaacaattcataattcggaaataaaaagttacaaacaatgtttaaaatagtacttaactgtttccatattttaaacattgtttttcccccacaaaaagcaggttcttgtacattcacaaagcacacacagatccgattaagatttagactgcacaatactcaaggaacgtgtcttcttcttctttttctttaaagaacatgtttactaaacaagaaagtgaaatttcttcatgagaatttgcaaaagagacaaaagctgatgcctacaacaactaagattataataacaaaattatgaactgaaaaaagagacatgttcagtcttttattgctttatatctttctgcagttaataaacgaatttgactacaatgagaagctttttctttcctattttttttattgtgatcttgtaagaaaaaatagtgtttaacactgttatttactattatagtttgaattatgttcttgatcaccaataacaagtaaagttggagatgtggtgcagtgataatgaaaatatactaaactaacaaaattaatttaaaaggctcaatggtttaagcatttaagtgtaaccccaatgtaaactcatttttctgcaattgggccaattaaatatagacaaccacaaataaatatcaatgacatcatcactgtatatcctaatgcttctcaaagaggcatataatactgtaatctccaatttttttgtttgtcaatttcttttaatcccaccctaccattgacggctgtggaggaaaaaagagagacaactaatgaagtaatgagtaattatacttttgctttagttaaagagccggctttagccgttttttactttcttttgtttagtttttgttttctactttattcttcttaagtagaaagtttacccaaaaaaaaaacccatcttaagtggaaagtaatagagcataaataaaaaataaataaaagagggttacaaaatatgcatatttattaaaggatcacatgtattctaaaatctgatatacgttagccatacgacagaacctcgtatagccttcaaatgtattaaaatgtaaatgcttcgtcgaattatgcgatatcacagattatatcttgtgcactaaaagtatggactatttcaaagaaatattcaataaccaaatgtacttcaaataatcattattagatgtaaaacccattacatggataatgtggatttcttctagatcgctctccttgtagaaagaataattgacatagtataatagcaaattgattatggaatagttaaggatgttcaaaagggttttaacttttaaggccaactcgacctgattctaaattagctcagttctgaattaactctaacctgtttttggtccgctaaattttgcataaataatatggttaagcctttttgtaacatggttttagtctgccagtttttttatttaattcttttttacaatatttttgtatgtataaataaatagctcagattttcttctcttaactaacatttaaaagttattatgcattcatagatcaggtatttgtttcatattttagaccctaatgcctaaaccccatgtagcgagctacaagagcaacttaatgtctgtacaattaaattaattatcgtttatagggtttttagaaaggcggttaaaaaaattatttatatataaatctaataaatgcttatattgttcaccaaaaagtaaataaattttaataagttcaaatttaaaaatttatttttaaaaaataacaaaaatatgttaaattttattgtaattataagttttactctaaatgaaatgattaatatgatatatgtctaactttatctctaattaattaatttttaatatgtgatttaacattatcaaaatatatttatatttacattagctcggtaaattttctgtgttttggattaactacaactttagtatagtgtaattagaagtggacaaatatgtataaattttaataaatacatcatctgaacttatctctttattttcaatattcttaataggccttgaattagaggcccaagtaaaaatgtcgaatattgtttttttttcacatttgtaacaatcggctttaataaaagttttaattctgccatttcctttcaaagtaaaaactaaaaagcttcccttgaggcaccacttcttctagagtcgatcttcttcaaccttgactcgtgagtcggtgcgacccagattcttcatgatcgtaatctcatcttctttatatattcatgggggtttgatcatctttctgcagcaacagagataacgtttaattcgaag

SEQ ID NO: 881 - DNA, 3000 bp, Unknown
  misc_feature (1)..( 3000): cDNA_ID_3059396_gDNA_ID_1620332_Annot_ID_153673 3000 nt of promoter + ATG
tggcaacgaagtcttcactatctgcaaaactcactcttccttcttcttctactaagaagacactgagtctgagacaagtctctgtttcacttccaacatcaacttcaatctctctgttatctctctttgcatctcctcctcatgaagctaaagctgctgtttccattcccaaggaccaaatcgtctcctctctcactgaagtatatataataatctcactttacttcttgaaatgaccaaaatgtctcctttttgttgatgagtgttcttgtgtcttaacaggtggagaaaacaatcaaccaagttcaagaaactggttctagtgtatttgatgcaacgcagcgtgtgttccaagtagtaggagatgctcttaaaccagctttggacactgctttacccattgcaaagcaagctggtgaagaagctatgaagcttgcttctcctgctttctctgaagcttcaaagaaagctcaagaagcaatgcagagctctggttttgattctgagcctgtctttaatgctgcaaaggtcagatttcttacattcaaatatgtatgagaacataacaatttaggttttggggtttagggtttgaagtggtttgtctgtgttttggttgggatgtagacagtaacagatgtagcacaacagacgtcaaaagcgatagaagatgctaaaccgattgcttcatcgaccatggatacgatttcttcagctgaccctagtgtcattgttgttgctgctggtgctgcgtttcttgcttaccttcttctccctcctgttttctctgccatctcttttaacttccgtggttacaaaggtacctcaagactccatatagatcatcttgagaacatatataagtttttgatttggttattagtgatctattttgtatctagagtctaattcaccatagcaaaatgctgacaattactctgtgtttctggtttgtgtttttttaataaaggtgatcttacgccggctcaaacgcttgaccttctttgcaccaagaactacttgatggtggatataagatcagagaaagacaaggagaaagccgggattccacggctcccttcgaatgctaagaaccgcgtgatctccattccgtatgtgtctatctaactttgataattcttttcattattattatactcaaaacattgaacctgttcttgtgattatcagattagaagaactaccaaacaaagtaaaaggaatcgtgaggaactctaaacgagttgaagcagagatagcagcattaaagatttcttacctcaagaaaatcaacaaaggctccaatatcatcatcttggactcgtgagttttgattattactcttttacaagaccttttttgtgaatcttgcttaatctttattggtctttttggctcgtaggtacacggattcggctaagatagtggcgaaaacgttaaaggttctcgggtacaagaattgctatattgtgacagatggattctctggtggcagaggatggttgcagagccgtttaggcactgattcttacaacttctcgtttgcacaagtcttgtctccatcgcggattatcccggcagcttcgagaagctttggcactaggtccggaaccaagttccttcctagctccgactgaaaacagaggatatatatagttttacaagtgttgtttagtattcctttatttctcaactttgagagatcttttgataagataagattttcgaattacttacttacttgtcttttacattgatgatcatatatggaaaagattacatcaaactgaagtagtagctaatcatctaaaagaaaaaatgtatgatcaaaaaccgggatgagtttggcctatagtggtaggaaaaaattgggataaagactaaattcataatgagttatggacaactaattgtaatatcacatagatgcacaatcattttggaccatctggtaggtgtgtgtgtgtggcctagccttatcacttagtgggattgccaatagctttttgccgaaaatccattttacaaatggttgaagataataaaaattagacaagtttttttttttgtggagtttagtttagtgctttcaatcatgtgaaaaccaagatataaattttgaaaactattataaatattgtgcaatagttgaagtatatacaaactatttttaatcaaaatgttgtctaattaatattaattgtaacaccggtcactccgaattgtaacaaaattgtctattttgctaacggattctacaccaaattaaataaaatttatatagactaacatatattgctctactgatccatacaatctaaattgatagtgtatatagactgaaatcaataaataaaagacataaaccaaataagatgatgatcaaaagtcgaaaagagaaagcaaaaaaaaaaggtgtaagagatcagtaccactacataatgtatatagactgagaccaatttcaagatacataaaatcatataaagtaaccaaatgtaaagtgttatcttcttttcctcaatatatcaatcaatcaacattttttttctttcactttcattatgattcctaacatataaataactaaacttagtttgtcccaaaaaaaaaaatacccaactaaacttaaggtaaaaaattggtcatagtaacatatcgacaatgtatataatatggagcctagattctgaaatgattcatagattaagaatacaagttcatatctcatacaatgtatatagactgatatcaataaaaagattcatatcataatataacatgaagataaaaaaaaagtaactcctatcaccaagaagaagaagataatccaatcagacgtgtaaagagcgaaaaaaagctatcaaatatcagaatcagattgacacgtggcgatcacgagctctctttatattacgtggacaattttgccactcttctctctgccactctcatcattttttgaatcattcatgatttcttagctctctcaaaaaaatg

SEQ ID NO: 882 - DNA, 3000 bp, Unknown
  misc_feature (1)..( 3000): cDNA_ID_3059391_gDNA_ID_1620332_Annot_ID_153675 3000 nt of promoter + ATG
taacattaattctaacttccatataatagaatgatttttagaaggaaaaagatatatatgatttattgttatttatttgacaaaaagtcttgtttttttttttgtttttttttgtttttagcttatggttaaagagttaggttttggtaaagtctattgtttatcttttgtaatgcgtaggtaaattttggtgatatttgataaattttaacaaaaaaagtgaaaattatagagttgataaattttggtgatatttgataaattttaacaaaaagaagtgaaaattatataaaaatgaaaagaagtagaaaagaagagaaaaactagagtgagaatcattagactgtcaatcatagagttggattttttattgaccaaaaagtacaaaagacgaggatgagagaaaattatgtaatgtacggtaaaacggtgagtcatcagattcctctttttcaaatttcattgattccaattgaaaaatctcctctccttccacttatttctcacatgcattctctctatatatatgagcagctcctagttttataactctgcatctatccacctctctctgtaaatttatctaaatgtttcttttaatctttttgagattaataatgatttgtgtttgttcatcaaccgattttctcagatctgtcaattatttttgtttatttatttatgatttatgaatgaggaaagagtgaagtcgctggaggcagcggttcatcgatcaattcctgtgaatatttatttttgtttacaaaagcaagaatcgatcgataaacctctgcatccagcgctgcttgctcttcatgacttttgtttaattgatatctatttgagtattgctgagaagcaggacaatggattcgataaagtcttctcagctgctgaaactaaatatttaaaatttatcccaaatctaattcaaagtattcatcttttagctgttgagatagtgagggaaaacaaaattcttgtatatgaaaaaaggataaaatgaaattgtttgtttgttattgttttgggtaacagatcaattatcatatgtgtttttgtttgtagtcatgtcttcataattgactcatattcttaaatcttacaacttcagttttgtcttaactttttttttttattgatctgttttttaacaatggtcctgaattctgatgatgcagttttacttttggtttacatgtatgtatcaaggtttgtgttccatatggtctttcttcatctagcatttttgtttttgtttgttgagccactgaatccaacttgtacttcttcagctttgcagattagtagatcggtttttttcctggctatgtcttttgtcactacagaccctcaacgctaattttgttcctgagcatggctatgttgttatgagttcctgatatgaaatttgctgtgatctcttggtttcttgatgcaatgtgtgcttttgcttacttctctggctcttttaagtattacctacatagacattgcataattctaaaacctttgcttttgcattactatgttcattcttggcaagtgataaggaatccacgtagaatagtataatacaatcaaaaactttgatacattgcgcaatgagtgcgtgatgataaccctttaatcaggatccaagtggtgatattcactgattaataaccttctagagagccatgctatacttcttgttcttttcgtattactatttatgaaactggctgttcaagaagaatcaaattcactccttaaactttcttgttgtaaaagacacttttgttataagtcattggtcttcctgtgtcctctctttttttccctcacctttggcagcacagagaaaaggtgagggaatcttgtgaagtgaaaggattccttagctcgtgggttttaaaattccttggagcaaaacttcaaatggtatcatgattccattttcaaattaggtaagaaaaggagaatcttgttctttttcaagatcaagacttgttatctttcttatattcctcacacaagaggggctgttaaaatatgagaaaatactgtttctctacaatgttcttatatagaatttgtgatgatggtagcactactaataatatgataccactctctaggctgatgctttaacaaacatgaacttaatagcatagtttaaatggtgagcttgcttgttttaaggtctagtaatggtactactatacattttgtggaattatatacttgtaaatgctatggaactagtgatcatgtgtgtttgctcgtcttccttcaatcatgggaaagttaataaagtgagtctataattttactagtagacggttgaccaagtgtaggtagtttacttcacttgatcagcatgctcaaatctgttcaaatttttaggagagtaaacaggaaccacaagaacggaacctaaaccaacatcagtccaatttaagatacttggttttgtacggaatgaagtttaatagcagttttcggtcttggttcatacaagatgatgtttattggctttgattggtaacacaatttgaggcgcttggagcggaggttgaaccgcttctttgattaccaatcgaactgatggaactcattgttagaagaggcggctaaaacagatagctacttcgtgtacaaccataagcatgtttcaatgtacagtattcattttttgttgctcttattctgtagtacacctctgatattactgctacaatgaaattcttgtacgacatatatcaaagtattggattggcaacgaacggctaagctttaacacaaaaatgccacgtaggattagtctgaccaataagaatccatctttcaaatccccttccttcaatcttaaccagaaaactcaatttatttataatctttagaaaaaggtacttgaagaaacagtttgcagacaacattgaagagaagctctaaagattctttgtctctttctctgtcgcattgatttgtaaaaaagtgtggcagagagaaaccatg

SEQ ID NO: 883 - DNA, 3000 bp, Unknown
  misc_feature (1)..( 3000): cDNA_ID_3059451_gDNA_ID_1620333_Annot_ID_153694 3000 nt of promoter + ATG
catgacaactatatggtgattgctaaacttcttcagctaacatattccaatgtagttccccagatttgcctaaactttaaaaccacaaataggcgatcttacatcctgcaaatattcccagccaggattgcgtttagccaccaagtcccgaagttgatcatatcgcatagattcctgatcacagaagacataaatagttaaactctcattgatgcttaaagctgaagtattcaacaacaatagttcctattgaacagaaaattctatgcaatacagatccctgagtacatcagtatcccacaaatgtctccaattccatagcacaaacctatccagatatggaatcgaaactatgttggtgtagcaaaaccatcccaaatgaggattaagaagattcaactatcaggtaattgtagactaaaccttttacggtatgcatgctttaagcctctagaagaccataacctcaaaagtgaagcctggcaaataactcatgctgaaggagatctacatatgtagaaagagatactaacctcatattgccaccatattttcttcttgacatcttcatcataatcaaacccacccacaatctgaggcaaagtgatcaaccagaaatttgcaatgctgggatctttcatgctgtgaacaatgtgctgaaatagaaaatatgactcataagacggtaaagatgtagtaaacatagcaagctgttgggttgataaatagactttgtggtgctcacctcgtacggataatccatcttcttcagcacattataggctttccatggaggttccatgatctgcaaaatgaatcgtcagtaaaggtatttagcaagtgatagttttgttcaaaaccaaactacctctccatgtgcatttcatttctaataactagtatatatacatcccacaggggatttatgtagatgttaagctgagaagacgtaatagcagactcaaaacatacatcatcagctgagattctgacttgcagcttgttcttgcactcagtacagctcatcgcacccttcaatatcaatagatgttccatcaaatttctaagcatacactgatgaaaaacagcctatcgcgatcactcttaacacaaacaagcacctttttacgtggatatgaaattagcatagttgacaatttggagatataaaccaaatcagtatcaaatatagcagtgcaaatacatttacagaagcctagagcattaagagcgagattaaaaagcttaccgttccatcacaagttgggcagtcttttgatggcaatggagcactatggttgaaggaggagggaagatgaactaactcagctcgattctcaactatagcatctgcgacacaatctgctgttggtttctctccactacaagtaaagacagaaaggataaatctttaaatccttttatctgttagaatatcactaggatagcttaagcattgccaaatggaactgtcgacattaatatacagagaacacaaagagaccgtcagaataaagtggatctattcatgaagcctagtagtttaagcgatataacttgggttaaacaagagataatcccaccttctcaagttgtaatctttgatttggtaatgaacactccctgttcctttgcacatagtgcaccgtaatgcctgccacccattacaagttttgcaatccctgaccaacaaaaaatgttttcatctcatcggatgaactcaaacagtagaaccaaaaacatagcgaggaagtgtgagaactgaggtttctcaaaaattctctgacccagaataaagcatcaaatcttgaagctgacctttggcatatgactttctttcccaaatccaatgcaatgtcataagttccaagcgtagcaaccgcctgcaatcaatggaactccaatgataaaaagattccatatagaacaagtaaaacatgcattttccagtttcctaaactgattttgatcttacaaaacttcgacttagaaatcaagttgacaaactcagacagaaattcagcacaatataggcacactcaaattaaagctcaaaactttagcaaacattcgaagcgtaatttccccggaaacatcagctaccaaaaacccagaaagaaaatgatagtttcaagctagaaactcagcaaaaaccaacaaaagtttcaacctttaagacaactacatgtcaagttctaaacccagaaccatataagtttcaggagaaaccaactcacaaaaacagagagatacgaaattttggagatgaactcagggatgccaaaaccacgaggtgcagagccagcgatatcaaaggcgagagtgaaaggagacaagacgagcttgattggaaaatcgagaatgtctataacttgttgtccataacgagtagagaattgtttgaattgagcatcagcgaactgtgtcacgttctgtattaaacgacctggtcctctcgacattggagaagatgaagaagataagagcttttctcgctctctggtatttttgaagaggaggtttcaagagtggtttttacactattcttatctcggttttggattagacttattctttgttaccaaacatgtaccttctaattagactacgtgtcgtttctttgtaagaaaaacgacaaggagtttaatttgagaaatccccaaatcgagcgtcttttctatatttgcggcgatgacggcgaagatacggcggaggaagcgccgtggtatagaaaaaaaatattgaaatttgctatgaaagtttttttttttttttatgtttgttctaactctaaagcaagaaacatgctgtacttaaaaatgcaaactttacgaaactttggacctttagattaaataaaaattaagggaaattgtaaaaaggaatcatattctgaaagcagccaaaggaaagctcgccagataaacctgcgtttcattcccctacaaagctctaatctttcaatctctatacctctttctctatctctgagaatctatg

SEQ ID NO: 884 - DNA, 3000 bp, Unknown
  misc_feature (1)..( 3000): cDNA_ID_2128077_gDNA_ID_1620333_Annot_ID_153702 3000 nt of promoter + ATG
aagattgaaaaggaggatggaggagtagaagaagtgaagaagcagagaggtctgactctgctgtctctgaggatatggcgggagagattcttgcacggaaagtgtttgatgaaattccaagctaacattttcttctttttttttcacctaattatcgaatttaaacgctgtcaagtcacaaatagagaaaaattaagaggaaatttccaaaaatgtagatagaaagatattttcgtctaaatagacacacaaaagcttagggtttaattaattatacaaagatatacataataaaaaaaagaaaccttaaatataaagtatatatttaatatttaatctgaaaaccatgaaaatcctgaaagataagttttatcaaaataggatacgctttaaatatattattactatgaataaaattaaatacaaatattgagtggttatcctaaatctaggttgcgtcatatatatacttttgttttctcgtagaacactcaaatttccaacctttacaaataacattgttttcttttggttgtagacgtaaccaacataacgtttgtgaacttatctattattttcattgtataatacaatgtccgtagaaaacaaattgaaaagctaaagtcgatacacggaaaacataagaaaatatactaaaatcaagagatgaagctctcgaaatcattggaaaagtaataatagatataaatattttatttgtcaacatgcgtgcattatgcatgattgaatatggatggtgacacaacgacaacactagcacaaattaaaccactaagttatcagttatgacgaaagatataagtgtcttactcatttcaaaaaccgtataatattgatctctatacctaaaattaaataaaaccaaataaagcgcttaagtgttaatgtatgttagttataaatctgtagttctttgaggaatatgatcatcttcacgtggtaattcgaagcgacacaatggacaattgtagcgaaccttaaaccattccataatacacttattgtcaaattcatgaccacaaagtaaagtagcaacttctcgtccggttttaaactcctgaaaacaaattgcgcatttgtactcaccactagaataggtctctcgttttctcatgtatcttgtgctcttgttagcaatagagctggtcttttgtttcctcttgtatattctcctgctcaaggctccgacccttaaattgctcgcgggtctatactcgctattcctctcatattcattcaaaggagccacatcaagagtcaaccacactgacaaagcataacgtggacagtattcaaacgaattagaagttaaatcacgtgcaagttgagtgagttttagtattaacgtgtaagcatcttgtgaatcaactgctgaatctgttaagaagtaatagagtctttgtttgtggggagaatcttcgtcgtcagttaattcattggcaggtaatgaacatgagaagttagaccgggttagtatcggcgacatgttggctgatccgacgaaacttacatagacttggattgtgccaatctttttgcgttcaggattgacatcaatatggtagttgaatacaggagtagcttccatgatgtgggtagaccaaagagatttgtaatgtgtaaattcagagattcttatatttatactctattgaggcggtggaatagtccacgtaggattattatttggaaaatttatattaccttttatttatttttcggtccaatatttcctttttataattggtttccaattaaatatttgatttacagtagtgaattctttccatgaccaaaacttaccttacattcttttttgttgttgacttttttgtttcctcattggcctttttctttctaagaagaatcttaccaaaatatgataaattatggaatatatactaaagtattaatactaattaacattttaaaaaataaaatactacaatttttatagtattttaacaaagtatgtacatatatttatgaacattatatgagaagtaagtttgtaccacgttaaaagaaggggcaatgaaactcttttgttgaaatttgacgtcaaaactcgaagctatccttaatgaaaagtgtatgaatttcggtttcgattttgtaatgagataatgataaaatcataagtatttgatatagaatatggaattttgcgtttcctctatttttaaaatttagagataaaacttaaattatttggtgaatatttttatttgaaacttttctaatttaaaaagtcaaaattttggaagataattatgacggcttaccctaaacattaaatataaaaatatcatatgtattcatacttcttaggccatagccgctaaataaatcattacagttgttggatttttttaattatttcggttcctttgaatcgaactatttttttttgttcgagatgatatcgatttcgagaattaattttccgtgagttcttcttattttactatatatcaatattgttttgctgatgattttaaattcgttggtttatgttttaggtttattgagcatgggagtttctatccagaatcatggttgttcgtattttgtatgagaaagaatcaactagtgaatggagagaattaaagaaatcgagattgaacgtaacgagtggataaagaaaaaaacgaggtattattaatgaaaaaaacagcgtcacctagtttcattataaatcgaaattgtagtagatatgaacataaggtccgttcgatgatgatgcttaatggataaagaagacaatttattttgaaaaggaagaaaatacaatctttgaagacgatgactatgatactgatgaattgattatcatacgactcggtaattttgctgcatggttattgctgtctagtataccctatggggaaattagccttaatttgtgttcatggttcatagcctttgaccaacataaaaattctaccatctcaaaacaagtttcatttgcaacaaatg

SEQ ID NO: 885 - DNA, 3000 bp, Unknown
  misc_feature (1)..( 3000): cDNA_ID_3057935_gDNA_ID_1620333_Annot_ID_153708 3000 nt of promoter + ATG
gcctttaatctaaatatatatcataaattaagatatttacagtatacaattatttatacattacagaaaacagagtccatgtagccatataatgctatattaactgctcttctccttacctactcttcgactgcttgagcttgaccatcgagataacaaataatttggtttttgttttgggaaagtctatctgaagtaagatcctctttcgaaccataaaaattacaaatatgtattatcaaaaaaatgttgaccacaaaaagaaattaaacatagattgggctattagtttactcaagtgagtaggtcacaagggaatatctactgtttcttaatactgtgttaacctcctgcatttataatgctatcattatttattttattgggttctcttacgtcaaatagtttattattggcatttgttcatttgctttttgcagttattaaaaaaagatgatatgcggtattaccaaacattttagaaaataaataaaagttttgtaataaatgattgataaaacaacaacgaattttatggtaggacatatgtttttctgtagagaaaaacaaatccattttggtgttcgaaagcagccataaatttcagatcaatagaaaaatataaacaatttggaaaagaaattgaaaaataaaataaagaggatgatatgtatatagaatatcaaacactctactattgtgttaattaatcaaaaggggataaatgtggtatttaaagtgtcaaaaatatagcataaatggaatgaaggtgatagaaagtagggagtgtgcattttaaccttgaaaaagtacggatattagatatttaaagtcataagaatatttttctcgttatgaaaaaaatgctaagcaaacaaacaaattaaccgtgaaaaatatatgtttaaattaagataaagtaaagcaaatttctaaaatttggcaaggtcaatatcaacattgtaatctgtttggccattgttttcagtttaagacaattaacactttggcacactagaatgtattcaaaacttcataaattcaagtaattacaattatataatgttattgcttcggttcatagcttggtgataatcttttacttcaactatctgtaattaagacaggaaaggatcttattaattagatttagttactgtcatatgcagatatgtctaaaaagacgtatagatagacctacaatttctagatagtaataaatactactattaaacagtagtagcaggtgtaatagtcttagcatgtctctgataatgatttttaatgtataattattactttgcatactttataacatcttcttttttttaactaatagttacacacatgataagtccgtagatatgaatactcgaaggggagagttattttgatttaagtttatacaattttttcatacggttaaaatagtcaataagtctgtagttaatttattagtagaaattgatcaactcactatctttttagtttgatcttaaggtctttacatttttgggtgtgtcttttattctttagtttattctttagtacatttttgggtgggaaattttaaaaaacaagtcatgtcaaatagggctaaaattgaagttccactaaaataaataatttgtatgagataataatcaaaatattggaagtaacagaaataaattaacaattgtgaaatttacgtttagtcatgtcattttggtggacctgtaacaatcaacataattgataattagttatttgatgagccataattaatttatataaaaaaggagaaaaaacagacttgagatagtaattaagaaaactacaaaaccaggcagcataaatatcttctctgatttgcaacctgtaacttcttgattaaattatttttcaatcttacatcataaatctcgttgcttgaaaataatgaaatttaattttcttttgctgagtcttacaaatgaatatgaagcaatgaaaagtaactaaaaatccatcacaggagtaaaaaattggaaaatggaaaagatgaaacaaaaacgaaaagaaaatcaaggaaaaaaaaaagagaggtgaaaggtgtagaaggtggtggcgtgtagtaacgaagtctctgtcaaagtttttgataaattaatcatgtactgtgctgacactccaagatttgaaacagccttatcgatataatatccatttttctattaaaaataaaaattgaaactcttcactttccaaataactagtgtatatgtctaataatgtatccctcactatactactattgtttcgattagtcattgtacgtataataaattattatgtatcccaatttccaaacacaataataaaaagaaatttcaagttcgtagataaaaaaaaagatacaatctgaatcctctcttttattttcatcactgacagagaataccactgcactttttctcatgcacgcacgcatactcagatagaaacaagagcccattcctcgtttctttaataatttaattcaaagaaatacggacacttcatgattaattttaattttgtaattttaaaacaatctcgagttatgtaaaaaatatatcgataaactcaaaaatgtgatgtaataatctgctttggctttgctctctttactacaagacaaggcagagaaaaccacagattcctatgaaagagtagacgtacctgtctttttattattactaaatttataattatcttctctacgactttctggtttttaatcttttaataattattttactttcactaccccaaaaaaaaagcttccctctatttcgccgttttagatttaccaaatcccaatgtataaaaaaaataaactaataaaaccaaaaaataatatccatccacattattaccacgccccttactcaagaaccatccattatattaacctatttatcttcttcttcaaaacatttgagtctccttagggttttttctctctcaaacaaaagctttagatctttcttcttaatg

SEQ ID NO: 886 - DNA, 3000 bp, Unknown
  misc_feature (1)..( 3000): cDNA_ID_2128097_gDNA_ID_1620333_Annot_ID_153710 3000 nt of promoter + ATG
ctgctcttccttgcgtgagatctacactttctcagactcgatccctaccatggctgcctctacatcgcaactggaagatactacccgtgagattatagaaggtacttccatactcaacatcgacgatacttccatactcaacatcgacgatgtgatgacatcgcaactggaagatacgatcgagaagttaaagaaaggtacgcgaatatttgtttattctgttattcctagtttctaaaaatattaaaactctgattctgttcaattttccgttttagtggtgaggagtttggaagagataaatagaaattcaaccatggcctcactcacatataagctttaccgttttatactggagaaagaagatgaggctgccgccgaactcaacgctgtggacacagactctatcgagacaaaggttgtgaaaagtctaaaatttattgtcgacatattattgattgagacaacagtttaactttaaactgtctggtgcagctggtgaaactagaaaacaaacagagatatatccgtgaagttgaagacaacccgatcgacatccgtagtttgtacaggcctaaacttgttaagcttttaaaggagagagggtttacaccattcccatctgaagataagcctttctcacactatgactacctagatgttgctttacatatggaattacctattcaaaaatacgaggagctatgcgatcaaaaaaatgtgttgcaagacatagtttctattttgaagaggattattgatgcctatcaacattaactaatctgcggatttggttcaagattggtcaactagttttttttttcttttatgaaagctgcagtctctcaattgctatggaaagatcaaaatagtagttacaattctgcattgtaacacgaatgttttcttcttttagctttcagtttttgtgtgttgcaaactcttttgttaaatttttatggtttcttaactcgtttgtcatcattttcttcagccttgagccgtagaaactaaaatatacatagagtttatgtataaatcaaggcttccgcctatcgtcaatgagctcatgcttaatgggctaatgccgtattttccctttcattaggtccagtggcccattgaccggtttgattgtccgtccatatgtttacagagaaactatatacttttatgaatttatctaatatataagatctacttgtaaaatacacctataatgattagttgccagagaactcctggatctgtacaagcagattcacattcttcgtatagacacaatggttataggacttctttaacatggagaaacaataacctgctggaagtacacttagattctcctaggtcttgccattttcatatttacacgcatttagtttctttctaggtgtaatcatacagatagtgtttagttaaaatcgtgaagtcagcccttaccatattatatatatatatatatatatatatatattgtctatcaaaatgtttgagtataactttctttataattttcacaaaaatcattcttcaattaccacttttagttttttaaaaatttgaatcttgaattgaaaactttcgaaatacacagatgtcctctagtagaaaggaatgcgttaaaaactatgaaacaaataaaaaatcattatgagaaaacagtgattcaatgagttgtggtctcttctccatttggacagcgatagtgagacgacgaatacgatgaaaaataattttcttttttccgttgtgttagtttaggagagggagagggagaagagaggacaaatggaagcagcttgcgtaccaaaagtgcgacacgtatgtaaagagtcggaaggagacgtacggtgtaagtcatctcgtcttcacaaatatgttttggttttatcttatgctttgtcttatcctacgtggccattaaatcgttccattcgtctaaaccataatatcaaatcaaacaatcgtataatatcttatcaaccgtaaagatggtgtggtccgtttctctttaaaggtttttggtttggatgattctaaaacgtcacatgaattcttttttagattaccaaaaagttatgggctgaagtccataatgttttcggattagggattagaacattcaaacatgggatatatattgtgtcctttgtgtgttgtatcaaatttgctattgtttgctgcatatatttatctgaaattcgtaagtaaacctcacataaatttcaaactcatgcgtgtgtgcttctcatttctcatttggtttaaaaacaaattcaccctcattaccaaaattgttttgactttattaatatcattaacaaaccatcatcagtcaaatatgattatttagacatatacattgcctcggattttgaactatggccacgcattttttcatggctatgcaaatttcttttgatagctaattattaattattagttattataatatataattgttttttaatttagttttaaacgatgatatcggtaatgaaacaaatatttatgggctaaaatcgtaatttcaaccatttcctagtttggtatatttgtttgggtagaatatataaaatcttaacccatctcctagttgggttaaaatgtataaaattataagaaatttagtgcaattcgtacttaaaccaaaattttttgggttaaatccaaatttcactcctaataaaacaaatccatatataaacaaggttattttctggtcaataataatgttatttttttgggtcaaaataaaataatgttatatgaaggagaaaaaacgagtggctggaaagtaaacaatattttcttagttttcttctccaatctggcaaataaatctcactctctcaatcaaaaacacacatcaaaatcaaaaccttctcttcttcttcttcttgcgagttgcaccgaaacactcaacaaaaccaaatcatccaaattgggtaaaacaaaagaaactaacaagaagaagatcgaattcaagaagaagag

SEQ ID NO: 887 - DNA, 3000 bp, Unknown
  misc_feature (1)..( 3000): cDNA_ID_3059447_gDNA_ID_1620333_Annot_ID_153695 3000 nt of promoter + ATG
tcactttttacccgaggccattctctttcgtattgtgaatccttgatctgtgaatgtatggttctccggataggcccgtggtctggggtagcagcatccagacccagttgatgaagcttaatggcagcatcgaacagataatggtaacattcagcctggaagtgatagttaaagtttataaatagaaacaaacaaatatatgaacataacataagaaaatggcgtagaacttattgttggtttctcaactttcaaccaaatattgaagtaacttgcacaaacctgtgtcttagcatggatccaagaatcaccccaaatgtaaactccgtgattgcgtaccaacactgctgttgcttttggataggcttctatctgcaaatgagagtgaaatatgtcaaaactaattaaaaccattattttgttgcatatattcaattcaagcttcctcagaacaattagacttacagctttggtaagtgaatctgttagttcattctcatatgctgtgttctctatgattgggacaacaagttcatcatagtatccgtgaccttgaatcccttttatcatctccatgtgagttatctatgaaatgtcggacaggaagaaacattaaaatgcaaagtcctaactctactggggaacctggaattgtctaccaaataagcattacagcttacacggaattctttggcttgcggattcagcatcgtcacaagacaagattccatgccatgactgtgaataacagctccagcatttcgcatctcatatgcctgcaccacaacaaggttttgctatgaaacttattgataacgtcactatctcaatgttattagagattggacatctataaaatgagaagggaaatcatacaaacaaagcaagtcaatttggcattaaaacaacccacatacaacttgtcgaaacacaactcactgaaggaaaaagagattgtcttaacatacatgcaaatcatatataagtttacacattacaagcaatgatcatgcaacctcactgatcaactgaacccaggaaagatatatttgatagtctaaggtggttctttaataagtaaagagaagttacaaccaaaactccattttcaagagtgtttgtgtaaacatcaatacgctctaaatatcaattcatttttctgagcccattgtgtttagttctaacacttcactactgaatccatctcaaccagtgcaacctagtgggtattctatgggtcgaagaaacccacttgacacatccaacgaggggattattgctcaaattggacaagttttaccttgtaaccgagttttcgcaagcgtttccccaaagaaagtcgcctgttctgcacttttttttggattgtaatccaacagtcattagcaaacaacgtatttgccattccagtaaaagatcactagctaaatgggaggaaggacaaaataccactagaaaagagcgacgagctcttaacatatttcgttcataaccatgtgctctaagaaaaatccttcttaacagaaaacattataacttgaaatccgtaactgctgctcaacactttgacgaaatccaacattgctcaacaatttgagaaaacaaaaaatgcacaatcatcaaagaaaataccataagataaagaaggccaatagcaaagtgataatcaagctacgtatacagaaatccctaacgcagaatcaagtattactaccttgaaagcgacaaaaccataccttcatgaaaagtggagcacaatcggtacacttgggaggcttatttgggtatggctttggagagggtgtagatatgatggatccattagcagataagatgtacatatcctcaggttgcatcctctccttttgaacaccttcaaacacaacaagaatcagtaaaccgtgaagcaaataaaataacacatagaatcagcattgcaagattttcctttccattcaacatcttgcattgttaagtcgctaatgattcaaatacacaaagagaacgcttctaagcattgaaagaccaaaccaattctccacaaaaagagtgttaccagtgattttaaatacacaaagatgatctctagaaacagaaactttaactgataaacgcattacgcatagctcatatagcaaattaaaggtccacgagaacaaacacatcaactcaacagagcaacgacacatacatcagttcaaagatgcatcaaaatgagaatcaaggagaaagaaagtgactttaagatgtagagaacctgaaggagacatgacgataagttgctccggtttaggaatcgaagcatcatgaactttcatcgttatgctaccgccagtgccagacacccaaccttgagtataaaagtgacggcagagttcagtaaccaacgaactcgtctccttcacctccttcccttccagatacgcctgtggcaacccgatcatcgccgctgcagccaccgccatagattctcagagatagagaaagaggtatagagattgaaagattagagctttgtaggggaatgaaacgcaggtttatctggcgagctttcctttggctgctttcagaatatgattcctttttacaatttcccttaatttttatttaatctaaaggtccaaagtttcgtaaagtttgcatttttaagtacagcatgtttcttgctttagagttagaacaaacataaaaaaaaaaaaaaactttcatagcaaatttcaatattttttttctataccacggcgcttcctccgccgtatcttcgccgtcatcgccgcaaatatagaaaagacgctcgatttggggatttctcaaattaaactccttgtcgtttttcttacaaagaaacgacacgtagtctaattagaaggtacatgtttggtaacaaagaataagtctaatccaaaaccgagataagaatagtgtaaaaaccactcttgaaacctcctcttcaaaaataccagagagcgagaaaagctcttatcttcttcatcttctcca

SEQ ID NO: 888 - DNA, 3000 bp, Unknown
  misc_feature (1)..( 3000): cDNA_ID_2128059_gDNA_ID_1620333_Annot_ID_153697 3000 nt of promoter + ATG
ggtgtatgaaaatgcacttttgagtatattataagatattgcaaagaatttactagaaaaaaatgaaaatcgttcataaaaaagatatataaatcagagtagggcggccatccacttggtttgaaagagaccgaagtggaatccaaccatatgataatacacataaagatccaaaagtaatatagtcctttttcgaattattatcaatcctatgaatatactttttccaaagaaatatgcatgattcatgaatatacgtaaaaagaagtaaattagaaccaagtgttttcccacatgacatacattacattacatagtatcagttccctccattattctgtacttccattaccatcccctttataaccactatcaaaatcatcgtttatatgttatacaaaatcgatttcattaaaaaaatgtttgtgatctaatggggttgcaccgtttaggtcaaaattgtcattctctgatacataatgtcaaacggataaacgaaagcatgcatccgcagttcgaaaatttatgctacattacagttaaaaagaccattatatataagatttgctaatctcccctaaaactaaatgacagttcaaactataatttcaaagatggtgtgaatacgtaaggaaaaactattatggaagttatctatttagttataatacacaaacaaattggccaccgtcagtacactatcactccagccgagctaaagctcgtgtgtcttttgtgtatatgcggtttacaaagaaacatgattgaaaataaaaaaagaattggttggagaatgatactaaaattcaatggagtgggaccaaatgaaagcatcattattaaacgagaagaaaaagacagaattgttagagaaatgtcaaaaaagcacagtaataagtaacccaaaaaaacaaacccaatcaattctctactttcattaaagcttagtaagcaaatgtgttatgtgtgagtgagattgtgtgagagaaaagaagaagataagtgagagagaaagagagaaagagagaaaatgaagttcttgttccagtgtccatgttgctcttgcttctgcttcatgaaaccaaagccgggcaaaccaaaagctgttggagatacaaaaccaaaggaggagaagaagaaagaggtgaagaaagaagagatcaagaaagaggagaagaaagaagagaagaaagaagagaagaaggaaaccaaagcagagaaggctgagtgaaaactctactttgagaaaatgtaattaattatcccatttttattattatttatctgctatttgatgattatgcaagtaataacatgttatttttatggtttggtaacctttttaggcaaattatggtttaatctcttatattatatcattctcttgtttgaatttactcttatgatcaagatgtggaagattatgtttatcgtttctacgtaattttcctttaatgaatttaattaaatcctacttatttaagtaagtgtatgaaccaattaaaaactgaatctagttctttttgggcttgagctaaataaaattcacttttatctttgttgttcatagagtttcactgaaaagtaaacaagaatatcaatcaaaacatgttttttttaaggattatctacatcaagaatttataagattctaaatatatatttaagtcttggttttgttttttctcttgttttgaattttggttactttaatttggatcggttagatttcactctatctttttttttttgtctaaagatttcactatatctaaaaacgccaattcatgatataacaactatggtctggaaagcgatacatgaattcgttttcttagtgcaaatacaaaaacactccgatccaatttgtctatgttagtagtatatcaactaccataataatcaccgaaaatgaatggtgtttctaatagaaaaagggcttaaaacatatactcaccagtcaccaatgtagtttaatcaacagtgtgactattcttctatacccacatctcaacaagctcgaccttattgggtctccctcactaagtgtgtctcctatctttctctctcaatcactccatattttggatccatgtgatcgcgcgtattcataaaattagtagggtttaagatacatgttaactttttttttttggccaagatacatgttaactcaaatgtgtttattcaccaaaaaactaaggtagttttcggaagaaaatagtttaacaaaaaagaaaagaaaaatgtgatctcgacgtatttaaaatctgatatgtttggagaaaactgaaatattgtatttattcaaagcattttccacacgatttattcaaatcacatgcccatcttcgtgagctattcaaattaacttgggcttcgaaattaacaatgcccaccacatctcactaaaaaaatccagtccccgaagtccgttccttacaagttacaaataaggaagtaatagctagcacctagctggctagtttagaattcagaaacaacaatccgaaagtagaatcatataaagagctaatcactactatacaagtagactcaatagctttcatataaatgaaatcaaactaaaaatggaaaaccagcccattttgtcaatagttttaacaaatttaaatcatcattaacaaaaatactaataattaaatagataaatccattaatcaaatcaatttttatgggaagtgaattaatacgtgagtcaaatctcacacgtcttcttaacataaatgccttcaattttatttcacaactttcaaaattattattaccttaccaaacaaaatctctttgatataaagaaagaaagtcttctgtcactaatcttcgtattccatttttgtaaatttcagagattttctttgattcttcgtaatctcataagttcctatatatattcattacataacttcactcattccacaacacaaacacaaaagacaaaacacaaaaaccctaattttcagatctccgaaaaccatg

SEQ ID NO: 889 - DNA, 3000 bp, Unknown
  misc_feature (1)..( 3000): cDNA_ID_3059473_gDNA_ID_1620334_Annot_ID_153731 3000 nt of promoter + ATG
ttcaaaaaaaattcattccatgtcatatgcatgagaaattgattcaaattgatgtttaatcaaaaaagaaataaaattgcacctgaatgaaattcaaattgttgcttccactcctctgcctttacgtcccaaacaacagcagttctatcaacactaccggttagaagatagtcccccttcttgttccacttaagggaaaaaataggtcccttgtgtttgctaagagtacttatcagttcacctggaaatgtgaaaaagaaagacgtaatttgtaatttagaagctgactctccaatacataacagaaggtggagtaaatgtttttggccaaggatatgatacccaatgcagagttataatgttttttactagctgatagcttttattgtttcaatcttgtgtcgtgttactatcaaaagcccacacaactcgaacatcacaatttgtagctcacgctagaaggaaacatagagatattaatttaggcataaataactaagcatattcattgattcatagtaaaaataagattaatttcaagaaaatagagatgctagtgatacaaggggatgacacatacaaggagtgaaaccaaaaaatcaacgtggacataccatttaaagtccagattcttgcttggccatcacatgaaccagttgcaagtaaagtcccttcaccctgaaattcagaaatcagaataacttattagcagaatctaaggcacaaaaaaggaatccagaaatgcttcaaatatcctatggcttttgaaattagcagtaattagcagtgaccaggaatatctattttcatttaaaaattcagtagcccttacattccagtcaagagtggtcacatccttgctcttctcgtttgacttgccttttgcatgcttcaggattaaagcgttgatattacgaccagtatgcacagctttgaatgatccttccggaatactccagattcgcgctgttgcatcaccagacctgattatatgcaaaagatgtataaatggaataagagaacaaattatccacaagtgcattcatctttctcaacaaacaatttaccctgacgcaagaagtgaagctgagggactccatgcgcaagcacaaacctaaagtagtaatgtagacaaaattgttataaaataaataccagtgaagatggaaaagacctatagaacatgtttaattatcggataaagtcacctaataaagtacctcagaagtatgcccttccaaaatcctcacatcagaattaggaatgtgacttgtctgagatgtgggagtcataacaatatccataggttctgcgcctgttcaaataaaaacacagattcatatttgaaatagaagtttcatgaaaagttggcaaagaaaagtatgaagagttacctgtagaaccatccccagcaatttctttgtcagtttggtcaataaccatttccctatcagcatctccaagctgtttttcatggctcttttccctctctatcttctctctttccctctcccgttctatttctctttctttctctaatttcaatctatccttctccctctcaaatatttcccgttccatcttctccctttcccgttccttttctcgttctatcttctctctttccctctccttttcacgttccaatttttccctttccctctctcgttccttctgcttctcgtgcctatccttttccttagctcggttgcgatctccttcatgttctcgttcaacccctttatcgttttctttagatctgtctctttccttctccatatccctctctttcctcttcttttccctcagcatatcctgcagttcctttacatcctttgaaatcagatccaagggttgaaagaatgagaaatcctcatcaatgtccacttcactctgcgaacaaaaagcacataataactcagtctaaccacaccaaacaccatgtgaaaaaaaaaaaaaaagttgaaaaagtatgctaacattgctcaaattagcttccatctccatgtactgaagacctttctgaacaaatttgataagagcaccaggtggaaccatattcccatcaatgttggatttattaatccctgcctcataacctagagtgaatgcagcgtgtgtaaaccctgcaaaacaaagataggattgatatagaaaaacagagcataaactacttcaatcatctaaaataacttctagtgaagaaagtcttcagatacagaaaactcaagctcccagactgacctcgacatggaaaaatcaaaacctagattcgcgagtagcagtacgaactagaagatctaaatgatcctgagctatggagacattacgaagatccttaaaactacaattttcggtaacatcgctgaaaccctaagccgaatccacgaaaacaactaaaacaattctaaattcgtagaacaaggcaacaacattcacaattcgaaatcaaatccaaaacctcagccagtagctaccggaacacatacaaattcaaaaacaaaagtacaaaaaaatccgcgagaacatagaaagtctatatttatcgtacctgattcctgaagatatcggaaaaccagaaaattcaattcgacggaggtaagtgaagacatctccacagccaaatcctaactttaaatcaccgaaaatggagacaaatcggagaaagagctccgagcaaacaacgtcgcccaaaaagatttctcgagattataaactcttctcacatgatatttgcaatctccgacaaaaagtaaacctttactgggtaaccaaatcactagattatcgtaatgggcctatcaataaccaataacttcatatttttcggcccaacccatcgtatatttttgactagtctctccagaactatgtacactttcttttctttttttcgctccctcgtatattataatagtgagacctctggtatttttttgactactctccagaatcatgcgactagtctccagaattatgtgttcacgaatgggtgagatg

SEQ ID NO: 890 - DNA, 3000 bp, Unknown
  misc_feature (1)..( 3000): cDNA_ID_2128025_gDNA_ID_1620334_Annot_ID_153742 3000 nt of promoter + ATG
taattattactgtattgtttttgaaagaagacaatatcccttgcaaaaaggattttgtccaaagcacccacagttgtcaacattttaatttttcaatcaaataatttatcaaattcatgttagtaaaattactgtattatagataatatgcattatacagatttaaaattgggtgatacttgtggatgatgctaacaaatatatttatcaaaaatttactttgatacaaaaagaaaaaaactgaaagttattcttctttctagttttacctgacctatatccaagatgatatcatcaacgacttgtcggaagattaagaaattttatatatcatacatataaaaaagttgatacaaattgaagtcaatgatgtttaaagaaacggataggatgatgactcgtgctggatgaaaaaagccgtagttgtaattggaccctcgtagggcccattaagtcttttgtccttcaccttatgtctctgagcccacttgctgacttaatattaattagctttatccatttgcatcaatgatatatcaactttctcataatgagtaaacttttttttcttttctaattgttatcaaagaacgaaactcgaatcgatcttacatttcatcggaatggaaaagtaatattttacatcaaagtaagagagatatgaaatgattgggttaaacgtttttcgtgtttatatatattttaaggaatttagtcgttgagagatttgataacatatgacgtaagatggtttctaaagacaaaagccatgtcactagcgttgtttttgccactaatgaacaggcaaaaactaataaaagggggtttacaaataaacgatccttcgtcgtgggagagtccaagagacatatgccccttcaacgattttattggtcgtatcccctaaactctttttcatctcctaatccacgcactttgtatttggttacattaatacgtcatccactacatgtatttttaaaatctagagaaaataaatgagtacttaatctactagtagtaccttgtttattgattccttccacacatgtcggatctgttttaaagtaataaatatacgtttttaaggattataattccattgacttcagagtgtgtgttcaatgattttttgtttgtgagttttttgtcggtatgtaacaattattgttttcatattggcaaatacatacaccgaaaatacattaattaaaataaggttacgtaattattcaaacaaaaaatagttataaattattgtcacacacttttcttttcttttactagattacagaaaaaattggtattcacttgcatgatcagaacgctgtttcacatattattaaagaggatcgagaatgttcggtaatgtcgggggtaatttggtaaatcaaaggatgggaggcgtaaagaatctggggacttgggaccaacggagatttgagagcgatcgagataaggaccagacagtgttcgaacacgtgatcatcacgtgactgtttcccgcatcgccggaacttatatccagacttggcatctttgggcctactatgaatttgacaactttgactaatctttccccatacatataacttagctgcatatacacgtaactgtaagttgtatatattttgagtaatttcaagtacaacgattttttttatataaaataattcacattcaattttatttatgtaacaaagggatataaaaatgggcccatgtcatcaagaatcaagtactaacttcgtttattgttcatatgttttacgtcaattctttttgactggctatcattgtagcccaatgctctatgggcccataatggattttaatcattgtatgctatattcaatgtgttttttgagcccgttaatatttctattaagcccaacagccaatacccaatagtggtagtagaaaaatacagtaatacacgatcgagcgaaatactaatttttgtactaacaatttcagtgtctttctttattgatctacaaagtgctcaccaacaatattagcattttaaaactattgtaaatttaatctttcaaaaaaataaaatttgttagttggaactcactttaacaattaattttcttatataaacgtattattagaatttctttctaattgactccttgacattgtagcccaagaccattgcttcctatatctacttgaatagtacttgtcaaaatgcacagtgcacgaaacgaattgtcctttcacacccgtcttggcatataaagttcttattataagtgtgattggcccactcaagatcgtctctaccttagcttatcatatataatgacaagggtaagagataagagtgattaacaataaatatcttctctaatcaaagtatccaactaatttagcttatcatatataatggcatatcaactcttatggtcgaaaatgttgtatttgtcgtggtgtttaaatcaacgacgccaaatccctaggttatatgtcttctagtccctgttaatatctcaaggcaaaggaatcctcccccaacattggatttgatgtgcccacctaatcatatattctttggtcgaatatctcctcaaatttttgtcttatacaagcaaaatatatatagccacggggcgtggtaactacgtcaacaacaaattagaaaatcattagtttaaagatatgaaaaatagtgaaaccttttttaaaaaaaaatagtgaaacttacacactgagtttagactgtttataagcaattttttgtgtttttttcctccagtaattatctaaactggtacgaactaacaaatatctatattatacgagaacttggaggaaaaaaccacgtaagaaaaatgtacaaactgttacgaataataaaatgttttgtccatatacatagagataccaccataaatgcagaagactactataacctaaatttagctatttcagacatataaacgcctatatgaattaagacccagagaaacgaaaacgaaagcacacatg

SEQ ID NO: 891 - DNA, 3000 bp, Unknown
  misc_feature (1)..( 3000): cDNA_ID_2128021_gDNA_ID_1620334_Annot_ID_153741 3000 nt of promoter + ATG
ctaaacgttttttgtttaaataaataaatcatgtattagaacttatttacaatgtcatgacacaacattaattatttaggaattaaagatttaaatcttctaaatccttgcttttagagttattatatcattacctaaaaggctcaaaatataaaaaatttaaatattattatttatatatttaaactttataaaaaattattaatatttaaacttataaaaaggtttaatatatcataattttttaacatcattatataatatatagagtttaaaaaaatctcaattcttccgtcatattttgtgactcgaaattttaaaaataaacatatattaaccaattggcgaaaaatgtgtgagttcaacgtcccacatcgactaaaatatttagacaatgattcataaacatatcataaataagattaacatcaggaaaaaaaaaagattaacattaataaaataatggtatttttacgggacgggtttggcgggacgggtttgacaggatgttacttaataactattgtagatagatacaataatagagtatggtttagagttaaccatacatttgtttcagtaatgtaaaccggtataagatacactattactagatttttaagacatgtgaaatatatataagattcaccatttttgcagccattttaacaaataaatcttggagttggacttatttacaacccaatgccattagcattaaatctttttttcaaaataattaattttactttaaattcttaatttaaattgtcaatcacattatcaatcaaatttaatccaaacaaacttcacatcaatcccttaaaattagcataaaattattttgttaacaatattttaaaacaaagttttttgtttaaataaatattgttcttactaaacgttttttgtttaaataaacaaatcatgtatttgaacttatttacaatgtcatgctactgatattaattatttaggcatgaaaatatttaattaaagatttaaatcttctaaattcttgcttttagagttattatatcattacctaaaaggcaaaaaatataaattttttaattattattatttatatatttaaaattcataaaacattattaatatttaaatttataaaaagtttaatatatcaaaaaaaaataacatcattatataatatatagagtttaaaacatctcaaaaaaaaattcgtcatattttgtgattcgaaattttaagaatgaacatatattaactaattggcgaaaaatgtgtgggtttaacgtcccgcaacgaataaaatattttgacaatgattcataaacatattataaataagatcaacattaataaaataaataaattttttttgtggatggatttggcgggacgggtttggcaggacgttacttagtaacaattgtaaactataaaataatttacaaattatatatatattaatttaaaaaaatgaattgtctacgcggtgtaccgcgggttaaaatctagtagtatatacattcgtaacaattattagcattcagtttgatttttgctaataatatatatagtatggaatttcatactgaaactcattctaaaatttgaaatatgtagaaattaaaacagttaagtagacacctgtttccagttttgctaatatatattgcaaattcagaatatattttcaccggctaaccatatataacaagaaaacttgataattagtcttctaaatatgtatgaatcaaaaaatttagtaatatattatgtatatatgcatattttgaagaaacaatatacgactagtactcataaaacatagagaatgttcttgaagattggcatttgccaaaataaaattcaagtgcaatgaagaaaaaaaaagctaaagtaatgttgtcattagcatttttatttttatttttttccggagcatttttattaatttattaagggcatattttgcacatcagatcaaaggagtactttattacagaaattgaaaattcgtttgaagacatgttgagaaaatcaaggatcacggccttctgaaattctgaaccttgggtttcccatttcataatcacgagcttgattattactagtattggaaagtaaaataagatgattaaacaagtgattttctcaattacgtgtcactaacactaagggtaattatgatgaccaatgggtgacatctcgattttatcaaacgtcccttaacttttttcgacgtcgagattttataaaccagtaaaggcattctctttcacttttttcattccctcatttttatagaatcagtttaagtttttcaattgctaagggaatcgatcgcctatcaggagattcttcacatcccttataagctcatctgaggcaagaaaacaaaataaaatgattcaaaaactacatcaaaaaaaagtaatggacatgaaatgattcaaaaaaagtttttgttgctatttttgctctgcacgaatgtcacgtttgagaatcttatcccttcataaattccccaagtgtcaaatgtcatgcttcttgttgctcataaagacccttttagattccctgagatggatcccccaaaaatatatttcttattaggttgagattctctaacttgtcctttcaaatgtctatgggcctgaaagcccataaaagtcaaaatttccaaagttggcccaaaacagaaagatacttctgcgtagacattctacaaagtcaacgcttaaatatgtcatattcttttactaattcaaatcccaagttactagagaagcaactcgtcggccatcaccaagaacgtggctccaagttatatatgattcggccgaattttgaaaacttcttcaaaaacatatagaattgttctatcattttattgataacttccatttcaccattcctataaataccattcaatagttttcttcattctcacacaacttagacaatatctcaccattcctgtaaacacaaaaacttgtaatttccaacgaa

SEQ ID NO: 892 - DNA, 3000 bp, Unknown
  misc_feature (1)..( 3000): cDNA_ID_2128001_gDNA_ID_1620334_Annot_ID_153733 3000 nt of promoter + ATG
gactcccaagaagaagactcgataatccccaagttacacgttctctcgacttattgacaaatctatccctgcgcttatttaccattcacatatactgccacttcttattctgacgtggcgtaatagtattggataaaacggtattatctacccctaagtcgattatagtatatatataaagcaacaaagcagttgcaaatttcaagatagtcgtcactttagtcgcagcaccaccaccaatttcgaatttagcatttctgaattccgactctgagaatcggcggttaccgggaaatatgtcggagactgatagagagcgtccgttattagcatcggaggagagagcttatgaagaaaccgagaaagttctcatagtcggaatcgacgaagaagaagacgctgattacgacgatgaccccggaaactctcctaaattctcatggaagaagctttggctattcactggacctggttttctgatgagtatcgctttcctcgatccaggtaatctcgagagcgatcttcaagctggagccatcgctggttactctttgatttggctattgatgtgggctacggcgattgggcttctgattcaacttctatctgcccgtctcggtgtggcgacgggtagacatctggcggagttgtgtcgagaagagtatccgacttgggcaaggatggtgctttggattatggcggagattgctttgatcggagctgatattcaggaagttattggtagtgctatagctatcaagatcttgtctaatggattggttcctctttgggctggtgttgttatcactgctcttgattggtaagtgtttttttttttctcaatttggttattgatttaggaaaaaccctaatttttggaatttagggttctttattattgtttgtttggtatctttagttttgatcctaacattgtgtgtgatgggttaattgcagtttcatctttctatttttggagaattatggaataaggaaactagaagctgtgtttgctattttgattgcaacaatggctcttgcatttgcttggatgtttggtcagacgaaacccagtggaactgagctccttgttggtgagactctaaatattcctttcttttgtctagtgtgtggagatgggagtacaaaaatggtaactgttcatgttttttaacaggagcattggtccctaagcttagctccaggactatcaaacaagctgttggtattgtgggatgtattatcatgcctcacaatgtgttcttgcattcagcacttgtgcaatccagagaagtcgatccgaaaaagagattccgggtcaaagaagctctcaagtactactccattgaatccactggtgctcttgcggtttctttcattatcaacgtctttgtgaccacggtgtttgccaagtcgttttacgggacagagatagcggacaccatcggtcttgcaaatgctggacagtacttacaggacaaatacgggggtgggtttttcccgatactgtatatatgggcgattggagtcttagctgctggtcagagtagtaccatcacaggtacgtacgccggacagtttataatgggagggttcttgaatctcaagatgaagaaatgggttagagccttgatcacaagaagctgtgcaatcataccaacaatgatcgtggcgcttgtctttgattcatcggattctatgcttgatgagctcaacgaatggctaaacgttcttcaatcggttcagatccctttcgctgtgatcccactcctttgcttggtctccaatgagcaaatcatgggcagtttcaaaattcaacctttagtccaaacaatctcatggatagtagctgctcttgtgatagccattaatgggtatctaatggtggatttcttctcaggagctgcaacgaatttgattttgcttgtgccagtgatcatattcgcaattgcttatgttgtgtttgtactttaccttatctcacgaggactcacgtacactccttggcaactagtggcttcttcacataaagaaccacagagggatgatgagtgagtaaaggaaaagcaaagagaccttttcattgaagaataagaataagagagattgctctttttagtgaaacaaacaatagaaagttgagtttcagtatggtaacaaaacaatgtcctgatgtatttgtattatagtgttttatggtttttagagtatagctttggaagaatccgaatcgtatcgtttgtgtaaaacttccggcgtttcttagaattttggcagaaataaaacgtaaacatgaagttccttcttcagatgtgcgttatttcattttcttttagatagattttttttttttgggtttaagtatataagttaaaaaaaaaatcttaatatttatacatttagatatcttgatgtttttcaaagtaataacgtgaactctggttttgaatttcttagagaaaaaaaaaatggtcaaaaatggggaagaaatggtcaaagattaatggaaacgcgctcgcatttaatttgatgtttaaaggtcacaaacaatgtttagtcgtttaggggaaattcatgcacaatttctttgatgccacgataagctttgattgcaaatttaagttaaaaaaaattctggaagctagttttatcatttgataatgaaaatttcctggcaaacgagagtcgagtcgagtcgaggtatttaaatacatcacgtaagtttcgttaactgccccaaattaaattaaaaacacaggagcagcttctcctaatccaaaatccaaaaaaacaaacatcaaaaagtcaaaaattaaaatatttaaatacataacctacctaacaaggtttgacgcaaaacccgccacgagtctaacgcatttattaagagaaagtatgcaccaaaaatatcgttattaattgactaagtagaccgataaaactttatttaagagattaatggagctcataataaatagcaacaaaaatctttgacgatga

SEQ ID NO: 893 - DNA, 3000 bp, Unknown
  misc_feature (1)..( 3000): cDNA_ID_2128013_gDNA_ID_1620334_Annot_ID_153738 3000 nt of promoter + ATG
ttcgacttcaaactcgagataattcatgagaatgcgttgaacagtgtcagtatcaaacatggagtgatctccagtgaatgaataagaaggaatcaagagatcatcgagcacggcttgtcctaattgtaatcccattctgttttccaagtcaagtctacaagcaaccgttgtttcgaggaatattgctgcgcgtagaagcatagagagaaagctaaccgacattgcatttttctctcgaggaagaaggcttacgattgtttcaagaatcactcttttctcgtgttcttgttttggctcaatcttcttcattcctttcccgaaaatttcctgcatttgcaaagaaacgaaacaaacttttaacggatacccatcattctttgtccctagtttatggaacttcaacaaaagaagagactcaaccaaaatggtaatgtgtgtttgtaagaaactcaccaaccctcgaagagatttctgagcatagagcataagcactggaccaagtccatactgcttaaaccctctagccatcatcgcgatcaggacacgttgaaacgaatcaatcctaagaaccgttaagtcttcagcccaccaatcaacaacaggctgcttgctctgctgctgaaccacaacctcattgttaccgctattacttgaagaaggactgcaaaaatggctctcttgacaagtcatataagcaattgcatcgatgcaacggcttacaagtttgactctttcagcaatgggcaacaacttctctgatttgtgcaagactgtgatcgaactcgataagctcttgagagctacttcattcaagtaagcttcggctcttacaacgagattttccacagagtgttcctctgtcatctctagatactccgctgcacatcgcaacatggcaatgttctctgtgctcatatcaaagttaatgccgtagcagaacttagccgctagctcaaatgcttcagagcctcctggaatatctggtatcttgataacagtggaatctgaatctttgcttgattccgacacaagtttcttgataaacccacattttgacatgagtggaaactgcaagattcagagagaaaacaaccgaatcggcacgaatgtgatcatgtcattggctttacatcagagagattgatcgctaaatacagatctataatctaccttgtgcagtgaaaacgaagcttctcctacatgaacggtgacatcactagatacttcttgagaagaaatcctgaaacgatgtaataaagagtattataaacgatttctacttcaggactggaaacaaaaaatggattgagaaacaaaataatcttatgaagagaataaaaaaccattcactggttcttttcatagctgaggacaaaagatctttcttctttgctgacatattacgaacacttagctcgcagtttcttttcactcaagaaattcaccatggaacactatttcaagtccttctcatgaagaagacgtgccgtaatgtactactaaaagagagagaataagatcaagaaaatgagcttcttcctctcttttgataattgtgaccaaacagaaaaagagaactcaaattctccaaacaaagaaaaccataaactacccttaccaccaaaagcaatgaacaagacagaacagggtagttatgtcattctaatggagagtacaagatagggagtcagtctaaggagggagtgtgtgtggtaatggattggtttaaaaattgagaagagtccaagtggatcagacacacatctttgtaccaaactaataattccaaattataaaaaagagagtattgattcctctccacaaatgtatatatcccttacaaatattagctataaattggtttagtggtaagaagaagagaaggaaggagtatataagtaagctgcagaatcttggttttgtgacagaacatgaatgatgggatatttgtccctacagagagtcttatcatctttttttctgataattgaagtcactatatgcctcaacattttgattgagactctactcaatcttgcaataaattgtgtctcttgaataatataagacgtcctcaacgaaaaattcaaaattttcaaataattgcaaacaataaaaacagaggatgatacatgaatctgagtttttacctctagttgtttttcatggcttggtcagctaaatgagtaaagacgacagaatcttccctcgagttctcaacattggaatcaaaaatcagtattgttaaccaattcaaccccttcaagatcaatagctttttgcagtcttccacactatacattgagcctcttcatccatcaaatgcctcaactcctaaaacaaccatagcgtaatcttcgcgtgtatcaaccaattagctgttacatttgtcggagaacccattgatagtgataggagtctgaacaatctttaaatggctttgtcgcagcctccttgatgaatcgtggggacacagatagaaagtttccaccttttacttgcccattattgcagactttctcgagacttagctccattatcactgatcgaatcctcgcttaatgcaaatccgaaatttcaaaagcttcccaaaaataagaaccctaacatgtatataagcgggtggactatttgggtccaaatatattgggccataaataaagcccattatactatgtcaggcctttatggcaaatttagttggcgcaaaaataacgcaaacgaaaaaaggaaaacaaaaagttaatctggtgcggaagagcgtagtgaatgatagatacgcttttcttcttgttcttcctcttcttcgattctcctcttcgacgtctcttgttactgtgcgccgtcttagccttacgtgcgccaacggcgcactctcctatcctacgctcatctatcgtcactcccacagcgagagctgtctcggaagtttccggttgtactacgatcgatccagattttctcgtagagatctctgattctaaccagacgcgggcgatg

SEQ ID NO: 894 - DNA, 3000 bp, Unknown
  misc_feature (1)..( 3000): cDNA_ID_2128017_gDNA_ID_1620334_Annot_ID_153739 3000 nt of promoter + ATG
ttatggcaacgaaaatataaaacaaagatttcattaacgaaaatacaaaccaaagtttttatttaattaaggttttaattaacgtattattaaacatggaaatttattttccaaaattactggtactttaatgtaaaagattctaattttattttaataatgaaaaaatattttcttataaaatcatttaaatattcaaaaaatagttaaataatattagtacgttttttgtttattttggtaaaaacaattgcgatagtagtaatacgaatgagcagaaaaacattaaaaataattaaataaaactagtacgtttttttgttttattgtaattctgtttttttttttttggtttgatacaacatacatgaaaaatatatttaaaatataagacgtttcagacattcgaattcaggacaaattgtttaataagttggacagaagaaacatcaccttgatttaaaaaaaatactttgaagaaaagatgaacattaccatcatcatcatcagtaagtttatagacagagagatctctgtgtttcattgacttctcattctgctggtttctgctgccctaacttgggcgaagtaagcgtgcgcctgtcaacaaatcaacaaaccatattaatttacctaatatgtgatttatatacaaatacaaaggcttctaatttgttttctgaagcatgcgtaccatggcttcttttgcagttaatctgtcttgatgatcataccgaagtagcttgtcgaggaaatcaatcgcctacaccgttttaaacaaaacccttaagaacccaactaaaccattttctatacaaggagttaaggactcaaggaaaggagtaaacctcgggtgaaactaagtgctgattgtctgcgttgatgaatttggaccaaggtttcctgctatgcctgtaggttgtgttccattgaaccagagaatgatacaacactaattctcagcttcagctcattacatggcaatgccaagctcggagattacaatataatgtttaagtttcacataccgcccaacaagtgcttccagttgtggatcaagttctaactggtacttgttcagataagcattcaattcgtcagtcccaagcacctggtgaataagaaggagagttcatgacgacaatggaacggagatctcccatattctaatactgaattacaagtaatataccttggcgattttcactagctgatcctggttgtcatggccgtagaagaaaggttccttacggaatatctaatatgggtaatgaggaaaaattaggtcaaaattagatcaccacaagttcatttctcagaaaagaaaggaaagccgttcaaatgttatatcatgaacttaccatccctgcaaacatacagccaagactccacatatccaatgaatagtcatagtcttgcaagtccacaagaagttcaggtcccttgaaatatctgatacacattaggagagataaacattagagtgaagctaggcaacagcgaaaaaaataaaataaagggtatgaagtaaaaccataccttgaggcaacacggacattatactcttttccagggtggtaaaactcagcaagaccccaatctataagacgaagcttacgcagctcatggtcaatcataacattatgaggcttgacgtctctgtgcattattccttgtgaatggcagaagtctagtgcctgcaacaagtagtcttaccaaatgtgagtatgaagtcaaatggaatacttatataatccaaccaataccagaatttataccttcaacagctcatagatgtagtaacgaatgtcgtaatcagtcaacgtaggatacaaaactttaaagtctgtgctgttaacatattcaaatatcaagcttggagttttcgaatgttgatctctaacaacatcaagcagcttgacaatatttggcccaccgcataggttctgaagtattttaatctctcttcttatctacgaaaaaaagatcatagagagattcaagaaacaaccccaatcatccaaaacaatgtaaaacaattcaccttctttttcttaacaggtttgaggattttgataatgcacttctccttgctgttcacatttataccctcgaaaacttcactatattttccacgccctaccttccttactacctcataatcatcttgctccctgagagagcaaataacaagatcaaaatgttaaactaaaaaatcattgctttacaatagaagaactaaaaggcaaaataagcacaactaaaaaatcaaattcatcaatagagataaaagtaaagttttttacattagcagcatcaatttgattagattagcttcatcaagaagcaaatccagagcaagctgaattcaaattcaatacaaacactacaaaaatcgattaaattactttagcaactaccaattcagctaattctagggtttaacaatcttacccccattgaacaatgagtgactcgtaatcccaataatccttgggtcgaatcacattgacttcggtgtacacacgagctttcgacatcgcccgcgtctggttagaatcagagatctctacgagaaaatctggatcgatcgtagtacaaccggaaacttccgagacagctctcgctgtgggagtgacgatagatgagcgtaggataggagagtgcgccgttggcgcacgtaaggctaagacggcgcacagtaacaagagacgtcgaagaggagaatcgaagaagaggaagaacaagaagaaaagcgtatctatcattcactacgctcttccgcaccagattaactttttgttttccttttttcgtttgcgttatttttgcgccaactaaatttgccataaaggcctgacatagtataatgggctttatttatggcccaatatatttggacccaaatagtccacccgcttatatacatgttagggttcttatttttgggaagcttttgaaatttcggatttgcattaagcgaggattcgatcagtgata

SEQ ID NO: 895 - DNA, 3000 bp, Unknown
  misc_feature (1)..( 3000): cDNA_ID_2105155_gDNA_ID_1620334_Annot_ID_153740 3000 nt of promoter + ATG
tacatgcaacattatagtatatatggagcttaaactctcaaaatatggaatcattaatttaattaatcgaaagagactaagtaaaaaacaaaagaaagagtataaagcgcgtgatcatagcgtaggaggagggacaagacattactgcagaagtcagtgtctcgtttgctccaagaacctacgaaaacactcttcacaactctcaatctttcattttgttgggtctgatccacattttatcaaaactcggaaccaggggttgatataatattatgtggccattccaaaaatacataaataactgttgtaacaacaatttccgaggaaggaatgagcactccacaaacgcgggcgtcgatcggacccacggctccatgccattgccgctcctctctccggcaacgcgtgcctctctctctctcacatccacatttctaagcacgtttgtttctttagtttatttggttaattatagaaataaaattagtagctagttgtcacatgttttctagctaacataacagatggttataagtaaataacgataaaattgatacatggtgttagtagttaggttgacaaaatgaaatgagagatagagaattagtggctaggtttaaatctaatttcaactcaacatgttagctaataattcccacatatttttgttaagagatctaagagattgcgattcgaacttgttatatatatatatatatattgttatgaaaaatgttaacattctttgtatactttctagtttctatagctaaatagttaattatatatttctgaagtactttaggccaagtttaaactttgtataaataaacataacgacttctgacatttatgctactttatatttatatatatatggttttatttcctaaatcattccttatcgtaacatataattatggattagtgagttgtaaaggatttgacattgttcccgttacacattacataagaaattgacttaatatagaagatcaaatcaacacaaaacggccaactctaaagccatgccttgtattaatttaaatttgacataacatgcaaactcaacgagataataaaattttattgttgaaaaaaagtcggtccaggaacatttaatcagcaaaactttttcatataaacaatactaaaaataattgtgataattacttatagaagaattatttggtcacttttatgtgtgtgttttatagatacggtggagatcagatcctgttgggtcagtttttaagacttttgaacagttcgaaaggacatccttaacaaatctaacggctaagatctctttctccccccatacttgcaggacccacgacatgccacctatttctcagattctgattcgttcgctctctaaataccaaatttattctctaaaaagtctcttctaattattttagaatatctactaattaatcatacttcttctttgtataatacatttattaagacaactgggtttgttgatttgttagtctgggttgcatgtgattcaagctcagcaagatataagatgttccccgaaacactttattatatcttaatcataattattatcgaatcattttttattgattattataaagtttataagatatatataaagtctccaacaaccactaaattcacatttatttgacaatgtatatacatattccggagatttaaccaaaaaattaaagttctacgaaaaactccaaaacaacatcggtattcatgatgatgatataatatataaaatttcaactaccaatataaaaaccatgaatcataaatcccccaagccatgaatattattattctatggatgaatttaattttatgaatatgtgagggatccgaaattgaatctagtattgtctcatctgtcaagcatgtatccatgtacacgatttttgtagacatatatacttacatgtaaaattaatatagatcatattatttatatggattgtgtaagtaaaagctttgctggagctgtctgaactctgaagaggtggcatatggcatatttcttagaagaacctttgaaggctattggctaaacacactcttgttttatttgggctttgagttagtttgcaacaatcactctggttcttgtgatatgtgagagagagattaattaattgttaaacaaatgattacttaaaccttgtttttataatcattaaatttgtgaactttctttttaaataatttttctgcagtatatataactatgaagaatgtgacgcaccaatccatatctcttctctaagctcatcataatcatctgcttctcaagctcattattctcttcttaaaacaaaaacaaaaaatatctcttttaattttcttcatcatcttcttccatcgtataatcatcagctcctaaaccctaattggtttcaggtcagtaatgataacctagcactacgtacttattatctcttcttagtttgattttatttcttcatcagctttttaatttcagttttttttttttttttggatttaattcaattcgattattttgagattggtttgttttcattttagatagaacagctctattattattcccaccaaacttgacatcaattcttactgtgaaaaccacaaaagtccataagaatgtaaaagaatctttattgatgaaaagacaagattgacatgcgtataagggaaagaacatgaaccaccaaattggttttcaaagtacgatatctatatgttatgaaattttgtatgtatagatagatgaagatatttttgtgcatgtgtgctcagatttgttagcattagtggctaaaaattgcagaatctaaatcgagtactactagcagacaatttttttttaattttttttctgtccctaacaactttcaaatctcacaggttattacaaaaccgaagttccaagtttcgtcatatcaaatctccttgagatcttgatgaaataaaatcctaatctcttggaacatatcaaacatg

SEQ ID NO: 896 - DNA, 3000 bp, Unknown
  misc_feature (1)..( 3000): cDNA_ID_2128005_gDNA_ID_1620334_Annot_ID_153734 3000 nt of promoter + ATG
gagcgtgggaggagctgggacttactcggttaaagtaacttcggagacgacaggagtcaagatttcggttgaaccggcggttttgaatttcaaggaagctaacgagaaaaaatcgtatacggtgacgtttactgtagactcgtcgaagccgtctggatctaacagctttgggagtattgaatggtcggatgggaaacacgtggtgggaagtcccgtggcgattagctggacatagtcgtaaattatgagaaatgaaaggggttttatggaaaagaaaaggtgtttacagatttattgtaatgccgtttttagatacgaagaaacctctgtttagcaaaaacgacatgcagtctgttaagacttgcctagtttgtttttgggatgtcttgctgtttttaattttaaaaagaaatatattctccggctacaacagtagctgggtctctctaggtgttttatcatgtgacttgaaatagttaatgaagagaaaatgtttgaaaaaataaaaagttaatacaaaaagtcaacgattaattaccacaccatatacttgagatagtattaagatgtttctatcaactaagctataaaagtgtatataccgtaaataaccaaagtagagtttctgaattatgaaactttaccataggcatccagagattatcaatgattagatttgctggtgagaaaactcttttctgtcacacaaaaaaaaaactaatagaaaagcatgatagatttcggtcaatttatgggctttacaaggaccgtataatataatgggctcatttggccttattatcagtttccaatattttcccaagcacttgtggaactatttttcctgtaaatttctcaccacttcaagaaaatcgaattgtataatatatgttttcagacttcaataaatgtatttttcttaaactaaatggtggatttatttaatgtctaagttaacgattgtcagagatgatagtgattacacacactccacaagtctaatttgtatcatgccttccatggccaatgttttttcacgttgcatgattctaaacatctttagacttcgaagccaaatattaggcgcacgattaacgatatccacatgcgaaaattaaatacgcattatgtagttatatacacatgtgtgtgcattcgttaacatttagtatgtgtaatatgtgcagttcgatattttgaatttattatacaaaattagacgccaaaccaaaattaacaaaacaaaaagtgtgttaaaggtatcatttacgtgataacgtcccaatgcagattaacaggaagtgattgaaaagtatcacttattaagtaccaccaataagtgaaaaaataatgcgattatgagattagaagatgtgtataaagaaaaagtataaacgacaatatgatacgtcgtttcttgcggccctttaatcatacaaaacaaaacaatggcataagcgacgcatgagtcacaagcaatgaacaatagtggccatcatcttaataaataaaaagttgacaaaaacattttcttgttttgatttgcaccgcaagtttcaactatttttggtaccaccctctctatttttgctttttaagtcaaaatcttttataattatacaatttcgatctagacgtatcatatgatttcaaatccattctaccttttattttgtatgtgacaatattgtcttgactcgcggtgtaaagttcttttctcatgaaacttttatccttctggaatttgatacatcaatatataacttatcatttatataaatgcaaagagtcattttcattttatttatagtttgtaattatatatgtagtcaaagtctaatgtttctacaacttaagggaaacaattgtagaccattaatacgcgtttgacaaaaaaaatagatcaaactcctaatttctagctacatttcaattagaaggatcttttctgcataactttctgtctcttctctgttactaaaacatggaaatgatacttgatctatcctcccacgcatatgtaaaaacaaaattaaaacgctcgtaattaacaacaaaacaccaaaagcaatgataaaaatttactaagaatcatgataaaatgtatgcatgttgaagatgatggtgatggtgctgggtaaagtgtacccatcgcgtgccagaaatagtggcctaggcccactcctccacagacccaaccttctaagctattcttattcttattattattttcttggtttttcagtttggtaatatttatgttttcaatttatcggaaaaagtaaggtagaaataaataaaagcaaaaggctgccatatcttacagcctttcagctttatcatgtgtgttctttttcttccttaaaaaacccatagcaatataagcattttaatacgctttgttataataaattgtggctaaaattaaggttttaaaatttaaatgacatatggacagttttgaaacagactagtcttgtgcatatgcaagttgaccatttaaaaaaaaaatcagtctaagcattattttcaggattcaaaattaggcaagagaacaaaacacaaataaataacaaattttgaccatgctgtcactttactgtatacaatggtcacgatactgatagagaaaaggtaaggagaaaaaaaaccgtgtctagtaaactaggactcatacttctcatgattttctatttttggttaaaatttctacaacataaataaaaaagaaaaataactttttcttttattacgattgcttatgtctcgctccaagtatataaagatgtataaatacatgcaattatatgtatcaaggactataggttatgtgagaaataacaataataataaaaggttatagtcgtatttgacttttccaaaagaaacttctcttcttgtcttctttaaatattcaaattcgtcttcctctctttcgttaatgtgtttaatttaaaattttgtacctctctgtctcttcgttgggaagcttcgaaaatg

SEQ ID NO: 897 - DNA, 3000 bp, Unknown
  misc_feature (1)..( 3000): cDNA_ID_3059469_gDNA_ID_1620334_Annot_ID_153732 3000 nt of promoter + ATG
ccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttatttataactacgcttaatgatgataatagatcaaattaatacacaaagtatcacaaagtgaaagataaatgatccagttaaagaacaagtttgtcgaggattggtaaagacttgcatttggcaactaaaggcacagatttgggcatggtaagaccctttccttccgacatgtcaacggcaacgtcattgtctctctcccaatcgaaacactggatcaatgagcctaaagctaagctcagtactagttgggccaggcccataccaggacatgctctcctaccgattccgaaaggcagaaacttaccacgatgggtctctgattcaaacctctctggtttgaaagtttctgggtcatcccatacatttgggtctctctgaatagcccacgcattgataaatagccaggtgcgacgtggaatgtcaaatccagcgacttcacagtcagtggatgaagcgtgtgggacaagtaagggcgccgccggaaacaaacgaagagtctcagagatcacattgttgagatagggacacttgccagtatctgattcctcaaacacacgcccttctttcgaaacctcgtttagttccgttttgagtttccttaaaacttccggatgatttagaaggttagccatagcccactccaacgtcactgcggttgtgtccgttccagcaagcaacatcacctgcaatgaatcctttgaatctttgatgaatcaatcttgatcactcctattaacgattcaaaattataggaattaaaaactcatgtacctgtacgagccctttgatgatatcatcagtgtaacattcaggttctgattcttgaagagacagcaaacgagtgatcatcgttttctcaagctctgcttttcctctgtttttccgatgctcgtcgactaatttctgcataaacttgtccaatttcgaagcgagtttctttgctctctttctgtatccatcaagatcaaagagcttcagagtcgggagaaaatctccgacataattaacaccagcgaaatcgaacacctccctaatcagcttccgaacttccttagtttcctcgtcttcctctcgttttccagcgaccatgctcattaggatgttatacgtaagcccataaagaaacggctggagtttcaatctgacactgcctcctgatgttaccagttccacgttgatcttccgaatcatagctctcacttcgtctctccgtatatccgaaaagtctctgagacgagcggtggacaagatatctacggcgcagaaacggcggagtctgcgccaatgctccccgtacggagctgtgctaaccagcgtgttgttgtaacccatgtattcagttaaagtagcgagaggcctgttggcgaaaacaacatcgttttgctgagataagaactcctccgcagctgaagctgacgttacaaccaccgctcgacgagagcctagccggagaataaacacgtcgatgccgaggtttcgagagaggtcacgaagggaacggtgaacaggttctttgagaaggtggaggtgtccgatcaccggaaaacctacaggatttggcggtaaattcttcttctgctttgatcggaaaacatacgccactgcaatgaatccggccatgagagcgagtagaaacaaatcaatcatctcacccattcgtgaacacataattctggagactagtcgcatgattctggagagtagtcaaaaaaataccagaggtctcactattataatatacgagggagcgaaaaaaagaaaagaaagtgtacatagttctggagagactagtcaaaaatatacgatgggttgggccgaaaaatatgaagttattggttattgataggcccattacgataatctagtgatttggttacccagtaaaggtttactttttgtcggagattgcaaatatcatgtgagaagagtttataatctcgagaaatctttttgggcgacgttgtttgctcggagctctttctccgatttgtctccattttcggtgatttaaagttaggatttggctgtggag

SEQ ID NO: 898 - DNA, 592 bp, Unknown
  misc_feature (1)..( 592): cDNA_ID_2128149_gDNA_ID_1620335_Annot_ID_153757 3000 nt of promoter + ATG
ttttttgtaaggaaagtcaaatttgggtaaggggctaatgacttcacactttctctctatatacatacagtacgtctttttcgttcttgaagttggctttacttcttccctaatctatggaccatgacgaatgtctgtttaagcgccacgccatatatatatatcatagtgtttcttcgcgtatggtgaaaagggtatttcttacttttattattgaaagaaaaattacaacctttatatgattatgaggattgaggagacagttactattagttaacaataaaatgatctcactcaaatatgcataaatggaatctgatatctacatcaaatggtatgaataaataagcaaaaaaaagaagaagcttatcctaataagagacaatctgatataaataataatgatatcataatccacagtggagagtgatttggtcacactcaaacaagcacacaaaacaagaaagatatttggaagctctaaaaagataaatcttgtttttccctcctaattgtaaagaagagggctttagacttttagaacaacactcgagggaagtacgacgacgaagaagagctaacaacgataatg

SEQ ID NO: 899 - DNA, 3000 bp, Unknown
  misc_feature (1)..( 3000): cDNA_ID_2992285_gDNA_ID_1620335_Annot_ID_153760 3000 nt of promoter + ATG
tatctctgaaagtgaaatcccaatgataaactatgtgatctaacatctaaaacccttcaggtggtagctttgaacagttctcaagaagcagaaggtgaactctacatcgatgacggcaaaagctttgaattcagacgaggctcttacatccatcgtcgcttcgtcttctcaaagggtgttcttacatcaacgaacttagctcctccagaagctcgtctctcttcccaatgcttgatcgacagaattatcctcttgggacacagctcaggtccaaaatctgcgttggtggaaccgttgaatcaaaaggcagagattgagatgggacctctgcgaatgggtgggcttgtagcttcctcgggtacaaaggtgttgactatccgcaaaccgggtgttcgagtggaccaagactggaccgtaaagattctgtgattgaacggtttgaaccagtttcactcatggccgttagagtggccgaaatctgcttttccggcgacggaatatcacactttttaatatatgtttggagatttagacttaaatagttgtaagagctaacagtttgaaagtcactttgcattgttgtttatcttcatataaatgagtttagattttgataatttcagaattcgtggaatcataattaacaattttgatagggaaaaataatttgttttttttagtcagagggtcaaataatcttaccttccatcgttgcctaattattgtcaaatccttttactttttacctaatcaacccatgaaaaatcttgaattacacgttttaagagtcatgaagaaaaatcaatctgattctgttggctagatttgttttttttatactgcttagtgtttactgttatagaaagggttctaagtatgcaaagtttgccctaattagataatgttagatccgtgtaggtgaaacaagaagccaaaattctgtgtaaaaagagtcacgtaactacctaactcttgtaggtctaaagaccatcttcactttaaattagaacctcatgtttcccaaacaatatattccgttcatgaatctcgtttcgaattaaaactaaaatattacacattttagaatgtaagaaaaacacactcaaaattaagaatcttggaattgaaaacgagattttgaatgtgttcaaagatactctttagaaattataatggtagataatagcacttgcatgacaaattcgattctctcttctcatcatgcatttttgctttacattttgttcctttaaaccaagaatattttgactcacctaaaagataaaccaaacatatctgaaatctacaattgacaattaacttctctttttcttttctcttattcttactgaaataaaaatagtatgcaactggtctttataaatttcagttttatatatttaaaaaaaatcttctataccaagtttaccaactcatggtagtccaatgattaaaaaataaatcattatggggttaggacttaggagatcgaattcgaatcatttcaaattttcaatgcgatttcaatcattgtttttcactgttaacactttgaaatatctaagtgtatctaaaaatttcaagccttagagattaatttggacttcgatccggaattctgcgacgactatcaaacaaattttgttttaaccgaaatatagattatttgcatctctgattatcaaaccattcattctttttattattattcagtttactataaagtatatgtccctccctttatgaaccgtatcaaatactatacatagtatgcatgttcgaagaaatttccaacatactaatttgaaatcaacgaacatatcaaattataatgcgttgatgcagaatatatgctttctatatatataacttaaatacaaaaacctaaattttccatatgccttcgtaatttagtatataaatattcattcattcttaatacagcctaggactcggtagcattttgaagtaggaacgaattttgttaattaagatacatgagtgattagatcgaatccaaaaggtatggaggcgtagaacaagaatttggttctctttcattttacgtatctttcactaaagaatagagagaaaacaaaaccatgcaaaaacctctcaaaaattatatattgaacgcttagacaaagagccaaatttattcgctttttgatgtttacatcagtatttgtttctagctagttcatattatttaaactccataatcatttgaaagacataaaatacagatgtttaagatctgtggatgtttatataggatcttcgaattcggataatgaaatcatttatacactattaagtattaactttgtagaggacttaagtattcgaaatcttgattcaggttgtcaatcaagaaccgtaatgtttgatctatagagccatgggattaatggatgctaaaagaataaaacactcgagaagaagagtacacgtaaaatcactcacacacaaagaatgagagatgggagaagaatactacaaagtgtttgttttttttaaatcggctcatatataaatttgggcgatactctactacccacattattcttttaaacaatgatataaatgtgtatggcctatgtagccgaactttttacatatctgacctgtatatatataataattatttatcaaagaaattagagaaagattcttccacttttgatggcttataaaagatgatgacccaaaacactcaaaatgcagcagcaactgctctctcaccacccatctcctcatttctcttttgcatttctttctttttttctgcattgcattcttttgaggggtttaattttctgcatagctttgtctaatctcttagagctcaataagagaaggtactataactgatctctccctctttcaagttttttttttgtttggtttatagaaaactataaccgccattatccgttagttttaaccgttttttgaaactagtgaatcctcataactttggtttctcactaaaaacag

SEQ ID NO: 900 - DNA, 2374 bp, Unknown
  misc_feature (1)..( 2374): cDNA_ID_4255186_gDNA_ID_1620335_Annot_ID_153767 3000 nt of promoter + ATG
cctgatgtttgagcgtcacgagatagtcggtggacgcatgaggaccgtcactgtcgccggtgatactttcgaagccggcggttcgattctccatccgaagaactaccacgttaaggatttcgtcgaaaggttcaatctgacggttcgattaccgacgccgattgaagaatcttcagcgattggaatctgggatgggaagagatttgtcgtcaagacattcggttccggtaccaaatttccgtttttggatacgatcgtctcttgggtgaatgatctctacttgttcttacgttatgggttatcactgctgagaatgagcagcttcattgaggtatttaaatgtagaaccttttgatttcagaattggctatcaattgttgaacaatgagtttgttgttgtaaagtgattttaatttgttagctagcaatgaggatgttttcgtaacttgattttgcatctaggtttgtgtttgtgtgtgtgtgtggatccttttgtatgttgactgatgttgattttttatgttcgtagaatacagttgataatttcttgaagtactatgaaagcttagagtcaagacctatcttcgacaatgttgaagggatgcttaaatggtcaggcttgtacaatctcacaaagctcactctacaggagaaattatctgaagctcagctttctcctttgttagtcaacgagctggttacggtaatctttcttacaatactgtccttcaaaggccattttaatctcttctttgcttatatggttcaacatataactcttctccttaacaacttttgccaattatcatcctattacaattttgagtgtgtttattgtgtttctccaggttattacaaggataaactatggacagagtgtactcatcagtgggttggcaggtgctgtctctttggcgggttcaggtggaggattatggtctgttgaaggtggaaactggcagatggctgcaaagctcattaatcattcagatgttacgttacacctgaacgagaaaattgaatccatttcatatctcgaaaaccattacgagcttaaatccactaaaggaaacagctacaagtgtgatgtcacagtagttgccacaccattagacgaagtggatattcagttctcacccacgatctcaattcctaagagagaactacaacacacgcacacgacatttgtgagggggcttttaaacccagtaagtatcaatcactgtctgtagttttaacgttatcctgatcatgattctgactcgtaactaatgtgtgatcatgttttctctatgaaaagggatactttgggatgaaatcgctttcagatgttccagctttggtgggaacccttgaagatcctctaattccattctcatgcatctcaattctaaggaaatatagtaaaacagatatgacatacaagatttttacgcgacaacctgcatcagattcgttgcttgatgagctcttcaggtagttacaacacaatctctgtcagatttgaagcacatctgttcagtttcattaaaactggttcaatttctcttctttcttaaacagtaggagaaccgaaaccgttcgaatagactggggtgcatacccaaagtaccacgcgcctgaagttttcgcaccattcatattagatgaccatcacttgtactatgtgaatgcttttgaaaacgcggcaagcacaatggagacaagtgcagtggctggtgagaacattgccagactcataatttccagattcatgacaaaggaatcattatcttcctcggacaaaagaagctgtagttctggtctgcactcagactcataaacaactttggtccccacataaacaaggactattggctgtgtgtgttttgaagaagaatatgatgtttatgtatatagacacataaaacagttttgagttactgattgtgtttgttcctcgtaacctaagcttcttcttttttttaatctttttcgagttcttgaatcagaccattggcattagcatacaaaaacaaaaacagagaaagttaagaatcttttagtaccaagacagagacataaacagctacataagttgattcaatattagattttactacgtaaacaacagcaaagttgttgattcaatagcattttatataaataaataaaaaactttatttagtagtgcataaatgataaagcaaattttctaattagcttttgttgattaatcgggttaataaataaatcattaatgtaaaagattttaatataaaataagaatccccaaaaagagctaaattattctgcagaagacgcgtcttctttcttcttcggtaaacttcaaatcagaagcgaagaagagatcaaatcaatctgatcgtagatg

SEQ ID NO: 901 - DNA, 3000 bp, Unknown
  misc_feature (1)..( 3000): cDNA_ID_2128163_gDNA_ID_1620335_Annot_ID_153763 3000 nt of promoter + ATG
gagaaatgggagggactgattgagaacgcaggctcggttttcataggaccatggactccagagagtgttggggattatgcgagcgggacaaaccacgttcttccaacatatggatatgcaagaatgtacagtggcgtctctctcgactctttcctaaagttcatgactgtacaatctttgacagaggaaggtctgagaaacctcggcccttatgtagcaactatggctgaaatcgaaggtttagatgcacacaagagagccgttactctcagactcaaggatatcgaagccaaacagcttgcataatccaattgagatttatattcagacaaaagaggcaaaaattctttttgtattgtatgaacatatttggtttcctgagatggaataacaataaaataagagatgttggaaaactcttaccataatcttgtttttcattctttaaatctaaatccttccgtatgtttgaaccaaagagtaagttaattgtgctaactttcccgaaacacaatgggattccaaatatatcttgttctttacaaatgacagcgacttcaaagattatacagaaaacttcagagagcaccaaagaaaaaactggtaaaagaatgataaaatcgtattgctgatcagtttcttctagctcaagccggcaaaggttcttcgagaactgcaacacgaaagtaacagaccaaataaaacatgtcttgagtttagttcttgcaattctaacaaggaaaagaagaagaagacgaaaggaaaaaccttttgtttttgtggcggactcagctggtgtgatttccgcattggaagcgacaggagtttttgttggcacatccggaagatccagcttctcagattcttcagactcctttgtaggcacttcaggcatctcatcaacaataagctttaagcaaaacacacatcaacattagtctctttatctagtaaagataataatacacaaatttattttgtaaacccatacctgactttctaggttgtcaaattctgctaatatatcttcctcatcctctgctgatagtttctctcccaatatagcgttcagctcctgacattcggaaatgtaaatagagtcatcaaacacaaaagctcgacaaaaaagattatagaggttttcacactagacgagctcagaacaaactgtgccacacaaagcagtgatcaaataagaagatatttacattctgacaaagcggataacgtaataatgaatcataaacaaatgatacgaaacccgaaagtattttgactcacatcttgataagctttagcatcagcagtatcatccattagtttttgaacatcatcaaggtccaattcgctttgaatggccttaatagcactattaccctgctttaagctctcaaacactgccttttgtttgctcgtaagttcaatatctgttaactgcgagttcacatgaaagtttgagaaagccataattatgcatcaaaagagacgatgccggatacaaaacatacacacaaggagaaggatttacttgttgttcaacattgatgacccattgatccacttgcttcaataactcttcttgagttcgtttcttcctcaatgctaacaaagctctgtcctttcgcttttcacggattaagtctcttgcagcttgcttttccgcttcaattactttctcaagctaaattagcaaaaaaaatgagaagatcggttaacaaagagatgagccaaagaactcaaaagcttgagtctttcttttccatcacactactaacaatcataagacacatattgtgaaacgaatcaaatccaatctccaattaggattttggatgaatcaaaactatatgatctgggttccaaaagaaattgtaacaaaagaaaattaagatataagaagagagaataaaaaaccttctgctgatattgaccaagcttgcgtctttgggttttgagagagagaatcgctcgatcaacctccgtgatctgtggtttcttcacgaacaaattccccatcttttcttcacttatcgaaaccaacgattcggaaaatcaaacgagcagaagaaaatttagcaagatttgatcttttgacgaaattgattattagtctctagatttcccaaaaatgtcgccaatttcaaaccaaagtccaatttttgtgtttcttctctctttctgcttttcagtacaaatatctcaaaatagaggaaaagcatgaaccggaccgaaaaaatgtaaaaatcgatatcgaaccgattttagtcggtttgatttcatccacactgaaaaataaaaaaatcgaaaccaaacaaaaattccttggatagtaccgtaaacaaaatcaagctgaaatcgataagtaaccgaatagaccaatgtataattcggtctcccaattttgttcaagtttatatcaaaaccagaacaaaccggttggccacctttaacaaaatctcgaactcgcgttttcgatagcgcgtgattgcaaaacgctattgcagcgtcacgacaaaaaaggtttgttcgtttattaaaccggccggtttggaatcatgaatttgatttgaatccttttagctggttaaccgacgtcgtttgagtaaatggatccaaagccagacagatcctaaatctcgtcgacgacggtgtcgggactgaaagcagagagaaagcaaagtaagctagcttagctaggtccaagatccaagctttggaattttgtaaattgtctccactcttagccggtgagtctcactctgttccgaattattctttgtgatatggatttcgatttcccatgattcgattttgtactttttgctcttctcttgagtttaaagatgtacgaatgaatatatacagattcgattttatgttctggtggctttgatcgctgaaatttgaaaactttgtctatgtttcgattgcttgatactcttgtttcacatgttcatactctggaattgattatagattagtgtttttacagttttaatg

SEQ ID NO: 902 - DNA, 3000 bp, Unknown
  misc_feature (1)..( 3000): cDNA_ID_2128157_gDNA_ID_1620335_Annot_ID_153759 3000 nt of promoter + ATG
ctgggaaaagtataatacgtctacgggcactgcttacattgataactacatcactttggaggcaatggatccgtcctgcaactctgtcttctcttttcagactgtgttcagtgctgctggatgttataaccaagatacttatcatgtacaagactggagggtcttggcctgcagaccaacatgtacgtatgcttttcttctttaccactgtcttttctttcgagatcaatcaccagagaggactaactgtttatagagatcaggtggcaagtctgtgaatgaatattttgaccggcatgaggcaatggatcccttctacacaggtaaaatgcccaaatggttgtctgatgacgccttggcctttgacaacaaaaagtattacgtggtaagatgtccagaactggagtttaatcttcttttttagtttgagaagcagttagaggtgaatgcatttttgtcacaggtgcaagaatcagacttgcatgagaatgactggctgcttgtattcatggaaatggtattcttacaagaaaaatcctgtaagtccttgaatttcttcttcttctttttcttcatgtttcttttctcttacgcttgcttgccagtgtgactttaggaattgaaggtttccccacccttggagatcaacaaggtagttgtagaaactaaagaagattacataactgaggcgcgtgagaagctccacgcagagaatgcaatcttctacataagttacaagtatacaggtgtttcttcaagtgatcacaaagctatcataaggaaaaccatggatggggtaccagaacacatgagtcttgaaattgctttggtaaagtaagtcgagaacaagaagaagaagaagaagaagaaggagaatagacagacacctcttgtatgcatctggtctgttgcaatcaattattaagcgctattcaacttttatcttgttatatgactatgcacgatgtgtaaagataatgctgggatctatatgactatagcgagttgggatctatatgtattttaaccttcgctaactgctggatatctgtttgcaatgcataatagtactttgtatgataagttgataaccaataacacaagctgtaccaaaccgtggaggttattgatatgatcagtatgtggaaaggcaaggcatagttaaatggtaaagagattggcccaggagttctccaaatgacgaatatgttaaaaaatccgattagaggcaagcaaattcgtgccactggtcactggatgtggagagccatctctgagatggtaaactagaaagccattagagttctcagatttttcattgtttttttggctaaggtatcgtcaagttccaggtacgatcatgaagatttgggattcatatgctaccaagggaaaccaagcaagatatatatatatatatatcgtttgcctagttaacacaccttacattttttaattaggaacaccacaagatattcatttgttaacataccttacatcatcaagctatgtaactacgacatcagaactcattctatctcctcaatcaccacgccaccaccttttcgaaattgatctttcttcttcatttctggaaaccctctgtaatcgttgagctcaaccaccgagttcttctctgcccttacagatggttccagagcttcccatacttcagaattctgctcattgacccaacacatcatgtagaacactttcctctctgcaagctttagtttcttcttcagatcacgccctgatgatgattttacttcctttattgcaccaagaatcaacctttggagatcaccgagcagacataccatagctccagagccaagagaaagaaaacaaatcacatcatccaccagattcaatccgaacttcagaccaccaccaaggtttttataagctgaagagcatgtctgttccaagcaaaaggacaacacttcctttatggtctctggttgtccattgtgacccaaaactgatgaaacagtcaacaccattgttgctgcaccaagcgaatcagattgccactctccattatagatacggagcgtaaagcaataactatatgcaatgtcaatcaaatggattggtaagagaggagatggattcgtggaggtaagcttgcttagtgagatcaaaggtgtatcaggccctcgtgggatttcactcacaactgtggtctcttcttcgtcttcaacgcattgaacaagttgtgtacctccgagtccaagattgatcgttcgagctgaagcaagtaaccaccaaggatcccatggttggatcattttgcttaattctccagaagctaaggctctttggaatccttttctctcttctaagctcaaatcatcaagactcacttcatctccgttcattatcttctgaataatctcctccggtaagctcaaaccttcatcatccgtgatgctatcaattcccccatcatcttcctcttcttcttcgtgaaaccttttcaaaatttcgagcatcttccttttcgtttgatcatcagatcgaacttgcttcaattcatcgtttacattatctctcatgaatgattcagtacattggacactgtgagatttgtaacaaggaagggaacagtaccggaagttgcagcgaggacaagtgtactgcgagaactgcttattacatacatggcagataatccgcgtagaagaagggtttaacggagacgaatttgaactctccgacgaaataatcgtcttctccggcatcatcttcagaaagctattccaaattagggttttgacttttgattgaagaagacaggtctagaaacttacatacaccaattttaaaatcgagtttgggccgaattatggaccgtactttgggctatgggccttcattttaataaacaggtcggatatatccaccggacccggaatgatcgtcttcctcagtgttgtattttggctttcctcattgcttcctcaatctaaggatttccatgaacaaggaactaaa

SEQ ID NO: 903 - DNA, 3000 bp, Unknown
  misc_feature (1)..( 3000): cDNA_ID_3059531_gDNA_ID_1620336_Annot_ID_153782 3000 nt of promoter + ATG
ttttggaatctaataacaaaacaatctcaagtatcttttgaacttctcaacggttacgttttttatcgcaactttcgctcaattatttacggtcattgttttacggtagtgtttttttgtcgtatattttcgttatttacgggttttttggacagttatatttgttcaactacagtcgtatcttttctgttttgaccggttgcatttttcacaaaggaaccaaaaaagtttcataaaatttatttttaattgttatagagtttaaatattattattataaactttttatagaatgtaaatattatgaatactttaaatattttaaatatttataatgtttaaacttcttataaattcttataaagttaaactatttatattatttgaatgtcattcaggttttaatattataaatatttaagacgtttataaagtttaacaaacttaaaatagttataacagttaacttttagtacctctattttaaattatatgatgttttacttaaaagctaacaatttaagacaattatttatttcgttaaaaatatcttttaatacttgatttagcaaactcaactaatgatatgcaagattgcatgatagaaataatcataactcataagtcataagataccaaatcatttataaattgcatagaaagttgtataacatcatatataatgaaacaaaataaaatctctaaaacatcctattgagacataaaccggtttaatcgggttcgttcaatttgataaacaccgatgattcgattctaagggaagaagatctctctctactacgacaagctcaactctttcgttttcgagaaaccaattccaaagatcatcctaaacaattcgaaaccacaacaatgttcaacaacaacagtgtctcgatctcagtatctgacgacgaatctaacgatttgaatcggatccgagctcgtacccgacgaaagcggaagaaagtgagtcacagaaccagctacgagcttcctcgtcatgttctaaggctttttgtgagatactgggtcgtcttagtttttcttctcgctgttgggttgcttgtatttgaatcaacgaggatcggattcaaatctagtgacttgaagaaaccagatttgaatgggaaagagagtcctagtaagaaaaatgaaggaaatttgaatcgattggatcctactaccaaagttattggtggtgttagacaacgtaagcttgattaatttgtgaagttgtacaaaaaggatctgaattttgagatgattatgtacgaattggcttatgtggaaaaagagtgttactttaatttgctattggtttgtgaaaacttgggtattgtttggttttattcgttctctgatgtggaatgataagttgatagttcaagtgtgtgtggattgtggaaaaaggacctgaatgttgagatgattatgtatgaataggccatgaatgtggaaaaagagagtgtctttaatttgctattgattggttaaaacttgggtattgtgtggttttatttgttttgtgtcgtggaatggttattgatagttcaaatgtgtttggattgtggaaagaggatcggaattttgagctgattatgccggaataggccatgaatgtgggaaaagagagttgctttaatttgttattgattggttaaaactttggtattgtttgattttatgtgttttatgttgtggaatggttaagttaatagttcaagtgtgtatggattgtggaaaaaggatctgaatttttgagctgtttttatgtctgaatgtgggaaaaaagagacatctgtgataaaatttgagtattgttgtgttttatgagttgtgtgtgttgtggaaggatatgttgatattgaaagtattgtatggattgtggtaggttgtttgaagcttttaccacctgaggagcttgagcatcttgatatcttagagcgtaaagattcaggctctccggttaagagagttgtgtatctaactgatacggatgtgtcggtgggagaaatgagaggtgttcgtggtaatgggacgcggtttaatttattcacggggaaccagacttttgctgagagagaaaatagttttcaggtcatgatttggtaactctacaaggcttaagaacttgagtttcctataattttaggaattttttatatggatcttgaactgagtattggctttattgcatcaggtaagggaaacagtttctttgcattgtgggtttttcaatgaaaatgggggatttaggatttcggataaggataagaagtttatgacatcatgtgaagtagtggtctcgacgtgtgcgtttggtggtggagataacctttatgaacctattggaatgtctaagacatcaagtcaaaaggttggtcactctgattttctcctgtccactgtttctcttgcatatcgagtacggagtttgaacaaatcgtgattctctctctgctgcatccaatcctgaatgagttttttggatgcaggtttgctatgttgcgttttgggatgaagttactcttacaacacaagaagcagagggtcataagatcgatgagaatgatcacattggaaagtggcgtattgtgattgtaaaggatcttccttttacagaccaaaggcttaatgggaagatcccaaaggtactactcatctacttcagaggcacatgtgatgatttgtactgcacgtagcaatcttattcgctgggtgttaaacgtttctgattatgcgttcatggtactgtgtaaaatgtttccattacaaccaaatttaaccttctttggttttcattttgtgctgtgtaaaatggtatgtgctcgatttgaattagctcactgttgtcttttttttttccttacatcttttaatcttgtttaaatatggttggagtcacaatatttgagtttccgttttgctttcaagcacatgtatgtctgatataagatgcttcataatgatactaatgaatctacatgctgtcagatg

SEQ ID NO: 904 - DNA, 3000 bp, Unknown
  misc_feature (1)..( 3000): cDNA_ID_3059514_gDNA_ID_1620336_Annot_ID_153797 3000 nt of promoter + ATG
agctttgtggaaacatgttattcatgatccgcttgctcatttgtttgctggagagacacatttgagaaacctacacacaaagattcagactgaccgtctcaacaatgctcgagaggtttctggtgtgatcctagccgttcgaactctctggtttgacacaaggattcaagctgctctggagtctttccacggcgatgcagcacaggttgttctacttggtgcaggtttgttttcccctgtttagacattttaacttatgtgtgtatatatatatgtggagcatgagtttaagataagtagccaacatagaatgatgtaattgaatttcaggaatggatgcaagatcatacagactaaactgcttgaacaaaagtgacgtattcgaagtggattttcaagatgttttggaaaccaaagcgagcctagttcaagctgcagtaaactctagagatgagcttaggatgacagcgaaatcactagtcagagtagcaattgatatcagagacaacgattggtttgaacagcttaaaaaatcaggttttttgccagagattaacacggtatgggttctcgaaggtattctctattacctgtctcacacagaggcaatgcaagtactaaacctcatagctgagaagtgtggactaaccagcacagttctcttggcggatttcatgaacaaaccatcagctacacttccaaactctgtgttccacttttacagtgactggcctgatcagctcttaccaactttgggattctctcatgtcaagctttcacaaataggtgatccagatgcgaatttcggtctgctccacgatccacggaatctcttcaacaaacttctccgcctgccaaggactgcacaaatccatccagatgatggaaaaccatgctgccgtttgtatttggtcgaagcttccggttcaccgcctcaagataaccaagcgagcttgtaagctccttccggacgtgcatttggcactgcacgcttttgcagaacagatatatatgtgagtctttcacactagagaaattgtgtaggaggttaatgtaatttgatgtataaacgattgatatgaacaattcattatattctaaactctaaagttctatatttctatctgcttgaaaattacaacgaagaaagaacgcttgtcatgcctttcgataactagcatgatcgtccttccttactgtaactcaaacgatgaatgaagctcagcatcaagcataagagtatattcatatagaacgagatatcgtctctcacttagacagttgtaaaaaaagttggtacacctattcagccataatgatttcacaagaagaaaaggaagagagaactagacttcatctcaaatctcaagacagtctttgacacccttctcaaatttgtcaagataagagatagtctctgtaaccccatctgcaactttttttctgcaaaacaagttaaaacattgtactgctttagtgacatgagagataccaaatcatcatacaaatatagtttcgagtaacagagaacacatagaagaaacggatccctttaatcatttcaatcactaacctatcagaaggaagattcatatcaaccccattcgtcaacacgataagggaaccgaaagacctgcgatataaagtaagtgcaaaatcaacaaacaagaaccataaatcacagcatttgcatcacatttctataattcaacaaccaatttcattacacatttcaatagagagtcacactagcacatacctaacaagatcatcaagtatattctctgcttctaatttaactggatccttatcatcaagtaatgaagcagcattcttcacaacaagcttaaatgtacaaacctaatcaacaacatcatcatcatcatcataaaaatcaaaactttaatgtcattcataactaaaacccaaaactttaagatcaatttaagattctagaaacctcaactccggatttagattgaaaatcaacaagagagcttctttctttaggaacacaatctcttgcagaagacttaaacagattctgcagattctccaaatctttctctgtataatcagattcactagttaacgaaagataagcagattgaagagcttgacgagttgcatcaatgggagcaagtaagaatcttgaagacttcttcttctgatctttaagccactctttaggtcctgctgtgtgagaaaattagtttttttttcaaaattcacaaatttggagataagatcaataaaatgaagagtgagtgagaagtgtgttgtgtacagattcctaaggagaaggcgaaagcgggattggtgggggagagagtgaggagaagagaagtggcggaggagagaagaacggtggcgtctcggcgagagataatctgtggcaggtggtcggagatttgtgcggcggcgattggtggtggtggtggaggtttagtgtttgaagagaagaaaggttgagaaattgggataagacgagccatggcttaacattaacgagctaagttatgtgtacccgctcatgtggtatttaccaatggtttcctttttgaacagatttttgtcttgtttttaaacacaaaacgacgtcggtttgtgaacataataaaaatgtaaatgttgacttatctttgctaaattggtccgtcagctaaggatgtaccttatttagcaaaattaacgaaaattaacgatttaattgaaaatcaactaaagtttaaaattaaagtcatcctactcaaaattggtgctttgtttcaccacttttgataaactggtgatggtttttatgacattttttccagtaataaaaggggtagttatgcaatttagtagaagttaaagggtttctaaacaaacttaaaaaccaaatttttctttattgctttgctcgagagtgcctgcaactgcaacagttgagattttgagcgtgtcaaggattctgattgataacgatattcaagttcagcaatctcattgcagtagaaa

SEQ ID NO: 905 - DNA, 3000 bp, Unknown
  misc_feature (1)..( 3000): cDNA_ID_2128402_gDNA_ID_1620336_Annot_ID_153802 3000 nt of promoter + ATG
ggcagttgcagctatcaaatactccttcacaatcttcaagctttcatctaaaggtaaagcatgtagagacaattccgcctccagtggcttaccttctttacatataggacaaggctggttgattaaatcgtaatacgaatgaatcgctccttcaatgtctaatttgtctagcttctgaatttcaagaagtctatcaagaactcctgagccatagacagcgtcagatactagttgtagaaagcactctgtcctatgaccgtcttctgattgaatgaagcctttgagagcatcctcaaaggcatacccgatttcggggctggttctcccggtgctttcacctgaaccccctaatatgagagaaccattcaagaatacgcggaaattgttttgaggagtggaatataaagcttttatagcttccaaaacactctcttttgatccagagaagagatcaagaggatcgtactcgctttcttcagatatctgtagaatggtgacatacttattagacatttcagcaaatcacaatctatagaccattaagattttatactaacaatgacttgcttttacctcgttatattccaactttaagagttgatgcattttgaaacggcttacgcttgttttgagcatgttttctttacctatgaaccttgaggttggaagaaatccgcatttgggctacttcatggaattaaggacagtgagtttaggtcaagcatgataaagagaaaactaaaacaacccagaggatttatcaaacctttatttcaacactaatgcaatcaccaccgctagaaatacctgacacagataacaccatatagttacgactaatttttatgatcatgaaaaaagtccgatttcttataataataggttaccttgagaaaaaagtgaatgatcattcaatataagggcagaatcatgactcgtatcaacatttgctgcattaacacgccatagcggacgctgcttagttactttcttatcaacacactcaagaaactccttggacacagaaacacgtacctacaatactctaatcatcagcttaccaagaagccataagtatctaaataaaaccaacaaagaccatttgataatattacttactccagcatcaacatgtttaggacccaagagtgggatgatcacattcttaacatatctttgttcaagaacttccttgtttggtgatgaaatcagctcattgttttctctccatagatgttgctcatcgcttgttaaaaccgaaacaacaccattcgcattcttgattgctttatcattcctccgagccttctgtatacgaatcactttcccaacctaatcaaagttcagagataatgtaaaagattggtcaaacttaaacaaaccaaatccaattctgtacaaaacattttactgttgaacattgtgttaactctttagacactaatcaatctgagaagataagaattataccaacactgattctgattctgattcttcatagaagaagagagccactaaaaaagaatctatatccaagtttctaactagagaatctaaaccaaacttttataaagctaaaaagtcaatgacggcgagaatctgaactactttttttcaaagttcatcagacttgctttaacttttacaggattcaaaaggaagagagatcgaagaagaagagactaacaaaaagtggagaagatccagcgtaagcaagaacgagattggcaccaccttcgcctctgtaaatccaatctgatgcatctttctcctccaaaatcatctccatgcgatacaaaattcttcgatttttaaaatcgaaatcaagcgaagatctgatcaaatcaattcaccagaattttgctaacgcaatgcaattgaatagagaacgaagatttctagtggttgaagaagaagaaggagagctttgaagtattcttctctctctgcgtcgagctcaaacgtggtggtggactacaccaaagacgcttggcttactttgtctctctgtttggaggagagtcaaaattaagctgacctcttctctgacgtcttacgatacaacaaattgaaaatacaagagttatattgattctgtgttttagaatccacgtggacgaggtaaccaccacgtgttatttcttactttatgagattaagtgattcactgtccttctaattttattttattttctttgcgaaaactggaaataaataaatttttgaaaacaatattttaacatatcaattatttttataataattcgtgaaataataatgaaaaagctgacatgggacacaattggataattacatcttttaaagttttagtttatgtattttatgtaaatgcttataatatttagattgcaataaatctagaagtcatatttataaattaatatgttttataattttacaattttgtaataagaaactcctaattcataaatctaaaatataaacatatttttcatttaagcttttccaagatttataattattttaggtgtctgatttttagatttcaattaaaattaaaatattacttaagtaaaatgtatttctgtatatattctatcaaaatgttaatttgtttagacaaattttgatttatttcgtaaaagtgggtggggaacaaaaacaaaaacaaactgaactgaagtcacccacacgtctcaccaaacaaatcgaagtcaacgtatttcacccaccggtacaacaacaaaatacacacctaaggaaataataaaatcaacttaccagattgttacgtaccacacatctctttagtccttcgtcaaccaacgttccccacgtgcttctccggttggtactcacgtgaccggcagcttctcgttcttattatctgttttcttcaataacgattcataatctctagtgtcttatttataatgtcttcacatcacaaagatttgtaccgaacatacatagttgaatctttcccaaagcacaatctatcatataaccacaaaaatg

SEQ ID NO: 906 - DNA, 3000 bp, Unknown
  misc_feature (1)..( 3000): cDNA_ID_2128406_gDNA_ID_1620336_Annot_ID_153803 3000 nt of promoter + ATG
aaatcatcataggttgttgtaacaaatataacttgcaaagttcggtcgattcaaagacagcactctttaaatacgtaaataggttaattcataccgttacaatcacacgcgatacaaaatcatttcatatcatttgccaatgataaattatgattaacataatgataaacccaaatcacacctccaatagtaaaacgatatgataatataacagttgaattttctaggcacacatctgttgtgctagcatgggagcatcggttctctcgccggttatccccgtttctgtcttgttacatggcttcataccatcggttaaaccatctccggttttgacgtcaatgttttcattcttagtcttgatctccgatatggattggtacgataatgaaaccgggagaaaacccttttgacgacatgtctcaatagattcaataaacatttcctcgagactatacttgaagttaaaccccatgtccgtcagcttcttggaactgaattcaatgctctttagattctcatcaacaccttcaaacctgttatatagagttttgtttaggacaaagagattatgggccaaaacattttggttgaacaaaaagttcaggcttaaacgggtatatcttacgttgaaggtacgttatattcggggtattttggcctgagaaatttggagatagtaagaatggttgcatcatgagaggaacaaatataacgtcccttggcggctgcttgttcgtataagaagatatgagcgttgcataagtcgtccaaatgcacatactgtccttgtcttatgatcgagtaatgcgcctcgttccctaaaacattataatatattcaacgttttagatttaacattttcacatttccaacaaaagaagaagcacacacacgtacgagtgataggagagagcgcggtgataaggctaggcggcatagacgttgtgatgaatggaccgaccaccaatgttggaataatactaatgaaatctaatcctttctcttcggcgaaatcccacgctgctttctccgctaacgtttttgacacgaaatacatctgccacacaaatatatatgaactttaaattacttcaaaaaaccgtaacttgagtttaattaatatgtatattcttacccatcctgtcatctttttggacatgataaactcaagatcactccaatcattttcatcatagacattcttctgatgttcttctacattaacggttccggcagatgaagtaaatacgaatcttcgtacggtctttgccttaacacatgctttcattatccccaacattccattcactgtcggctttatcacttcgttctgattcgcaaatacaaaagtcaagttaagctaggttgacgcaaaaaccaaaagaagtttcctaatatagagaaactcacctcaggatcttttgattcaaaatccatgggtgttgccacgtggaaaacaccgtcacatccgtttatggcatcatcgtagcttccttcctcagataaatcagccttccataaagtgagtagcgtcttggcgtttggcaaatcaagaagatgttgtactttcttcaaattaccttgacaatccaaaaaaacccgtaaataaacgttatattaatatacataatcttaggagaaatgagtttgtaagaacatatagatatgtaccgggatctcgaacggtggcacgaacaaagtaaccacgttctagtaatcgcatcactagccatgaaccgatgaaacccgaagcgccggttacacacacggtctctttctgactaaccatttttgtggttatatgatagattgtgctttgggaaagattcaactatgtatgttcggtacaaatctttgtgatgtgaagacattataaataagacactagagattatgaatcgttattgaagaaaacagataataagaacgagaagctgccggtcacgtgagtaccaaccggagaagcacgtggggaacgttggttgacgaaggactaaagagatgtgtggtacgtaacaatctggtaagttgattttattatttccttaggtgtgtattttgttgttgtaccggtgggtgaaatacgttgacttcgatttgtttggtgagacgtgtgggtgacttcagttcagtttgtttttgtttttgttccccacccacttttacgaaataaatcaaaatttgtctaaacaaattaacattttgatagaatatatacagaaatacattttacttaagtaatattttaattttaattgaaatctaaaaatcagacacctaaaataattataaatcttggaaaagcttaaatgaaaaatatgtttatattttagatttatgaattaggagtttcttattacaaaattgtaaaattataaaacatattaatttataaatatgacttctagatttattgcaatctaaatattataagcatttacataaaatacataaactaaaactttaaaagatgtaattatccaattgtgtcccatgtcagctttttcattattatttcacgaattattataaaaataattgatatgttaaaatattgttttcaaaaatttatttatttccagttttcgcaaagaaaataaaataaaattagaaggacagtgaatcacttaatctcataaagtaagaaataacacgtggtggttacctcgtccacgtggattctaaaacacagaatcaatataactcttgtattttcaatttgttgtatcgtaagacgtcagagaagaggtcagcttaattttgactctcctccaaacagagagacaaagtaagccaagcgtctttggtgtagtccaccaccacgtttgagctcgacgcagagagagaagaatacttcaaagctctccttcttcttcttcaaccactagaaatcttcgttctctattcaattgcattgcgttagcaaaattctggtgaattgatttgatcagatcttcgcttgatttcgattttaaaaatcgaagaattttgtatcgc

SEQ ID NO: 907 - DNA, 3000 bp, Unknown
  misc_feature (1)..( 3000): cDNA_ID_3059506_gDNA_ID_1620336_Annot_ID_153800 3000 nt of promoter + ATG
tcatcgttgattatacgtttgataccattgttttattaggtaagatcaatatgttagattaattgaattggtggatttttaattgactttagtgggtgaatttcttgtgacaatgagttttaacaaatatgctggaataaaaaaccgaacctgaattgaaaccaagtcgaggtttgattatttcgatctaagttttggttattagaatagataaatcgattgactaaagtactactataaaataaatttggtcatttcatgatgtcaaataattgaaatcaaaattcatattcacataagaaatagaaaagattgcaatatattttttttttttgcaacccattattttattaaattatatatggagattattcgtagaaaacaaataaatatcaattttaacaattgaaactgcagaggcaggcctgatctattggatcgaatccaggtggtacacacaatccttgaactcctactcttttatacttggtaccacactcccagttacactgatcaatttcacagttttctgctttaatataaacatgacatgtacgatccttgcgtctcctccatcaccattcctaataatacatatttaaaatatatactaatcatttcaattattttttgttataaaaatattaaggtgatgaaaagaaaaccatcaaataaaaatatgtgaagaaacacggaatatttaataaatattgaagtgtagagcataccaataaccaaaacaaccataaaaattgtaagagatgtgtttttagtcatctttgatgatacaattataataaaagtaatggatgtaattgtattgtgaacaaagaacaatatatatagattaattgaatgcatacatttatatttacaaaaatatcattaattataaaaaaaaaatagaaataaatcagttagtaattaactaattaatgcttgaatttgtgtttaccaaaaaaagagagcaaaaagatcagttagtaattaattagatgctttttttgtcattagatgcttgaatcaggaaaacttacaaaattgaaaacaaatctagaaagtaattataagtgaaaacatataaaaacgttataaatcatagtatatgctaactttaactaatctatataataaataaattaaaattttgaaaacaaatcatcaaatatcaaataaagaataattcttgggttcacttctagggggtgaacctaatttattcaccccctctttaataacaaatcaatatttgccatgttatttgattaaaaaaacttaaaacaattaatattatcaaaataaaataattaaaataaatcattaaaaccccacttttttgtaaatccaaaccgatatataatctcgtttaattaccaaatctaagccctaattctcctttataaacccaaaccgccatttagacttatttaatcgttaaaaaacaaaccataatcgtattttctaaacccaaaccgacatttaacctagtttaattgtaaaatctaaatatgtttataagcccaaactaatatttaacatcgtataatcataaaatctaaaccctaatcgtattttgtaaacccaaaccgatatttaacctcgtttaatcataaaatctaaactctcattttttctaataaactcaaaccgatacataattttcttttagtggcaaattagatttaatagttaaattaattttttattattattactagtttgttagttgggtttaaaagtttcatcaaaggagatttcataattgaataaggtaagtgacgattttaaaatagcttgtttttagaagtttttcgttctaggtttgttcttattgcatgtagctagttagcgtcatgaactagtaactgatcttagggagataaaaccacaaaagtgctgaatttatttacttgatctaacatacatagactagaaactacgttataacaatacaaaagcttagttgtagagctttgtttgtggaggtaaaggaacttgatctcattgggtgattgattttgtggctacaacaaaaatctgagtagttaagtttttatcgatgctacaaaattcaatcccctagtcatctgtgattccagtttaaggaacttgagctaaactgaatatgcttttgttaatcttcttgtatgagacaatatgaactttcgcgatattcttaaagactcaacgattaattatcatacagttgataataatagtcgaaaataacaatcgttaccaatccacttctatattatgtataaaatgattaaaactatattataaaacaaataataattcaaatttaaataaatatttaaaaatcaaaattctattagtgttgtacaagcacatgttatgatctacttcatcactatattcgtcaaaactaaaaatgtatgacttttcagctgtcataaaagtttagaaatatacaataaattaattttaagatatcaattttaaaaatgataaatgttctaaaattttaaataggatcaatcacagagactttttttttgtaacaattcaaattatatgattactaataacaaaatcgcaaagttttatatttataaaattaattcatttttatttagtttcaaataatatacaagaatattcaagctagtgtgctctgttttgtctaatgtttttttttttactgagaactattgaccaaactcttttgtacatatttaaagattcttaaacaatttcacatttcatcaaaaaaaaaaaaaagaatatacaaggattatcctgtataaaaacataggcctaaagtctgtataaaacatatgcctaaagtcttagcccaataagctagataccgagccaatacaaagcccagaatttaatagaagcccattaaatcgagagagagatcgagagcatccatggcttgaaggaaaagaaaagttttgtttctgaactttcgtctctataaaccctttcgacgacgagtgaagaagaaagcgagacgaagaagcaaagatg

SEQ ID NO: 908 - DNA, 3000 bp, Unknown
  misc_feature (1)..( 3000): cDNA_ID_3011905_gDNA_ID_1620336_Annot_ID_153793 3000 nt of promoter + ATG
tatttcaaatgaagcattgtgcaaagtaatgaagcgaccagagattaagaaagaagatggaaaacatgatctgttactcaaaagttacaatgacagtaatgagaagaaagcagaagtagatacatgcatcaaaagttctcaagtttcaggtgttgagcataagaaagagatcaaagatgactcaattcttcttattgccgcagagagagtcccatgtcaagctccatcagaaaatgtaagcttactatttgttaacttcacatatataccatctgtatatgttagttctaatcggtgttggatgttcataagcagcatcatgggcgtatgttcacaaatgggatggatcaacaagctccaataccaaagtctgatggaaattcagatatattatccaagacagtatataaaggtaagaagcaaataatgaacttttggtttgtcttgttattaatctcattgcacatttttaaaaaatcactaataatcatttcgagcattatgtcaagattttgttttgataaaaatggaactaaaataagttacaattatttcagaaacaaaaggggagatagaagctggtttacccttgttggagaagcgacaagaacgccgaaaacgagaaacaacagagacattatccgaaaatgaaataaacctaaagaagatatttgtgaaaagccaattatttctagacacagcaaaggcacatttcaaactcaacattcctcaaaatgtctttcatgacaccaccagtgggagctattactatcaagaagacaagaatctaaccctcgagtgtgccttcgagctaatgaaacgaaaaaggagatttcaagagttaagtgtccatcctttcgtgaaggtacccataagttcctctaaaataaactcattggaccatcttattagacaaataagcaaagagttagagaagctgagagcctacggtagagactgccacattggatcacatgttgaagactacgtgttggaaagagatgttcactataaagacccatacttgaactcaatgtgggacatgggttggaatgattcgatgctcgcgttcatcgagaaagatgatgttatgagggatatagagagggaagtcttcagtggactcttggaagagataacaagagatcttatatgcatatagccgaaactcttctttctctccgatttaaaagtgagctcttgttttaggtgattagagtgtcttcaaacattaatccactccgttaatgttttgtctgataatggttttgcttttctttttattctactactcttttggattaactatcctgatatattgcatggttaataagaatggatgcgtatttgatgaaaaaacgtctactcattcatcataaacacaaaaagctaagtatctatttctcaaattctaacttcaaactatctaacttcttaattctattattatatacttttaaaactacctatttcactaaacttccacaacttattcttagcttttgtatgagttttatcctcagttttctatataggattttgaaaattcgttatttttattcgtgaagagaatgtacatactttgagatcaatctagctacaatagcacaaaaagataattgaacttgataatgtatatttgatggagaagttaacttgaagaggaccgatgaactttaatttcatcccaaaacaattaagtaacaaaagttatgttatagaaagaacattttggggttttaataacataaatttggggtttcacgaattaagaaccatgaatcggttaactcaaatacgataaacgactgctaccagtgaccagtcaacaatgttttggaagttacgttaatatacaaaatgattcaaacaatcgaaatttgaaatttgtggttcaaatgttaggccttttgtgcttttgttttttaataattttctcgtctttttgaggaaaaaaacaaacagtagtttaaacatgctttatcttttccttaggccacagcaaaagcgacttcttcttctttaatattattattctttttccatctttgtggtgtgtgttggaatgtctaattccttcctctcctcctccaccaccttcgatgcattgctccatttcttagtctagaaggaaaatctagttttcaaaaaagccctgaatttcttaaactagttaattacatgtttaatgctcttcattaagtgtgggaaaatccatttattataattctgtctcactttttcatgtaactaattaacgaaagatactttagggtttaattcccctttattgtctcttttaattgtcatgcaacacgtacttatacactgcaatgatgtagtattttgtatctttatctggtatatttgaaatttcaaatactcccttctaaacaaactattaaatgaatgtcagaaatatatatatatatatatatatatatatatatattttcaccaggtacgtttgaaatttgaaaatacacagctttaataaacaaactcttaaactgtatcagaaattgttgattataaaaaaaaaaaaaagaaaaaaaattcctagacatgaataatcaagagtttttttgttttcttcgttaacaatcaagagttctttgttatatatattgtttaaagtactcttgcgagcgctctttatggataatagatctagtagtcttcgtttactaattctctctcacaaatccaaacaaaaaggaactgtgtacttaaatcctgtaatgacaatttcatacatactaaacaagaactattaaatactaggataatacatacttgaagaaataacaactcttcatgtagtcgtgtctttttacaatttaaaatttgaaaaataaaagttacatttacctttacaacgtcggtcgttttccacacaatagattacccacttctactcgatagttttctctataatatagagacaaaagaagagagcatttaaattctaaagaacaaaaaaggaaaaacagagcagcc

SEQ ID NO: 909 - DNA, 3000 bp, Unknown
  misc_feature (1)..( 3000): cDNA_ID_1411707_gDNA_ID_1620336_Annot_ID_153783 3000 nt of promoter + ATG
aaccatgaacaacaagagcttcttctagaccgccatcgacttcattttcacgacattgtggcggatatacaggtcgaatcatcaagcatttctcgtttccgccttcgagttgttgaaatacttttgttgaatgtatccctgtggcactcaaaaacgttaagagatttacaaataagcatataacaatggtgaaaattaaaagtaccttctcctggataatcaatatactcaacatcaaagaataatgctttccttttctgaaatatcttcagaatctgataataatgatggtttaacatcaatttcgattgcaaatgcagaaattaagattaagcagcaatggagatttagagtaccttgcaacgaaaccaagcaccacgaaaacccaattcaaaagatttcaattctacagtttgaccaacttcaaatggtagattcatttcactcatttttttgtcaaaactgtgaactgcagcatgtattcggttcaaagcaaaacagaattgtaatctcagcttcatataatgtcaatatctcatcgattacactagtctaaacccagaaacttgtcgagaatgacctcaaatcagcatatcgagaactcgaagaaatatatcaaatcagctcaaattagtttgtggagaactcgaagaactcttccaaaggttcgtcgtgtggtcgagatgaagattggatttagggtctcgacatcgagagagtctctcgtgttgtgaatttggtagattctggtaattgataaaccctaagctgaaacgacgtagttttcgtttagtgaaacaaaactaattaatcaggctacccgttttaacattcgttgcttgtcctaaacgagaatgatgaacagtagataaatgaagacacactcttgaagatttcagctcgatttggggataaggaaacttttgtttttgcaacatagatttcatttctgcatttagacaaaaaaaaaaaaaaaaaaaaaaaaaattcgtttctgctctaagattgggctaggcccattacagaagatgataagaccttcttggcatgggaatctactaaattgttttgcaaacgaggaataaaaacacatctaaaaacggtaaaagaagaggatagatcaaagatatcaaagtgaattccatggagctccttgaattgagtctccgaattgatggttttgacgagttgtgaagagttagtagcaaaggtaagatggttgaaaccgagttggcgaacttgttttatggcaaagagaagcgccaaggcttccgcttgtagaggagaattgacatactccgcatagccggttccaccataaaatcttgatccatgttggtttttgaggatctatccaaaacctgcacgatgatcatccttccaggttgcatcagtattatagataagagtttgagaataagtaaacttattgttataatttaataataaaaataatctgaataaatgtctttcgctttttttttggtagtttttattaaaatattttcagttatatttttgtggttgtatctttttataatatttattgttatgttttgaacagttattttgttcaactaagttcgtatcattttgcatctcaaattctgaatagctgcctttttttatcacaatatttctttcaagtatttagagttgtatatttttatcgcatctttacattaaattatatacgattatttttttctgacagttatattaatttaaatacagtcatatcttttcagtttacggtttatctttttatcattgagttatatttgttcaactacaattataatttttttagtttgcggttgtttctttatagttgcatctattcatttaaagtaacgtctctttattatatattttctgcttttttcacaacttttcgtatgaataaagtagtttatttaaatgttcgtgagttttgaactctatatatttgtccttcttcctaaatagttctcatatttttgttccttcacaccgattatttatgatgaatccaaatttttttttttgtaaaatggatctaaattctttactttcgaagttattttaaatatacatcattttaatatgaaagaaatttctctaattcttagtctaactaaaattttttggaatctaataacaaaacaatctcaagtatcttttgaacttctcaacggttacgttttttatcgcaactttcgctcaattatttacggtcattgttttacggtagtgtttttttgtcgtatattttcgttatttacgggttttttggacagttatatttgttcaactacagtcgtatcttttctgttttgaccggttgcatttttcacaaaggaaccaaaaaagtttcataaaatttatttttaattgttatagagtttaaatattattattataaactttttatagaatgtaaatattatgaatactttaaatattttaaatatttataatgtttaaacttcttataaattcttataaagttaaactatttatattatttgaatgtcattcaggttttaatattataaatatttaagacgtttataaagtttaacaaacttaaaatagttataacagttaacttttagtacctctattttaaattatatgatgttttacttaaaagctaacaatttaagacaattatttatttcgttaaaaatatcttttaatacttgatttagcaaactcaactaatgatatgcaagattgcatgatagaaataatcataactcataagtcataagataccaaatcatttataaattgcatagaaagttgtataacatcatatataatgaaacaaaataaaatctctaaaacatcctattgagacataaaccggtttaatcgggttcgttcaatttgataaacaccgatgattcgattctaagggaagaagatctctctctactacgacaagctcaactctttcgttttcgagaaaccaattccaaagatcatcctaaacaattcgaaaccacaacaatg

SEQ ID NO: 910 - DNA, 3000 bp, Unknown
  misc_feature (1)..( 3000): cDNA_ID_2128361_gDNA_ID_1620336_Annot_ID_153792 3000 nt of promoter + ATG
tgggtttttgttttgttttctacaggttgatgttaaacgagtgcacatacagagaaggtgaaattgcaaaaagatcttatctttttcatcttttgttaaatctttgaaattagactagtttttgtcttggttttggttctgtttaggggagtgggcaagaagagagatttattgaatcgagtttatgtttctgaagaaatcagagatgaggccatttcaagagctaacaaatttcaggatgaattggggagtggttatccaagttttgtgaaatctatgcttcaatcacatgtttctggtggcttctggctggtaagcaactttcgtataccctaaatcgttagcttacattgcttgatttctgttctgtttggtaaagtccattgctagtctttacattgcttggtttaatcaattttcagtctttctaactcagtacctatgagaagtctagctagtagctatttatataacttacattgcttaatatttatgttctgttcgcttaaactccatcaccgttcttagtattgcttcgtgttactctaaaactatcgcttttgaattcgaaattgttgagataaaaatgtctaaccatgtaaactacacataaaagtttatgtgttaagtctagagaagaactattgtaactagcctaggggtgttgcagggaattgtagtttttccagctcaacaacaaatcttacattaaggttctaaggtcttggttttgtgcgtttctctggttaatcaagtctcttgtatggttttagaattgaatcttcttaaacttatctgatgtttttgtacatgtgaaatagcattagcagacagtacttctaacaatgataagctatttatataatttacttaatttctggtctgtttgcttagactctatcaccattctttgcattgcgtattacttggaaaagtatagcttttaatccgatgagtttgtgataataatgtcaagccatgtaaactacaaaatttttaattcaggacctctgaaatgttatgtctagagcagaactattgtaactagccttgggatggtgcagtgaattgtagcttttccagctcaagaacatcagctgaatcttataaggcccattctggattcgtttaaagtcttggtttgagtgtttctctggttaatgaagtctcttctatggtcttattaaactcatctgatgtttttgttcatgtgaatgttatcattatctaaccaagcaaagccattcttttggttgcaatcagggtcttccagtgcaattttgcaaatctcacctcgggttacatgatggtgtcataactttgatagatgaagaaggcgaggagtatgagactatctacttagcgagaaagaatggacttagtggtggatggatgggatttgcggttgctcacaatctagcatatggggatactcttgttttcgagttagttcgtcgtaccgctttcaaggttagtaaacctgttagttacctaccaaaaccgcaaaaaatgatgaaactgatgattgatgttgttattctgtcaggtttacattacaagagttggaagttgtggagaaagctccaaagatatgagctgatcatgtcaggaatttggatatgacctgagttagaagtttatttgcccttttgtcttttgtaagtaagatggtaactctaggctaattgtcctcttcagtcttccactgctaaatctgatattttgttaacaatattttggaagggttgcaaaaatccttgaaattttaggaatgggaaataacagtaaatttagtttgatgtttgatgtttttatttgttgttttaactcttaagagctaagttgttctaatgattaaatctcctactaaaatcgcatcactttctcctaaataatttaaacggatataacctaaagtatcgcttgatccactttagacttatcaacgaaattattaatgaaaaaatcttagtatcgagcttatctattttaaaaccattaactaaattattaatgcaagaaacacttcaagtaaaaatcctcaagtattagtacattcttgatgtgtttgagttgttggtagttgctactgatttcagcccaaagttatctcgctttcgccgtcatagatttcaggtaacatgtgttataaaagacctttaaaaaattctaaatattctttatatcatgcgttagaaaactttagaaatttgcatttgttatattttaaatatagacaaaaatgtagtatttttgaaaaatgttatcataaaaagtgttatttttgatgttcttcctaaatcatttgctcattttctatagtttatgaatgtggtgcaaagaaatacaagcttttaaatgtaaaagtacaaacttttcttcagtcgtttcttgattatatattctctaaacaaaattctcattattaagttaaaacatgttttgctaaaatagaaatcaaagctgatttttaagaatgctcaacaagtagtattttggatcggacaatgatatcatcatattagcatgcacaattcatttgaaaatttcaattttttctaagcgtaaattattgtattcatcttattataatcaatgcaacgcagtaaggcactagcagacgcaaaagagagtgagaagaggcttgaaagttaagtcgcaaaggaaagccttcgtcattgcttaacttgcaatcgaagtcaagaaacaaaaaattactctgaagggcctaacgttcacgtcaatcatccaaacacacacatgaattttttttagagtcttccattgttatcaattagatttttgctatcactactagaatactctcaccaaacactgaaagaaccatctcaaccaaagattaattcaagaaaacaactcaaaccaacaaacaaaaataaaataaaagtattgagtctttagaaataaccctaaagcaaatgttcagagacttttcttgtgtcttctattttctggactcaagagtaaaaataagagaga

SEQ ID NO: 911 - DNA, 3000 bp, Unknown
  misc_feature (1)..( 3000): cDNA_ID_2128357_gDNA_ID_1620336_Annot_ID_153791 3000 nt of promoter + ATG
acactctttaatataaaaaaatgaaaaagtccaaggagattacataagtttctacagaaaaacctcaagaactacactttttaaaaaatcgctttcaagatcagtggaaaaaaatacaaaatctagatttacaattttgttataaaattaacaattgaagaacaccaagaggaaaatatcatcattaataaaaaaaacagagagatcaaaacgattgagattcctcactcacaatgttagtatttgtagatgatggagttttaacgcatcttgtataactactactaccattactactgctactgctgctactcatcatcataattgtcttccgaatcaaaagctgtataatacaaaactacagaggagaaaaaaacattaagaaacatatgaagaagttgtaaaagcgaaaattcacaactaaaacctggtttggatcagtgatcttgtgtcatcaaccatggtgatcattcttgaaagtttgaaattacagaaaggtacatgtgtaatgttgaatcactttctttgtaatattatatatgtagagagaaatgaataatttagtacgtatagatggagacagttgcagaagaggaagatttggtgatgtttcgtcttcagcttcggtgagttttttttttttccttgatttgttttgtgtattcattagagcaaaaaataaaaataagtgagggatatcaaaaggagcggtgaaacggtcggtcgtcttcatttttatttttaaattgtttctttttgtcttatatctttaaattgctttttttttgtgtggatcaaatgatatttttaagttttaatatatatactatttctatttctgtacacaaaaataaaatattttaaccattgtcgaatatattaaaagtatagaaaatttattatgtcctttatcaatagactaataagatttgtttttctaattagtaaactaaaataataaaattaaaattgagatttggtttaaaaatatttttgtgaaatcaaaaaagtattttttcggttaataaaataataagtgcttgcaataccaataaaatagttatggtttgattggtaggtaatcacagtttttgtcaaggtgattatgagagttttttggctgttaaagagaacggttaaagaaaaaagagacgattataattggtaattagattctaacccacgttattattgctttttagaatatatttattgtaaaaatgatagtatttaattacatttgtcatttgataatcacagttttgttaaagcgagtatgtgatgtttgaaggttaaagagatatgattataattagttatagactataacttatagtcttatagataatgattaaagaatagacgatacggattaatgcgtcaatctcttggtgcagtgaatttgaaactggtttagggtgaactgaaaaaggagagagcaaggtgcttgagccttgaggtgttgagatgaacacaagttacacttgcccaaaaaaaagggaaaacgaaaaagaaaaaagaacgcaagttacgacttgacatagtataagcacatgtgtgacgtggagaacagaagggaagcataaaactaacgaagatcatatctaattattgaacattgaagagatagatctctacaatatcctagaaattctttaataatcagaaaatgatcagaaattttatcatccaattaggtttacgaggataaatgtagtcggtacgtaatccattcatttgatttttttcatagtaaaatatagcactatttcgactagttgaaaaaaaatagttagataattacatttttgtggaaagttgatctctagtctatatctacgtagttataaaataaaagaggagtggttcatatcaaatatgctctaaaaatttcatgagcgacacacatgtgtactattgtgtacgtcacaccagagttggctaaattttttcattgatggtttttgtttgaagatcaacacgttgatagcttaatctgtttctcatcgttaaaacgtaactagtcccgaattctagtttacactatttttggattgttcgcaagcccagctggcaaattatattattacatagtttcagttgatatgtctctttttcaaaattatgttcatataccctaacgatacttaaattatagctttcgcttaatgatgatggatacatcatacctgctaaatttctctacctaatcggccagtttccttttggcctaaagaattaaaagcatcttccactaaatgttatacttttctattataattgtatatataataaggaacggagatattggtaatctaattactatattagtacatcacatgcactacaaaaaagaagtattgtgggaaagagatagatccgtacagaaataatgagggaggtgtgggcatgtgtttcaccatgatgagtgaacgtggtgcggtggagttagaaacctttttgtcttctctgtctcttttcgactgtactgttgtgtcgttcaaacaattatatatatgtcaaatgaatatgttttagagacaatagtaatatttatgttaggaacatggatcggtgtgtgtgttatggatgacaagatcttgaccacgtacgtactgataacaacgaccaaattatttattttcatgaggcaatttgaaattaaacaatctttaacaaatacaaatttcagattacaatcgcaagtgagatattgcatctctggttttcagttttcccttcgccggaaaacaaagttgttcgtcaccagactcttcctctagatcgcgagtgggctacttatgggcctttgatagttgggcttaaacttttcatatgttgaatttttagcccacataggcccaaatatatgtggtattatcataatcctgctttgactctttgaccattgtttctggaactcagtgcccacacaattcaaatacttgagctccgaacggtcgtcagctagggtttttcttcactcagagagaaccaaaa

SEQ ID NO: 912 - DNA, 3000 bp, Unknown
  misc_feature (1)..( 3000): cDNA_ID_2128239_gDNA_ID_1620337_Annot_ID_153819 3000 nt of promoter + ATG
agtgaccaaaagccaacggatttctcctctcaagaacctcttttcctttacccgaaccttcgagaggcttgctcaacgctttccataacctgtctgacccgttttctgcggttttggtgtttgctttgaccgcaggtgtgtaggacccgttccatgcttcccttgattctcccccaagaccccaaggttgagcatttattacagtcccatcatacctggtgatgagatatgagttctgtgaatcaaccttcgggtacccgggtatgtacttgtagaaagcaggagagtaaataactccagggtaaaaggctaagacggttccaacatctgcctcgcctttgataaaacaaccttgaccagcgtctttgtgaggtattacagacggtttggtctcgagggtgtaacccatttgatccattaatctctgtgagacgtcattgagtttcaaaggctttgtctcgggaacaactgtgctgaagaagaatcagtgagaatactaattaagctgaaagaaaaatactgagtaataagttcacaaatcgattcaagtaaagtaaaacacttacggggctgatctgcatgtggaaaagcattattactaccaatggcgaaagtaagaccacttctacgaggaggacgagggcttgttgattgtgaccccgactcgttcctcctaacatcaggaagaaggattccatccatcaaagagcagaatttttcaacttggtagtgaatgttctcttgaacttgcttctgctgctcagataaagtggctttaccagccatctcaatgatctcctctgcatcagtctcctcagcttctcgtcccaaccggttatagctaaacacaacaagttttcatgagcacaaatagtggatgtatatacaagaattaataacttagaaggaaaaaaactagagctaaactaaagactatcgtgtgtgatggttcacaaatccatattagaaatcagactttgattcttctgagacaaaaaaaaccaaccttgtatacataaagagtttgttaacgtctgcttcaaactgcagttgccttgggttcttagcaaatgtggtactcttggcaagaactccaacagcctgcaaatgcaaagtttatcaaatgagcaacttcattagaaatttatcaataaaaaacgaaactttacgattccccttcagcctaatttcaattcttctaatcttaattctattggtgcaaatcgaaaagactaaatccgaacaaaaaattcaaactttcttcacacccagtaagagatcaaacacagaagcaagagattcattaacctgctgaaatttgttgaaaagagtcgccatttttagttttctttcctctgaaacgattctccacgctctttgtttataaggattgcaagaaattactgaagaacatcaggaatcgcgagagcttggggcgaatcaaaaacctccattgatgaagaagactgcatctagtactttacttactcggtagcacacctccatgggcaggctccagcaccatggttgggcccatttcttattaatgggcctaaaatagagcttctagggcctctatatattttgtcttttctcttccgtttaggcgttttgctaactttcttacgtatatgaatgtgaattatagttagttaactttagaactgttgagcggccaatgccacgtcctttgtacgtaaattatgttattcatgctattatttatgtaccaattttctattctaatatatattctaagttttttttgtatcaatactaagtatttatacaatttttgcaaattttgacagaaagatagtacaaaaaatatgaaagaccaaaaactacataaaccaccaaaaattacaacacaaacagaaaacggaaagaaaactcaatcgaaaactctacaagtagagaccttaaaagaaacttagattccaaaccacaaagctcaaatatttgtgtggtttcctcaacttaaaagatctcaaatacttatagttgttgccactagcaatccaaacctaggccagttttcaaaatctctaaaaaagagcttaccattccaaacttaggacaatcctcataatattttaaattttatgacattttttagttttttcttaccgaacatagagatacaacgaataacacaaaataccaaattttactaaacaaacaattactgcacaaatgaaaaagtaatcaacaacatgagctcatttcacgaaaaaagaagcgaaaaagccaacggtcttgccacaaattagtatattgcaaattacaaatgcttaaaaaaattcacagatatattcatcaattataccttttgattatcttgcaaataaatcttccaattcatattacctacgtcaaaatttagccatctacccttattatcccattatgaaaatttcaaaatcgataagatgacagacacccaacaacgaattatcattttatatactataggtattagatacctacaatttatttggtttattgggaatatacgattcataaattccctcataaaaatataaagcaaatgtggacggaagcaaaaaaactaaatatagaatggagagaaattgtattattaacttaggttacccatcgccaacaacctctcatttcctttcctaaactatttcacaattttggtcaaaaacacaatctaaccccaaaaaagattcgacctttgaaattcccaaaaccagaagcaaaacccccaaaagaaccctacttatagtgaaagaaaagtaacataataatatatatacacgagaaccaagagccacttgaatataaagttcacagtttttgtctgctcaccaaatcaaaccaatttctcctgatagccaaagtttttgtccccaacaagaaactcatgcaacattcttcacccactagctaactaacgacttccattcttattaatctctctcaattcttcatttctgagattcatcgctctctcttctctttgtcacaatg

SEQ ID NO: 913 - DNA, 3000 bp, Unknown
  misc_feature (1)..( 3000): cDNA_ID_2128276_gDNA_ID_1620337_Annot_ID_153830 3000 nt of promoter + ATG
gaacacagctcaacaaaaaagtactttaaaaagactctctttctccctctatctctctatatatatttctcactagctctttcacacacacacacactttttctctctctatctcctctctaattcacacatcaagattcaagaatcaacaacatccttgaaatgaatattgtaattaactaattctagggttttcagattcttgttttttttggttagttaattagggtttcttttaagttgatctagctttcatatacacttgaatcaggaggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggttaacttcttcttctttcttgaattagggtttcagagatctatacatacatgtgtatgtatccatctaattaatgaggaaatgagctagatatatgactcgtgcttgagaacagacagttttcatcattagtttctgaagtagcaggtgtcatgagtcgttttttggattttcatttggcccagaagttaagaatctttgatccaatatttttgttcttgcagtatttaatttgtattttcatgtatcttatcatatttaatacgtatgggtcaaattctatatttaatttgtatttgacatttcttgatccagctttttcgtaataagaccctaattttttttacttatttttgtcacaaaaaagaccctaatttatgtagtatattaatgtgtcatatttacaacataaacatacataccgatatatatgtataagtctcatgttaatgattcaatttagtacaattataagttttagttctaagtcatgaaccagataaataagaaaattattcacatatagccataataggagaagaagggtgtgctaatagtttaagcgttgattacacaaaaaatgggtaaaacaccttttaaatttgttttctcctaaccaatgtttaggccaaaatatggattctacccttcagaacattattagttattttgatttttgtgttcctccagtgattattgaagtcttgacgtgtagcattaaagatactaaactgatcacattttcatattgaataggatgcctcaactcattgaccgatacttgcataccaacggattgcgacttcctgatcatcatgacgaccaggtatatatatgcacgcatactttttcctttgtgttaccaattgacaacgaaggaaatcacacattttcttaagaaacatatgatatattcatttgtatttttgtgtataggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaaggtaatgcaaatatatgtccatatctatacatattcttttaaaactatattggttacacttttgtttgatctctgctattaatatattgaagaatgagttaatgcagcaacagttggagaatctaagcagaaaggtcactctctaatcactctttttaaactctaatttcatctaataatctgattataccgcgtgtttaattatcattaccgtgttatgcatatgatcagaggaggatgctagaagaagataacaacaacatgtaccgttgggtgagtttggttactagcgaatgtcaatacgttttcacatttacgttggtataacatttttctacatataccgatgtttctcgcagcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatattttccaactaaagatcatctgtttatgtaatgaaacacccttgttctccaagttatgtttgtgaaaaaaaaaagctgttgctttgatgttttgaagtgaagattggccattacctggagacagagtgcaagagataagcaaaactattcttagactattagccgcaagaaatacaaaaaatccggcaaatgtcttatagactattagccgcaaaaaaataaaaaataaaaaatcccggaaatgtcttatagattacaagccgcaaaactattcttagattattagctgccaaaaaaaaacatgaggatctttgtaatgtctggtggattcagacagagtggatcataatcccgaaaaaagctcttataaaaaactaagccatgattgaaaacattccaataacttttacagaggactgcaagaacgatcaagaagcaagaaagacgtttcagaagaacaaacgtcttcttcttgttcttcttcttcctcctcttcttttttttgttttcattacgacgagaaaatttgagttcgtgatcgcttgaacaaccatcatcatcatctagagccccaaaaaagaagaagctgcgggccggttattttggttaattagtctaaatcc

SEQ ID NO: 914 - DNA, 3000 bp, Unknown
  misc_feature (1)..( 3000): cDNA_ID_2128288_gDNA_ID_1620337_Annot_ID_153834 3000 nt of promoter + ATG
tggtttttgacaacaaatctcaggggatccaagaactgcataacctcctacaaaggataaagaacgaggaaattcaagtaaacgttaactcgctatatactcgattttatgaatcttaacaatgaattagttttggcatcaaggaaacatatgatcttgatccaaataaatcttgtaatctctgagttatactagtatcagtttgaccatttagcaaccatacaaatgtaatatgaggactaacactacagtctttatggcactgaatctgccaaaacccaggtcctacatgaacattgagattttacagaaaacccaccaaccaacacaacaatcgcattgcaagtttcatacaaggataaatttcacgaacacaaagcttgaaattgcttatctttaagaaaattttccctttttactcacgcagttatgggcacgactcctaatcaattgtagaaaattcatagacgaggaaatgaacagaacctcaagagcccaatcgaaatcgagagtttccgcgagagcgagttgggaaaatcagggaattacccgatgctgagggagttccacagagacgatcgcgtgaaactttgacgttaaggaggaagaaagtttatacctttacgttgaagtgaacgatggtgtcaatccctattgtcaggagacgaagaagaagaagaagaagaagaaaagaaagaagaggaaacggatactctcagtcacgtgcgggtcacgtgagccagccttcgttttattataacttaataagggttaattgcgtcactaacattactgtcaccatacagggctcactgatgatcttaaagctagagagtctctcaaaaggcaaaagaagagaaaactgtcgctaaattacacagaacaaaaagatgggtcacattcagaaagcaactcttgttttgttggttgggacttgggacttgagacctctgtttgcaaaaatgagactgcccaagtttccaaggagttgtgtttagcttaagcgattgggatgttgggttcaccaagattcacaaacgcttctgcacgggccatccgactcatggcagcgttccacgacaccaagtggttcagaaatgtgtttatatacttagccctgtcgttctagcaaccggagaaagaaagaaacaaacactgatttagccttttgaacgaacaaaaagaacacagaatggtcggaatttaagctaggtttttaccttgtagtccagataataagagtgctgcaaagtaagataagaaaacgaaagatattagaaaatgtttcaaagtgtttcttggaagaatgacagaagagaggagatggtgtacctcccacacatccacgcagatgattggctgtaacaacaaaagagatgtgatcaagaggtaacattaagttcaacaagaaaactaactaataaaactctaacatacaatatcgtcccacacgagtgggttaatggcgtttgaggttttgaccacctcaagccttctctcttccctctttactgaaattttccagaaaaaaacaaaaagagaatcaaaattttccattttcaaagtcattctacagtttaataccaagtgaaaagctagtcaagtttctcacagacaagccagacccatccagaaccaaactgagtaagagctgcattagtgaacttttctctaaaatttgtgaaagaaccaaaatccttatcaatctgctcaagaacacccttttgaggcgtgtctccaccaccaggttgcatcgactcccagaagaaatcatggttatagacctaaacaacaacataatcatcatcaatccttccaacattagtgtgtgcctcgggtgataatgtacaagttacttagaatataaagtacctgtgcagcgttgttgaactcgggtaaaggattcccgttgttgtatgtagccttgataagctcttccatggtgtatccatagagtctatcatctttccctaactgtttattcagattatctacataacctcgatggtgttttccccaatgcacttctagtgttcttctactcatatacggctccaaagcatcctattcacatttgtttttaactctaattagaatctcaactataccatcttctttgacatatcaccaaggccctaaagatcaagacacatctactttgcaagatagaagatacacagatcaagacacaatctttcctatactcacaagacaattcacccaaattaacaaactttctacagttccgtgcttagtcgagaacagaattggattacagaagcaagacatagttactacacttagaatccaaatacaaataccaaagtcttatttgcacttacaagtggataaggaggtgtctttagaccgtagtaagcttcaacctttaaaccacctcgagacctaagagagcgtcttctctgctggttactctataaggaaacgaaatttgaaagctttagtgcttaaaagagatagattcatgtgaaacagaaccacagcaatttccatgtcacacaaagaaacgaaccagattgaggagcttgggggatttcaaacgtatactagaatctgaaattgtatagaaacagcttgtcgtcacaacacaagaactcatagttcctcccactgttgtcgtcaaagtctcacttctgcttcgaaagacagagagctacttcgcactcttggtctcgctttttcagagaaagggccttccttatcaatctcttttcaaaccggttaacatataagattttaccccggttaactacattaaaccggtaaatcgaaccggaaagatcaacctgaaggaagcaagggttttagcaaatactctgacgatcctttgtaaccgaacaacaaacaaaaagcgtatatttttctctctatcaagattcaagccgtgagctagaaggctaaaaccctcttcttatagatttcaaagcaaccattttcgaactctgtttgattccactgtcgatttaatcatcttacctaatg

SEQ ID NO: 915 - DNA, 3000 bp, Unknown
  misc_feature (1)..( 3000): cDNA_ID_3011889_gDNA_ID_1620337_Annot_ID_153837 3000 nt of promoter + ATG
tatgagtagaagaacactagaagtgcattggggaaaacaccatcgaggttatgtagataatctgaataaacagttagggaaagatgatagactctatggatacaccatggaagagcttatcaaggctacatacaacaacgggaatcctttacccgagttcaacaacgctgcacaggtactttatattctaagtaacttgtacattatcacccgaggcacacactaatgttggaaggattgatgatgattatgttgttgtttaggtctataaccatgatttcttctgggagtcgatgcaacctggtggtggagacacgcctcaaaagggtgttcttgagcagattgataaggattttggttctttcacaaattttagagaaaagttcactaatgcagctcttactcagtttggttctggatgggtctggcttgtctgtgagaaacttgactagcttttcacttggtattaaactgtagaatgactttgaaaatggaaaattttgattctctttttgtttttttctggaaaatttcagtaaagagggaagagagaaggcttgaggtggtcaaaacctcaaacgccattaacccactcgtgtgggacgatattgtatgttagagttttattagttagttttcttgttgaacttaatgttacctcttgatcacatctcttttgttgttacagccaatcatctgcgtggatgtgtgggaggtacaccatctcctctcttctgtcattcttccaagaaacactttgaaacattttctaatatctttcgttttcttatcttactttgcagcactcttattatctggactacaaggtaaaaacctagcttaaattccgaccattctgtgttctttttgttcgttcaaaaggctaaatcagtgtttgtttctttctttctccggttgctagaacgacagggctaagtatataaacacatttctgaaccacttggtgtcgtggaacgctgccatgagtcggatggcccgtgcagaagcgtttgtgaatcttggtgaacccaacatcccaatcgcttaagctaaacacaactccttggaaacttgggcagtctcatttttgcaaacagaggtctcaagtcccaagtcccaaccaacaaaacaagagttgctttctgaatgtgacccatctttttgttctgtgtaatttagcgacagttttctcttcttttgccttttgagagactctctagctttaagatcatcagtgagccctgtatggtgacagtaatgttagtgacgcaattaacccttattaagttataataaaacgaaggctggctcacgtgacccgcacgtgactgagagtatccgtttcctcttctttcttttcttcttcttcttcttcttcttcgtctcctgacaatagggattgacaccatcgttcacttcaacgtaaaggtataaactttcttcctccttaacgtcaaagtttcacgcgatcgtctctgtggaactccctcagcatcgggtaattccctgattttcccaactcgctctcgcggaaactctcgatttcgattgggctcttgaggttctgttcatttcctcgtctatgaattttctacaattgattaggagtcgtgcccataactgcgtgagtaaaaagggaaaattttcttaaagataagcaatttcaagctttgtgttcgtgaaatttatccttgtatgaaacttgcaatgcgattgttgtgttggttggtgggttttctgtaaaatctcaatgttcatgtaggacctgggttttggcagattcagtgccataaagactgtagtgttagtcctcatattacatttgtatggttgctaaatggtcaaactgatactagtataactcagagattacaagatttatttggatcaagatcatatgtttccttgatgccaaaactaattcattgttaagattcataaaatcgagtatatagcgagttaacgtttacttgaatttcctcgttctttatcctttgtaggaggttatgcagttcttggatcccctgagatttgttgtcaaaaaccagcttccattactgatacactatgcctccgtctcattctcaggtctgttgtagttcttgaaacaaattatcataagctttgatcaaacaggaaagaaaacctcttataatctttcttgattgataaaaatgacagagatcttcagtgacaccagcatcagacagttatctcaaatgctactatcactaatcttcttccacatatccgaatacattctagccatcaccattcacggagcatcaaacgtaactcttagttcgcttttaatcaccaagcattacgctttagcaatgcttctgtcgcttctcgaatacctaacggagattatcctcttcccggggctgaaacaacactggtgggtcagcaactttggactcataatgatcatcgttggggaaatcatcaggaaggcagcgataataacagcgggaagatcgttcactcacctcataaagatcaactacgaagagcatcacgggcttgtgactcatggtgtgtatagactaatgaggcatccaagttactgcggttttctcatctggtcggtcgggacacaagttatgctctgtaaccccgtttcagcagttgcgttcgcggttgtcgtgtggcggttttttgctcagagaataccgtacgaggagtattttctgaatcagttttttggggtacagtatctagagtatgcagagagtgttgcctctggtgttccatttgtgaactgacacttgaattatttttgaacatatgagtttgatgtacttgacttgaggtcttaaagtcacaaaaacatacaagaccctctggctgaaagagaaggtcttgacgtggatatgaaatttaccacagcgttaattgtttatgtgacacctgtcaccggtgatgcatagctccggcgaagagtttcggagaacaagtttggtctttttaggggtttgagcagtggagtcggtaacc

SEQ ID NO: 916 - DNA, 3000 bp, Unknown
  misc_feature (1)..( 3000): cDNA_ID_3059587_gDNA_ID_1620337_Annot_ID_153821 3000 nt of promoter + ATG
tctgagcagcagaagcaagttcaagagaacattcactaccaagttgaaaaattctgctctttgatggatggaatccttcttcctgatgttaggaggaacgagtcggggtcacaatcaacaagccctcgtcctcctcgtagaagtggtcttactttcgccattggtagtaataatgcttttccacatgcagatcagccccgtaagtgttttactttacttgaatcgatttgtgaacttattactcagtatttttctttcagcttaattagtattctcactgattcttcttcagcacagttgttcccgagacaaagcctttgaaactcaatgacgtctcacagagattaatggatcaaatgggttacaccctcgagaccaaaccgtctgtaatacctcacaaagacgctggtcaaggttgttttatcaaaggcgaggcagatgttggaaccgtcttagccttttaccctggagttatttactctcctgctttctacaagtacatacccgggtacccgaaggttgattcacagaactcatatctcatcaccaggtatgatgggactgtaataaatgctcaaccttggggtcttgggggagaatcaagggaagcatggaacgggtcctacacacctgcggtcaaagcaaacaccaaaaccgcagaaaacgggtcagacaggttatggaaagcgttgagcaagcctctcgaaggttcgggtaaaggaaaagaggttcttgagaggagaaatccgttggcttttggtcacttagctaaccacccagcgaaagagatgactccaaacgttatgatatgtccttatgacttccctttgatggcgaaagatctgcggccttacattccgaatatatcttttggggattctggagaaataaagatgaaaagatttggaagtttctggtttaagacagggagtaaaaacgggttagaagctccggttctgaagacactggtcttggtggcaacgaggtcgttgtgtaatgaggaacttttgctgaattacaggctgagcaactctaagagacgaccagattggtatactccggttaacgaggaggaagataggagaagatggagctaaatttctcttttatgttttaatgaaacttgaaaggctctgtttcaaaacatgctcctcggttttctttagactattagcgggacgtcgtttcgctgattgtgtcactatttttgtttttcgattatttttggaagacattttattctaatattttatgttgttctgttgttacatactatggacgaagagcaacacacgactctgtgatgaaaccagtgctgcaactgtaatagggaaattacgtaatgccaatgcaattatagagttctcaatggatggttggaatggaacaatggtgatgatctgtgttgttgaatgtgataaatgacttaatgatggatttggttttgtagtcaaaattattgaattgaagacgttcaaaagttatcggaaaatatgactaccgaataattaccacaaaaggaatagcgaattcaataaagtagacataaaatgcacaacttcaacataaacgattatatgaaaactataattgtataatcttataactctattatctataatcattgtgagtatatcaaatgttgtttaaactcactcttgaactatttgataacttaaacatgtaataattatctacgcaaaaaaaagacatagtaattgaaaaaaaagagagtaaatgtttacatgtttatgatcttcgtagagaatcttagctagtttcttttaaaacacgttagtcatataataatgcaaacaaaaaaatttataaattttttgtttgtaaacatttcatattgatcacactgtaacataaatgcctcgtgacttcttaatgtatataggtataataggagagtacatgtagatgtagatatacacttctatgacgtatataaacagaaactgaatctttttattacgcaatcaaagccgtaacattctgttttgttatatgacaggtataatttactttgcacatacatcacaattcacacattatattatataaaaatatttatgtagatcggtcgttgctaatttcaagggggaggaacatgaaagattgagagagagagaagtaaaacagtgtttggtcaaatctctcttaagaaataatcttatgaaatgaaccgtcactttctttgctctgctctgctttttatttggatccttctattccaattcattgaccaatcacttcattatctctaattctctaacattttttttatattatccttttgatttatatatcaaattatttcaatcatgatacaaaaacgatattggagacatagcacaagttgcgtctgtctgtacgtattttctatttatctagtatagtctaacaaaaagagaaattgcccataaaaagggaaactcaatttctaacaaacctttctatttttataaagagaatttgctactattattactgatataaaaagaaataaaatttcttgctttctatcatatttgatattttttgatgtcttcgtcttaaggaaatggttacaaagacaagtataatcatataattcaaatagaaaacgatattaaagacagatcacaaattgcgtgtgtagatatttcaccaagtgttaacaaaaagagaaattcatataaaaaaaaatatttataaaactgcaactattaatttattcaaactaattaaaaagaaagagaaaaatcttcctataaaaagaaatgaatctttctttgtaatcagaaagaaataaaattctttttacttttccagaatttgatttttctcatgtgtcttatcttatgaatatggttaccacccagtgagactacagagtgttcttatctgtctctgaatcccattctctctctcacacaacattatataagcttacacagtcacttcacaatttccacaaattcgatatattaaactataataaactaaaaagaa

SEQ ID NO: 917 - DNA, 3000 bp, Unknown
  misc_feature (1)..( 3000): cDNA_ID_2128418_gDNA_ID_1620338_Annot_ID_153853 3000 nt of promoter + ATG
taataataagagggtaatttaacaaggtttaaacagaagataggagatgagtgtagtctctttctttatacagagctaagctaatgaacatacgaaccgggcaagccttaaccgaaacgacaactggttcgcaacataaagtcacaatttgtaaacgtgatgttaaatgtaactcttttattctaaacatctaatcaccgattcggggctaaacttataataaaattaaattacggtccttattcataagaagatataaaaccagggggcaatttgaagtttctcggttcgttagtacttcgtacttggcttcttattttcccgggaaaacaagaatatcagaagtctctgtaactgaatctcacatatctctctctttgcacagagaaccaactgagaaactttcttcaacgatcgaaagaagctgcttcaatggcgaaatcgatgagaactatcaaaaatccattctttacttcgcatccgccatctccattcttccatctctctctcctcttcttcactcccctgaagaaatcaagtccccgatacctaaaccaccatcaccaaactcgatgcccacctccacagtttttccttcttctcatctctctttctctcgttttctcgggaatttcatttctcacattttctttagacactggatcgtcaacttgcgtctccacatcttccgcttcctctctcaaattcttcatctccgatgtcgatcaccgtcagatcttaacctcccttgctgtatccggagcttccacgttgtttccgttaccggcgagaggaggacattccgggaatatgacggaggaagagaaagagttttggaaacaacccaatggtgaaggatacaagccttgtttggattttagtttggagtacaagaagaaatcagctagtgtttctaaagagaagaaacgattccttgttgttgttgtctctggtggacttaatcaacaacggaatcaaatcgttgatgctgttgtaatcgctatgattcttgaagctgctcttgttgttcctgttttgcaagtgaatcgagtctggggagacgaaaggtaacaaaaacacaacttgatcatctctcttttctgggtttatgattcgagttactgatgatctcttgttgtgttttctcagtgaattctcagatcttttcgatgtagagcatttcaagaaaacgctgagatctgatgttcgtatcgtttcttctctaccgtcaacgcatcttatgtctagacaaacaattgagaatcagattccttgggatgtttctccggtttggatccgtgctaaatacttcaagcaggtttgattctattgtttactagtttagggtttatgttttctctgatcgattcttgaattttgaatgttaactacgttgtagttgaatgaggaaggacttttggtgttgaaaggattggactcaaagttagccaagaatctaccgccggatctgcagaaacttcgatgcaaggtaagatttttcaatcaaccctttgttttccagtctctagaggaaggtttaatttgttggtttgtaggttgctttccatgcactgagattcgcggcaccaattgagaatctcgggaacaaactcacgagaagaatgtggatagaaggtccatatattgctctccatttaaggctagagaaagatgtttgggtaagaaccggttgtctcactggattaggctcagaattcgatcggatcatagcagaaaccagaacgtctcagcctcgatacctcactggtagactaaacttgacctatacagagcgtagacttgctggtttttgtcctctcaatgtatatgagattgcaaggtaacttaaaaggaagaaaattgacatgaaacagagctttgaccatttgtatacatggtttgaggaaacttaatgctcgagtctttttttttttggatcaaaggttgttgaaggctttgggagcacctagtaatgcgtcgatatatattgcaggaggtgaaccatttggtggctcacgagcattagagcctctcgctaaagagttctctaatttggtgacaaaggagacattggctcataaaggcgagctcttgccttacaccaatagatcttcagctttagcagctattgactacattgtatcacttagcagcgatgtttttattccttcccatggtggaaacatggcaaaagctatgcaggtaacacagaagaatagtcttttgagattttccaaagtttctttcttaaactctgtttttctctcagggaaatagagcttatgtaggacacaggaagtttataatgcctaataagagagcgatgcttcctttaatggagaattcttctgtttcagatgccgagctcagttttctaactcggaagcttcaccgtaagtcccaaggctatcctgagtcacggagagggcggagagatcgtgacgtgatagcttatcctgtcccggagtgtatgtgtcgacatagaaaacacaggtctgtaggtttcttctaggtcaggctcattgcttctcaaggcagcgattgtcacaaacgctggtctattggtatagctcggttgccttgctcctcaaagcaatactagtccagctgcaaccaatcggcgttagacacgtgtacatataaatctactgtaaatgtacagattcctttccatgttttgcgtacaaaatttcatcattcgtacaaatcactgagctctaactaataagaatgagacacgtgtaaaaagatttatggcccacagatctttgacgaaagaacgttgatacttgacagcctttttagttattttgtttagtagttttgtaaacaaaaaacaatataataaaatcgatttgccgttaaaaaaaaaaaaaaaacattgattggtttagggattgccacgtatgcattaatttatgtgagttcatatcttctcgcaggcgcgcatgttcaccgccgacgaaaagattactgtatctctaatcgtcttccagaatg

SEQ ID NO: 918 - DNA, 3000 bp, Unknown
  misc_feature (1)..( 3000): cDNA_ID_3059645_gDNA_ID_1620338_Annot_ID_153858 3000 nt of promoter + ATG
aggcatataatcttgtcatttactaataattctttagtaacaaccataaagcttattgagaggttgaaagtggtggaccggtgggtgaagttataaatgcaaatggttgaggcctagggaattgagttactaactgtgtacccaacattaagtcacagcctgtcctttctatatcgagtgtgaaaggtcaaagatgcgtacctttgtttactcttcaattcacactttatatacgactactactagtactacttgaactcaaataataacaagaaattggagtgagattatatgattttcaattatttgtacgtagttcagatgtggtgtgtgtgtgataagtctttgatttgtagtgtataagaaaatagcgattacagcagtgtggtttgaaaatgttcgatactatgcgttgtcattgaattaatttgacaatggagttatggagcagagagactctctcctttaaaaattaatttcccaaacaatgaattctgatagaataaatttatgcacatttattttatactatagtactatgtgggggacaaaaaaatactatataatcaacgttattttcatactatttaataaaatacgtatataaatatcgaataagatggtttttgtttgcgtatgaattaggtagatgtgataactcgctgtctttgatttttcataataagccgtcaatatccatttatcactagttggaacttggaagtgtatatatatatatatgatttctttttaagttctgataaagcaaaaaagaatatgttgacttggtcaagtggtccaatgaatccaatcttccagcgggccatttataaagagactatcaaactaaaaagtggtttacgagtataaactaagttgataaaaggttttttgttttgttaaaaggaaaattatgttttgcagaatgatttatcttacgagtataatgatcaatgatgtattcttaaaagcatgggaagattgacttcggtttaaaaatatatccagtttcaagtctctcacgttaagtgtaatagtaatataagatttgacaatctttatcatcgttgactttgaccaacaaaaatagtcaaatattggatatttggatattttctaatttattcagacaatgcaaaattgcaggttcagtatcaatgtatcatattcatgggatttcagattttgtgatgactattttagaacactactttgtgattatctgaaatgttatatttaggaataaaaatcttagctaaacttttttttttttttacattcgtgctatttgaaagaaaaaaaaaacttatagttgctatgaatgagaaaccatcttcctatgtatgttgacctgataatcacttgctatgaatgagacatttttatataaaaaaaccgctatgaacgagacatttaaaaccatcacgttgacagcaaactgcatataaattaagttaccgaatggtttaatgggcctagtaatgggccaaacagtctttctcctttatttcagattgatatagtggccactacaaatgcaggacctgtcccgttgaggaataaccggttttcaattcaattgagagaaggtttattgtattcgtcgtctcccatccgataagagagaaagatagtttacagtcacagagatacttttctcactcatctctctctctctttcccgcttccctccttaaaccccaattcttctcctgctcacaaaaaccctatcttttgggttttgttatacagtgatgatgaaacctgcttctttgcaaggtttctcctcacatgcgtcctcctctatctactccgatgttcgcaggccagctactactccttcgaaaatggcagcttttagtgccctctcgctttgtccctatactttcaccttccgccaaagctctcgaattaagtctaccgtttcctgttccgtcacttctgctcctgcttctggtctgttgtttttctttctctcctcgtcttttcctattgggttcctcggaaattaagttattgattgagtaaatgtgctccactactgtaatgggtttggagtattttgaattagcatagaaaaaaattgaaactttataagatttttggttgatagtggccgatagtttggacagagtttctatggagattctcactctgattctgttgatacttgatagtatgagtagaatctttgaaatttggttgttttatgtgtcgtgaatggaccataggagactgactagtcgagtgtttttatttgtgtgtgtattgactctatttgttgattctggtgttatgtatcaggtacatcttcatcctctaagacgccacgtagaagatcaggtcgactagaaggagttggaaaaagcatggaggattcggtgaaacgtaaaatggaacagttttatgaaggaaccgatggaccacctctccgtattcttcccataggaggccttggtgaaattggaatgaactgtatgcttgttggaaactatgatcgttacattctaatcgacgctggtataatgttccctgagtaagtccggagatacattcatcttgttaatattggcgagaagtcattatctttgtgtgcgtggtgctaactctccgtggaaaacattgctgtataatgttacagttatgatgagcctgggatccagaaaataatgccagacacaggatttatcagacgatggaaacacaaaattgaagctgttgttataacgcatggtcatgaagatcacattggtgcgttgccttgggtaaggtcttcttctactccttgaaaaatccataatgagccatagacttttggagatttctagatagagtctagcttttatttttcaattaacagctgcggctcgtgtgtataatgcagttcttttcctcagtccattgctggtttctgttctttttttgaccgatacccttttacatgagcaggttatcccagcattggaccctaatacaccaatattcgcatcatccttcacc

SEQ ID NO: 919 - DNA, 3000 bp, Unknown
  misc_feature (1)..( 3000): cDNA_ID_3059635_gDNA_ID_1620338_Annot_ID_153862 3000 nt of promoter + ATG
aaccgtctgtaaattttttcgtttagaacatccactgttctcttttttctagatacatgtttcaatcttgtagttattttgatgtgttcaggctggaactactgcgggaataggtaatgaggcgacaaacacaatgatgcaaaagttttgggattcagctatggcattgtctcctaatgaggacgatgaggactcgagaaggttattagctagtcttacttgttccactatttatcgagtttcttttcaaagaaagctttggttttgctgactttgttgacaacatggggaacaatttgtttcagtgagagctccatgaaggttgcttccgaagctgagacaggaaaatctttcccttttgcaaatacattttctttcaaaattgaagacaaaaagcacaggaaacacagattcataagcggtaaaaataattttgatttttattcatcaagtaaatagttgtagtcttgcttttacttaactgaattggttctttttgcagacactcggagtttgacagaggtgataaccgcgatcattcagagggtaggggatgatatcgatccagataacttcccccaaattttggtaaatattttcttttacataaagactatgatgcaatcattatctaattcttctcttgtcaccccctgaattgttaaaatgatggttataatgtgcagtatgaagatgaagaccacgataaagtgttgttggcttcagatagtgaccttcaagcagccatagagcatgcaaaatcaattggctggaaggtaaaaagaacgatttcctcctgctttaaacttttggttgataagcaacaagaaccaaagtcgaagatgaaaccttcatgagattgcccataaaccccttttgctttctgaattgatttgatcattataaattgcagagtctgagattacatttggatgattcaagagaaggcaaaggaagaagaaggagaagagcatcaggatcagcagaatcaatggagtatgtagagacagacgcttgggctgctgcttatagtggagttgcggctggtgcagcattagtagctggtcttggttttatggcttttctcagaaaattcggtcattgattcctcagaaacactacaagaagtgtttctttaacagatcaatacaaacaaaaaagaaaaacagacacagggtttgaaggttttgtctgaaatatttttatatacaaaagtcatttttgattatttttttggcttcatgatatcaaaataacaaatatctaaaactaatacatggagtaattcaagaacaaggcttagaatctttgtctaaactgatctcactattgtcaaaaaaataaaactcaaacagaacaagggctttgccatgtagagatatctgctataagttcccgaagtttatctataagttctttaacatgaacattcttctttgcaatctcctgcatgaacaaaagcttccgtttattaatgccaacagagaagaacaatataatcacttcccataaggttattaacatagaaatcaaaatgaccagatggctgaaatgtattcaaaaaattatcaacatttccatggttctagaaccgcttaagctataatgatacaaacacttacactagacagtgggaaagaacactttatacaagaaaatatgaatcaaattcaatgctatgtgagttgaaatgtacagagaattcgagactgaatagtgtatcaatgtagtaacatcagattgaaaacaaagagatgtagaaattgcagaaagctttaccattctgagacttaaggcttgctcctccaatttttcgatctcgtcttcactttcaggagatcctaaaccattttgcatttcagatgcttttgcctgtaatagatgaacaaattcaaatttatgaaacctcaaaaaagctctcatttaaaattaagcaagttcactacaagtgaagaacaagacactcaacaagcattagatccttcatctaaactctctatcgattcgaagatttcctaatctaagatctcaaaacaccctaggaattcaaaatttcctcagtccagaaacaactcagaacaaaacacttctcgaaatagttagtaacatcacattatgttcaataccttctgcgaatttggaatcgcagcaagaacagcacgaagcgaagtcactgagttcttataccgaagactcgcctcatccaaaacactatttccacttcctccgcccccgccaccaccagcagattccgaatgatgcgatgttccatcaatcgcagccgcatcggcggaaacgagagccgaaccattagaacccgtcgtcgtcgcggcggaactcggggtagctgaagtagaccacaaagacggattacaaagctcatcattcatggctgaaattatctgaaacgccgcttcaatagtttcttccaattgcttctctccttccatcgctagctcctgtgtcgtcatcgtcgtcgtcgtcgagacctgtttctgcagcatcaccgtgaacacactttatcacggcgtcggttgactaaactattaatacgatgtcgttttaatcaaactatataatatatatatcaataatatagtttttatagataaataaaaatagaaagaaatcagctacatcgctgtctaccttatccactattactccaatccatatgacaaaaactatctaaaacgttagtttgatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatg

SEQ ID NO: 920 - DNA, 3000 bp, Unknown
  misc_feature (1)..( 3000): cDNA_ID_2128467_gDNA_ID_1620338_Annot_ID_153868 3000 nt of promoter + ATG
tctaaagagaaaaagttacaacaaaaaaaaacaaatgagtttattagctggaccaggttgtgttattggttgaaaacgatgagaaatcaaatgacgttaggtaaattccgttacatgaaagtaagtgacgatagttgattggttatcttgaaaagttaatcaaacgtattttcgttttagtcaatatgaccattaattacaattgacagcatgtataaactcatttttggataaactataagatatataattgagtctagtctaagaaaagcgagtttgttgtaagttttattctaaaaatttggtcatctccaaaacaagtgagcgaaacactggctagtcgtaactggtaagataaaaaactgtgatattacatcaacaagtttcactatcgagtgagacatcttcaagcaataatcgagaggatattaacatcatcagttaccacctcaattttcccatgcattaaatactgacgtggcgccaagtaggacttcacacgtgtggggcatgaactttgggatcgcactgtgggacaaatatttgtgttcccgaggcttacacatggaactgccgacttggattcttctctttctctcgacttacatttgtattaaaagagtatctatcttttcttttcttttcctctccctcttttgatttttttccctcacatatcacataatactccatattactaaaacacatgaaattataaagagaataacaattgctaatccaattatggaaatttatcaatagctaaaaaaattagaaactgttgtaagtgagtactaatatttaaaccaaaaaagaaaagaataaaaaagtaagtgctcatatgattctctcatatggtacaaattgctaaaatcttattggtagcagtaaaacagtgaaaaggtcaaatgatgatacttaaagctgattaaatagtcaaaccccaaacacattcgtgattaaagctgatacaatagtcaaaactgaacacatccgtgaaaactttaattatttttggtaaatactagtaaaatcgaagttcatttagttatttttttttttttctgtcttcaccatgttttaatttagttattatgcattttaccatgttacttctacccacattggaagaaactttaaaatttctagttgataggtgaaattaatttccaatttatatggttaaattggtatgactagaaccggtatatatatactcaacaaaattaatatcctgtttgatgaaataaataaaatatacacaatctgttacaatgttcatatcttttgtctccttttaatggcagtgatataaatgatggatctggtaaaaattaaatgcttttttctggcagagagacaaacgaatccaatagctgacgctgacacgtcatcagtaataatgacgtaacggccgtttttgttggcttttgttttttacctccttacacgtcattcttgctttgtgcccacctcgttgttaacggagtaagttgttggcgttaataaacagtctaatctaacagatgtttttgtttcaatagcgctataattacataagtacccttttgccagaaacaaaagtggattttgttgtaagaaaatattcgtaccaccgcaccacaattagattgcttttgaagactcatgaattaaaattactatatttgttttgtgcgttttattttttactaaatatatgaaaaaattccagaaataaaaataaaatttggtttcacggttttgaaaactgtacaatcacatggtgatttttaatgaattatatgttcaatttacaaaatagatgatcatagaaaacgtttcttttacgcgaaaaaaaagaaagatatataatctcctgatacattggataaacgataatttgctcacacatgatacatgcatgtgttttggtataatctcctcgagttatatttctaatccgataaaggaacgtattggcctcgaatatcgattacgttttaggttcttattacgatccctcaaccgtactacatgtctaaaaattgaaagttaaaacttatgaaaaaaagctttggtatatgctactgtctttcgcgttgtgatcaaaaatcaaaaacagtctttttttttcttccaaactcctctctctctctgtatatatacaagtatattctagcaattaaggagaagaaaaatctccaatggaataggcgtataatcaatcagcaacagtcaagatatacataagtggtttactaattgcatactagaccccatctctcacaaatcacaataataacaaagaatgtatgtttgagttctataaccaaacttaaaatgttaactaatcttctagtcatagatttgtaaattattacatggtgaaagtgacgcggcataaactatagatttttaaataccatatatttttacacgtgatcttttttttacggcataacataggtcaccggatatgaagttgaataatacgatgaaatactaccatccaacatgtactaacgagggcggtcgctggtcgccttttccgtagctctctttttgaaaaactcaataatacattaatgtaacaaaatgttgagattggaaaaagattcttcgttttttcaggaaaataaaataaaattaaagatgataaacaaaaagaagaagatactttgtgtctatatccaaaacaagtacagtgtgacatattaaagataagatttcttatctcaaattttgtgggtttcttcttttcttttcttttgtcaatgatgtccgaataattttcaactacaaattcatagtttacgaacagtacagacaaatagataaccgattaaaggaccggaatgtatgaaaaaaaaatcaatctgggcattttaagagagacgcggtttaagataatgggcctattcttttgataaagcccaatgtaacttttatttttttaacaaacaaaaggcccaaataaattcgccgaagagaaaaataagaaaatttgtaactctcatg

SEQ ID NO: 921 - DNA, 2500 bp, Unknown
  misc_feature (1)..( 2500): cDNA_ID_2128477_gDNA_ID_1620338_Annot_ID_153872 3000 nt of promoter + ATG
ctttttagtttgccttttcctctgcgtagtaacaaaacagggatatttgtacaacccatggtcaacaactaataaatcaagtcacatagatgagaaagcatataataattcatgcgaatgacggtaatccaaccaaacatttaaaatcaaaattcacaccagtcatatgaggaaaataaaagaaaaacaagctataaaggcgccagtagcaggcaatgaatgcaaataagagaattgagataataacaaagtacaaaccttggcaggggtgtccgaagattctccagatttccccctttttggtgtactcttgcgctttttcgcctgctaaaaatgaattcagtgctcccattgagaatgaacatgtagaacaataatgtactgattccaataataccttttcttgatcagcaattataacatctctagtttccttgggagattccaaaaattcaagcactttgacagctagttcttcctggcagtatcaggatagaggatttcttagaatatagaacaaggtgcaataaatagatagactacatcttcttatcacttacttttttcacgttacttctgcttatagggatatcaagcacatcacaaaaaacaatcaatttttcttttacgcatttgtcaatcttctcttttattcgtgctctctgcttctcctcctaagaaacatttaaataaaagtttcaacaccagggacaacagcatacacatccctgtaacaaaataaacttgaaatgggttatacctctttctctgaccaggcaaagccagaaaattgaccaatgtttctcttaaccatctgtgcctgtagagaaattttcacaaaacgctttttaagtagctatgcactctggcaaagaaacaatgaaaattccgagacgacatccatactaacagagacagaagcttgcaagtgaaacataactaccatatgtggaatataagagcaacttttagcgcacctttgctttcttcccaaaaagaatggtgtgtagtaacatcaggttgtcatcagcttttctcttcgatagtttatgagccactgaaacagcaaaaattatcagacaactttctaatcaaaaataaatgtaaacaagtctttatcaaaataactaaaattttcaccctcaagctaaacaaacaaacaagagaaagaaagaaagaaaaaaaaaatctcatcttcttatcaacaacagtgcagagtatgagtatttctccacagcaaaattaagcaaatcacagacagcaagttaatagactaatagtgatattccatcagaaagtcagactataggtatcaaattggtagaagtaatagtatccaagtagaccaaaagcccaagcttttctaatgaaatggttctatctataatcatgccaacacagacaggaaaaatctcacaatagctatctcatcttctagatctaagatgtgccaaccagccaagattgttcatcgttctgattaacaacaattagatctacacatcacaaattcacaagacttcaatcaaaacaaccacaaatcgaaattgattctcatacataccatttggaatttctctgagaggtgttccacgaccctacaacaaaaaaccataactaattgatccaattctcataaagacaaataagaaagacaaacaaaagttccatcaagctaccttttcaattgaaacggacttgctcggtggagcccgcataggagtcgacaacgagaaacgctcaaccttctttctctccctcgttggtctctcactagtcggagtcaccgtttccttctccgacgatttcttacttccacttccttcttcttcttcttcttcctcctcactttctacatcgtcttctttatctttctcacccaattctccttctttcgcttcaccctcttcttcatcttccttcttctcctcctccgcttcgccaattctcggcgaatccactttttctttctctacctccttctcctccttcggaacaacatcaatttcctccttcgccggagaattcacttccggtgtcttctcatctagggtttcagtcgccatttcaaacccaaacaacaggcgaatcaaaacgtgaaaagtcaagaaaaaaaaaaactcaaatttcagatttggggaaactcgaaattgtaaaaccctaattcaacgattatgaagaagagaaacaaaaaaatttggggattttcaaaaattctggtaccaaaaattagaacacaaaggcgggctcttttcgtcacccccaaatattttcaccaaattcagctcgcggcaaaactaaacccaaatttatatacatacacatatacatacatacaacaaaactcggcccaattttataacaggccccattttcctcctaatgagcccaattgcgttctggcttctaaacaaactttttcaaaaaaaaaagcaaaatagaaaattgattttggagggaaaaccaataaaattccctaaatttcgccggcgaagaaatg

SEQ ID NO: 922 - DNA, 3000 bp, Unknown
  misc_feature (1)..( 3000): cDNA_ID_3059624_gDNA_ID_1620338_Annot_ID_153871 3000 nt of promoter + ATG
tggggtttgactatttaatcagctttaagtatcatcatttgaccttttcactgttttactgctaccaataagattttagcaatttgtaccatatgagagaatcatatgagcacttacttttttattcttttcttttttggtttaaatattagtactcacttacaacagtttctaatttttttagctattgataaatttccataattggattagcaattgttattctctttataatttcatgtgttttagtaatatggagtattatgtgatatgtgagggaaaaaaatcaaaagagggagaggaaaagaaaagaaaagatagatactcttttaatacaaatgtaagtcgagagaaagagaagaatccaagtcggcagttccatgtgtaagcctcgggaacacaaatatttgtcccacagtgcgatcccaaagttcatgccccacacgtgtgaagtcctacttggcgccacgtcagtatttaatgcatgggaaaattgaggtggtaactgatgatgttaatatcctctcgattattgcttgaagatgtctcactcgatagtgaaacttgttgatgtaatatcacagttttttatcttaccagttacgactagccagtgtttcgctcacttgttttggagatgaccaaatttttagaataaaacttacaacaaactcgcttttcttagactagactcaattatatatcttatagtttatccaaaaatgagtttatacatgctgtcaattgtaattaatggtcatattgactaaaacgaaaatacgtttgattaacttttcaagataaccaatcaactatcgtcacttactttcatgtaacggaatttacctaacgtcatttgatttctcatcgttttcaaccaataacacaacctggtccagctaataaactcatttgtttttttttgttgtaactttttctctttagaaactcatcggtctatactcttgatctaagtggtattgttattctaggcaagaaatcaattatattgaacaaacatcttatcacgcacaatccggtcgcgatgaaagaagtttctacttctagttgaggccgtcctaaatcaattcgaatacgtattttagatcaatatttggaatgcaaaaaaaaaaatgacggagggagtataaagaacccatatttaatttgtagactagtctatatatcttcctcatatcttagtgatttgctatgaatctttcaattgtaagaccaaatgtgttcaaaatagtgtttaatctgtatagtatatgtatacattagaaagaaatatacgtacatgtatatatatatatatgcattaaaagatgtgctttatgaattaaggtaaaatatgtgaaattatgtcaacattattcttcccttttagggtgtattttaaaacagaagctcattggtactttaggtttagcataggctataggttttagttgttatcgagaatgccgtgtttacttcatcatgaacatctcatgttaacaacatgcattttaagttcttcaaaaaaaaaaaaaaaaaaaacatatgcattttaagtctttgtaaagagatgtaacattgtttatgttatctttaatcaattaaatacgaagttataatttacatatgaaaggtaaaaataaagaaaggtaaaaatagtaatcaataaaatagagttattttgatcaattatgctgaaatttcatgaaatatgtgagaaatacatctattggacaatccactaactgtcaatctcgagaattagaatcgtgctttgacagttttaactatatatagagaaacacaaatggcgtgagttttaggtttatattttgactgatacattactaaacaaaaatattaaattaagtactaaaataataaatgagtgaagtaatattagattcacgtataagtcatgtctaaaagggaataaaacaaaataatttacatttcttttcagatcttgaggtccacagttccaccttcgtaccaacacccaagtggttctttagagagagagagatttataagcttctctttgggcattacaattttttttgtgaacatagaaacactcaaaacttcaaaccaaaaaaaataaatgggagaggttcaagaaaatcctaaactcttatatcagcttttcaaatctccatgaataatattaacaaatttgttctgatctattttattttatttttggtatcaggaagagaagaaaccagaagcagcagaggaaaagaaaatggaagagaagaaaccagaagagaaaaaagaaggagaagacaagaaagtggatgctgagaaaaaaggagaagattctgacaagaagcctcaagaaggagaatctaacaaagattccaaagaagattctgctccggcggcgcctgaggctccagcaccgcctcctccgccgcaagaggttgttcttaaggtttacatgcactgtgaaggatgtgctagaaaagtccgccgttgtctcaaaggcttcgaaggtatgtattaaaaacagatatgtgtagagaaaaaaaaaagaattaattgatttatataattttgcaattccacacaaatcttttggtttacatttttaaaaatataaaaaattcagttttccatagaatagtttcggaaacaattttttaaagatgattaattatattgtggctttattttaaaaatatacaataaacacaattatcttgtattctttccagcatcctatgtcaattgctgtaactggatatatcttgtttctgtcaactatagtttttttggttaatctcgtatctaagtatagttaatattcgtcatataatttgtgtgtagggccacataaagttttggttatgctttagtattatagcttttgttttttaaaaacactcaaactagaaattctgtttttgggtaaaaatggtaaagctaatggtttataaaaaaaatatataactttggaattttggttgaattaatcaattaggagtggaagatgtg

SEQ ID NO: 923 - DNA, 3000 bp, Unknown
  misc_feature (1)..( 3000): cDNA_ID_2128465_gDNA_ID_1620338_Annot_ID_153867 3000 nt of promoter + ATG
tttctcagcagccctctccatacgagcaattgcatcatacaaacactttgctatatctaataaagcaataacttcgccattttcaacaaccggcaaatgtctgaattttcctgcagtaggtaaggttaagatatagcctcattaaggatctagacacagcaatcagataaacatcaagtttctctagcttaaaaacaatgagacaaaccttggaccatcttttggagagcttcaacagcaagtgtttctgagagaacaaacattgggttcttcgtcataaccttagatacaggtgtttcctcgacattaagttcctgtgaaatcactcttgtagctatgtcctgaaaatccaaaaaagacacacatacacacagatcaatgaagtctccatttccttcttccaatctgtttctaactttttaactacacttagcgaatagtggcataccttatcagtaagaataccacaaagcatttcattagagtcagtcaacaacaaggcatcaactcgtcgtgaagccatccttttacaagcttcatatatagttgttgttgctggtactgtaagtgctttcgatagccttaaccgtttcacagtccgctcgcctcctgttaaacccctgctccatatacagatgagagaaaaaagttaaaaccaaatcacaatagcttcaatggaaaagaaataaggtaaacctgaggagctagatgttctctatgaattgaatacgagcataaactagggtttatatataagattgagacccagctgagacttacaaaggagaacgagaaacagtaagagatctccggccagtatcgagacctcgttcggccatatccatggatttcttctttccgtgcaatgacgcagtcgtaacggataagctccgtcttggcccgccttggctagccatatctactgtatgatatagaaaaaatcaaacccttgtaatcgtcaacgcttacgaaatgattaccaaaattcgaataaggaaagtttttctggaatcgaaactaaacaaaacgccaaaaaacaaacactaataagaatcagaaaactcgtgaaatcaaagctattaccaggcggattcgtcgggtcaacaaatggattctgggattgaaaaaactgagctacaccaagttgggattagttccgtttcgtagatgctctcttctctcctttctcaaaatgttcgtgagacagataacggcaagagagaaaacgacgatttgtgagacgagaaagattacagagattctcccgggaaagtgacgggaaaatgtaagaaaattagaaagcaagaaatattctgtgatttttctctctgaaaaacacgttttattttgcgattttcacccaatcggattctttgatttcgatgctctgtcgaattggacgatcgctaccttttttttttttggtctttgcttttttttttgggggggcaatatattgatttcttatatctggttattgacacttatatcctcaatatttgagaactatgacaagtggatcaaagatttgtttctcatttggcaaagggttttatcgtcattagctatttatggtcattattacacacgagttgatactttttctggattttattttttatatgttgattattggatttgccttttactctttcttcttagcatttggatttttttttttccttttttttggacaaattggatttcgtctaagacagaaaattcaaactgattttttcttaaaacaggttaatttaattaggatattaaaagttctgtgttctatctggataaaaacgtgtagactaaaaacaaaatgaaaataaaatatccattctgtctcattttcagtttcttacaatgtatttaaggatttgttccatccatggttgtgaaatctgtgtgaaccaaaaaaaaaaaaaaaaacagaaattttaatattcaaactttatattaattgttgaatatttcaatgttaaaaacagtgaaatgaatcaatgtcacaacagttttgaccaaaaggaaaaagaattggtgtcacaacaattttgaccaaaaaaagaaaagaattgaggtcacactcacaacaatagtcaataaccaaagctactttagcttcatggatatggaccaaacataagttatgaattataatactgggccgaaaactcaaagcccatatgtataagattcacgttgttcgaaatcttttcccactaaacaataattttataattaaacctaaagtatgtccacgtggataccatcaattggttcaccacagcattagctttcacatcacacgagaagcttcgtctctaactaaaaccaaaaatactccagctccttcaccactctctatttctctctccaaattcatttcttctctctttaagacaagaagttatggcggattggggcccagtgttgatcgccgtgatcctcttcgtagttctatcgccggggcttcttttccagattccggcgggaggtcgagttgtcgaattcggtaatatgcagacgagtggcgcttcgattctcgttcacgccatcattttctttggtctcatcactatctttaccatcgccataaacgtccacatctattccggttaactgtttagccagacaaaccggtgctgcttggttttatttcaatttgattgtaaggtctggatttgttttgtttgtaacattttcggatttgtgaatataatcaaaatttcaccaaatgatacaacatccagttttgtttttgaatctggtatcaatctgtagagtttgtttgggatctggtttaatttggttttcaaatgctacttgacacctaatgtacatccacctaataagtgaaacgacgacgttttactattattgggcctgtggtccgttaaaaagcccaatatgctgtatctcgtttaatttcaggtgaatctttcgacgaccactctctctcttttcctctttgcaaatccttgaagaaatccaaaatccatagca

SEQ ID NO: 924 - DNA, 3000 bp, Unknown
  misc_feature (1)..( 3000): cDNA_ID_3597187_gDNA_ID_1620338_Annot_ID_153859 3000 nt of promoter + ATG
gaaggaagacataattctttactctgccaaggtgtatatatgaaaatctacatacataggcttaagagcatctaataagttagtggctgtgatcgctgatatctatttcggtctaatgttttaatccaggtaatcccaggcaatgaatcacgagtaatgaaaatgatgaatcggatagcagatatcgggccaaatattatcatgggtaagaatgaaatgctccacacatctggtcatgcctaccgtggagaattggtaagctgctgcttctcttaagactgttgataccttcagaagttttgttgccagctttcctttctgtttcttttcacttcatcaatcttaggcttttagcgcatatgtaaaggtgtaaaggcaatagttccctgtttgcaaactgatgaatatctaagggaaaattttgtttctaatgattgtaactattccctattttgaaggaagaggtccttaaaatagtgaagccgcaacattttcttcccatacatggagaacttttgtttcttaaggagcatgagttgctcgggaagtctactgggattagacacactactgtaagtctctcaccaaagacatatgaactcatggtagataaatagcatacaacataggaaaataccgattgtgaagattttttctaaaagttctgcaacatgtttatgagtttgatgaaatagatgcaaatttcatctggtcacaaagtgcctcaaccgtgaaaacagaatttctgagacatgttcaatttaatacaaaaatttcatggaaggatccctttattatctctcggagatataaaataaagaaacccttgtttgtctggtattaaaacctaggtcaactagctgaatgtttcactttttttttttttcattttctccaacttcaggttataaagaacggagaaatgctaggagtttctcacctgagaaatagaagggttttgtctaatggatttagctctcttggcagggagaatttgcaggttgatttgattgtcactgttgtgttctgtttatcttgtgtaaatgactagattaggatattgaataatcctagcgttgctgcagttaatgtatagtgatggtgataaagcatttggcacatcaagcgaactatgcattgacgaacgacttagaatttcttctgatggcattatagttctgaggtaaatctgaattgtaacattcctgtgccagtgcattttgttagtcgtatttaataatttgttggcttccttgtatgattttctataatccagcatggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaaggtctggtcttactttcacatttgtaggtctatattcgggatgtaatctaacatgtttcagtcatgcagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggttcgtctctgaacatatgaatctgtagccgtagatttgaagttcatgattacaagatcaaaagctcttaagttagcaaccaagatttgatgtaatacatttttgtgcaggagagcaaggctgatgagagaagcaagacgagttggccacattttgaggatatgaacaacattttgtcagagctaggcacacctgcgtcttaagtaatgtgatttagatgacattatcttcccaaaagaatcatctccagattttcttaaattgaacaaaaacagaaaagcattaattatattatgtatgtaaccagctgtaagatgatttttgtctgtagaactagaagctatcaacgcagaatccaaatcccaagggacaagaaagccatgactagttttttcggtttggtttaagattcgctttggcttcaaacacatgactaaccggaattattcaattttgatgttcatgtggttttcttattggttttcgttgattttatataccaccaatcactaatttttttaattaaatccggtttagatgctgttgtacattgaaccaacagttaaagtgagaaatgacggtttcacccttaaagcagcgtagcccgtctggtattccaccgtcgatcgccgccgtggcaattttggtaatttattattattttaaaaacaatgtgaaagagattaatgcaaagttgagagctgagtttccgacaaatttattggattgacgaactttgaagaagaagaagagag

SEQ ID NO: 925 - DNA, 3000 bp, Unknown
  misc_feature (1)..( 3000): cDNA_ID_3434283_gDNA_ID_1620338_Annot_ID_153855 3000 nt of promoter + ATG
tcaaatactcagatcttgtctgagaaattaagctgaaatctgataaatgggtttgtttaaattcatcttcttgttatctcttctatggagtttctacagtttaggctcatctcagctacaagcttcacaagcacaagttcttcttcagctgaaaaaacacttagaatatccacaacagctagaatcttggtatgatcacagaaccaatttctgctacttacaagcaacaccatcgatgaacatcacttgtttctctaattcagtctcagagctaaacatcttcggtgataagtcatcagaaaaagccaaaagctttgatggttttgctatctctaatgttactttatctgatggattctccattgaatcatttgtcactacactgtcaaggctaaaatctcttagggttcttactctggcttctctagggatttggggtcgtctccctgagaaacttcatcgtttatcttcacttgagtatttggatttgagcaataactttctgtttggttcagtaccacctaagttgtctacaatggtaaagcttgaaactttcagatttgatcataacttcttcaatggcacattacctagctggtttgattcgtattggtatctcaaagttcttagctttaaaagtaataagctatcaggagagctacattcttcattactctcgttgtcaacaatcgagtatatcgatttgagagcgaattctctgagtggttcacttccggatgatctgaaatgtggaagcaaactctggtttatcgacatttccgacaataagttaaccggaaaacttcctcgttgcttaagcagcaagcaagatattgcgttgagattcaatggaaactgtttatctctagagaaacagcaacatccagaatctttttgtgttaaagaagttcgcgctgcggctaaagctgaagcaaaagcagaagcagaggctgcaaatgaatcaggaaaaagaaaatggaagaaaggagctttaatcggcttaatcgttggtatatcaatgtcggtattggttttagtctgctgtgtatttatcttgctcagaagaaaaggagtaacaaagaagcatgtccaccataatactgtccaagataatcatccaactactggattttcttccgagatactctcaaacgcaagtaagacttttttcctaaaaaaaccgcaagtcttaaatattgtgaaaaagatcgacttactattatcctttttttgtgtgattgtgatttagggtacatttctgaaacatccaagtttggttcagaggatttaccggtatgtagacagtttagcttagaagagatagttaaagctacaaagaacttcgataagactatgatactcggtgaaagctccttatatggcacggtaaagttcatgaaaaccatttgtgttttcacttttcagcatcatcatctcctttaaagagattctgacatttgcttaacatctttcagctttacaaaggaaatcttgagaatggaacaaaagtggcaataagatgcttaccttcatcgaagaaatactcgataaggaatcttaaactgcggttggatttgctcgcaaagcttagacacccgaatcttgtctgcttgttgggtcattgcatagattgtggaggaaaagatgattacagcgttgagaaagtctttttgatttatgagtacattccaaatggaaacttccaatcttgtctctcaggttaaatcttgtttaaagctcaaatctttgcagttttttctacaaaatatatctgaagaatactaaaatccttctttcgtgcggtttttggttttgcgcagataatagttcaggtaagggtatgaattggtcagagaggcttaatgttctcacaggtgttgcaaaagctgttcattttcttcacactggagttattcctggattcttcagcaatagactcaagactaacaacgttttgcttaaccaacatcggtttgcgaagctgagtgattatggtttgtccattgtctctgaagcaaccagacataacacagttaagctcgtttctttaatgttctgtttctgtttcacatgatatagcattgttttcataaacgtttttaaagtgcttagacagaaacatagacttatagctacattgtgtgtgtccgatgattctgatcctaacattgactaacaatgtcaaagccagctcaaacactcatagttacacttttgtatcaggaaatcgcaaaatcatggcaaatgtcaaggctagaagacgatgtttacagctttggattgattcttctacaatcaatcgttggaccatctgtatccgcaagagaagaagcatttctacgagacgaactggtacggctttggcaatatcacattcacaaaccagagttaaatcattgtacttattaaaagtgtttttcttatataatcaggcatcgttggagagcgaagaagggaggagaagaatggtgaatccgacagtacaagccacttgtcgaaacggatcactgataagagtgataactctgatgaacaaatgtgtttcacctgaatctttaagccgaccgtccttcgaagatatcttgtggaatttacagtatgcttctcagttgcaagctgcttctgatggtgaccagtgttaatatattcatagcttcttcttctcttagtaaaaaattcaaacgaactttttaatgctttaaagattcgtgtaatgtgtgtgtacgaaaatcccctgttatttatgtaacgattgggaaaaatggaaattaataacattaactcctttacttaatcccaaaaagtgagtggcaataaatgtaaattaatgtaagtttcagggtaaagtttgtccacgagatcaaaaaagctccgacccaaattaagagacccgagtttatgaaacccgacccggtcattgctacatccctttgactaatgagaataaaaactctttttcgagaaaaacgaagttttctgagctaaactagatcagctatg

SEQ ID NO: 926 - DNA, 3000 bp, Unknown
  misc_feature (1)..( 3000): cDNA_ID_3059651_gDNA_ID_1620338_Annot_ID_153856 3000 nt of promoter + ATG
ccgaggaacccaataggaaaagacgaggagagaaagaaaaacaacagaccagaagcaggagcagaagtgacggaacaggaaacggtagacttaattcgagagctttggcggaaggtgaaagtatagggacaaagcgagagggcactaaaagctgccattttcgaaggagtagtagctggcctgcgaacatcggagtagatagaggaggacgcatgtgaggagaaaccttgcaaagaagcaggtttcatcatcactgtataacaaaacccaaaagatagggtttttgtgagcaggagaagaattggggtttaaggagggaagcgggaaagagagagagagatgagtgagaaaagtatctctgtgactgtaaactatctttctctcttatcggatgggagacgacgaatacaataaaccttctctcaattgaattgaaaaccggttattcctcaacgggacaggtcctgcatttgtagtggccactatatcaatctgaaataaaggagaaagactgtttggcccattactaggcccattaaaccattcggtaacttaatttatatgcagtttgctgtcaacgtgatggttttaaatgtctcgttcatagcggtttttttatataaaaatgtctcattcatagcaagtgattatcaggtcaacatacataggaagatggtttctcattcatagcaactataagttttttttttctttcaaatagcacgaatgtaaaaaaaaaaaaaagtttagctaagatttttattcctaaatataacatttcagataatcacaaagtagtgttctaaaatagtcatcacaaaatctgaaatcccatgaatatgatacattgatactgaacctgcaattttgcattgtctgaataaattagaaaatatccaaatatccaatatttgactatttttgttggtcaaagtcaacgatgataaagattgtcaaatcttatattactattacacttaacgtgagagacttgaaactggatatatttttaaaccgaagtcaatcttcccatgcttttaagaatacatcattgatcattatactcgtaagataaatcattctgcaaaacataattttccttttaacaaaacaaaaaaccttttatcaacttagtttatactcgtaaaccactttttagtttgatagtctctttataaatggcccgctggaagattggattcattggaccacttgaccaagtcaacatattcttttttgctttatcagaacttaaaaagaaatcatatatatatatatacacttccaagttccaactagtgataaatggatattgacggcttattatgaaaaatcaaagacagcgagttatcacatctacctaattcatacgcaaacaaaaaccatcttattcgatatttatatacgtattttattaaatagtatgaaaataacgttgattatatagtatttttttgtcccccacatagtactatagtataaaataaatgtgcataaatttattctatcagaattcattgtttgggaaattaatttttaaaggagagagtctctctgctccataactccattgtcaaattaattcaatgacaacgcatagtatcgaacattttcaaaccacactgctgtaatcgctattttcttatacactacaaatcaaagacttatcacacacacaccacatctgaactacgtacaaataattgaaaatcatataatctcactccaatttcttgttattatttgagttcaagtagtactagtagtagtcgtatataaagtgtgaattgaagagtaaacaaaggtacgcatctttgacctttcacactcgatatagaaaggacaggctgtgacttaatgttgggtacacagttagtaactcaattccctaggcctcaaccatttgcatttataacttcacccaccggtccaccactttcaacctctcaataagctttatggttgttactaaagaattattagtaaatgacaagattatatgcctatatataaataataatatgcccatacaatagaatcatagaattacattttacatgattgtcaaaaaaaaaaaaagaagtgttacacaaacaaaaaactagacatacataattttttagagcatgttaagccgatctaaaattcaccactactatttttagttaacaaatttctctagttagtttgttatatatctttccatcgttattgttttatttgtgtccatagtagttaaatcacgatgagactgtcattactattcaactacaaatgactataattattacgacaccacatttaacatcttctcctttggtttcttccggtatcacttggtcccagtttatatacatacaactagaaaagcttatgtatgcccagacaataatgtataccgaataaaaaaagaaaataactattataagtgcttgtttaataattgtaaacattatgcaaaaagctttgtcttctttttataaagataataagcataaaacaaagtcactttctataggaatgagtgatttaaccccacaaatttttaactcatgcatatcaaaaagaaagattcttgtatataacataacactactgttactctctcacttacctattctcactaacaaactctgaacaaaccaaaaaaaactcttcttttttctatctttcacgcgttgaagattcttgattttctttcttctccttccttacacgaccactgatatgtgtcggtgactgaaaccatctgttctcttttgcctctgatttatcgatatgttttaaagaaaaacggtgtttgaaacttttgtaatttaaggtactactctgctcttgttctgcatattgatctgctcttgtactactctgcttttgttctcaagattactctgtttttttttgtactgaagtgtctcgtctctttttcttttttttttattgcaggttcatcaaatactcagatcttgtctgagaaattaagctgaaatctgataaatg

SEQ ID NO: 927 - DNA, 3000 bp, Unknown
  misc_feature (1)..( 3000): cDNA_ID_3059710_gDNA_ID_1620339_Annot_ID_153884 3000 nt of promoter + ATG
taagggaatcacgaacgataaagcacataacaatttatgcaatctcaatgggatcaacacagcaaacatatacatcccaacagctctttcaattttaagcaagaatctctttttcaaacttcaacaaaagaaaacatagcaattatcaaaacagaaaaaaacttctaagcgaaatcataatacttaaccaataaccagactagactctacaacaacaacaaataaaaatgtggtattaaacagactacaaagcaaacagaacaggcaatgaaactagacagaaacaaacacaagttaacacaacaaagattatcaacatgtgtaaaagataatgctaccaaaaccataagcaaaaggcataacccaaataaaagagaactccatgactatgctctcacaaagagattaagtaaaaccaaaataactctttgaacttgaagtatgtcctctgcaacaccaaaattaaagtgtgttctctaattcttacaagttttgaaactgtgtttaactgttaaacagaaaacagcaccgtaccaacctttctcacctttcatttcactaacttaacgcttcttcttgctgcttgcctttgatacgttggacttaggtgttgccaccaagtatatgaaacaaaccaccatggagatcacggagacgagtgatccatatttcgccagcaacctctgcaacaattgaaacacggtaatatgagaaactgatatatatttgatgatttcactgggaagtgagaattacacatcggtcattgagttaccttggcctgagattattttggcagcatcaagagcaacatccaagacacaacagaagatagcaatgaaagtcaatattgagaagaaaagaaaaaaactctgactagatgattgaaagaatagtccttagaaggtcaaatttaccacgtccaaaggtttcgttggaggtttgtctgcgaggatatctagaggtagtagtggagttgagtatgcttcctacaaacaataaaaccataatacacgattacatcacaaaaccaaatatttagtaaaataacggccacaacaacagaaagtaattctgattagaaagattaattggggaggtttattgcttcaaccagttccaagaactagaatgaagggagcttaaaaatggcaaacctgaagagctggcttagtggggatgcggaaagtaacgacagcaggagcaccgtagaagactcctttaaccttggcctccaattcgatagaatgagacagaatacctcctctgcacagcaaatattagattagtgacgagagtaaaagctaaagcaggccaatataagattttatgattgaggaagaaactcacgcatcaagtctttcccatgattttgaagtgtttccattaacaacttcaaaagtctttttatcccagctattatctgtcagagtcacatcatacgccgacctgagagcaaacaccacaaatatctgacgcttttagctgacattcattaaaaatctcaaagtcatcgtagccggcagatacaaaattcacaaaccaaatccaaaattccgataaacaatgagatcagatcaaatggcgtttcgtttaactgatacgcatacggtagatctaatgatagctcaagcataatctcctaattctacattgaccaatctctccatgcaatcagaaattaacacggatcggaaatgaaaatggagaaatcaaacggattcgggaaataactagatgaaggatagagaactaacgaggatccttggttatagatgtcgtaggaaacggagacgcgttcggcgccagatttgagcctgttgagagtggctttcttgtgaaccaccatgaacggcacttccgaggtcgcgaacgaagcagaaacaagcatgaaaaccgccatggcggagatcagaagcttagctacagcgacggccatggtttgcgatctacgacgatgtaggtgtttaagcagatgcggaaatagatctacgaatgttttcttcagctcaagaaacctccgacgacgatattaatcaccaccaccaccacccattaacaaaaaaagtcaatgatgggcccaattgtttttcacctgataatgggcctacttataaaagcccattctaataataaagtgtattaatataccgtccaaattaaagaagggaagtgtgtttgcacttgcagtagaacaatgaagataacacagcctgtctcctgccacaatctaacatgtttcttttcccacaccacatttcgattggatccaaatattctctaatacttttataatcatagatgactttgtctattaattatctcgtctaattataaagtctacttaagatgtaatagccaacgattcatatcattcaaaagacatattgactcgaatcaatggaggttttgttaccataatctcattttcatttctaacaatcttttggttggagtaagaaaagagggtaaaaactgataaagttgatttgattcaattaatcaaggtggcgggaaagttaaggaaagaagtcaacgaggaaggaagtactaaaactaaaacaggagagccaataaaaagtaggcaagtgggtggggacatagaataagaattcacagctacccgtaagaaacataattaaaacttggattaaaccgaaaggcatgtgattttcctttgttggttaactaaatcacgtatatctatcgttgaatataagagcatgtggagggatttgcatcgaactctgaaacctgagtaaatcttctcttcccatcatcacatgcttacttatctcttctggttagctctctgagattctctcttccagattgttctttttatattttacttagagcttcaaaattaatccggatctatctgcttcaggttgttccaaaacatccttattttgacatatatatatgtcaatgttgtgtaggatgattttgtgagcaaaagatcatagcagagagagagagagagagaaagagagcatg

SEQ ID NO: 928 - DNA, 3000 bp, Unknown
  misc_feature (1)..( 3000): cDNA_ID_2128528_gDNA_ID_1620339_Annot_ID_153898 3000 nt of promoter + ATG
ttagactaatagacaggtgtttgtttttactttttagctataagctataggtttaaacttgatgaagcctttgaccacaaaaaaaaaaaaaaaaaaaaaactggtgaagttgtagtacatttgacgtgacgatagctcgttctgattgagtgcaagttagagtcgagagatactatatccttgaagatatatatcaacgtatcttcacatgttgttttcattagcaactctatcaattgattatcttcacatgttgttttcattagcaatatactatcatccatattaaagtcaataccgtatatatctcttaatattagtctacttcttctaattatgtagtcttcaatgattgtgttgttgtatccgtataaatataatcttcaattacaatctagaaatacgaatagtcgtcgatctcatctgcgattgcatgcttctttatcaaaggatggttcaaataagaaatgatatacatagttagaagtaacaacaaaacaataaagaaaaaggatttattgtaattccaatacaagtacttaaatggtaatcataaatcaaagcttaccaaaaaaacaataacaaaaaatataagaagttaagagatacaagcagctcacgagaggaagaaagaaaacaataaaatgttaaattaattaggcaacatagatgtggatatgaagagcgataatagagactgtaatgcacgcaaagaagataagagtgtggatgacaatggctgcgccgcttgtttgaaagccgccaaactcaaccactttggtcttccctggaagctgaaacaatactccaggcgtcaatacgatgaacagaaataccgacattaagactggtccccaattcaacaccatttcaatataaagaatcaatcgatttgatgtatatatgtctatgtaaattagaatcgttattgtatgagctaggtagtgtgtacgtttctatgcaccacttttatagagtgattgaattaatatggaggatcgtaatgaaacagtggcttgaaccggacgaaattagaaagtttgcaaggtgaaggaaagaacgattcccctgcagctactcgattgtatcaaagttatatattattatattgtcacactatgtattgattgttgggtatgctaagaatctgattcttgtctcacaaacatttttgttcaccctcttgtttttttgttataagagacatttgccttttttagttcttgttaggagagacatttggcctttgagagtctgtctcttttattcaacaaattcataataagtaaatttctatatatgcctagtaagtataagtgttttccatgaaaatggcggttactcccgacttatttgaatacaaaatcaaatggataagttgatcgaataattaggaaacgacattatgtgccaaaaacaaagatgataaaatatcaattgctgtccatataaatctaaaacttatccatatccgagtcaagccgctcacatctttattttattatttaatttaaacgcatgtttttatttaatttatttgttgatacgaacattttatttaatagcatgttggtctactataaaatctttccatatacttctctcatataaagacacgggaaaacgactcttcacccaattcttgcttgatttccaaatgctaatccttgatgataagaaaacgtataaccaaacaaaccaatcatattcatcaattgatttaatgccaaaagttaaacagtgtcttatgctatgtgcaaagaacacatgcatgcaagttgcgttcatactggcaaaaaatacatgtttgcaaattgcaagttgtgtaatatgtcaaattatatacagataatttttatttttatcacaaactaagttatttttccttttccaacattcataaccccactaaaaagggttggattgaaccttaacgacaggtcatggtggaaccacccccacccaacaggccacattttgattataaagaaaatttactctcgcctatatataacctcctcaacattctatgaaacagcgtattaaaaaatgataattttatctcatttcacttcatttgttacgtcatccaatttccgtcagaagaaaaactgtgataagatcgattccattcaactagttggtaccaacaatgacaagaagtatcacttttgaggatattcactaatgttaactttcgtgaataataactttttaaccaattcaacgtgcatgtatagttggtaagaataccagactattccacgtactaccaagattagtttgtgttttagccggcttgtataaaattaataaatattattttattattcttattttcataaattatgataaatatgctttgaattgctgtttaaattttcttttattaattggtccagcaaagacagatttaaatccagttaacgataatgttgaaaaaggcttaagggataatcaaccttaattaaaagactgaaacaatgacaggcacgccatttaaaaagatggcaggcacgcacagagaattggaaaacagtgacgaaattcacaacagtcccacggtgactgactactactcataattatcaacgagccttttgttctacaatttgtatacgacttcttcactaaaatccacttttttctttttcttcttcctcactaaaatccacttacaagttgtaaccaaattttgatcatattaaaattatcgtaattaacaaactaaacaggaatcgcatatctgcaatagtaactatttcacagattggttttatcttttctatgtcttgtccttttttgtccaatttaagaccataaaaggagaaaatcgtgtgaaagacaagacagatagacagacacgaatattcaaaaaaaaaaatttcttttctctttctaacaccacagatttcgcaatcgtgttttgatctgattcttccaggattctcccggtggcggagagaagaaacaaaggaaacccagaaagcatttttctca

SEQ ID NO: 929 - DNA, 3000 bp, Unknown
  misc_feature (1)..( 3000): cDNA_ID_2128549_gDNA_ID_1620339_Annot_ID_153903 3000 nt of promoter + ATG
aagtaagattaattagattaatgtctgtatctttttttgataaagaatgtgcatatgtgttatcttagtggtggtaaaattaaaacattaaataaagagacagcatgagtgttaaacatgtgtgtccaacaaataaagtgataattggagcgttactagaaaggtaattaaaataaactcaagtgataaacaacttttctggtatggaagaatgattgtaccgtacgtaagtgatattatataaataaccgtgtcgactctcgactctggtactcatcgaattcttaaaaatcatcgataaagtgcataagtacaaaacttgatgagatcagtactactattttcatcagcctgctagaaagaaaatactttatgacttgccttatgttttaagttttatgtggacagagacgacagtcgtacgtatgcagaattgtaatttgtctctttgacaacatggtcctttaatttcttatagtttacattactatgatagtcaaataatcatgagttaaatgtgcaggatgggatgtcatggctgttgaatccagcggatcaaaatctgccgttgattttggcggatcaaggattcgatgtgtggatggggaacacaagagggactagattcagcagaagacacaagtaccttaacccttctcaacgggtctggttcagtgaaccactgttttaaccagtagattacgtatatatctttactaaggaaactgatatttaacatcgttggcacgttgtggacttaggctttctggaactggacgtgggacgagcttgtgagttacgatctgcctgctatgtttgaccatatccatggcctaacaggccaaaagattcactacctcggacactctttggtgggtccaacgttatcaacatattttttctctgatttttttctttttcttatagtaatatatcttctcataatagaatgaaaaatgaaatggaaattgtcaggggacgttaataggatttgcttcgttctcagaaaaagggttggtggatcaagtgagatcggcggcgatgttgagtcccgttgcttatctcagccacatgaccaccgtcatcggcgatatcgccgcaaaaaccttcctcgccgaggtccctagcttctcccttgtaatacccttttttattcttatacaaatatgtgcctacagttatgaaaataacttgtttatcgtctttcaaaaataggccacctctattcttggatggccagagtttaacccgaaaaggtaaatcttcacccttttttcttaaaatatgcttgttattattggcttgatttgattacgtaaaatagttaaaacaacatttgcagtggattagtaggggattttataaaggctatatgccttaaagcggggatcgactgttatgatttagtctctgttatcactggtaacgctacaactaaaaaagtccaccaatctaccattgatgaattaattacatatattaattaacgtaattttacaaaaacataggaaagaattgctgccttaacgcatcaaccattgatctgttccttgccaacgaacctcaatctacttccaccaagaacatgatccaccttgctcaaagtaagtgaaacaaattcccattttttaaaaattattttataaaccttaaattgttcaaattatttatttgtagcggtaagagacaaggagttgagaaaatacaactatggaagcagtgatcgcaacataaaacattacggtcaagcgataccaccggcatacaacatatcggcgatcccacacgagcttccgctttttttcagctacggtggtttagatagcctggctgatgtgaaagacgttgagtttctccttgaccagtttaagtatcacgacatcgataagatgaatgtgcagtttgtgaaagactatgctcatgctgatttcatcatgggtgttactgccaaagacgttgtttataaccaagttgctacctttttcaaacgacaagcttgataatattattaccttgtcattagtttatgtaattgcatgtgcccatattcttcaattgtttccctctaaacaaaatgggcaaaaataaaattaaaatttttatgaaaaagtataccagtctactagcttctaattaaaataatcccaatatttaatttagattttttttttctttaatctataaacaatggggcaaccattatctaatttaccctagttttaggtatatttaagaaagaacactaaaactacagattcgtatttgacaaaaaaaaaaaaaggaaacgaaaaactatagtaaaacaaaattatgtggaatgcttttctttttaattttgtcgtcaaattgtatgtggatttgtcgttgaaaaaaaaacacatggattaaagttgggccagtttgatataactcaatgtgggctttaaaaatacgggtcgggtcttaacccggacagtaaaatagatagctccggtgggcatttgtttttgttttctctctcgagtctcgacaactgagaagcaacggaacaccggtgaatcccggaaagaaggtgaatcaaaaaagcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggctgataggtttatatagcaatg

SEQ ID NO: 930 - DNA, 3000 bp, Unknown
  misc_feature (1)..( 3000): cDNA_ID_3059685_gDNA_ID_1620339_Annot_ID_153906 3000 nt of promoter + ATG
ggtacaatcattcttccataccagaaaagttgtttatcacttgagtttattttaattacctttctagtaacgctccaattatcactttatttgttggacacacatgtttaacactcatgctgtctctttatttaatgttttaattttaccaccactaagataacacatatgcacattctttatcaaaaaaagatacagacattaatctaattaatcttacttgtaagtttcaaactcgcacgcacatacgatataaggatatatgtacatatatatatatatatatatatatatatatatatatatatatgtatgtacatacttgttgatgaggcatccactggaagtatacacgtttggttttggcccacgtgtatatgtctatttatagatgtaaatcatcttgaaataatatatgcacatattctccatttgtataacttctgaaaacgggtataaaatgttctcctaataatgtttttctcactatcccttgacgtcactttccactttttcttactttcaaaaatttatgtaatggaaaacagcttcaatgtagtaatcagatattccgagtgcgatgcagtggtttaattacagctatatatgtttttaataatagactttgtagtttggatgtatttcatgcatgttggaacaaagtttgatattatcacaataattatctgcacataaaagtagcatgcgtgtgtatacacaagttaattgacggttaaggcgatgcaaaaaggtaaggaagagtaaaacttacgacaagaattccatgttgtattaggacaggttgtctctttcccccatctccggcgacggctccggctcgtccttccggtatcctttgcatattcaatatgtacccatcttgagtcaccaccttcataatttaacaattaaaatagcagctttatcagttaatatatcgatgagtaatcatcatcaatagctatatagaaaaaaaaagaatgtcgtacgtacatcatgttcttcgcacttgtaaccaaatatgtgaacagaagaagcgcatatgccgccggcagcagtcctctgcggtggctgtccggcaagcctgccgaaggttccacgagcttcaagggtcttgagggaaagagcgaagaagattaagacagataaggctaaaccgattgaaacggacggaaccataaccgaaccggccattgagatatatataggggttatcacgtacgtttataggaaagtgaaaatggttttatatagagagaaggggtgacggataagataatagaaaatggaattattagctatttataaaaatgcaaaaccacgttagcaactatggatagacaaaaacttatttagaaaaaaaaacaatttatggtgtgtaaacataaattaagaattgaatcatgcacaaaaaataagacaagcatttatgaatagtttctagaagtggtgaatcatccactgctatcgtcgatacaacatttactaaagtttctatatataagtggagggatgatcagtgtgaccatgccatgatttctaacttttttgagagagcgaggttattatgataaacatttaaaataatacgtggaactgagatgaatggaaaataatctttataaaagagaaaaaaaaaaatagaagatctcatgataataaaagtacttccatatgttttcaatgtgaagaaaagaatagtaaaggagatacatccaatagcttagtctagaaaagagctgactaattttttttaaaaacaagatctctggtttgtatatttgtatcgattacacagcctagatatataaaacacaaaacttgatggagacaatttcatatcctatatatacacattaatttaatgagtgaatagtaatagcaactagcaaggcaatctaaacaaaattaagaaaagaaaaatgttaaattcctgagatctataataactcataagcaaaaaatatatttaaaaaaatcatacaaatgttgtaataatatcattttgttttaatgtggagtgataaaaagaagataggacgaaagaagaaactgttaaaggcgattgtagatgctgtagggacggataaatggactatgacatcagtttccgttacttgtttcttctcgaactcaaagaagaaagaaaaaaaaaaaaaaaattctacatcggtacgctttcgtttcacaccctgcatgcacacagtgtccggtagtcaaaaatacaaaaaaaagaaaaaaaacctcgagacatgctaaatttggataatgattaataatttgggggtacacaatgttccaaataatttatatacaaagtcttgctttcatattatttgtgtgtccacacttcaacaatatagtattatactattatccctatcccctatgaagtatgaacacactttttatgatacgtatcatattcagaaaacatcaaaaattggtcataactctcacgtggtgtggtggatttgcctcgcctttcgtttctgttttttgcaaatatttaagaatctttggtcatttaggctttaatttagttactttaaatttatttttgttatagaagtattatgttaaaaacagttcgtgttcatccttggactaaccagacgatttgacaaaatccgaatatccgatcataaaattaaataatcagccgttattgttcctctactactacgttttaacttttaagaacttctcctggtactttgatgggctataagagcggcccaatatttcgactttaaaatgggccaatctttggtaaaggcccaattatagtggcgcttcttcttcttcttttcctaaacaagcaatggcatggtttagctggtgagccagtttataggtaaaaaggataatttaagccatttaaaaaaacaaatctttaatggcgtaattcaaaaaacgtgcacacctatctaagtaccaaactctttatgttatataactattgtgacacaatttcaaatttgctaactcccaaaaaaa

SEQ ID NO: 931 - DNA, 2237 bp, Unknown
  misc_feature (1)..( 2237): cDNA_ID_3059681_gDNA_ID_1620339_Annot_ID_153909 3000 nt of promoter + ATG
ctcgtgatccagattgcgacatgaaaattacatgtttgattccatttaatacgtacaatattaattatatgattaaatatcgaacttcttttgttgacaaaacatgtcgtcggtcatatatattacttagttatgtactttttttttgttgataaagcataaattatctgactactactgtagtacatagcttagtggttatttttgtttatgtgtcataataataaaccgttcgaatgcatattattgattttagttatgaacttctggtaataaaacagtagtgttaacaaacaaaaaataaataagagctattaacgcccaccagcttgagccatcccaaaaaacatatatgcccccccaaaaaagttagaaaactatgcgtttgggatcatttcccttctaatcactaattaggacaaagcatggaccacctcctaattgccctaccttaatctgctaattaatcttacttactgaacatttatgagtctaatgattttatgaacaacaaatcttactaactacttaaaggcaaacgtatagttattctcttcttttgttacttgtgcttactgcgtatggatgtttgagttgaagtgatcgaaaagataattgaaatttccttcaaacggttatttggttctattacttgtgtttttgtcaaacgattttgttgtgtctatttttggaaaatcacaaccaatccaacaactaaatgaatcactaatttctttgaatttatattagtgcaaaccaaaactaaattaatttttattaacaaaagagaaaactagaaacactcaaaaccaaagtcggattcactattcgcctagagtcgagatcaagcagtttatagaatattcaaaattcaaatcctcgacaatatttattaagaatcgtttctttgttctgattaattaattaagacgtgaagaaagtgtaagcaaacaatgccgatggaatataatcaaagtggcaaaaggaaaacaacttgttacttttttcagttttgaaatttgaaaagctttatagaagtaagtcatacatgattatacgtgtaaatcaaatactatatgatttcgaattcatatttggcggcagagattaaatatttaattagtttgcttcatccttaaagttccatggcgcaagcaaatatcatgtctgataaatgataactaattcaatcttcaaatttagtctaccttaaagcaaaatgacttttccttttcacatccatgcgatattgctaaaatctattaaactgtagattcgaaatatcttattgtacaaatgggccacgtaatgttctcgtaatctcagcacaattatttgtttataattgttttttcctgtttgaatttatttattaagttaatattcaaagatggtatgctctaaaaagcaattattcacactaatgttacatacttttctcataataaaaccaattatgttcttcttgaaaaagtacttttcatttaatcgattagattaactaccacgataactaccaacaaactttgcattcctttagtttcccaaacctacattaaaataaaataaaaatcgccttatgaataacgaatgctttttggtcgggaatacaaattgagataagaacctgatattgttaatagttttttttaaagatttctttagaaaactgtggagtatttgaccagagttgattgacctaattgaaaaataggtcatcaagtgtagtttgtgttcgaactttaatgtgccaaactgcaaactagagactaaactgaaaaaatggtactatcaaacaagacgtataattgtataaacgcaaatccaagatactagttaaacgagctaatttgagtttgagaattagataaccatatagttgcccaaaaactaaaaacgaattagataacatatactatatattagtacatcatgcagagagagagaaaacaagtttagttttcacatgagttcaaacaattcggtagaaaaaggtcaaccatgcactctcctcaagaaactttgtcattcaaataaatctggtttggatccgttgacgaaaaaacaaaggcccgttaggcaaaagactgatgataatgggcctgattaaaaacggtaccctttattgtcgttttgggataagctggaattttgccgctgtgtttttttctacttatttccgtcactgctttcgactggtcagagattttgactctgaattgttgcagatagcaatg

SEQ ID NO: 932 - DNA, 3000 bp, Unknown
  misc_feature (1)..( 3000): cDNA_ID_2128563_gDNA_ID_1620339_Annot_ID_153907 3000 nt of promoter + ATG
agcaaaagcatggtttcaaaactctaggtaacttgttggtgtggccttaactcaaacaaatagccctatacttttccttctatatttatcaatacttcatactcctctatacgcaggtacacttttttcatcaatgatgtttccagatcgttcccctagtgacgttcatctatatacaacttttattggtgggagtaggaaccaggaactagccaaagcttccacgtaagtgaaatttgactgcttacgaaaagctacaaagaatcgaggcatttataccatttttctagtttcctactttacccaattctgactacttttttttctttctggtttaatcttcgtagtgacgaattaaaacaagttgtgacttctgaccttcagcgactgttgggggttgaaggtgaacccgtgtctgtcaagtatgtgaactttggagatttttttgatttgatcgttttagtgtacgaaagagaagattaccacccttatagataaacaatatatgttatctgcagccattactattggaggaaagcattcccgttgtatgacagcagctatgactcagtcatggaagcaattgacaagatggagaatgatctacctgggttcttctatgcaggtaacttcaatttaaagtttcagtcttatatgatccatgatgatgaatgtagtcagtatatggcctcgagacgattcattgcagttatttatctattgtgcacggaccaaaataaacaggtaatcatcgaggggggctctctgttgggaaatcaatagcatcaggttgcaaagcagctgaccttgtgatctcatacctggagtcttgctcaaatgacaagaaaccaaatgacagcttataacattgtcaaggttcgtccctttttatcacttactttgtaaacttgtaaaatgcaacaagccgccgtgcgattagccaacaactcagcaaaacccagattctcataaggctcactaattccagaataaactatttatgtattgtttggtctgttttcttgttgcatcactggtatggtctgtctaggtagaagaatatgatagggtgagggattttaggattgaagaatctttaaaacaaattgctgatattgtcttatcttgaagatatcatttctgctctctagacaagttggagagaaacttgtttggtttctggtgggaaggggatgttgatgttttaattgttttttctccaaagccacaaccataagatggtcccaaaaaggttgtcctaatgttagatgttagtatctgaatgcccgtttctgttcgtcccacatgctctcccggttccaatttcgtggagtcttatgttatgtcttatcattctcctataaagcgttatctgtcttaacccataatgtcttgttaagtctctttttgataccaaagcagaatcagtaatagagcttgcattgttctctagtccttttgttcctttttgtggtatgcttaataatgatggttacatatcttttatgtttatattagttttataattttaatggtaaatcataagttataacactaacagtattgaaacatcatattggctatgaaatatactaggttttagtaacatcctgaaaatgctaacgaaagtattagccaaattttaaagcatcaattgtgattacactcacgattgtcaatttaaaaaaaacaaaatgtttgttaaaccttttttttttttgtgcaccaacaataacaattttgttaaacaacagtgaagaaacattttaatgttcatacttcatatactgtataaaaaaaattgacgcatgtgagaccaaaaaaagaagttaattaatacgatggtccggtctttgagagtagaacagacctgtgggacatgtactgtattgtgggccttaaaactttagcaaagcataatcaccacctttgtctctaagtaattgacctacttgccctctttatgccacaagtctattggcatgtgtctcaaaaaactatatgctacaatctaaacattgtggattcgtgttttagatggtttgataaaactatcttattagaaatgctattatatggttgggaatgatataattatttattgccatattttgtccttcaacgaaagctacttctaccggacaatgtttcgtattcgtagagcaaaagcttccttttgtcatttggttgtcatttggtatcgtagaagggcagtttggtgaattaacaagacatggaatctaatcacacacaaaaatcaatgtttaaatcttataaacaaagtggggaagaagagacatgtgttaacggcatcttctatgagtcaactaaagtcacaaagcatacactaataaacaagtatcatcaaatcagtaatcatgctttatctataccaaatttaaaatcaaatttcatttgttttctcattatcttacagaaaaagagatttccagacaattggtcataaaaaggaacaacctttcatcaaattgagtgcacattttttgctttatgattgtttttcgtgacccacattctaaatttactgtttctttcataaagagaagaagaagaagaaaaaagattctcagataaattactgaagctgccattaatgctgctcaactcttttgtcattaatgctcttatcatcttcttctctagcttccctagtttctttctcgtctatgtgttgaatccgacaaacagactcacaagaataccgacattctcctccacgatttctgcatttgtcctcactctctcttattcttcttttgctttttgtttcctgacctctttctcagggattttgattataaaccaattcagttccttggagtttgctccataggagcgtctgggatcacgagcttggtttgacttgagttgactagaaaacacctagatgggtctctttcattttcctctcagaatccaagtctgcttctagttctagggttctgtttcaattcatctttgttttcttttcctgcaatg

SEQ ID NO: 933 - DNA, 3000 bp, Unknown
  misc_feature (1)..( 3000): cDNA_ID_2128553_gDNA_ID_1620339_Annot_ID_153904 3000 nt of promoter + ATG
agttcaacatctggatattcagaggctaaagctgttactcttttcctccacaatattgatgcctacatgaaacaaagaaatttgcatttcgtaaaacacacaaaagtggaaaaacaattcagtgaactaacagaacgtacatccaacacattggctttgtcaacagaacaaagtttgccacgccttttcctagcagtctcgaatgctacacgagcaattctgtcaatctgaagaacataaatcaatgcattaatatccatacattgccaatattgtcacagagcacagtgtgaagggttattacctcgtgagcagcgtagatctctgtactaacgccgacttcttcgccattttcattgatcgtaatgcctcttggctctccaaagtaaatacctcctgtgagctccctaacaatcatcatatcaacaccttctgctacttctttcttcagtgtggaagcatcaactagctgaacaagcaaaacagaaacatttgagtttatttacaactagaagcaaaattcaagtgctaagcaaatcaaaaccgaagatacctgtggcaaaactgtagcaggtctcaaattagcaaagactttgagatctcttctaaggtaaaacagagccatctcaggtctcagatgtttctcattcttgtcccatttgtacctgaacaataatcatccaaacctcaagatcagaataaatttggaagcagattgctaaagaaacagcactcacacacataccctccaatagctccaagaagaatggcatcagatagttttgcagccgtgaaagtttcctccggcaatggaactccaaccaaatccaaggctgctcctccgacaggcatctccttgaaatcaaactccagtcctgtgatacaaaagcaaagacacaatcatctactggctaagcaaacacactcgttgtttccaaaaaccattgagaaagagaaagaaccttcgagagatccagctttctgaagcacattcttagcaacagagataacttctggaccgataccgtctccgggaagcagagcgatgttataccgttttttcccaggtgaagcggcggcgcacctaattcgatacggcgcacgaaactgatgatcggtgagagaactgtatttccccgggacgatcttgatcgcattcagactgatgttcgtttgcaaaaacgccgccattttttttgggagttagcaaatttgaaattgtgtcacaatagttatataacataaagagtttggtacttagataggtgtgcacgttttttgaattacgccattaaagatttgtttttttaaatggcttaaattatcctttttacctataaactggctcaccagctaaaccatgccattgcttgtttaggaaaagaagaagaagaagcgccactataattgggcctttaccaaagattggcccattttaaagtcgaaatattgggccgctcttatagcccatcaaagtaccaggagaagttcttaaaagttaaaacgtagtagtagaggaacaataacggctgattatttaattttatgatcggatattcggattttgtcaaatcgtctggttagtccaaggatgaacacgaactgtttttaacataatacttctataacaaaaataaatttaaagtaactaaattaaagcctaaatgaccaaagattcttaaatatttgcaaaaaacagaaacgaaaggcgaggcaaatccaccacaccacgtgagagttatgaccaatttttgatgttttctgaatatgatacgtatcataaaaagtgtgttcatacttcataggggatagggataatagtataatactatattgttgaagtgtggacacacaaataatatgaaagcaagactttgtatataaattatttggaacattgtgtacccccaaattattaatcattatccaaatttagcatgtctcgaggttttttttcttttttttgtatttttgactaccggacactgtgtgcatgcagggtgtgaaacgaaagcgtaccgatgtagaattttttttttttttttctttcttctttgagttcgagaagaaacaagtaacggaaactgatgtcatagtccatttatccgtccctacagcatctacaatcgcctttaacagtttcttctttcgtcctatcttctttttatcactccacattaaaacaaaatgatattattacaacatttgtatgatttttttaaatatattttttgcttatgagttattatagatctcaggaatttaacatttttcttttcttaattttgtttagattgccttgctagttgctattactattcactcattaaattaatgtgtatatataggatatgaaattgtctccatcaagttttgtgttttatatatctaggctgtgtaatcgatacaaatatacaaaccagagatcttgtttttaaaaaaaattagtcagctcttttctagactaagctattggatgtatctcctttactattcttttcttcacattgaaaacatatggaagtacttttattatcatgagatcttctatttttttttttctcttttataaagattattttccattcatctcagttccacgtattattttaaatgtttatcataataacctcgctctctcaaaaaagttagaaatcatggcatggtcacactgatcatccctccacttatatatagaaactttagtaaatgttgtatcgacgatagcagtggatgattcaccacttctagaaactattcataaatgcttgtcttattttttgtgcatgattcaattcttaatttatgtttacacaccataaattgtttttttttctaaataagtttttgtctatccatagttgctaacgtggttttgcatttttataaatagctaataattccattttctattatcttatccgtcaccccttctctctatataaaaccattttcactttcctataaacgtacgtgataacccctatatatatctcaatg

SEQ ID NO: 934 - DNA, 3000 bp, Unknown
  misc_feature (1)..( 3000): cDNA_ID_3059691_gDNA_ID_1620339_Annot_ID_153899 3000 nt of promoter + ATG
tcaatccacacccttccacaaggcactcatactgcataaagatgttaatgagagcagaaagaaggaagaattagcatatgatgtgactttaaagagatccatggcaggagtggtatcacagtcactagctaacagtaagagctctgcctcaaaacgcacttaatatttggacaaagagataaagagtatataaagcataccatgtcataaccccgagaaactttagcttgaaagaaagagtcgtgtgcttcggatatgtgaatacttagtaagcgagaagtagggtagacccttgagcacactgaacaagaggcagtgtgccgtgcattatagtgatcttcaaaatggtccaaagatttcaggcgttcaggacagccaacaatgggacacgagattcttctgctcaaaatagtcaaactcatgaccatcaaatttcgtagataattgtggaccaaatttggaattgaaactagtctacataaatttgatcagtgacacaatgccatattactgattgccacttaaaaatgtggatattgaaagaaaactacatagataacagtgatcaaattcatagccatttggttactattagctagaattcttacacgcactaccaacacatatgtgaactgcacagtaaacaatcagaaataggataaatggcattgacaccaaaccagattcaccaagacaaaaaaacaaaaataacagtacagattcttagcttcagtataccaatcaagagaataacacatcaaaaaccaatgtaaaacacatgaaactcttgtaagcaataatctaatctaaaaattataatcattgccatagttgactgaattgttttcatttactatcagaaaacagtccgcaacaaaaaaaaaatctcatccgtgaagaaggagaaatacctggtttcaatttccacaaatttatgcagatggttgatttcatcttctgtgaagtccaatgtcacctgtaaattaaaatcctcctttatgactcaactcttgcgagcataaatatttgtagatgataaacaatctacagcataatacttataaaacgattactaagcatcatataactacatggagaaggagaatgaaacaatcgtttaatccaaattgacaaagcagacctaattacaagacttcttcaaaatgaaaaattcgctgttacagaataaccaaacagatcgaaagcaaccgaacagttatcatcactaagaaaatgaattccccaaaaatcgtttctggatactaccacaaagaaataattcgacctcaaaatctcagaaccgcttcgatttgagctatgctaacacgaatatcatcatcaagtattcaagtggaccattaacgagagtgtctagacaagaaaccgattttactgaaaattgatcatgtagattgtttattccctaagaaaagcattacgtcagattcgatcgattcagattccataaggagtacctgtttagcaagtagctcgcgctcgacatttccagatgcaaagaacggcgaatccggaggaaatcttcgtcggattgggttccagtacggaaagcctaactcgcctaccgtatctaccgccatacccgtagccatcgcttccggcactgagcagagcagaagaaattcaaaattttccgtttacgtctcacaaacatgaaacaagtatccaactgaacatttcctccgctccggtttattaactggatccttcctggactatatgatatcttgttcggcccaaagaaggcccacgtataagaaacaccattttctttttcttttatatctagaaattcaagcccaaaaatcttatattttccaaaaacgggattcacaccagattaaatttatcttctttggagaaaaaatcctttccaacatgtttcgaacctagcaccttcacttgagagatttaccactacctcattggttaacaccactatatttttaaactcgagtttcttaacaaaactcattatgtttctatcagttgattaagaaatgaagagagaaaaaattctgaatttttattttttattaattaaatcagatagctagaatgttgatcatgtaatatggattcaaacattttctaaatcaatccagattgaacttttttctttaatcaactttatggtggtgtatatagttaattaaaaacattttctatatttctatataccaaagtaatttggttaagctctaatgtgtttgtcacttcgtagtttgtacacgtgctgatataattatatattggtcacctgcaatgagcttataaatagttttctaatttgtggttgaaattgaaatgatctagaaatcttctcactaacattatatgattcttttgtagaaaataacactttagtcatcagcaatttgaatatttgctaagtttctattatcatcaaaaggggaactagtcctgtgatatgataaatttatactattataatttataccaaaagatatctgtatcagaaaataaccaaaattgggtaatattaaatgttaaatttgaatttcggctacaatagaggaaccgttgagctaaagttgatgaactaaattagaacaggtattccgctgaattcatggcgatcagtcaaaatcattatcatattaggatggacaaagactaattttcaaactcatcttttgaatttaatttatccattttgtgtttaacgacactatattatacgtttcatcaagacaaagtattttaaaatatcagaaaaaaattccatgcagatgactgacttaatgaggtttgttaaactgtcactgtcagttaaaccccctaactcaagaaatgtgtactcgcttaagtaaaatttgagaaatccttgttgtaaaattctggcattcacctgtgaatgtgattagattttaatcatcaaataacttattcattaacaaaaaattaaaatataagcacatttatactatagagactagatccagtggctatagataaatg

SEQ ID NO: 935 - DNA, 3000 bp, Unknown
  misc_feature (1)..( 3000): cDNA_ID_2128521_gDNA_ID_1620339_Annot_ID_153893 3000 nt of promoter + ATG
gatcaactgcagagacagatccaatcaacgcgtctaagatatcattatccatagggaattttccactcacaatcacctcagccacttccttagcctccgttaatcgcttagctgaaatcaaatccagaataaaagctcggtaatcgctgctcctaggtgctactccgagctttctcttcttctttaaaacaacctgtctctcatacagattcccagtaactacaaacgcttcagctatgaccctataagccataaaatccggtttgcaatctatgttccttagctcttccaatatataaaaagcatccatttctcgtgaacacttacaaagactatggagaatcaacagtgcaatgattgagccattgatattcaaattagcctttttaacctcatccaccaatctcaagagctgattcgtttcagaacttctacagaaccatcctatatagacaccgaatccaagagtgttcaacgaaacacctttatgacgcattttaacaaacagtttctgtgcataatcataacatccatcagaagttaaaccagctaaaagacgattgcatacatcgggatgaatctcctgacccgttgaaaaagcttcttctaaaacccaaaacgcactctgagctttcctacccagcacaagcgtatcaatgagggagcgatacacggaagaatcgagaaggattttgttcgatttaacctgtttgaaaagagcgtccatggcggagaactgacgagaaagcgaaagagacttgaagatagagtggtaagatatggagtcgtgagagtaacctggttgctgagcagcccaattgaagaaaccgagagcaagagaatgatgattcagcagaaacgggtctatgactcgagccacaagcgaagggcttattgagtgacgaaaaccgagaccgtgaagactctgttcaatcaatggactccatatccgagcagctcgagagcttccggaaacttttagcagctctcggccgatcctcaccgcaagctccgtcgcaggtctcatggccgagaagctgacgtcaacattttcagggagtcgctgacaagttggagaaatcgaatttggttaatgagtccattagttagaagtcaaactcatactggcccagtccaaaaagtgatttttagtgacccaaaactttgcatacgagattaatccttattacttgcccatttttggcccatcaaatatctgcatacacacagtaaatgtcgttcaattgtttacatgagaattgagaagtttcctagaggaaaatgacaacaattcacaaccagacatgacaacaacaacctcactttttggtaattttgcagatggggtctataggagtgacccactaaaagaataagaagaaaagaaagaaaccattacatgttttacggtttcagtaattaaatttttgttttaaaaagagaatatattatctctacttgggaataatgtcgactgggagatacaataaggaaagtgaaaatataggataatataccaaaagaagatatgattgaggaacaagaaagggagatatgtcgacttatcgagtgtccacgtgaatttgacataagtcgatcacattcttaagaaaaaatatagaagataatggagtgggaacaatggaagtgactccagattgcaaaatttagcatttgtaagtttgtttaaatctggcacaaaagtgtattgctttccctcttggtccccatacctataccacctacttctgtttgttcctttgttccttgttcctttgtttcatcccaatatgcttccctgtaatccccaattaacccatttgctttatcattatcttttcatacttgttcaaactaatctaatctgcattgtctatggtgtttgtttcacacagacgcctaggttcaagattcaccatctaattcttaccactaacaagttcctatttgatctacaaaaacaaaactatgtgcttctaacgctaaggagatgggtgtaggataattaatagaggagaacaaacccatagcattacgagttgtaatattaaaaacactgaagcaaacaacagtacctgatgtcgtggacagcttcacttgtctgaatcaactagccccaaagtcttcgttgttttgtcacggagctcccatatgcctcctggaaaaagtactctttctttacttttctgcaggatggtcatcaatccaaattgcattttcttcttgtcggagacagacagatcaacaaagcagactctttatataagaaaattattaccacataatgcagcctcaatcactctaggaatagaatgcagccacaatcactctaagtgagcaaggagccagcattgattgttgtttcaagtaaaataaaataaatctctaggcaaagcagtatcagtgtaaaacacagtttacattgttactataatcaaacacagaatgagtttgtacctatgtaactagatttcaagcagagtgcatactccttctactgtactagagaagaatagaccatttcactcaatttgcacgaaagaaagtctaaatatcaaggtttttacaacacagagcaatagcaaaaattgactatttattcatgctttatctgcaaatgacttgtaaatgtaaacgccacataaaatccactgttttacaatgtagaaactcaaatcaagataaaatagtaatacctgagatgctcgatgattgtaattacggatagctactccatcaatgaatttgaggcgtcatgtaaccacaacagtaggggctcaagtatgtaatggccctccaacttgttcttgatgtgatcttgaaagagaatggccaaccaaaattttgtagctttcttggtgttggtctccactgtcatcaacctaaaagacttgagatacagttgcaaccaattcactgccacagtaagactttaccaatcattgttctctataaaagtcactttctcctctagtattctgtagcaactgaagcacgaaa

SEQ ID NO: 936 - DNA, 3000 bp, Unknown
  misc_feature (1)..( 3000): cDNA_ID_2128498_gDNA_ID_1620339_Annot_ID_153887 3000 nt of promoter + ATG
tattgaaccaattaatacactgtaagttgactgactaattttcagtgaaatcaaacaaccaatactaataaacaacatcataagagaagcacttgtgaagcatataaaccagaaaatgtgtaaacttgtgcttcttcatcaccccaaatgcaagaaatgatgaatcattcgagaaattagaaaagaaaacagcaaaacccagagaaaccaaagtaaatcgagaaatgtagacaattaccttaactggatttccgtgaagaaaaacagataaaaattggaactttccttcggacacagctgaaacgacctgtcggattcgccggccaggctccgaaggaaatagtactaatgtttttttttgggtttaaggagtgaaaaagcggcttaagactctattagagaaggaagagaacgtgagacacaaacactgttttgtttgcccttcccagaatggacggttcagattcaatctctgggtcgagataccctttcagctattagtaagccactctactaaaatttgtactttgtgttaatccatgaaataatgttgacatctttctttttctcctgcatttttatttttagatgatagtaccaaataagtggttgatgctgtcaaaatcgtgagaaaacaaaacttggcccactcaatcccaagaatcagaaagaaaatttttcattgatcgataattggataggaaaattgataacataaagagtacttgcgacaaaaaaagaggaaacacaacaatcccaaaactgcccttgttaaagaccacttcaagcattctggtaatgatggagtttatacagcaaaacttttccggcagcgttccccatagccatgaagccacttccggggctgaagtctaggcagcgagggtaatgcattgtgctgtttggtggcggccagtttgagaagacggttagggatggaacatggactagctttacactgtttttgttcattgtagagactatagctagaatctgagcatcatggttgaacttcatgaaatctatcttggatgtgagattgtccactgtctttatcggctttcttttgcctcccacaaactcagatttcttgtaaatgtttacgattcctctgtcggttccagaagcaaacaatgctccgttaagcgaactgcaaagagaagtgccacaagtgctgccttcatccacgcctttgtataagcatttcattgttctcagatcccagacatagacttgcccgtcacctcctgagctcagcaaatgcttcccatcttcactaaatgctaaagacctaactgaaccattcatctttagggttcctatcagctcttttgtttttgtagacacaagtaagatataaccttcgttgccaacaaaagctatggtgttagagtcttgtgacacctcgaaatattccaagcttttctcctctctaccaaccaaagggccaattttgtcaaactttgccttctccaaatcaaagctgtaaaagaactttcttcttccggagacaatgacctgagagccattgggcaagaaagccgctttacgaatgggacagtcctcaagaaaaatgctctggatcttggtgttcctctttccatcaatctggaaaaaccttaaccgtcgatccaatccagcagtgagaagcagctgagcgttctgatggaagtggacagagtttattggaccatttgaaggatccgctgcattggcatccacaagcttagagtattcaagacgaccagcacacagcttgttaccacgagacttcaccacaagatcttcattcgttcgaaggatatcatcaactcctccatcctgagtatcatcatcatctgaagactctccatcaactatttgagaatctggccgagcccaatcagtccccgggtttagcttagcatgatgagccctcagccttgcaatgtactcagacccagagatcaaaccctcattctcctctttccttagcttccttagacggttgacactagctatatcaacgtttatctgtttctcttcttcatcctcccaggcagcttctccctttctaattgccacaacttgaccattctcttcatcagaaagctcttcatcatcatcaccatcatcctcgtagtcaggaatctgcctcacagcagaacggtctacatgaaacaaagccgaaccatcttcttcttcttccttaccaaacgtaacaggagagtagagtgacccgaatatcaaattctcaagctttttcatttcaaccagttccgattcttctagcttctgcttctccttctctgtctttcttctctttcccctagtgagatcatcatcggacccaatctcttcctcatcttcaacatcttcgtactgtttcttgagctcctctcttttaatacccttacttttcggagcattctgagataagctcatctttcaataccactaattcagagctgcatgaaacaaacaacgataagattcgcaagctcgttatcaatccgtaattaagctctcatttcgggaagaattactacaaaagctactaatttgacctaattcatgcacaaatttgattacaatgaagaaataacttacaacgttgacgagcagagaaaccttgtagccggtaattgtcggcgagagagcttctacccttctggttggattttttagggttttagaatttcattttccaacaaaagataaacaaataaaaattggaacttgtcgttaatacagccctttaatgggtcaacgggtcttatgtctcttgaaaaagcccatgggccaagacaggtaaaataacaatgtcactttcgtaattatcgcaaagtatatgccttgttccatcagattccatttgcccaataaagcccgagtttcgagagttaatacctcattggtgcttttggttttggcaaagcgtgagtgagatcgggaatcaaacatcgcctccgtctctcatttcaaacgctatctccatctccttcctccgccgccgccatg

SEQ ID NO: 937 - DNA, 3000 bp, Unknown
  misc_feature (1)..( 3000): cDNA_ID_3059699_gDNA_ID_1620339_Annot_ID_153891 3000 nt of promoter + ATG
cctgatggttggtggtgtccttctttagcttcagcctcaaggaacttatccaattcattgcttatgagcttcaaatcattctctgtcacatctgcatcatctattgctgggtcctcaaatgacatgccaaatgtcggcgttgctggttgttcatcaagaagtgtttctccaccaagggttccaatggcaagaaatccatcaaaaaaatcactgtttctctcatccttgaagtcttcctctgtgtattgcttgggtcctgcgaaggagctttcctggaacaggttgacctgttttctgaatccagtattgtatctggagccagcacatgctgttgggtaaacctcttggctatcaagggatggatgagctgaaagaatggaatagctgttgcctgaaatggtcatgtgaagagaagagttctttatttctttgaataagtaagaacggccagtgagatttggaaaaagatgcatttgcacaagaactagggaaaatgtctgagttattgtaacatgcacgtagaggcatggcatttactagataatactcgctagggagagctggtttggctgctatctatcactcacaaaatcgaagcgcaagacaaagttggtttcaggcaaattgagtaggtgagctttttattcagctagctgacacccatcataatgctttgcacacgagtgcatgatcctagtcttttatcaggtcagcagattgattttctagaaatggatgttaatagtagtgagattattactcagtcctgaaatgcttgctaagtcctattgctattctcctaggattcaaacacacttcatgttcttgttctacatatttgacaagaaaagaagtgccagagaagtacagtcaaattaccagtagaagcatcttttaatggctctttgctattctcccggaacttatgatgcatccagccccaaaactgccagaaaatgagcttttgtaagtgttagctatgagatatttaattttggtttttagatatagaccataccttcattttcgtgcttcagttgctacagaatactagaggagaaagtgacttttatagagaacaatgattggtaaagtcttactgtggcagtgaattggttgcaactgtatctcaagtcttttaggttgatgacagtggagaccaacaccaagaaagctacaaaattttggttggccattctctttcaagatcacatcaagaacaagttggagggccattacatacttgagcccctactgttgtggttacatgacgcctcaaattcattgatggagtagctatccgtaattacaatcatcgagcatctcaggtattactattttatcttgatttgagtttctacattgtaaaacagtggattttatgtggcgtttacatttacaagtcatttgcagataaagcatgaataaatagtcaatttttgctattgctctgtgttgtaaaaaccttgatatttagactttctttcgtgcaaattgagtgaaatggtctattcttctctagtacagtagaaggagtatgcactctgcttgaaatctagttacataggtacaaactcattctgtgtttgattatagtaacaatgtaaactgtgttttacactgatactgctttgcctagagatttattttattttacttgaaacaacaatcaatgctggctccttgctcacttagagtgattgtggctgcattctattcctagagtgattgaggctgcattatgtggtaataattttcttatataaagagtctgctttgttgatctgtctgtctccgacaagaagaaaatgcaatttggattgatgaccatcctgcagaaaagtaaagaaagagtactttttccaggaggcatatgggagctccgtgacaaaacaacgaagactttggggctagttgattcagacaagtgaagctgtccacgacatcaggtactgttgtttgcttcagtgtttttaatattacaactcgtaatgctatgggtttgttctcctctattaattatcctacacccatctccttagcgttagaagcacatagttttgtttttgtagatcaaataggaacttgttagtggtaagaattagatggtgaatcttgaacctaggcgtctgtgtgaaacaaacaccatagacaatgcagattagattagtttgaacaagtatgaaaagataatgataaagcaaatgggttaattggggattacagggaagcatattgggatgaaacaaaggaacaaggaacaaaggaacaaacagaagtaggtggtataggtatggggaccaagagggaaagcaatacacttttgtgccagatttaaacaaacttacaaatgctaaattttgcaatctggagtcacttccattgttcccactccattatcttctatattttttcttaagaatgtgatcgacttatgtcaaattcacgtggacactcgataagtcgacatatctccctttcttgttcctcaatcatatcttcttttggtatattatcctatattttcactttccttattgtatctcccagtcgacattattcccaagtagagataatatattctctttttaaaacaaaaatttaattactgaaaccgtaaaacatgtaatggtttctttcttttcttcttattcttttagtgggtcactcctatagaccccatctgcaaaattaccaaaaagtgaggttgttgttgtcatgtctggttgtgaattgttgtcattttcctctaggaaacttctcaattctcatgtaaacaattgaacgacatttactgtgtgtatgcagatatttgatgggccaaaaatgggcaagtaataaggattaatctcgtatgcaaagttttgggtcactaaaaatcactttttggactgggccagtatgagtttgacttctaactaatggactcattaaccaaattcgatttctccaacttgtcagcgactccctgaaaatgttgacgtcagcttctcggccatg

SEQ ID NO: 938 - DNA, 3000 bp, Unknown
  misc_feature (1)..( 3000): cDNA_ID_2128505_gDNA_ID_1620339_Annot_ID_153889 3000 nt of promoter + ATG
ataattacgaaagtgacattgttattttacctgtcttggcccatgggctttttcaagagacataagacccgttgacccattaaagggctgtattaacgacaagttccaatttttatttgtttatcttttgttggaaaatgaaattctaaaaccctaaaaaatccaaccagaagggtagaagctctctcgccgacaattaccggctacaaggtttctctgctcgtcaacgttgtaagttatttcttcattgtaatcaaatttgtgcatgaattaggtcaaattagtagcttttgtagtaattcttcccgaaatgagagcttaattacggattgataacgagcttgcgaatcttatcgttgtttgtttcatgcagctctgaattagtggtattgaaagatgagcttatctcagaatgctccgaaaagtaagggtattaaaagagaggagctcaagaaacagtacgaagatgttgaagatgaggaagagattgggtccgatgatgatctcactaggggaaagagaagaaagacagagaaggagaagcagaagctagaagaatcggaactggttgaaatgaaaaagcttgagaatttgatattcgggtcactctactctcctgttacgtttggtaaggaagaagaagaagatggttcggctttgtttcatgtagaccgttctgctgtgaggcagattcctgactacgaggatgatggtgatgatgatgaagagctttctgatgaagagaatggtcaagttgtggcaattagaaagggagaagctgcctgggaggatgaagaagagaaacagataaacgttgatatagctagtgtcaaccgtctaaggaagctaaggaaagaggagaatgagggtttgatctctgggtctgagtacattgcaaggctgagggctcatcatgctaagctaaacccggggactgattgggctcggccagattctcaaatagttgatggagagtcttcagatgatgatgatactcaggatggaggagttgatgatatccttcgaacgaatgaagatcttgtggtgaagtctcgtggtaacaagctgtgtgctggtcgtcttgaatactctaagcttgtggatgccaatgcagcggatccttcaaatggtccaataaactctgtccacttccatcagaacgctcagctgcttctcactgctggattggatcgacggttaaggtttttccagattgatggaaagaggaacaccaagatccagagcatttttcttgaggactgtcccattcgtaaagcggctttcttgcccaatggctctcaggtcattgtctccggaagaagaaagttcttttacagctttgatttggagaaggcaaagtttgacaaaattggccctttggttggtagagaggagaaaagcttggaatatttcgaggtgtcacaagactctaacaccatagcttttgttggcaacgaaggttatatcttacttgtgtctacaaaaacaaaagagctgataggaaccctaaagatgaatggttcagttaggtctttagcatttagtgaagatgggaagcatttgctgagctcaggaggtgacgggcaagtctatgtctgggatctgagaacaatgaaatgcttatacaaaggcgtggatgaaggcagcacttgtggcacttctctttgcagttcgcttaacggagcattgtttgcttctggaaccgacagaggaatcgtaaacatttacaagaaatctgagtttgtgggaggcaaaagaaagccgataaagacagtggacaatctcacatccaagatagatttcatgaagttcaaccatgatgctcagattctagctatagtctctacaatgaacaaaaacagtgtaaagctagtccatgttccatccctaaccgtcttctcaaactggccgccaccaaacagcacaatgcattaccctcgctgcctagacttcagccccggaagtggcttcatggctatggggaacgctgccggaaaagttttgctgtataaactccatcattaccagaatgcttgaagtggtctttaacaagggcagttttgggattgttgtgtttcctctttttttgtcgcaagtactctttatgttatcaattttcctatccaattatcgatcaatgaaaaattttctttctgattcttgggattgagtgggccaagttttgttttctcacgattttgacagcatcaaccacttatttggtactatcatctaaaaataaaaatgcaggagaaaaagaaagatgtcaacattatttcatggattaacacaaagtacaaattttagtagagtggcttactaatagctgaaagggtatctcgacccagagattgaatctgaaccgtccattctgggaagggcaaacaaaacagtgtttgtgtctcacgttctcttccttctctaatagagtcttaagccgctttttcactccttaaacccaaaaaaaaacattagtactatttccttcggagcctggccggcgaatccgacaggtcgtttcagctgtgtccgaaggaaagttccaatttttatctgtttttcttcacggaaatccagttaaggtaattgtctacatttctcgatttactttggtttctctgggttttgctgttttcttttctaatttctcgaatgattcatcatttcttgcatttggggtgatgaagaagcacaagtttacacattttctggtttatatgcttcacaagtgcttctcttatgatgttgtttattagtattggttgtttgatttcactgaaaattagtcagtcaacttacagtgtattaattggttcaataaatttttcataattcatttcttaacatgattttacctcattcattatatttatagatttagatcccttgataatgatctgatattctttctgtgaatttgaaagttgcaggtttccacattgcacagctgtaccatttgtcgagatcacaacacgcaagtctcttagatttagcaagctt

SEQ ID NO: 939 - DNA, 3000 bp, Unknown
  misc_feature (1)..( 3000): cDNA_ID_1009090_gDNA_ID_1620340_Annot_ID_153924 3000 nt of promoter + ATG
ggagggagatttgcgaaaattcacctttcttgtttagcttttttgaacatgagtttttgattaaacttaactatatggaaagtcttgtggagcagttgaaatccatcaagaaggataagttttcttgtaatgataagtggttaacccttaagcttcaaatcaacaaaaactttgaggtaacgcttgttgattacgagatcctgaacaagatattttgggatatataattgtgagcgattgatcgatagtaagatttcggatatatattgggactttatctgaaaacactaaacaataagtcgtaaattgggagtacgtaaaaacattaagggtctaaatgaaataaaacctataatataactaggtttagtgacgtggcatgcacacgtagattaagcaatgccttggcaacacgtatgcaaaaacccatatgtgtgcacctgtgaagtgttccaataacaattcaaaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccggtttgtcttcgaattcgaaccaattgattcttttgtgtctttcttctacttggaatttgattttgttgttcttcaggcttcaggagagatctctattttgggtgcctaagatataaagtttctattttttggctcttggattggaattgacaattttttttgtgtgtttgttctttgcagataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggtaaaactgttctcgagagtttgttttttcttatagattaattgttaaccattacataagaggtggtgactttggctactttttgagtctctaagaggaatacagtaaaattttaggagttttgtctttggcttgagttgattgattatgtttatgtaaattctaggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggttttgtcacctggcttctaattgttgtatgatggttcttgattgttgtcgttcttcttaatgaatgttatgtgtgtgtggtttaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaacggtttatgttttacacttctacttcaaatctgtgcaaccaaatcaaaacctgaaatatcaagcacagaagaactagtggatatagtttttacacttcaaggcttattaagtggtgtgtttaatgagaatcagagaatggataaatgatgggggcaaattagtaaatgactattttccaaatccgtactgtttatctttctcgtccagatggttgttgcactaagatttgtagaattttctcgccgccattaaacctctgcttttgtttctttctctcttcttctatacgagaacccattttggagaagtcaagtttcctcaatactccgtcaagccgattttattgatctcgatcagtttcgtcaatttttccggtttaagaaaccctagaaaagctgatgattcgataatgaagtttgatttcactgtgataaatcgatctgtaagttggagatacttaatcgtcttcgttatatcttctacgatgcttcaattttgctttgttgtgctgaggaaattcagtttttctgtagtatgtgttatttgcttatccttagtaagttagttacatatgaaggagattcgtattgaaaccctaggtcattgatttgatggagttgctttttatagtatcagcttacactgtttacattgttctacttttggtttttaattagaaaatttgaagtgagtaggtgaattttaagtcgcatcgatctcattttcgatatatgtctcaattcgattaggcgtggtctttggatgtgtgtttaggatggtatgaaatggattgattgtgaaatttggaacaggttttgtaagagctgaatagaaaatg

SEQ ID NO: 940 - DNA, 3000 bp, Unknown
  misc_feature (1)..( 3000): cDNA_ID_3059723_gDNA_ID_1620340_Annot_ID_153944 3000 nt of promoter + ATG
aatattatataatttgcatagaaacttgaaaacaacttatattgtgaaacaaaaaattttatctaaaacaacttatattatgaaacggagggagtatttatctacattcgttataattattttttactttataaatatacttgttttctgttctagtttatgtttgtggggaaagaccgggacacatagtagagaaacattttgcaatgggagagagccttaacggtaaaaacaaagtagacattaataccgaaaggcgattggcagatcagaaatcaaaacaattcaaagaacaaggttgttccgaggaagaaactgaacaagccatgaaagatttcggattaaaaaggttgttatacaatatcaaatactgaaattagaaaatagatactatgaagtaactcgaagcattttcattattcatatatataatgttaattagggcaagactttatgggtggccaaacacatatgtcttcaccaaagcaatgggagaaatgcttcttggacactatagagaaactatgccaattgtaatcatacgtcccacaataatcacaagcactttctcggacccatttcctggttggattgaaggtttaaagtaagctatccatttatcattcctcattatagtagttactttagattattcatccacgtacttgatttgtttctgactcaacttctaatgtgtttattgtatgtatgaagaactgtagacagtgtgattatattctacgggaagggaattcttaagtgttttctcgtcgatcaaaagacagtatgtgatattgtaagtttcactagcacattaccaactttgaaaaatgtaaactaaaattctatttttactagcttgattgctaacaaagaaatatctctatataacaagataccggttgatatggtcgtaaacgcaatgattgcaatcgcagctgaccattgccatgattctggaagtcatacagtttaccatgtcggctcatctaaccaaaatccggtgatatataaacaaatttatgagatgatgagtcgttatttcatgaaaagccctcttgtcggacgtaatggtatgcttatagttccaaaagttacaagaatatccacactggctaggttccgtgtatacacaaatcttcgctataaattacctatacaggtaacagcttgcataaattgcacacgatttttttttttttctgtttgagtgttattctttttattattttaatagcaacctctcattttggctttgtgttttttcttctttagatattgggattacttagtgttatttccctatcccaaagagataaatttgcacttcacaaccgtaaattcaagatggccatgagattggtgaaactttacaagccttatgtactcttcaagggcatgtatgtatcactctcatatttcctccaacattccttttttacaagtattttcttccacttttaatgtatctagtagatatttttcatgccttagttcacgttttaactatagtttgaaattctattgtgtattcaatgcagatttgatgataaaaacatggaaactttacgtatcaagaatgaagccaaagatatggagaaattgtttggcaccaaccccaaatgcattgattgggaagactattttatgatacgcatatccctggcctcatgacacacgtattcaagaaatgaacttcaaatacaagttaatatacgaagtcaagtccaaagatattgttttgcatgggatgaagcctactatatataattactaagtatataaataataaatcgatggaaaatcgacgacaagtaatgttgtctttgtttgcttcttaatgtataatccatatttggaatttgcctatctaaaatccctcggcttgtctttggttatatataaaattggactactcattttgacaagtaaacatatactactttttaagtcaagaacatatactacttttccgacagaatcccacatttctttagttcttttactttgataagcaacgtcatcacttttaatgatattttaagtgaatgaaaaagagatgttgagtgaaggaaaaaaaagaagaaaaacaactagacgtaagtaaaattggactactcattttgacaagtaaaggtgggcttcggtgaagcaagaggttacaaagcaaatggacatcaaccttaaacactagtatataaaaagattttacaagtgacctgcgcttgtagttacctagttcagctaaaagtaaaaaaatgacacaaatgtaatggacaagtactgaaagataattttattggatataaatgatgtaaccactgacactgttgagcaaaccttcacggctcattaaagatttataaaggacagtaagaaaaaaaatatgtttccccactaggctttctatttttagtatcactctaaactctagcgagtgaagatggctaaagtatagctagttaatgcttaatgcgtaatataaatatagttggtatatgattaaatactagtaagtctggttttcaagtaatgcagtttaaatggttcactgatgaattaaaattgacacacaataaattgtttaaacataatataaatgaggaaattaatgttttgaaggaacttcaatacagtataagaatatatgtgtttctcaaaatggtgatttatgtatagttttctagggtctctccttaactccgttgctagacataattggtgttcgtgtataaatgatttgaatctaacaaattgttaggttgaataaaattttgcagcaaatttgaaggtggatgaatttaagagccgttaatatagaagaactgcaaaagtacgttatctatttgtgtaaagccaaccaccaaaaaacaacgcattttggttcctttaataatcatttctttcttttatataaacctaagatacgttccccatatttcactcactcaagaagacatctaaagccatcaaaaatatatccatagaagcttcatcgaa

SEQ ID NO: 941 - DNA, 3000 bp, Unknown
  misc_feature (1)..( 3000): cDNA_ID_2128687_gDNA_ID_1620340_Annot_ID_153942 3000 nt of promoter + ATG
ttgtgaagggctttggtgaccactctcatcagacggttctaaagggaatgcatgagcttgctcgaccactgagtcttgcctttctcttaaagttttttcgattagtgtcttgagaaagttcatcacttgaaccgcatacatcagtgctgtcagtggatcatccatctacaatacaagtgtttctcaatcattttatcccatctgaccccgagttaaacattgataatcaaccttgttgttgcagactcacctgtgtcatatttggtgcgaaaaccatagcgatgttgcgtgaattcatcttgtttagatgttcatactgaacaacatctgccattagattgatggcccaatcaagtagagcagcttctgtaggtggaagaagcctaacgagctcaacattttcctcttctgtttggcactgcatcacctgttcaggcgacaacgaatcaagaacgcttgtcggcagttctctaaaccatgcctgaaaccgaaaaccagaattaaaaaccaaggttcatatataagttttggaaataagatgtgcatatgttacataccttgataagccctgccaaacagtgaacatcgattcgctcaggtataaatcctcggtttaattgttccctaaccgcctcttcctcactattctcagcagtgagtctaaaaatgccctctgcctaaaaaaataaatgaagaaatgattacatggaaagcttataatatattcactttggagtaaactcgatgaagcaatgtacattacctgcaagcctccttgactatataaacagttttgcatcagcaatagtatggttggtacacaattgcctcttgaatcatacgataattgcattgattcggttgataccccaaagactgttgcactaaagtaatgagataccaaaagaggtaagagatgggatagcacacgagagacaatttatacttccaaaacaaatattccgagaagagcaaagttacaattgcataggcgcagtttcacccttttcaacattgatcttatcgattaagcatgtaaatagttggatgaacaatgcaaccttcacagaatctaacaactaagagatagtatctaagacatcaaatatagatgtttgaagacaagtaactatagtataactgcaagaatgaacacattggttcatggctcaatagcccaatcttgtaaatatgaagtgtttagcttccacggaaacacatagctatgagactgaaaaaacagagagagacaagaacgtgctctaatcacttcatgtactgactgataaaggaatcaaaaatcaaataagttcttctcgttttggtttcactaattccacataaaccttaatctgtatacaaccaaaacttagaggttctacaactcgaaacaaggaagccttaatcagaagcattctatatccatctgctcacccaccccaaaattgcaggacaagatcattgttgtgaggagacttttaagagcaattcaataaaaaggtaggatctttggacaatgtacctggcgcttggagctcttctaggaacttcaggctcgaattcaacaggcaaacccaagaagccattgaaacgatcaaaggtaacgtgcgccacgtgtctgacattggtaggccatccaatctccatgctacaaagctccctccggttactcttgcaagaaatcaaagatctcctgaaaatggcaacaagaagagccaacaacgaaatctgatcttccccaccatcgtcttcttctcctccatcggtactgctccgtcttctcaaatcttgttcttcgattgaggcatgaaagtcaacatcttgatcgaatctagcaactgggtttctccggttgtggtcagagctaatcaagagagtcgcattagagcgagaggcgtaagataaagaagaaggtgaaggagaagaagaagaagaagaagatgaatgagaagcgcttggagatgaaggaaagtgaagaacttcagtcatggcgcttcagattttggcaaaggaaacaacttttttggttcaaatcatttgtcaatgaaagaaaaggttttgaattgaaggaaatgtataaacccggaaatagagctcaagatcgaagattagattgttgattcaaaaccctaattagatgaattcggttgccactaatgaacaaaaaaacagagttttgttactactaattaaatttaaataaatgactaaacattgaccataaaaagtggttaaaccatataaaaatagttgaataagataagttttggtaacacaaaaaaaaaagagaatactactgattgttacatatttatgattgattttagttaaactattggaggttttacaattaaattagttaacattaagtattgatataaaaggataaacattgatatattaatgtttacaagtccttatcacttataaatgtggatttcgtttgggggaaaatcagtatactttatgatttttgcacgttttctaaaatgtgaaaccatgttatgttcttagattagtagtatccacgttttcacaaaatataccattcaaacgcttgctctatagtacataatccctatgttgagccagtagttaagaagcattttgctgaatttactaaaacaaagatcaaggattttattgcgttttaaagataaactcgtgttatgcatacaagtgatttgcttacaaaaaattatgtgatatatactcttcctatgggagaaaaaaaaaagaattgaagaaaacattagaaaaacgtatcttattatttgcattcggattgccaattttattataaaatagaaccagcccgacattagaaaatcataatgtgatcgcatgagtgagctagaatcaaatactatatccatgaacgcacgttagagaatcgtgcttgccacacatttggtaacaaacttgaacactataaaagttgttaacaatttttctacagttccccacatactagaattcatatagaaatttcaactaaaa

SEQ ID NO: 942 - DNA, 3000 bp, Unknown
  misc_feature (1)..( 3000): cDNA_ID_3059719_gDNA_ID_1620340_Annot_ID_153946 3000 nt of promoter + ATG
ttcatgagaaaagaacaaattagaatttctttttggctttctgttaacaagatacattgtatgaaatgaatctgacccgtgatgacaatgcaacaataatactagtacggctctaagagtcatagtcaaaagagatggtgattataagacagcaattacgcatgtcaacgtcacaataatgcgtgctactactaccatcctcctactgtctgctacgtcaacaagtggattgcaatcagacggtgattgtgtctcttttcattctctctcttttactaatttctctgataattaaactgagaatgtatattaagaaaaaaaaacaaaaacaagagaggaattttcatacacactaacttaagactctttgtaagttttcccaaatatggattttctagtataaatatgagttcattagtttcaccaagcctacaagcatctctccatctcaaatcatattcacctaaaaatcaggtcccctctctttatatctctaacattcttatatcagatcatattttttggatttcttgttaagtaacaccaatcttttaaaagtgttttcaggttaatataaaagaataatgatgttttcggtgacggttgcgatccttgtttgtcttattggctacatttaccgatcatttaagcctccaccaccgcgaatctgcggccatcctaacggtcctccggttacttctccgagaatcaagctcagtgatggaagatatcttgcttatagagaatctggggttgatagagacaatgctaactacaagatcattgtcgttcatggcttcaacagctccaaagacactgaatttcccatccctaaggttcactcttattctcaatattaactctcgtacatgtcacatgcccattttcaccattttagatatacagttttgatactttactttgcatttattttgctatatgtaattgaggatattgttttaatttctttgggttttttttttggctaaatgagaattcagtgtctttggttcttaaaaaaaaagtatttgttaatggtaaacgctaaacgctatttgagtttatgttttttcaagaactgaaaacgttttattgaaaatatacactttttttgctatttatagaaaggcatatcacatctagacgcaaacgcaaaattgacttttgaagcaaccacaatcttaaatgcaatgaaaaattacttcttcttttttctttcttgacgtgtctttttaaattttttgcaggatgtaattgaggagcttgggatatactttgtgttctacgatagagcaggatatggagaaagtgatccacacccatcacgcactgttaagagtgaagcatacgacattcaagaactcgccgataaactcaagatcggaccaaagttctatgttcttggtatatcactaggtgcttactcggtttatagttgcctcaaatacattccccacaggtaataaagagttggaatcatgttctgttttttacactttttttgtgtctcataatttaatgttcctttttgtggggttcatagactagctggagcagtcttaatggttccatttgtgaactattggtggactaaagtgcctcaagaaaaattgagtaaagcgttggagctaatgccaaagaaagaccaatggacgtttaaagtggctcattatgttccgtggttgttatattggtggttgacccaaaaactatttccgtcttcgagtatggtcacggggaacaatgcgttatgcagcgacaaagatttggtcgtcataaagaagaaaatggagaatccacgccctggcttggtaatatgattaaccttatacaatattgcattttatgacaatgatgttatttagatttaatacattttattttatgatctatattaaccacaggaaaaagttagacaacaaggagaccatgaatgtcttcaccgggacatgatagccggattcgcgacatgggaattcgacccgactgaattagaaaatccgtttgcggaaggcgaaggatcggtccacgtttggcaagggatggaagacagaatcattccatacgaaattaatcgatatatatcagagaagcttccatggattaagtaccatgaggtcttaggttatggacatcttctaaacgccgaggaggagaaatgcaaagacattatcaaggcacttcttgtcaactgatgatcatctctacacaagatgccacgaaaaatatagcatatttaatagattttatttatggattataatattatagcatattataagtttgtaagtaagatgaaaaccacttgaaagtcattaatttactataaaatacttgttatcttccactaatagtcattaaatcgaaccaaaaatgtcacattggtcaaagccgtgtgaaactgagagagaatgatgacgtcatcaatctgtgtacataaatgttaatggacgtagcaaaattcgcccaaccaaaacaatccgactaaaagggaacttttttttttccgtctgatctaaaacaacaacaacgaaagcttgacctcgttgaaaatcttcgggtgagatatttttcaaagctttggtctttgtctgaattacgctttttggattctccgagcttaataatagcgaaagttcgtttctttgggttcttctccgcgattctagggtttttccaatttctcgccggcgttgaggaattttagggttttcgtgttgtttgtctttgattcatggcttgggcttagatggaaaggtgagaatttctcgaaatcgttcttcaattcttgagaattgcgattttttggtctttaagaatccgttttactagtttcaaagttaacacctttattgctactatgtgcttcccttatatcgctcttgtggtgtgcgtaagagtgatgatgttactgtatttatggatttacgaaactctcgtttttttatttcaggtttgagttgcttttggagtgaagcaagtagaccaaagggcataatg

SEQ ID NO: 943 - DNA, 3000 bp, Unknown
  misc_feature (1)..( 3000): cDNA_ID_2128697_gDNA_ID_1620340_Annot_ID_153945 3000 nt of promoter + ATG
tgatactatatcatatatgacttctctctaggatgcccactcttgttaacttataattttctgaaaacagctgaattttgcgcaagaactcgataaatctctgtcagacgcaatcttagatggttataacatcttggtaagttgcaaatttctatagcaatgtctagttttctagtctcttttataatctgaatgtagaatgaatgaaagagtccttttttcagggtcttaaattgcccaaagcagtacatcgccctggtgtgggaaatgttgactattcaggtccaacctcatcatgtgtatctggtctttcattcgagagattggacatgagaaaattaaatgagagtactccattgtataagagggtactttctgctttaattgaggaagatgatggagaagaagttgtacaattcaatggagggaagaatctgtctcttcattacgctagtgacgattctcactgtggttcatgtacctatattgacaccgagttcagagagagagacagaatggaatttgaagtagagtcaagtggggattttcagacccctaagagcggtttgtttgacagattttccagtgagaggagtgttgtgtctaaccctttcagaaatggtggcatgtctatatctgtgcatagcaatgaacagtggattggggatgatgatctttcacattcagacgctgcactcggtaatgagacatattcaaatagtctgggtcaattgcaagctagggaagtgaacattcccaacttcccggtttctgacacccagtatcagcttatgtctttggatgagcgacttcttctggaactacagagcattggtgtgtttcctgaggcaatggtaggttttgcatccagtcatttaatctttaaagaacttgagctaaataaaaaaaaacttgttactctagcttggtcactgatttccagtttttatttttatcacagcctgatctggctgaagaaactatgagcactgatgttatggagttgaaggaaggcatttatcaggaggtaaacgcaaaacaaatatttcatgctttacgaggaagactttttgtcagatcgtcattaaactttcgtctttgacgcatagtaacctttctcatattccatttctgaccaatactagatcctaaacaagaagaaaaagctggagaagcttatcattaccatccagaaggggaaagatgttgagaaaaggttagctttggcttttttagattcatatcttccaagttacacctttattttcgctaagatttgaggtttacctgcaggaaaattgagcatcttgctatggaccaacttgtggaaacagcccacaagaaaagaatggtaataaacgaaaattaatttggatgaatgattgtggaatgagaaatggggttcttaattatatgatattgctctgaaaacaggcatgccgtggaagtaaagcagctaaagtcaacaaggttacaagacaagtggcgctggggttcattaggcggacagttgctaggtgtcgtaagttcgaagaaactgggtttagctgtttttctgatcccgcacttcaagatatcttgtttagttctcccagcaacgatgcaaaatcatcagaaaatggcggctctggaacagccagtaacacgctcaatgaaccttctaatcatcaggctgaggccaagggttcaggtacccaaaatctgaactttagatgttgattctataattgatttttctatagtttcttcttctatggtgtatgacaacatcgataagattatttcagattaatgcgagagcacatccttgataaaatagtttgacagtggttatactttaaatctttttgacggaaaatttgatgagttatttgggttttgtaggtgcagtgtctagtacaaagaggagagaagcattgatagatgatgttatcggatgcgcttcctccaaagtcacaacgagcaaaggcagtgccgttcttagtggaggaggggctcaaggtaaaagaagcgagagagaagatggtttcaggaacaagaacaaaccaaaaccaaaagaaaacaacaacaacaacaacggaaaccaatcaaggtcgacaacaacatcaacacacccaacaggaccagcaagcagaggggcctcaaaccgaggagttacctctggagatggtgcagtcgacgacgaagctcccatagatttctcgaaattagcgttccgtgatctagacgaaatagatgaacaggcagatcttggaaactggttcgagggtcttcaggatattgatacagcaggtcttgatgaggttcctatggatgatctctcgtttatgtttggataaggagaaaacaaaccacatttgacaggagcgaaattggtcttgactcttgacacaaacacccacacccacaagtattcttatgattttgttttctaactagttttgtatataaagaaagatttgtagtgaataggaatgattgtctgccttctaggctgagtattgtttcaactatgatttaaaatatatatataacatatgtattttcttcttcagagtatctctttcattcataccttccctgtggtgcgtataaaaaagcttagtacaatctacttaacatttcttgatttggttaaacaagttttgtttagtgtttaaaacctttctgaagaaattaggctttaattcgcagaaataataaggcctataatattttatacgtttctatgtgggcctaaatactgggctttaatgagaagaaataattagggctagagttttgtcactagtggttcatataagtaacagacgattgcttgtgacgccgttctttctctgtttccgaccttcccacaggtaaatcaatcatcttcttcaatacttttgtctttccgtccatcggaggattctcaatacgtttcgttacaacactgttaaatctcattttcctgaatctccgtttacaggaagcaaatttgtttcagggagtaccaaaatg

SEQ ID NO: 944 - DNA, 3000 bp, Unknown
  misc_feature (1)..( 3000): cDNA_ID_2105845_gDNA_ID_1620340_Annot_ID_153929 3000 nt of promoter + ATG
cgtctctttttctagccaactggtatccctataaaattggcagctggatttgttggtcaacttgaggctagagaggcagctggtcttgtagttgacatgattaagcagaagaaaatggcgggcaaggctcttttgcttgctggacctcctggaactgggaaaacagctttggctcttggaatctctcaagagctgggaagcaaggtaattttggatgtctcattttgtatcttctttgttacattgtttccacatggcttcattgtatgaagcttttttcttttacttttagcttattttatctggattgtttctttcttgcaggttccattctgtccaatggttggatctgaggtttactcatcagaggttaagaaaacagaggttctcatggagaattttagacgtgccattggtctacgtatcaaggaaaccaaagaagtctatgaaggggaggtgtgttgctatttgcggtttcttttgctgtgttcttatgcaatagcatgtctcgctaattggtttttgacatgttgtccttgtgttctaggtcaccgagctgtcaccagaagaaactgaaagcctcactggaggttatggtaaaagcatcagccatgttgtaattacactcaagacagtcaaaggaaccaaacatctgaaattggatcccactatctatgatgccttgattaaggaaaaggtcagttcttggcatgcgatgctatgctttggatgtggtattttcccctaagtttttgcttttcagtttgttccaaaacctgcttttcttttcacctttttggttttctaacgatgtcattctgtggggacaattgtgtatgaatttgctgattactttgtcattctgattggtttctttttatatttttgctgtttgcctctcaggtagctgtaggagatgtaatctatatcgaagcaaacagtggagctgtcaaacgggtaggtagaagtgatgcttttgccactgaatttgatctggaagcagaagaatatgttccacttcccaaaggagaggtccacaaaaagaaagagatagtgcaggtttaccttctttgacctctcccttctgtgtagagtaattattttctttgttgatttattatctgttatgtattagtttgtatgtgtattaaccttagttcctaagtttattaagactacttgttactcaactagaccatatacttttgactgataggatgtcacactccaagatctggatgcagcaaatgctcgacctcaaggtggccaggatatactttctttgatgggccaaatgatgaaaccgcggaagactgagatcactgataagcttcggcaagaaattaacaaggtgattttcgctagtacatgggtgatttttttaagcatcttactttctcttttgcaaggtctaatatttttatatgccattgtaggttgtgaaccgatatatagatgaaggtgtggcagagcttgttccaggagttctatttattgatgaggtattttcccaaataaagttttttttcattccactattgatcttgctcaggactcaggagcagtaagaatacctttgtttaattataaaacctcaggttcatatgcttgatatggagtgcttctcatacttgaaccgtgctcttgagagctcattatctccgatagtgatatttgcaacaaatagaggtgtttgcaacgtaaggtgagaagagcgctagaccttgatagacattttcctttggaaatcttgtgagtttttgttaacttggtactgtgatttactttatttgcagagggactgatatgcccagcccccatggagtccctattgatctattagatcgattggttatcatccggactcaaatctatgatccctctgaaatgatccaggttactcaattgtcatttagcttttggatttcaattactacgaacaacattctaatagatttatcattttgttcacagattatagccattcgtgcgcaagttgaagaattaaccgtggatgaagaatgcttggttctacttggggagattgggcaaagaacttcactaaggtactgtcatcattgcttttctaagcaaaatttctgttcgtgaatctaaatactaaaaccttttttgtgctttcactctcaggcacgctgtgcagcttctgtctcctgccagcattgtagcgaaaatgaatggccgtgacaatatttgcaaggtagatttacttgtgaaatcttagaacaataaaacaaatgtaaaatatgtggatgttatgttattaatccttcatcttaaattttgacaggctgatatagaggaagtaacatcactctacttggatgctaaatcttcagcaaagcttttgcatgagcaacaagaaaaatacatctcatgagaagaacactaatcgcacattttgttgaaacatctcataatttttctgtcgttttattttgtaatgtcggaatatggagaatgtctaatgggattacaatttggtttctctgaattcatttatttatgtgctatttttttgtttgtggtgctaactaatgaaaactgaaatatggtttcacgtgtatacacatacatggtcgtgagattcaaacttttggtttcatattgagttcccttgttacattacaatacacttattcaagatcaaactgtttgtggaacataacattgtgtaattgtctatttggttactgttaaaagttgatgttgcgccaaaaagaaagaaaaaaaactctattatcagaacagagtcagcagagtcggagattataaaacttgaggatcaaagtgggaggagtaccataagagggtgtccctgatccgtacaataataacaaggtcaaatgtataaacaatagaaaactgtggggtttttgggtaaagacttatcacggttgggaacagagacaatcttttgaataaggtgaaaccaaaagactagggttttgtgtgacaaggaagaagacgaagacggcgatg

SEQ ID NO: 945 - DNA, 3000 bp, Unknown
  misc_feature (1)..( 3000): cDNA_ID_3059738_gDNA_ID_1620340_Annot_ID_153932 3000 nt of promoter + ATG
tagtcgggcactacacatgcatcggaacaaatgtatccagtatatggatcacaaagctttagaatgataggagctctgcatctggagtgacattttgcacagaaggggcgagaactatagctgttaagaaccacttcaactctaacattattgtagttgatgatgcgtcctggcatgagacgtgaaaagtctccaagcacacattcaatatgtgcagtaaccacacatttagagcaagtgtagaaccacttacttggatctgtttccgcctcgcaaatatcacaccaatattttccggttgcattttcgccatagcatagggaaagaggatgattgtcgcagctgtgctttaccgtttttggtaaatcagtacagtgtaaatccagatcaaagtcacaagtgtcacaggaaagcagataaccatctatctctttataacatgcatcacaacagtgatctttcttatgttcgtaatatagaggatgtctgtgaccatcatgaatgaccggttcagaacgcgaaccacaacgtacatctagaacccaccaatcagaaacgtacctgaaaccagtagacttcgttctacaagcatagcagcgaaagacatcgtagaatctaaaatctttgctatggaatgtacgaggtggtctggaccatagtgtgaatggttttgtgtggaatacatgtcgtttcttttttggatgattagcgcatttctcatggagaatgaaacgacattcctcacagttgtagatcggatcggaatagataggaaggacgcatgcttcacaacgtgagccttcgtcacgattgatattgtccttgttgagtcttagattatgttcttcatgactgaaatgcttgatcaagttatcacccaccactttgaacggcacaatatcttcgtcatcatcatctggtgtcccttcgagttctaccccatcccatacgtcttttcttgttgcacatagtgaatgagctgcatagttcgggcaacgagggcataaataagccccatggtattgacttatatctttgcgacaaataccgcatctcgagtacccaacaccgagatgatgggtgaaagagatgcgatgatcgtgacggttgatgtttatgacacgtggtaagtcaatacaagttctatggacaacaaacccgcattgaacacacatgtaaggacttcgatcaccttgcatcccacaagcattacattcaaatgagatgagtcttgataagaggacaagtcgatgctcgtgcgtcttatgatgctcgatagcaagtggtggtggatcttttgtacagaatcgacatacgctgaagttgcatatcgagcagcgataaagcactttgtctggtcgttctccacataaaagacatgtctcttcagcatcacttgttagtgattcatattcaagtaacttgagagaatgttgaggatgagaaggatgattcacctcttgggaaagattgacacactcgacatgaaagtggacttcacattcaagacatgcataagaacatccaccattatagcccttgcaaattccgcatctgcgcctacccggctttgcgggttctttcaagaagataactggatgatgatgagactttggatgttcgatagaaaccggcaatggatttatcccacaagtgagatccacgatgaagtcacattttgatgaacaacgataaccaaaagcgaaaaaagtcttgccacatagattacatttacatgggttccttagagaattgtggagtttaagagtgtgttgaggatgagaaggatggttgataatctccggtggagcctctgcgcactctttgtggaagaacaaactagtagaggaaggctcgttgcaacggtagccgccatagatgggaccttttatattgcaacctttacaagaatcattaacaaaacgagtcgaaatggtcaaaggatatttgtgagttggtagtattttgggtggtagatccattttgtgattcaaatgcggtttgttttctggagatctcaagataatactacatcatatgaatgcatctttgtaaccccaatataacaaagacacgtaatgtgtgaacaccttaacgattcttgtctccaatgaatcatgtgcaatcgatcctgttttccacgagatgattataatatatagttgaattatttcatattcctaactgtttacaacctgcacacattaaattatcttatcatcgttatagctacctatgaatataatagtatgaaaatacccaataaattaatttcctaaactcaacatctaacgtgttaacaacagctaagatatataattatattgaatcatttctgcaatttcatattctctatcgtgacactcggagtcttgagatcgctagatttctttgaatactatgattggtaaagtcgtgtgtaaaaaagttagaccgagacaaaacgaggcacaggaagaacaataacagttgggctttttccagataaggcttcaccttttaacaatcaaattctacatattgggcctacgaagaggttcataagatttgaatagacaattagaaaaacagcaattatgtgacaaatagtgttttattctaattttggatgactatcggtgaaattttaattttaatcatcatataacaaaacaaaattccaaaacttcaaattctaaaatcaaaatttttaaaataccatacaatttctttttttttaaacaattgtatgttttgtattgacaaaattagttttattgattagcaaaaaattcgtttaagaccttaaatttgtcctttgttaattgttataccaaattttagcgtaaagacaatctcttgaaggagaaaaggaaaacaatctctctttctgtgacctttcgcaacttgtcaaagcaccacgaccttctctctacggagttgagatcaatccccccaaatctcggtgtggttcctctagggtttttgatcggaatcggaatcgataatctaaccggcatg

SEQ ID NO: 946 - DNA, 3000 bp, Unknown
  misc_feature (1)..( 3000): cDNA_ID_3059734_gDNA_ID_1620340_Annot_ID_153935 3000 nt of promoter + ATG
actacaataatgttagagttgaagtggttcttaacagctatagttctcgccccttctgtgcaaaatgtcactccagatgcagagctcctatcattctaaagctttgtgatccatatactggatacatttgttccgatgcatgtgtagtgcccgactatcaatacagctaagacaactatgtagctgtttatttcactctattgtttctcgtaattttttggatgtaagagtttatttccaactacaagtgctaagcattctggttatattcatactgtgttcatcagtacaggcaggattaaactgtatcgatgacatatataaagtcgtaacaagttatgacaaacttgctaaaaaggtagtagcaactaatatgatttagttaatgaaaacatagacagaaatgatggaaacagatatttgtgaatcagaaatgttattaaacaaagatgaaaactgaagtaattttaacaacaaaaataacgaatatgtgatgtacattgcaaatgcaaaaattataaagacacagcggataaagttttggaaatacagagaacaaactcactcacgtgactaaatctaaaagacaaggcaagagttcaatgaacctctgtatcattttgattttgacatttacaagagttacataagcaaggaggaccatgacatgtaacttcaaactcacagtcattttcatgacaaaaccaaggcttcaaatcgaaatgatgcgactgagttgatttacaaaaacagtggtccgtttcagtataccttagataaggccgccagattttaagatctgcatgatggtaaagtgattcctccgcagaaagatgcgattattatgtacagcaagaaaactatcaagcatgtcaacaagaccctgccgaacacaaacaagaaaagcagttttgttgattaataaaagtgatctggaactcaagcatcaaaacaaaacaataatgaaatttctttaagcagaggtggaatcaaggcagtgtagttcctatcagccaaaaattagatattttgtcgaggagaatttcccaaaatcgaaaataatgttgaatcttagaactactgtatctctagtttaagaaacatatcaataaactatgctgcaaaggcgagttgaaacacctagaatgtagaagagcgtatctcttagttagcaaagaaaaggaatgaagagaatctagaagtgagagagatccttacaggagcttagcatttttcatccaaagagctcggcgaaggcgcttagattgcttcctgaagtgaaacgagctatcttgcattgttgctgttttatcaacaagaagctcaatcctatcacctctttccattatcttctcaatgttctctaccatgaccgatcgaatctgtaaacacgataacacaacaatgagataacaaacttcatctttcacccaagacagatttaaagaagcctgtgtgagccaagaaggcgtaataactcataaaaattcaaccttttcaatggatatagctgagtaatatctagagatcatacgaagaaacaattatacctcactgacttctcctctaacacgattgagagtatcaacactaggattactagagaagaactccatctgctgatgcaaaacccttgagaattcatcattcattgcataagctggagcattatgagccactttgccatagtttttcatgaatctcatatgaatctcttccaaatacgaaaatggaaccctccctgaaaatccaatcaccaacacatcaaaacataaaactcagaatcaattacaaagactaaatcttcttaagagagattacgattcggagaaagtgaaaaatacttacttccaaaggtatcattggccatacagagaaaggtaagaccatcagatctaagaatatggaagatataacgatcttgagagaaacaaagtctttcatcggagatttccggtgaaagcttctcgaggatccgtcgcaccacggcgcctgtgtttcccgtaacggcgctgaattcagctaataccacggtacctctcgctacaacagcatagacaatcgccatcggagaatcttcaattagagtgattcgatgacagagagtggagatcacgcgctccggcggcgagaaagttcaacgtcggctttgctgcgatcagaacagagtataaaaatgcgaagttataaggttaggtgcaaacgtttcgaatataaccccttgttttattgttacgtttttaattgtcacctaaaatattattttgttacattttaaaccctgatgcatcggtttacggtttaccaatttattaggccttggtaacttatccgaaaacaaaccgacccgaaattcacttttcggtttgggttcggatactccaataataacttgatcgtttccttctttttaatttcgattatccggttcggttcgagtatagcacgaataaaccgaattaaaattaaagccctaatttaaatataccgatcgagtcttcggcgagcttacttcgccttgaatcgagtcttcgacgagtctccggctgcgagtttctcttgctccggcaaacagacctgtcattgcttctctctccggctaactacacaggcgagcttctctatttattttcttctgtgtctccagttgcttctgatataatgaatatgctcttgaagcaaattgtttctctgcttctctttctccagtgaattgtttgttgtattataaacgaggtttaggaattgggttaataatattggaggattgtgtttgtattctgtgtccgacgaacaaatgacatttccgatttctattgtgctacgagctcagtgtttagaagggttttgatgttctctattgaatattcatgttatgttagtttgatgattagatgattttgctttgcaattactgtgtttttttgtctgactggctctgatattatacaacgtgtttgactccgattggtatcaatcttcttcttcgtcttcagaagc

SEQ ID NO: 947 - DNA, 3000 bp, Unknown
  misc_feature (1)..( 3000): cDNA_ID_3059725_gDNA_ID_1620340_Annot_ID_153941 3000 nt of promoter + ATG
tctttcatgcgtcataccaacaatggacagtcttacctctaacactcgtaactataacgaacggctatacttgcatcactctgtcattttcgattagccttataccattaatctgagagaaatggtgatctatgagcatcattaatagtgatctattgattgtgactgcctctgcatctagagcagaattgacaatcctaacttcggctgcaaaagcaaatatgacaaagcaccaatcctaacttcccattcaaggaggtcattaaatgtattaaattaggtttccttgactctagtcgattaaaacattgtagtacatccacatgtgaatctataaatagagattgatgcaaaaaggaggtcattttgtagtcgaactgttgaagcaccagaactgtgagactcagtgatagtacaacccaaattaacaaaggcagataaacaaaaaaaaagttaacacaataacaataaacaaaaaaacttagatgccataacaatataaaatacttaacaacccaaataaaaaaataatgacatatgaataaaaaaaatgtgaacacaataacattaaacaaaacaaaaaatatagcgcgtaactttattcaactgtttatacgcataatggattgttgcaagtagaacgacatgatcttcttatctccccgtctttgggcttactaataactctcaccgatcccaaattcaccattgcctgaccaaacctaaccaagaaatcgttaccgttggctatatccgtcaccatcttacttgtcaaatcgtcgatggcaagtttttgatcgatatgaaggactccacggctaacttttatctctttgtagaaagatacatccatagtattcgagctagtagcattttgatccagactaatgatgccatcggttgatgaactcttagggcatttggcgcttagttcttcgaccaatttaggatccatagatggatcaggcttttgcgtgttttgaaagttatataatctgtccataatgaaggaacaatgtgtcactccaatcgtatgtccacctatacatttataaagttaaacgcaaaacaaatgtcactataaatttagaaaaccaaaagatttagtagttgtttttactagtcattttagaaactaaattcaaattcggtagggtgatgtttgacttgtaaacaacaaaaaatatatgatttgaatttaatatgtttacttcacataccaagaagtagaaccatatcgttaaggctaagtttcctctgatcaaatttagcagcagtttccgcgacggtcatctttggagacggcaaatcgacaagcaaagccgaagagattttaccgtccaatcgtcctgttggtatctcatatcgtgttttccctccgcttgccttcaaacaaaaatgtaaattatatttttgaagttgattaggaaaacatattatgtaaaataaaaggttgtagataaaagagaggtgtttacaagagtaacaagatctctagtcgcgagagctatgatatcagcacaagaaacgaccctgtcacattctttttcgaccgcagacttaatgtcatctatcacttcgtatccgcgtacacttagatttggtgacgcctttttctcactgttcgaaccatctagaagaagcgatgcatcacacccctacatacatttttgatacaacaaattaaagatcaatatttatttcttttgagactctctaggatattctagagaaatttgtagtataatgaagtatcaaccaacttacgttgctaaaacaatcgtgaaaataaaggcggatcattgcgggtgcaatcgatgaatccttgatgaatgcctctccaacaactttagatacgatgttttcgacgttttggcaattttgactgtagaatccgagtcgaagctggccataacaaccatggccgaagctaagtagagcaagggagaggatcaatacttcaatggtcgagatcttcacggccatttttagttgaaatttctatatgaattctagtatgtggggaactgtagaaaaattgttaacaacttttatagtgttcaagtttgttaccaaatgtgtggcaagcacgattctctaacgtgcgttcatggatatagtatttgattctagctcactcatgcgatcacattatgattttctaatgtcgggctggttctattttataataaaattggcaatccgaatgcaaataataagatacgtttttctaatgttttcttcaattcttttttttttctcccataggaagagtatatatcacataattttttgtaagcaaatcacttgtatgcataacacgagtttatctttaaaacgcaataaaatccttgatctttgttttagtaaattcagcaaaatgcttcttaactactggctcaacatagggattatgtactatagagcaagcgtttgaatggtatattttgtgaaaacgtggatactactaatctaagaacataacatggtttcacattttagaaaacgtgcaaaaatcataaagtatactgattttcccccaaacgaaatccacatttataagtgataaggacttgtaaacattaatatatcaatgtttatccttttatatcaatacttaatgttaactaatttaattgtaaaacctccaatagtttaactaaaatcaatcataaatatgtaacaatcagtagtattctcttttttttttgtgttaccaaaacttatcttattcaactatttttatatggtttaaccactttttatggtcaatgtttagtcatttatttaaatttaattagtagtaacaaaactctgtttttttgttcattagtggcaaccgaattcatctaattagggttttgaatcaacaatctaatcttcgatcttgagctctatttccgggtttatacatttccttcaattcaaaaccttttctttcattgacaaatgatttgaaccaaaaaagttgtttcctttgccaaaatctgaagcgccatg

SEQ ID NO: 948 - DNA, 3000 bp, Unknown
  misc_feature (1)..( 3000): cDNA_ID_1450208_gDNA_ID_1620340_Annot_ID_153930 3000 nt of promoter + ATG
aggcaaagagaagagtcgatagaatgtctctgatctttttcttggttgtttatggttctacttgtaaaggatctctagcttgtagagaggaacaggaactaggctttttaacaagctacaagctacgatcctttattgtagatccataaacaaccaaatttctcgtactctcgaagctgcctctgctgcctctgatcttacttttgataaaatattaaagaaagaagcaaaatccaatatagtttattgtaaactcattcaagtcatgcatataaacattgtattattgttttcgttagaaaagtaacccagaatgttttaaaaaatagaagaggttgctttgcttttgaaaaaaagccgaaaaacgccgttttgatctataactcactatatcctcggtcttagcggatgagtctagcttctgttcctgttcctctctcaaaatatgtaccgaacaattcacaattctgtggtttcctggtctatctcggaaggccgcttgtgaactttgcagttagtagtcatctgggaagatgaactgaagatcttggttgtctctgtacacttgaacgagagttgcagctttgtatacaaacaaaccaaccattgctggaactatctgcaaagcacaatcgttgtggagaatataaaggttcaaacttgtctaagaacatgtgataactttgaggtatcacggataaacatagctaaaacctcgcaacgtggaatagcttacctgaaagtcgaacaagtcgttctggaaatacttgtgagagagtatccacaaaccataaattgcagctggtatcaccaagcgtggagaagagagagccatgccactgcccctgattgtcctcactacaaagtcctcaaggtcttcacttctgatcccgattctgaattgggacaatacaaaagcaagttcagagcaatgtgagtatgggaagtgagaagaaaacgtgaccagactaaaaagttgtcaaggtctttactttttagacttttttttcaggaagatatcaggaacagcttcacgtgatagaccatcagcgtatccatacaaaagctgaaggtacaagcaactgcactatgatcagatttggttaggaatacgcgagtgctcgatcaagcatgttgcagaactatatcttacaacgtcaaggtctatttatgtacaaaccaattaaaatagacaactaacctgaatagaaccccaactgcataactgactgcagcctgtcatatgtcagaatatttctttcagacacattttcgtatagagaagccatagtataaactggttagagctttgacagagcttacctgaactgataaagctagtaaacagtatccgctgcatccagttccaattacaatcgacaggtacatgagttcacgcttcagctacaaaaataaagacacaaacgcagcaatttcaaagttcattctacacaaattgactactggtacatactgaacagccattttgcataatagagtgttttgttgaatcataaagatctgactggcagactaattaagaaaacatactgaaaggaataatcatacagcttcatatttcagaaagttaaacttcttccttctctcgctgtcatctcgtagtgcctgcaatcaaggaagtaggacaaacgcagcagagttttgcaatgagaaggacgtgtgaatgaatgaatacagagaacaagaacattcataaatagatgaccaaccttagctagagctttcttattcatgggggcagaatcactctcccaaccaatccattcttgtgtcggtttaagtttcaagaaaccactttcatcatcatcagcgccatctatcaagctttcctgcatatacaacataaagacattaataaaggagctataccaagttaccaaccaaagtaacagtaccaagtataagattgttgccatgaaagctataaatttgtgagatttcagaaattcacaaaccaatactggatttcataaaaatgtagtcactcacataacaattgcaacaggatcatataactatcaaactattcctcgatacaaagttagcaattttaatcgtcaaaagcaaacttagaactgaagaaaaaaaactagctacagttactaatgaacaagtgaaagaaacttaacccgagtatcatctagttcaacagctgaagaagaagctccattggaattaacatcaatagattcgagaatctcctttaaccagagcctatcagaaactttagatatgaaatctccattttcttctctgtctttcatgaacatttgcaacacatcctcctccactagctcactcactaaaaacaaagcaaaagacatgaaattttccacaaagagcgaacatttgagtagtaaggttcaatgtagagagagagattgtcaccagagcgagaagcggcattaatggcggccaagcgatgggaattcctgttgggaggtcgccggagatgatgcggcggagaaactctcaccttcgtcggaggaatggttccgccggaaaaccaagaagcggcgggaatcgagagactctccatgtagcgagagagtgagacggcctctggtttttttccagaagaagaagcttatcactattgttgatgaagagaaagaaagtttccaaaaagaagacccttttattattcatatattataatttcaccccttaatttacatttatgactattgagtcctgtctttttgtttcgcccttttctctaattgttttcgttttctttctatttctgagtttaggaagtgtggggtgattttgtaaataaaggataatataaaggcccattgttgcaacaacatgtttaacatataaactttgttaggaagaggttttggcaatttggagtcagagggaggcgttgcaaactcaataaagctcaaaactttccgccgtcgttttcgtcgtcggagaatacaacaaaagacctaaagcagatcaaagtaattgtagttgacggagatg

SEQ ID NO: 949 - DNA, 3000 bp, Unknown
  misc_feature (1)..( 3000): cDNA_ID_3059746_gDNA_ID_1620340_Annot_ID_153925 3000 nt of promoter + ATG
caaatgcaacgttcaagagctgtaggcatgagtttgcggtgcttacctaagaacagaccttgtgaatcgaagaaaagaacggtgcagtatagcgtgtagccttccctctctatcacacccataaccaagtatactttgtacttcttggccattaacgctaatcgttccacttcagggcctaacacaagatggcacagatgaataagtagaatgtaatttacagtttacacacacttggtgattcaagaaacactataactagtagagactgaaacactcaattgttagtagatgatcacactaacaattgttgggtttattggctatgagattgacccatgtgaaagcccaagtcactgggcctttcataagttaagcccatgtgactgttgctgaaatgatcttatctacaacttcttactcttggagcatctgtgcctcccttgaatgaagcttgttgtggagtcacgggtggagcaaccaagctacgtctcttgatgaactggtcagatcttggtgatgctacaagctctcatgtaagaaggaagaggcatctccctcaaagcaacaagaaccaccttgataccaaaaaaaaacaagaaccaccttggttgtttgttgcagtttctgttacagtgtcgtagtagaacagaagctgttttaaagacggctttggtgagaatttattagatcttaagtgtgataagctaggagatacgtgtggtagctgaaaaggaggttatgagacacgtgaataagcaaagagaagcatagaagtcatgtgaaaaggagttaaaacagagcaagaagaaacagattttgtaacctcttgtcaagagaattgatgaagttatgcatgtattgatgtgtttttaacaaacgtatggttttatggaggagagttaggagatctcttgaaaaaatctccattgttagggtagttcttgagtttgtatcttggaatgagaagtgataaaagataagagttcatagcttcaaacttatcaaatggtgcagtgaacgtgaatcgaacacgcgacctaagtgaatataaaagagggttgcctagttgttctatgttggtagctagttagagaacaatggatttatgtggtaataagtgcgtgccctggtattcatgctaagatccaaaatcgaaagaaaaaaagtgagaacataatcggagatatggtggaggactttattaccaggaacatcaatggcagaagcatggtacttgcgaaagtcatctcgtcctttagcggtacgagaaccaatagccaattcaaaggtagagccacgtggatatccaccgatgaaagcctccgggaacaccactagctgagatccattctccgctgcctcagaaagcagtctctctgccttatctgacaaaatttcgtggataaggcatcgaaagcgatctcaccaaccatagtgaatcaaaaatcgagaaaacaggaacgaacctagcgtggcgggagtatcgtagaagactgtagaggcttggacgactgtagctcgtacgatggaggaggaatcgccggcggacatgtcaatctcagggaagatttgatggccgttggtctgtggagccgccgtcatgtgagacgtttcttgttgcatggacatgagagaatcagagaaagagagagattccttttttttttgtcaaagaagaaagattccaattgtgttgtatcttgtttacttggttggtgtgtgtttaactttgatattatcgtgtattttataaactctctctttttgtgtgtcgattcttttttagtgaagggaaaaatgggtttaaaaaatcctcattttctctaaaaacatttacaataaccatcacctatattggtatttatatgcatgcatattgtacgatggaggaagaatcgcaagtgtatacgtcaaccacgggaaagatttgatcgatgttgaccggaggagccgccgtgactagagacatttattggtgactggtcagtttgtcaccaataagatatatagaggaaatgagtgattctagtagtagtatcttcttgatgggcttggttggtaggtgtttacttgtacaacacatgatatatattttgatttttactctctttttaactgtagggggaaatgccaaaatgtgtaaaaaaatcctcatttttttctaaaatcatcacctatatttatagattttttacaaaattcaaaagataaaataccccctcgataacaaaccaaccttaaaaaccaaacaaagcgtttgtttatatattttggttgttacttgttagcattcaatattaattattgtttacttttcgaaggtatgaggattagaagattagatgtttatctcttttcttagttttagacttgatctatatccttggatggtgttataaaaggtatcgaactctttcacgtatcattagcttttgactaaaatattgttgaagagttctattttttagttcaaaggcctatgaaaggaggatttttaattctaaagagttttggtatgaaaaaactcttaaatcatattatcgttatcgatcattgttgatcttgacaaaatataaatttgttgctgaaataatttggagaatttcttgttatgattgtttatagtttccgttcatcatcaactttaaacttttaattgtacgagaaactttcaaagtaatttttggattcacatcaccaaaaaaattaacagaacagagttaaccacgttaatatcactttagtttttttacaaataatgatttgagtataatttgatcgtaatttgtaaccccatttcatcatggaaacaacaataaagttcactcatacatttcgttttccctgtcgtaccttgacacagaaacatagtccacagattttactactaatactatttcgaagacgtacgaggttttacggagggagatttgcgaaaattcacctttcttgtttagcttttttgaacatgagtttttgattaaacttaactatatg

SEQ ID NO: 950 - DNA, 3000 bp, Unknown
  misc_feature (1)..( 3000): cDNA_ID_2130308_gDNA_ID_1620341_Annot_ID_153968 3000 nt of promoter + ATG
tcttgttttatgtacttcaacaacattgtgataggcttatgattaaaatttggattgacatcaactgaacaagatttgaaaagtattcgtatgaaaaaataaaaagataacaaaaattatatgtcatttaagtcaatatttttttatcttctgtcattacatatatcaatattagagaaatgatcatgtcttaaatgatttgaaaattgtctaacttgattataaataaactatttctggtttgatgtattcacctgatataatattccaacaacagtgttatcgactcatgattaaatatatagaattgatataaactgaataagatttcaaaagtattcatatgaaaagaataaaaaaaaaaagcaaaaattaaagcagcatttaagtcaatacttttagatcttctctcattgcatctatccatataagagaaatgatcgtgtattaaattatttgataggtctaatgttttaaatgtttattatttgaaaaaacttgaatgtcaatgttatcaaagactcaaaataaaattactaaactaataagaggttaggtaacgaacaagtacaacaaaaaaaatagtaaaataaaaagagtataataaaagtagtgcttaatttattaaaattaattttttattttatttttattttgaagaaaacaattaagagtaggattgatgatatatttaatttgcttatttaatttgattaatattttaatttaaaaaatatagaatgacacatgtcattttcttgtgtgatgatgtgtcatttatttggagagagttggccaactttcatatatatgatttataatctccaaaaacaatgctgtcaataaatcaactgtcagaatctaccaaatttatccaacggtcagaaactcagaatctagtcattacattgcctctgccattgaaagtaaatattgtccgttggattcttcatttttacacattgcaaactagggatatcaataatcagccattgtgccaattatgttgagattattgtaactaggtaacgactaacgagtgacaatgaatggcatatagacaaatttattctttattaaactgttatctgaaaattaaaaaatgatttcttccttaacttttaggtaaccgttgtttaacatatccaaattttaagtttttataattattttactatcagtttatatatgttattcattcacacaaataaagatatttgaaaataagcatttaataaataacatgatatatatcacccaaaggatggaacaaaaaaaaatagaaatttgacactattgaattagcattaagttacaccattacctcttacttattattatttattttttctcttacttaatttcaatcctaagtaacaattttgtacataggtggattgtctaaatattcttgtcgtgtaaattattgattatatttttgaaaactaaaacacacgatagagctgaccagagaccaatcaccagttagacatgccaaacatgctcagacattattaattaacggaatgattaaaaacacagctcgttagcaacgagagacattcattatagagttgaaaagaagaaagaaaaacgacatagacatataatggaatcgatggagacagagagtggtatggtcagtgcctcagtggtcactagtcaaaggaaaatcgtttcctctgtctaaccaaaaaacaaaatgtatttcaattttcttaaccaatttccagttttttttttttgtattatatcaatccagttaactgattttatgtttgattcatttctcactgatatctaaacttattgattttcgtgcacattttcaaatttgaaattttggatgtaagtatgtacagttaaaaaaagttatgtacaacattttagtaaagaacagtgtttttttttgtcagatagtacataaggagttattacacgattttttaataaccacgttttgtgtgaacattttccccaatacatttggtttcatattcatatccaacttactaatataaaattagtactaatctttctgttgacgaaaaaggttaattattttggaattttaaaggtcgattaaaactactccaccatcaagccatctccaattttaaaaagtaatgtcaattacatttcccaattaatttttgtggcttataaagtcttgacatctctttgctctttggacccgccttaatgtttttttgttcatgtaagatctttttctctctttcctctttccatgtttatgttttctattatttagttggcttttggtattttgttggtttctgggtttaagccatttttttcccaccgcctctgcagctctgcttttttagctgctattttttttttttgcttttggtatgtataatcggatttcttctttatcatttatcaaatgtttgaattcttccatctctcataattcttaagtggtcgtggtgtgtactatctcctaagctctctgttttttttttgtttgttcattggctatatttcaggtcttcttcttcttcttcaagaatgagctaatactcacagaagaagaagatttttctttggatttttcactactggtaagctcggttcctccctcttttgactgtaatttttaaattcggttttttttttggtgtttttctgaagaagttctgattattttatttgtgaagtttggatctttcttacagatttagtaggattaaagaatgttgttgtctgtagttaatcttcctctgtaaatctatatgctttgttacaaatctatgcttcaggaatctagggtttatattccactttgtttactttaataaaatatagtttcttaaaccctttttgtctgatgaatcaaaatctaattactttatttgaatcaagctaaaataaattggtactttaacatccccacagtgttcttctataatcttgattttttggaaattttccagaggcattgttgtgaaattggatggtagtagcattggaatg

SEQ ID NO: 951 - DNA, 3000 bp, Unknown
  misc_feature (1)..( 3000): cDNA_ID_2130333_gDNA_ID_1620341_Annot_ID_153977 3000 nt of promoter + ATG
ctgtccggtaaactttggttttaaaatatgtgacaactttgttttggaatggtttgaatcagcttggttcgttattccaaccctcacaaagttagcactaaataagaatggttttaatcaagtcctctaagccacagtggacccataagaatattactaattagaggctcctaagggacggataatgatatggacggactttattcaatttggttccaccaccttcttttattttgataatgtggttccaccaacttacatcgtcgtgttttttttttgtttcccctctaccatattcaatgatttctttttgtattaatgactatagtttgtgaattttattttattttatagcatatatctttttgtcaataaaatagcattttgcaaatgatttttaaataaaagtagtttgtgaagattgaatatataaatacaaacttcgatcactcatatgattattccaaaaataaatgtgaattaatgtatgtacattcattgcatgtagagaaatgatataatgcgcctacaataatgtcccaattgtagaagaagaagtatccaagtcgaaagagactagaagccaactctgacccgttaaacaagtttctaatttattcgtatctgccctttgcattttcataatgtataacatcacacctctaattttctcatgattgaatttttttaaaaaaacactcctaactatgtatctttttctaattcacagtaaaatatctaaggtggtgtgtgtgtgtgaattactaaacgtgttaaccaacaaataaatctagacttatgaagtattacacattactaacctctaattcatgcatagcacaaaattctctaaagagaaacacgtaggttttagtaaaaacattaagtagatttcaataggtagattaagagatataatactatgatctagtataaaaaaaaattaatgcattttgagagtaagcaaaacagaagttgatcaagactcaagatgctagagatggtactttacccgaaggtggagagttgcgcaaggaagaaaggatactccttgagtggaactaacgcgagcttatacatcactctgtttccgacgccaaacgccgccgtaaccgccgcccatatcactatctccgccgtcttaacatgctctccgtcgatcacatggacagtactactactgctcccttcgatctcgttatcgccgatcgcgtaaccatacgcgcctggcttcttaatctccgcctcagctccgtcgtcaaatccatcccaggatctcgccgcttggataatccaccgcctggaacttggaacgatcaacggtagacgatgatcgatgtggtttcgacggattagggagatggattgaggtcggtttgcggaatgggatttgaccgaggtgatcgaggcgaataaaccggtggtaaaccggcgagaagtcgttgccatggtggattaaggatcgagtgagactggttctgctggttttgagggggagagagacggaagtgagttgctgacttggactttgcctttttatctctctcttttgtttttaaaaacaatttgcattaacacacgctgcccaacttgttttgcaaaatacgacaaatgtttttttttcttttggtaaatcatcgaaaagacaattttaacccttatcaggaaatttcagaaaaagtgattataccttaaattagcccgttatcggtattttagacattcctacttttaatagaaaacataaccaataagtaatgatttaatttgtgctagtgttgtttacacatcactttctacaattatgttgttgaaaatgtaaataaaaatagatatataagtagattaatctctatgtaatgtggtagtagttcctttattgaatatattcgttttttttatgaggggaagatacttcaactataattttagaatttattattaatctttgaaatggtatatttgatcaaccatatctagtgtatatttacgttaatacaaggtgtagggtgtagtgatgtttttaggctcttttgttatgtgaactcttatgtacactacatctaacttgtgatgcatggttgaaaaaaacgtaaacatttatactaaaaaactgttggacgatacgatagtgaccaagttaagtagttagccatgcgcagaatttaggattttggcttgctaagttcatgttcatgtgatgttttatggtgattgatgaggaatggctcaaagttgtgtgttgacaagttatgataaaatatctgaaatacttattatatgtgtttatatatataggatcacataatacaacattatatacatactgcattcttatatgaatatttgaacttaacatctagcttttcgaattaaaccaattttgatgaacttttggaacaaattcttttaaagaaaaaacatatacgaaaaccgaagtgagctctaatatcgatacaatttgaaccgaattgaaccaaaaagttcaaaacttatttccctttttttgttttgtttcttttcaaatacgatttcaatccaaaatcaaaatcataccagaccgaataaccctaaatggaaaccaaaccaacacgggaccgaaattagtaccatcaccgctagatgcgaaaagtataataataatgtgaaagtatgacaaaaaaaggggaaaagacatgtctttgtcgtggcgtcttttgattggcccaatgcatagaactagactacacgttgctgtgcctgaactttcccttccctgccttcccctccttcactcatcttctcttgtagctgtgcagtaggtcagactcttgtagtgaattcactgcaaagtaagggaaagcttggcttggaaatgggagttgaacaagccatcgattcgggctaatgtgtatagtttgattcgtctggggagcttttgagagatagcaatttagttttccgcttacgaatgatctttttctgatgcgtcattttgattaagtgtgtacttctgcaatg

SEQ ID NO: 952 - DNA, 3000 bp, Unknown
  misc_feature (1)..( 3000): cDNA_ID_3059821_gDNA_ID_1620341_Annot_ID_153980 3000 nt of promoter + ATG
tctctctttcttgcttcaaggagcaggtacagtattgaaggtccgttactcacctatttacaaacctttgaattttggtgacattattctccttaatctcaaattcctttttcttataggaagtcatctttatagatagccaaagacgattaaaggtacattacaatccccaacaccacattatcagaagtttttatatgtttgtttgaaagactcaaaaatcatctactttttactaccacagggtgcttcactcgatctatttatagtaaattcatatggttcagctttccaagtaagtgtttcaccctaaaaatttctctgtaaactatgacttgcattccaagccaagtaatcttgtctctggtggttttgtttccttaccaattaggccatctgcattgcgttgcttcttccatttctttcaaaactttggggcataccgtttaaccaactcggtacctacctaaaagatggtgcggtttgttttctcaacaatgggacaataacaaaaggatgtgatggggctccgtttttgcctctgttgtttgtgataatgaacattggctataacattgctcttttaagactcctcaagatttcatccgcggtggtttcatgtcttgcatcaacagtctcagtgccaattgcagtgtttctgttcacaatgccattaccgtaccttggagttgcatcatcactaccaaaagggttcatgggaggaacaatcatacttgtattgggaatgattctttatagttggacaccacacggagctaactcttctcatactgattcagtcattccttcacctcctccaacatagagagggcttaactaaggggttttgcttttatataaagatttgagagatttatgcaaattcggtttgtgtttaaataaacttatatttgatcatatgatgttaatggaaaagttgacattttgtgtgtgttgcgttcacattagtattctagttcattagtcaacggctaacataatcttgtcttcaagagttgttaccctttaaacatatcactacaaatcgtgtgctaaaccatttaaaagacaaatcaaaacaaaataagaagaaaatagcctgcaacaatcaaagttacttcatcaaaattgttaaatagtaaaagactaagcaaatcctacaaaccactgagttttcttaaaccatttgattctacttgtggcaaggtctcgaagacaccacaagttgaaggaagactaataatatttagctaataaaggtcatctttaactaaacagattgaatcactattgattccgttaccaaattcttctaccggtgcttttagtgtaacccccagaccaaatatcatcatctccaatagaatctactctttcccatttgttactctcaactctcaagattcatcttaaagatgtaaaacaaatgtttctcttcaactagcttttctaataaactcaagatgatcaaaacctcttctgttttctgaatcactattctcctcttccaaatgtactcccactcttttgaaacgtactcaaacggatgatcccaatatggggtttcttcgacttcttctttgggaaaatctccagagaaatcgacaatcttgatgtgatcatcagaagtatacagataaagcttgctgttcttataagccagatcccaaaaacccaaatttgcgcctcttgtataccaattcaaccaacaatcatctcctttcttgtgtgtgaacaactcaagcttattgaaaattcaagcaacgacataatctcctgttctttcgtttatccacagaacagctgctctttcgcttccgaagatatctttcgacacacgttccttatgataagactcaacgaaataacctcactcatcaccaccgcttcgtttgaatctcacttgtccaccgcgtattgacgtctccattgatggaagattgattctttcgcccggtaacatgttaaagatagaaaagtcgagataagaatctaccatcaatagacagtttccgaagctagccatatatataatagctcttgtcagagattccaaagagtttcgcgttgtaaatcttgtcttctccgggatcgaacaacatcgaagattcattatggtaatatgaattgccatggatacagaggccgcttcacgcatgttttccaaacggagaaccactctaagcaaacgttttttatacggtgaaaatctatagtgctcaagctttcgattatcggacgtaaaagattggaccaatcttgattttcagacattttattcactcatcaaatgtctgcgcttacatcacactaatgggagctatagggttagggttttagggtttacaaccaaccctgtacatttccctttttgatgttctgcttttcactttgataattaactgtattttatattttactttcttcctaaatacaataaatttcttaacacattcaaaatcccatgaattagaaaattggttttcacatgtttcagattgatgaatgaaaattctcatacacctgattacgtagtttcttatgagatacatttataatcatatttatataagatttaggcaaaggttctaatcttgatttttatgagtagttgtggaatatagaagataagaagagacagttatgtaacaaaaattaaaatcccagaaattcctctcaacctttgtcttaaatccctaaatgttgtttttactttaaataccaaaattacagacacgttttggtcctaaactttctccctatcaacaaaccctataatcctttgaaccgaataccaacgaagaaaaaaaaacattctattcatagccattcacaaccaaaacacctaacgttttcttgctaaagaagaaacaaaaaccagaggaagaaaagcaaaaaaagtaagagaagaaaaacacaaaaaaaaataaaacctttctatttctcttcctcctttgagctttgacctctcctccatctcccccacccttttatgcaaca

SEQ ID NO: 953 - DNA, 3000 bp, Unknown
  misc_feature (1)..( 3000): cDNA_ID_2130357_gDNA_ID_1620341_Annot_ID_153985 3000 nt of promoter + ATG
tcctccaatcgtgatttctcttctggatccaagctgatgagctctacgtcttcctcccaggtcatcactcttctctttttatgattgtgaacttgttttcgatggttttgatcgatttctggttcagttttttttttatccttcttaaaggattttatactatagatgggtcgatcaagtgttattgatatgccattgaagtgaactaagcttgaaatgagccaagttaagtcttttatggggattcttacgaagttactgaatctgatgtgaatattttgtggcagatggttcagctcgtagctgacaagcatgtacgttacattctgatggcagaaaaggtacctagaaactgtatagaacctttgctcgttttctctgtttatgtcactgtgattgtatagcttatgttcttcttttcaattgctttttgaattttatttaatttgctagaagaaagagagttttgagtctgtggtgatggatcatctaagaatgaatggtgcatactggggactcaccactctcgacttacttgacaagctcggctgtgtttctgaagaggaagtcatttcatggctcatgacttgccagcatgaatctggtgagtacttgagtatcagatcagctctttttttacttactgatagaatgatgtaaaaaaagggatacatgggctaggcagtgaaagcaggtgtctttgacaattatgagaaaataatcattggctgtgattgctatataagaactagcaataagatctatggggacctttaaagttgctgggtggtttcatattttggttcgtattcataagatgtcgccacagtcgaagttgaaaacaagttgttcttttctgagcaggtggctttgccggtaacactggacacgatccacatatcctatatacactcagtgctgtacaaatcttggccctatttgacaaaatcaacattcttgacattgggaaagtgtcaagttgtatccttttgcacttagctttttgtcaatgtcactaactcgttcttcttcacaaatagtcatggtggaactttcatatgttaattaatcaatgatgttaaacaagaaggaaaaaccctgccttatagtagatattattatgttttcctatatacaatattagatgttgctaagttgcagaatgaagatggatccttctcaggagatatgtggggagaaatagatacgaggtgtttttccttgccatgtattacaaagacatttatatatttcctgttggtgatttcactatgttgaatcttaacagcaagctgtttatgcaggttttcgtacatagctatttgctgtctctcaatattgaaatgtcttgacaaaatcaatgtggagaaggccgttaagtacattgtgagctgcaaaaacctggatggtggttttgggtgcacacctggagcagagtcccatgcaggacaaagtatgttatgctatttgagtatttttctgtgccatcttcccaattgttacttgcaattagtgttataggtgactttacagaattaacaaggccaaccgcatcactgccgtttaactattccaatgactagatactcagatgtttatttttctgtagtcgacgtgctattgatacatctttatgtaaattgtataggacagtttcatggttgggagatatggtaaaaagacggtattctttatttgtttcttctgttactgcagttttctgctgcgttggtgctcttgctatcactgggagtctccatcatgttgataaggactcacttggttggtggttatgtgaaagacaattaaaggctgggggcttaaatggacgtcctgagaaactcgctgatgtaggcattaagctcatctccaatgagagagacctttgtatgatttccttggttcttacacattttttactgttcttatttccaggtttgctattcttggtgggtcctatcgagcctaatcatgatagatagagttcactggatcgacaaagcaaagcttgtcaagttcattctggactgtcaggttcgtctccaacaagaaaattcatatcgttactaataagccagttttgattgaaagctctcatctcatctatctaaatttgaatttgaataggatttggacaacggaggcatctcagaccgacccgaggatgctgttgatatcttccacacctactttggagttgcgggtaactttcatttgtctcttcttttagctcatctcttgctgtgaagccaaaagtggtcttatttcatcaaattggtgcagggctttccctccttgagtatcctggagtcaaagtaattgatccagcctatgctttgcctgttgatgtcgtcaaccggattatattcaccaaatgactgcaatgggtatatgatcttaatggtcaaacaatatggccgcaaggctctctatatgatttgttcattgaataatttacttggcggttttagaagttatgtatgctcaaggaggaggagattgcaatttgggtatgggaacagtctcaaatctcaatgttgtataacttgctacattattgaggtttctgatgtaatggaaacgaagttgtgttgctgctacattatataaatcacattaatgtgttttttctccacacttttcattctgatttacttcttgaaaaaagtgaactaatgtgtttaggagtgctcaatacttatagaccgaaccaatttaattaacaaattgaacaatttagagaaattgcaaagattatagtacacaaatcataattacaaataaattttatttccattgcagtaaactaaaaattaaaactcttgtatcgaattttgcaaatatatttccttttaaattttttaccttggggtttaaaaaaaaagagtaaaagaaaatcaggatgtctaaaccctagtacgccattagagagggttcagctcaagtgctctgtttttgtttgtttggtaaaaccctaaaagctttcgagccgactcttca

SEQ ID NO: 954 - DNA, 3000 bp, Unknown
  misc_feature (1)..( 3000): cDNA_ID_2990975_gDNA_ID_1620341_Annot_ID_153989 3000 nt of promoter + ATG
ggatataaacaaaaaccaatgatacgaacagatgcataaatctcattaacagtgatgaacaatatatatattctaatgggtcaagtcccacgaatgctcctctataatctctttgtgaaaaatcaacacacaagcaatttttaaaacaaagcattttaatctaacatatgaaaagtaaatatccaacaaaatatttgaaaataaaacatcaagttcttcatggatggttccctattcatgtaactttacttacaaataccatagttattgtgtttatgcgtgtgattttcattttgatgaaaataactaagaatagtatactatattttggagatatgttataattttgaaaaaatcacaaattaaagtttataattatattcaaggagattttacaagattatagaaagactttacaaaattttagaaaaacaaatcataaaaattatacaaaactctctagtaatcatttaaaatcttttaatttatctattttttatatattttaaaagtcattaaaactttttcacaatcacaaaccaataaattaatgaattacaattttgatcatagcaaaagaaaatgatagacttcactacttcagctaattgattacgttgttgctcttgttgaattctcaagagctgcattgaccaatcacttcgtttgctttgaacaataatcttcaaagagagatgtgtttctatttcatagagtttcatcatcaaagagcactcaactaatctcttttggacatcgctcatcctcggttaaccataacaaaaagttatgaatattcacagacatagaaataccagaaaattcgtacagatcaagtgagaggatttatttgaaagagtcaagacttattgcatagaaacaaattataatattaatcacgtaaataatactactacttacaaaaagagtaaacttcacttgatatatacttatactacaagatattcaatttttgtatttacaagaacttgtgggaaaaaaataaattaagaagatattataacgacattaactctgacaaactttgtaggtagggattggaatttagcaaaaaactttgtaggtatgagaaactactggagcaagaaactacgagtagagaaagttagaatttaagtcaggtgagctgttggcatgtcacatgggacgcaatgtggatttcatgtgcattgttctttttatatatctctacatctcattctgtcgctatccgatttccgatccacaagctctacaagaccaacacattcttgtttttgtacccttctaatttctcatatttacagctatatgctgttcttagcgtaatttatttatcacgtcttgtttatgatctaaatgatggtgatataagggcgacattggttttgttattgatatcattagtagtgcttttggtttcgggttttcttttgcattgttatagaaagtagaaacgtaagcatgattaatgttccatggaaaatttagtactaagcgaaaccatcgaaacatcacttttttattgttatacaagcaacgacaaagttgagaaaacaatatttaagttatccgattattagtttagattttccgaatagcaaactgatatatttattgattgacagtagatcgacagatgtaagaacttatagaatattttaaagatttcaaagtagcaatttagcatcagtagttaaatctaaacgagagtatccaatgcgtgtgttttacattatcgtcctaactacggtaatatgcatcaacttttttcttcaactctctcgtatagatctgatggaccaaaaaacaatttctgcatatatttcatataaactgattgctatgacatgcatgcaaaagaaagatttaatatatattttacgaaagtaactaaacttaactaactagttaatataggtacgaaataaaccattaagaattcatctactctccgaccatggtacggtgatttactattctccgcattgtcatacgcaatgagaccatttttttttcccgtggttcttagctcgattttatactgtcacacactcattacaaggtattgctcctgcctgttcctacggcttttgatgagtttgtttatgcatttgacgtgtattaagtgtgtaaccaaagagagcttctctaaaattgtaagttgcgtttggaaaataataagaatcttgacattactaccgaaatacttatcttttctatgttagaccaatggtccaagactccaatgttagagatttttttactattcatgtgacaacaataattggtatgtaggagtgaaggaagaaccgacaatcacaatccaattaacataaagtagctcccacatcttacccaacgccatcctcaacgttgatatctcaccatccaacggcatccagcttccgatagattaaaccaatcacagccgttggatcaaattttacctttccctcttcttactctttcataaataaatccaacttcttcactctccacccgtctcacttcctctcctactccggtcgacgattatcccaatctcgccgggattctcctctgcaccgtgagttattgtttactctgctatttcctttttatgtattgtttcctctctagggaatgagattatgaactcctactacttattgtgatactttgatcgaatcgtcttcctccaaatctgtatccgctcttgatctgtttcatattttctctcttaacttggattttgattttctatcacttgaaaatgtgttgccgttttgaattccgtgaagaatttgaaatcggagttttcttctctgcggcgttgtgtttttttccgattgatttgttttgggatctgatacagattgtttgatttcagatcttcgagatttagttgttgacattcgatataatttcatttggatctgatacagattcttttgctttcaaaatccgttgtttactgttttgttcatgtaatgttgatttcagataaaatagaagatg

SEQ ID NO: 955 - DNA, 3000 bp, Unknown
  misc_feature (1)..( 3000): cDNA_ID_2130369_gDNA_ID_1620341_Annot_ID_153990 3000 nt of promoter + ATG
tgagacgggtggagagtgaagaagttggatttatttatgaaagagtaagaagagggaaaggtaaaatttgatccaacggctgtgattggtttaatctatcggaagctggatgccgttggatggtgagatatcaacgttgaggatggcgttgggtaagatgtgggagctactttatgttaattggattgtgattgtcggttcttccttcactcctacataccaattattgttgtcacatgaatagtaaaaaaatctctaacattggagtcttggaccattggtctaacatagaaaagataagtatttcggtagtaatgtcaagattcttattattttccaaacgcaacttacaattttagagaagctctctttggttacacacttaatacacgtcaaatgcataaacaaactcatcaaaagccgtaggaacaggcaggagcaataccttgtaatgagtgtgtgacagtataaaatcgagctaagaaccacgggaaaaaaaaatggtctcattgcgtatgacaatgcggagaatagtaaatcaccgtaccatggtcggagagtagatgaattcttaatggtttatttcgtacctatattaactagttagttaagtttagttactttcgtaaaatatatattaaatctttcttttgcatgcatgtcatagcaatcagtttatatgaaatatatgcagaaattgttttttggtccatcagatctatacgagagagttgaagaaaaaagttgatgcatattaccgtagttaggacgataatgtaaaacacacgcattggatactctcgtttagatttaactactgatgctaaattgctactttgaaatctttaaaatattctataagttcttacatctgtcgatctactgtcaatcaataaatatatcagtttgctattcggaaaatctaaactaataatcggataacttaaatattgttttctcaactttgtcgttgcttgtataacaataaaaaagtgatgtttcgatggtttcgcttagtactaaattttccatggaacattaatcatgcttacgtttctactttctataacaatgcaaaagaaaacccgaaaccaaaagcactactaatgatatcaataacaaaaccaatgtcgcccttatatcaccatcatttagatcataaacaagacgtgataaataaattacgctaagaacagcatatagctgtaaatatgagaaattagaagggtacaaaaacaagaatgtgttggtcttgtagagcttgtggatcggaaatcggatagcgacagaatgagatgtagagatatataaaaagaacaatgcacatgaaatccacattgcgtcccatgtgacatgccaacagctcacctgacttaaattctaactttctctactcgtagtttcttgctccagtagtttctcatacctacaaagttttttgctaaattccaatccctacctacaaagtttgtcagagttaatgtcgttataatatcttcttaatttatttttttcccacaagttcttgtaaatacaaaaattgaatatcttgtagtataagtatatatcaagtgaagtttactctttttgtaagtagtagtattatttacgtgattaatattataatttgtttctatgcaataagtcttgactctttcaaataaatcctctcacttgatctgtacgaattttctggtatttctatgtctgtgaatattcataactttttgttatggttaaccgaggatgagcgatgtccaaaagagattagttgagtgctctttgatgatgaaactctatgaaatagaaacacatctctctttgaagattattgttcaaagcaaacgaagtgattggtcaatgcagctcttgagaattcaacaagagcaacaacgtaatcaattagctgaagtagtgaagtctatcattttcttttgctatgatcaaaattgtaattcattaatttattggtttgtgattgtgaaaaagttttaatgacttttaaaatatataaaaaatagataaattaaaagattttaaatgattactagagagttttgtataatttttatgatttgtttttctaaaattttgtaaagtctttctataatcttgtaaaatctccttgaatataattataaactttaatttgtgattttttcaaaattataacatatctccaaaatatagtatactattcttagttattttcatcaaaatgaaaatcacacgcataaacacaataactatggtatttgtaagtaaagttacatgaatagggaaccatccatgaagaacttgatgttttattttcaaatattttgttggatatttacttttcatatgttagattaaaatgctttgttttaaaaattgcttgtgtgttgatttttcacaaagagattatagaggagcattcgtgggacttgacccattagaatatatatattgttcatcactgttaatgagatttatgcatctgttcgtatcattggtttttgtttatatccaaaatcatgattcacaatctctctttttttatgatacttttcatgattttaatttgtgaagaaaataagataaaatcataatcgaataacacaatattttataatcattaacagtcatggaaattgttgtttaagttgaataacacaaaatttgtaatgattttattaaagtatcaatctaataactccagatttacaaaaactttaaatttcttttttacaaatcaaaatctaataacaccaaactttaaaaaaatcttacaaaattttaattaaataacaaaaaaaaattcatgacattacaaatcatttaaaatctatataaatcacaaaccaataacaccctctaaataaaaaatatcaaattaaaatataatcgtcatcttcatttttttttcgttccgcatatggtgccgtgtttttatttctttgatttgtaaatccttctatggtttctcaatcgagaagaaggaacccaacactgagatcc

SEQ ID NO: 956 - DNA, 3000 bp, Unknown
  misc_feature (1)..( 3000): cDNA_ID_2130361_gDNA_ID_1620341_Annot_ID_153986 3000 nt of promoter + ATG
ttaaatcaagaaaaccgagaagcagtagttactattttcaaagactcgttgttcaacactcttcaatctcatcccaccacatagaacacataagttacaatcacggcatataacgtacgatatagtgtatatcatcagtgtaagaaaaaaagtaaataaatatgttttttgtgtttgcacaaatgagttttattcagacaaaaattcacaaaaacttgtaaaagcaaaaatttatctattgtgcaatggattaggacctgtgaagacccttctcttgccatcttcaaaaacatcttcaccaccaccttcataattagtatattttgatcctcttgatgacgcagcattggagtcaagatcatgaagctttggatccaaatttccagatttcttcaagcttccatgagttgagtgatgatgtatattaggagaagacgatgaagctttagcgtaaagaaacagaaacaaaagaagaagaaggatgatcaaggcaactgtagtgatgtgtttcctagattttcttctagagtagtaatttcccatctcttaggaatcttcaagatatgaagagtttctctataaggtatagattatatatttagaatcgatttttgcaagtataaaagatctgatcaagatctcttaaataaattctctctcaaagtctgtaagaatgagaagagaggaatgaaagtgatggaagaaaaagctatggggcttttaacctatgacttcctctaaaagtttgttgctctccctttcttattctccaccactttctacaaataaagagaagagaaactagatagaggtttgtaaatatatatatcattaatttttaacgaaagttttttttgtgtgttgaatcatttccaaaggtcttagctgggattactaggtcaagtggtagtaattagtgtggttaataatatacttatagtggttagttttagagagtaatgagggtgtgataataaagcatatagaggaaggtaattatgtgaagggggtcaaaagtagaaagaaatagaaaagagagaagaaggggccaaaaagggaattggagtgatgattctaagacttagctttctttggggaaaatgatgttgtcttcactccctttttcttcacccacatttacactcactcacacacatgaaaaaatccacttaccacttgaatcttcttcctctccattttatataaatgttgtatatctatatttgcttctcgttttttagtctttctaagattacttttttttttttaattttactttattatgagttaagaaagagaataaagaaaacagtatcacaagaactaaattacatacatgatacatatatggatatgattctccaatatgcatcttctaccttcgataaacgtatttacaacttgtgcaacaaatgtttttaagaaatcaagctgaaagtttatagaagaaaaaacaaagacttacgtccaatatttgtcaagaaacaccatatgtgatatgtacctcaatatatcctcatcagtcatcacgtttttatatattatattcccatttattttacagcagacaaatcatcatttacatagtagagagcaggtatacaaactcaaatccccaaaaataccattattccattttgttctcgtcaagcactttgtctctgatgttatatcagcaaatatacacgtatgtattcatcgtatgtttcatcttaaattgtagaagatattgttaggcatgtctcgatcggattagacctgtccgaccaacccaaaacactgaaaacttacattatttatgttttgataattttcggtcttataatggttttttagaataacaattcatgtttttcactcaagtaaataaaaaatatagaaagagataacaatctaaatcggatataaatagtcgtggatatttttgtttggataagagtaccaccggttaaagagagattcattactcggttcgaatacggtttagctaatggaagatccttgatttgtctggttaagtgggccgtgttgaaggagcgcgtgaagcccacgcggagcccttgaataataataaaaaaaggctgactgtaatttgttgattatattgagagagaagccaacggaagaaaacagagaataattcctctctcattggtcatcagacacaaaagactctcaaaccctaactagtctcgctttttcgctctctcgaaccttcttcgatctctgtcctttctcgatcacttgctaaaatcaaaattttaggcgggaattcgatacccaagcccaagacccaaacacttcccccctcacgtttcgctgctttcgttagctagctttctcaaacgagatctgggcttgtcgaaagaaacgtgtatgttgattgtttcgattctttctcctaccaattgaatctgagattttggttttgctattgggctctgtcttgtttcgttttcgaattccaaattcctcaatttcgaatttctcttctgcttgaagcttttttatcgagtctaatcttcgtttctagtgattacttcgcttgtctgattttttttttgttagcttcattcctaaatagaacaaattgatgaaactttcttgttgactagatccaaaatgtatggacttggtatctaattttacttttacaaacttccgaaaactttctagggttttgtttctgatgctagtttcattttttttgagcttggagcagaaaagttgagaattgatagcatctaatgctaaattagattttcttacttcttagttttggtcactatgaaatatgagctggtgcttagttataacttttgtattgtttgtgctacagaattgttagtttagatagtatcgaagctgaatttgctttctgtagtagtattatttccttatcactctatgctttttctgatttttgtttccttgtgtaggatatatatgcagtgagccagtgatcatgcaaaagaaattcagagtgcgatagagaagatg

SEQ ID NO: 957 - DNA, 3000 bp, Unknown
  misc_feature (1)..( 3000): cDNA_ID_3059815_gDNA_ID_1620341_Annot_ID_153983 3000 nt of promoter + ATG
tgcaccattcattcttagatgatccatcaccacagactcaaaactctctttcttctagcaaattaaataaaattcaaaaagcaattgaaaagaagaacataagctatacaatcacagtgacataaacagagaaaacgagcaaaggttctatacagtttctaggtaccttttctgccatcagaatgtaacgtacatgcttgtcagctacgagctgaaccatctgccacaaaatattcacatcagattcagtaacttcgtaagaatccccataaaagacttaacttggctcatttcaagcttagttcacttcaatggcatatcaataacacttgatcgacccatctatagtataaaatcctttaagaaggataaaaaaaaaactgaaccagaaatcgatcaaaaccatcgaaaacaagttcacaatcataaaaagagaagagtgatgacctgggaggaagacgtagagctcatcagcttggatccagaagagaaatcacgattggaggagactgaccaagatcggaataaaaaatctaacctttcactaacatcaaaaccttcttcttccttagcttaggattttaatctagtccaccccctcagcttcaaacattctctagttagccccttataaaaaaacatatgtttatttatttattttaaatcagaataataataaaagacaagtaaaactagagttttttacttatttacaacccaacctctatgttggatctagatccataacaattttggatcttttattctcaacaaaaaaaaatttaatttctcagatcaaatttttttcatctcaatttatttttctctcaattcaacaaaaacaaaacttttgatttgtttcttcttcttcttcttctctttactctcttctctctattccatatataatctttcgtcttctttttgccttttcattctttctatcaatccaaagatccatcttttttaccttttcatttgtttctatcaatccaaagatctatctctattccatatatgatgattgatggtgttgtgtttaattagagttttatttcttattagatttgatagtttgatctcttttcctctttgattttgtttgaaaatgatggattttggatgaaatttcgattataatttagatttttatgagtacaattcaaatttgaattaattatctatttaaaatcgaaattgtcccttaaaagcctcttgtaatagccattacgacttagtttttaggattacaattgggattcgaatgaatttgaattttgttccttagagacagtttgtgaaatgcattaaaacaaaatattatgagattgcttttgaatgataaaaactagaagaaaagggaagaaggagaaagctgtggagaaagaaattgagaaggagaatgacaaagagaagaagaagacttcgtgtttgagtctttagatagtgttgtgtttaggtataattgtggctaaatttttagatataattatgttgggtttttgggtttagatacaattgttcggctgtcttttggtttttaagataatagatctaagcgtttaggtacaactggtacgctcatgtacaattatgtatctgggtttaggtatgaatctaagatttcttgtcaaaaaaaactccaaaataaatatgaatctacacgtcaatgtattttgatccaaaacaaaacacaaaattttttatgaatgttagtattttattttattaaataacagtgttttgaaaatgaaaaaaaagtttgaaagggaaaaatatagtttatttaactataaaattaagtatttttgatgacaaaaaaaactaaatatttttatcacaaaagaataaagctaatttttattataaaatatctacaaatatctaaaaaatatctataaatatctgaaaaatatattgcccatagttgtacagttgtactcggttgcacatttttgctcatagttgtacaatatcgagaatataataaatctagttgttatcaactcaaaattaatttttatgggtagaacatatggtattcccccatcaaaatacaattactttgtatcggtgtatttatatttatctaattacaagtatttaaaatttttaatttgttttgttaaaatatacaaagtaaccatgaaagtttaaggttgttagtgtatgaatgttagattttgtgataagagtttcattaatttagaaaatatgatttttgtcaaaaactaattatgtaatttcattaccattgtgtatgcattatttaagttttcttagtttggatttaaattttcatattttataatattctgaaaactagccaagtgaaaagaccttagttgtgcgggttgtacttagttgtaccaatacaaaacatattaatttgtataaatacgacaagaaaattaatagtatccattataagaaacgcgtatgactgaagtctttttgattataacttgaaaatgaaagagaaaaataaaacgatatgtaattatatgtttttcgtagaagttcatcaacatagttgtacctattggtttctgttgtccagcgtttttttgtaggtttaactgattaatgagataggaaataaaatgtaaatgattggttgattttaatagattgtttggtagcaaaacttaaatagaaaattaaaaaggataaaggagaagggtaaaattgtatttcaaataggttaagaaggagatggggtagtaagaataagtgagggtttttcaaaaattgattcaactaaaagggcaaagtaaaatcccttaccttaccttaagggttctattgaaaccgcgaaccggccagctctgctgcaatttggcaaaaaccaattgaaattcaaatccggtttaaccggttttattaaatgatttgattttccgttgactttccaattgatcggccaataacaaaaagagaatggaaacaatgataggaagctgaatcaagcaagactcgcgagaagctgaatcatcaatg

SEQ ID NO: 958 - DNA, 3000 bp, Unknown
  misc_feature (1)..( 3000): cDNA_ID_3059833_gDNA_ID_1620341_Annot_ID_153969 3000 nt of promoter + ATG
ctttccttctttgcacaacgcattcaacaaaatgctacaagtataagcattcattttcacgccagaatcaaccgcagtctcataaacacccaacgcagcctcagctttctcgttactcgaataaccatcaaacagaatactgaaggtgaaagcatctggtacaaaccccagatccttcatttccttcaaaacattctctgcatcttccaccattccagctttaaacagccccttaagcaaagtattaaacgtaataagactcggttcgatatgatccgctttcatacgttctctcactttaaaactcttttccggattcccagctttgcaatatccatcaatcaacgtgttatacgttatcaaagaaggtaacaatcttcttgcaagcatttcgtcgaacaactgttctgcatcattcatccttttccctttacacaatccatcaataaggacattgtagataaacacactgggatagattctatcgtgcttcatccggttaaacagctctaaacctttacctacatcgctcaatttcacagcagcttgaattgctttcccatacatgaacttactcggacgaaaatcagattcgagaatgttcaaaaacacgtttatagtcactctgaattgtttcgtcttcacaagatgatcaagcaaaagcgttaacgaatctgagctgggataaataccttcattcctcaaagcgaaaaacaaatccgcagcttcagaaatcatcttcgattcgtttagtagcacggagagaagcaagtaggagaaatcgtgtttcaacgacggagatgataacgagaaggcggagaagagctctttcggcgatgcgaaaggcgtagaatccgatcgaagcagcgaagagagaacgccacgcgccgtttcgattcgattctgctggagaagaactcggagattccgtagcttttcgtctccggtgacgggattcgtaggcggggcttgttcgggttgagattcgggttcggggtcggtggaggcagagaagagacgacgacatgagcatgctgagacagagtcagtgaacttgacggtggcgtaacgagaagatctcgaaacgagtcttaagcgagtcaccatcgttgagctgccggcgacgctctgcaaaagtgaatcttaacgaaataaccttaaaataaaacgaatattcggacatgaatagaactttgataatcattttgaaattaaaaacaaaattgttcatttcattgcttgattatactgtttgattaaagttttaaggaaactttacatttttcatttcttgttgtcacacactagtatcacaggtcacaacaaggtaagaagctattgcagagcaatgttctctctgccatgtatgagttaccttgtcacgtttggcttatgcactaatgagatagtaagctatattaatttcaccatcatatcaatttaacgattcaaagcaccttggatcgcatatacaacacacagtgaaacctatttaaagatgtaaatacgtaattatccaaaaaaaatacttcaaagcaaaactaaactcaacagtactaatctcgtaaattacagattgatagggatgagttatttgcataattgtgatctatacacttataataaacagagatcactactgtaagaaacgaaactagaatccaattccaatggtttcggatgaatcatcttcttcaacctcaaaagtttactcaaaagttttttaagttgtggaggcttagatagaaacatcttcaatgtcaggggcttctctctaatacccattgttatcttcgaagcttgtttgattctcaatttcaacttcaccagcaagggttgcttctgacacaaaaacggatgcaataacaactcagacgcggtacctctcttctcatgttcccttgcgaaacacgtttcaataaactctcttgcatcacaaggcacatattcaggaatatttggagcttcaccatcactaagaaaattcacgaaatcgacactagtaactctttcccatggctgctcacctgtataaatcttcaacactaagcaccctaacgaccacaaatctagggttttcttggcaacaccgtcgaagaaagactcaggcgttcccacatacgggtaatcacttttccagtgatccggaacttctccgacttgtctacagtttccaaaatcaaaaatctttaactcgcacgaagcagaatctttccgagagaagataagaaggttatcggatttgagatcgcaatgaacataaccgtgactatgcattgagaccaatccttcgagaatcatccgcgtgaagtctctgatcatcggatctggtaactttctgtcgggataattctccatgaatgaacttaaactcccttcgtttgcgtattcaagaagcaatttgtaaactttgtgtccgtgttcgttgaaatcttcttccaaatcgtctccatagcaaataacgatgttgggatatcccttgagttcagacagaatctgtatctctcttttgagcgcgtcgtattcttcgagatcttcagcgtaagatgtttttacggcggcttgtaacgaggaaccatcggttttagtgtatctgatgagatcaacagaaccataaacaccttttcccaagaatttgtgatgcagaacccgcacgtgggagttggcacgtgtgaagtcagtgaagaataaagaaggatctggaagtgacgcgtggcatgtgttggtttgcagatcagaattggccgttaggcgtgtatatgacgctgaggagagtcatcgttttcgatcatcgaatcattttgtaatcttctaaggtttttctgtgaaactttgtagctagtttctctcatctcgagagctagcatgagatcatttggtattttatgaacatcgtgttgatcatttgattacaagttattcaatcgaaagttatctgagttgatttgttgggttttctctattaaaggtatcagagccatctctttccttggaatcatg

SEQ ID NO: 959 - DNA, 3000 bp, Unknown
  misc_feature (1)..( 3000): cDNA_ID_2105148_gDNA_ID_1620341_Annot_ID_153976 3000 nt of promoter + ATG
caaccatctgctactgtcttgctatctttcgttacgcctaatgtggtctttagttatgtttggtgtttgaaatttaggtttccattgcgaaactgccagaaaaatttatcctaatttattctttttttttaatatgctttttctttcagggttttggtgttgaagattcagatgctgagtctcctagagatatccattgttcagtcgagagtacagacttttccgctagagtgaaaaaacatattgaagaacctattaaagatatagaagtttctagcgtttcacctactgaaaactgttatcaatcagggagagaggctataccctcagttactcccagtactcctctcacggcccttagatacacaacatcagctgagaaacctgcaagtaaaactactggctcatcaacagtaaattcgaagcgttcttcgtcctggggaagaggcaacgtaagttttccattgtctggcatgaaaagtcgaattctgttgtcctagtctctggagctgacttgctatgcatttattaagtatttataggatttttttttgtaatttttgtctgtccttgtaactctttgatcaccactagacgaaattagttctcctgatctctatcgttgtcaggtcatgatatgaatttcccttcagttttcttaatgccatgcttattggtgctataggctagatgagctgtttccacttgcataatcctataagaaaactaaccatcagcgtcttaggaaaattagatgttactggaagtcccatctatttggaataaattatcttagtacaagttagttgcatgtatgatgaagtaaatagttgtagggaaattgagtttaaggtgatatctcaattcttttctttgtttactgtgtgcagggcaagaaaacacctgctaaaggatcatttgattcctcaggaaatgacgagtaagataactcatcctgaatgtatacattgtggttctttaacactcctatgaaacctttttatatatattctattggcgaaacccatatgagatattatgtatggttaaataggttaaataggtcaaaaaggtatttactgaagcaacattctatttcgcttttgaattgagaaaataattttttctttgttctaaaatgagcttgatgtatcctgatgcaatgcgtttgctacttgtaggcttcttatacagaggctcgagcacatgaaagatgaactgcgacaacgaatcgctaaggaggtacttgttcttgcactagaagtattatgtgctgataccataatgttgttgtattgattgattagaccactacaggctaaaggaaatgcggctctacaagctagcttggagagaaggaagcaggctttgcacgaacgacggttggcacttgaacaagatgtataaaccttctcttgagattttacgtttctatcctctattttttttggggtataattttgaggggaaataaacttccattttgctgaccaagcttgccatgaaattgtcaggtgggtagattacaagagcaactgcaagctgagagagacctacgatctgctcttgaagttggtctaagcatttcttgtggacaatttagctcacaagctgcggattccaaagtcagtatacactttagctagagaaagcagttttttttttttggttctatctcttgctttccttagttctaacatcacaatataatgcaaagacaagggcagagcttgaggagattgctcttgctgaagctgatgtcgcaaggttgaagcagaaagtcgccgaattacatcatcagctaagtcagcagcgacagcatcacttaagttcactcccagatgctcaaagccatcaccagtttctccataatcacaatactcaactgtgagtttacactcgatgcctggttctagctcttattcaatagttcaaacgagatattactcgaatgtaaactcgctaagagaaataacaatctattttttttcaaattcgcaggaagtcttttcaacaggactttgattccattcttgctttcgttaatcacgaaagaaatcagagaacggtacaaatcttattatgtaaccgaggaatctctattatcttataaaaaatgattctattatctgtcagtaacattctctgctatcgaataatctaggatgaaactagcctaagagcagactggaggaatggcagaggaaacaacagacaagtaccaggctcaccaagcttgaatgcagcatccttaggcatcccaatggaagagtattctccggttagtgatagtcttgtttaaaccaatctcacgagattcaaatgtgtaaaaagtgtgagtaaacggtcttgtaggtaatggactacggaagacatcatcatcctcctgcaacatctgcagctctcatggagctaaccactcgtctggatttcttcaaggaacgacggtcacaacttatggaacagattcagaatcttgacctcaactatggttcctcttcttcttctctgcaccgatcctcttctccaccatggaattaggctctttgagaagctcttgtccaaaaaaatagaaaaatgtaaagaaagtctcgtctgtgcagactcttcatgcttgtaaaaccggttcaaggttaaaccaactatatatttaccacgaaattgatgagaaattgtttgctcttgcttcgttgttagtgtgatttatgtgagtgaggtttgtaaaaagttgtgtgtatttcctctgtttttgtttctacattttaaatggttggccgacatataaattcagtttattgaaaagaagaagtaaaaaaagattctctagttagtgctacaatgagtcataaccttttattattccggaagaattattcttgaagggaaagaaaaaaacgcgctttaatctctatatataacaataacactttgggttttagactttagatacgaatcaaaaacatttgagataaaaatcagaaaagtaaagagacgaaaatg

SEQ ID NO: 960 - DNA, 3000 bp, Unknown
  misc_feature (1)..( 3000): cDNA_ID_4282072_gDNA_ID_1620342_Annot_ID_153999 3000 nt of promoter + ATG
ggctttgctatccattaagacaattatgtttgaaaaactcgattacgtgaatttgatgaatggttttggaggtaaaaatctaaatagaggtatatttaaaaaatataattttgtttttttttcctatttttttgcttacaaaatgcttataaagttcaaaaaaaaaaatctataaagttttagtataacttttatatactattaattttttgattatgcaaaaaacaaataaagggcataaatgttttatatctgtagggcattcctacaaatattaaaagttttagtataacttttaatatatatatattattgtttttcaaattaattcttactagtcaaagttaatgggattgttagaaattattcacgtaaacaaacaaatatatatttatatatatatgtatatatactattattattcaaattaattcttactagtcaaagttaatgggattgttagaaattattcatgtaaacaaagaaatatataaaattttcttctatttaaaaaagcaaaaaaattgactcttgaattttggtatagtactggtttagctaaggatgtactaaaatttattattgaagttgatcgatgaagatgacaacaccgtactatatatatacacatactaagagggagaaaataaaacacttagttaagtatacatcgaggaaaatgactttcaaaattaagaagaatggtttaatggtgcaattgcgtattagttctcatatgatttaatttttaaatatctattttcacttttcgtataaattttacttattctaataatatctcttaaatttataagatcttgtgtgaccgttttttggtatgtgtcactagttacattattgaatttaagggttcgataaaaacttatggaatgatcgggtaaatatatttaaccacggatacttatttgattttacatctaggttttttaatgttaaaagtagattgatcacctaaatttaagtctagggatatgtacgaaacaaaaatgtttaacaacatactcgtaagaaccttaaatgagcaatactttctttaccaatgaaagctgctgttagagggcatcctgaacatgtggaggttaaaattaatgactctctaactattttgttcaaacagaatttcatagattttccattttttattttactcattttgtaaataacctcattttaccattgatcaaataaatttaacatttcatataaaaaaaaacctcatttgaaaattgtatttaagtattcaattatttggagattgtattcaagtatttaatttgacaaatataatttggttaaatatttcaagtattctaaaaacattcagatatttcagttatttcagatagtttggttattttgagtgtaaacataactaatatctttaaattataaattataaatttggctatcttgattatttgaaatataattaagaataacattttagatatataattgtatttcagataagtctgacattcactagatttttaatttatttttaattttattcccatattttttttttttcttctcataagtgtattatattaaccaccaaaagaggaaacaaagcattaaagcttacaacgatatgtgcagaaagaaaagttaggcccaacatagcccataagattaacatctacggcataaagatgttttgacatttggactctatccaatacacgtgtccacgtgatattacaactgcaacacaagatgaagagtcatcggaagtgtaccgacatcaaccttcgccgccgatgaacaccgaatccggtgaggaatgcatcgccgaaacatcgcacaatgaatccttgtaaccaccgaaataaaactgaacggtgctccatttaaaagacacagcaaaaaggaatcataataagcatcggaatattcttcaatctttcaacccgaagacataatcgcttgatagatttctgcaaatcgaagtttctaaagacacaagacagaaattaatcttaagtaactagcacctaaaactaattaccatctcaaatctgttgagatttattgaaaaacaaaactaaaatatcaaagcaatcagcataaaactgattgactacgagcaaggatacaagcggccaaaacctcttatgaaagcaggatttgccgtacgggaaccggtcatctccactaaaagagctagaagataccgggcaaaagcccaaattatttggaacggctatcatcggaaaattcttgtaggtggagacaaaaagctttccctctctgaaggttttgtgagagagaagagagagagaagctttagctctttttattcccatatttttttaaaaaaatcattcagatattaattatctagttctgttcgtttccttccaatccagttcagtttagtttggtttattcggttctgagccggagcaacaaaaggatcaatcttaaaatcctcgttatgttatgacgattttgacgaggaccaatattgtaactttctatagtttattttattattcctccttgtagaatagtttatttgcaaaataaacccatattaatatctctttctctttttttcaccacactctctctctctctccggctcacacgagtcgctaatcaaataaacctaaaccctagatcgtgatcggcaacggcacctcctcgtcggcgatagcttctcttccactaaaagaaaatcctcttcggtattcttcttcctctaatcaatctctctctccgtttcggattctcatctccactcgatgactagaaacgtctcgatctgttttagatttgacaacgattcatgattctgattcgttcattgatttgattctctttgattttgtgttaactctcgtttataagcttagatttggttctcgtctctgattctgaatcgttcttgtagtgatttgatttatcatataagcgtagaagaacaatttgtgtttagttgaatttgatttttgttatgtttaggtgagaatg

SEQ ID NO: 961 - DNA, 3000 bp, Unknown
  misc_feature (1)..( 3000): cDNA_ID_2128828_gDNA_ID_1620342_Annot_ID_154009 3000 nt of promoter + ATG
atggacgtaaccctcaaaagcatttaacgagactatattagcagtagaacaacatcatagtgaaagatgtgatcctaattgaaaacatatcgaatgaagagttataatgattaagaaaacgtttgacaaaaagtcaaaaagaaaagaaaagaagagttacaatgattttacgcaaattttcagttttttttttacaatggtaaataaaaaatttattcaacaacaaattatgataaagagacacaagactaagaagcatttattgagattgagttaaatccatggacatgtttaacaaataatcaaaagtaatagttatatttaggaaaaatatatataaatataagtataaacagaaagtatatataaccaaactggacatagttatgacagatgaggaacggcatcgaagacatcttagcgcctcgaatgtgtctcaggtttatataggtggagttgaatctgtgcttcacgtgtttagagactgtccagctcaattggggatttgggtcagatttgtgccgcgaaggaggcagcaggggttcttttcgaaatctctgtttgaatggctctatgataacttgtgtgataggagtagctgtgaggatataccgtggtccaccatttttgcggtgataatatggtgggggtggaagtggagatgcagtaatatatttggggagaacacgaaatgcagggaccgtgtgaaatttgttaaagagtgggttgtggaagtgtatagagcacatttgggtaacgctttggttggaagtacgcaacctagagttgaacggctgattggttgggtgcttccatgtgtgggttgggtgaaagtaaacacagatggggcgtctcgtggaaatccggggctggcttctgcaggcggagtactacgggattgtgaaggagcttggtgtggtggcttttctctaaatataggccgatgctcagctcaacatgcagagctatggggagtgtattacggattgtatttcgcatgggagaagaaggtgcctcgagtggagttggaggtggattcagaggcgatagtgggtttcctcaaaacagggattagtgactctcatccgctgtcattcctggtgcggttgtgccacaactttctacagaaagactggttggtccgaattgtttacgtgtatagagaagctaattgtcttgcggacggattagcaaactatacaattttgttatctttaggctttcattcttttgattttgttcccgatgcgatgtcatctttgttgaaggaggatactcttgggtctactcaactaaggcgagttcgtttgtaacttttctttagtttcttaataaatcacgggaggcaattgtctcccggtcacttaccaaaaaaagactggacataattttataaaaaaaatatcgaacaaaaaattaataataaatatatacaatttttaaaatattataaaataaaaatttatttaagaagagttaagataaagatacgcattcttaaaatacttaattgtaatttgtacacaaccatctataacgaagagttgtgataggaaaattagagcaaaagtaaaacttaaggagaaaaacaaaaccttaactgaaaatgtatagataaaaatttataaaaaagaaatacaattttctaaaatttaaattatttcatataattaaaagtcttaaataaatattttgcaaagagttacaacaatcaataagcactacgatagaagacatatttacaatttattaatttgtatattcacataattactcacccttctcttacaaggtagagtaaattatttttattcaaactcatcattggtgtaacctttcttgaaaagatgtatatctatcttaaactaaaattgaaggagttttcctgtttcttaagattactgagtatttaagtattttttattatttggataagttaaaatggttaaatgggtaatttataattcatagaatcttacatggtagagtatattgatccaaactgatcatttgtataacctttcttgaaaatcatagatctatcttaaaactaaactgtaagctttttttttacttttcaattccctaagattatgtctccactttaatattttaccatttctcttaaacagaaaaattgaatatacctatttataagtattcaaaatttatttttaggtagaatttagcgcaaaagtttattaaactttacgtttacaatctcattatttaatattcacgtgaatgaatattttgacatggtaaatataatataacactataaataatatatttacatatgatgaaaagaagaataatttgataaattagaaattcacataatacatgaaataatcacatattaattccaccctaactagctaaatgataaaaataaaatcatataaatcagttcataaaacaaaaaatgtctcgggaaaaaaaaaacactcttccaaaagagacatgtaatagtcaatttatttctattttcataatcatcgttaatcctcattgcatgtggtacaattattctaataagaaaagtgaatcgtcccaataaataatcctaaaatgccgtcttaaaaaaggcaatctataaaattatttataaatatctaagaatgagttgtctactttccattgattaaaaagagaaaatatcataaacaaaaaaaaaaagtcagagaagttaaaccaaaagcaacaaaaaagaaaaaaagaaagaataatcaagagagaggagaagaggacggtggaagatattttgcagttgaagaaaatatctttgatattttttgtgtttgaaatatctaaaaccaaaaagtttcatctcttcattccgccaaattgactggtgatgacgtggcaactttacccacgtgtaaaagcgtctacaactgtatcgtttcttttgatattttgtttctctctttctctctgatatttttcattttcttcttcttctctctctctctccacaaagataagccaacaatg

SEQ ID NO: 962 - DNA, 3000 bp, Unknown
  misc_feature (1)..( 3000): cDNA_ID_3059879_gDNA_ID_1620342_Annot_ID_154015 3000 nt of promoter + ATG
gtttgtcccaagtttggagtgttttccgaatttcatggataatcagaccgcctgcatttctaactaccatgtaaaccagttagaatttagccaaaacccaactaacacacttttcagacaaatgtgttttttttccaaagatggtcgaacttagatataaaaatttcactcttgaccaaaattttctctaccatattgagtaattcaattctctctctaaaaattagagaagtaaccctctaaaccaaatcattttaaaatgtatataaaaactcatttaaatcatgatcaattacaacattatatagaaattctctcttcttcgaatctctcaaagtaagatggttataatcatgtgtgtggtttcactaattaaacaaagacactttgattttcacaatgaaatcaacatatgccttcaaaaacatttcacatcccaaaacaaattttaatattcaaatacttttcaaaaattaaaattaaattatgctttcaggggtatatgaaattactttaatttccatatatcaaagttaaaatgtgcaaccatatttggattttataaaatttaaacaaaacattaaatttaaaatgatttttcttaaaatataaaaatattatgtatgaatagaatgaaatttcttcttaaaaaaacgtttcaagaagataaaatttatttaaggggatgaaccttattatttacagttcagaaaataataaagaaattgattgctaataataaaatattgaccaaaatttagaagtaaatattacacatagactttttgttaaccctaaaaaaacctttttcgtttttttcctttcttttatatatataggataggataaaaccattcataagttaataaatctgcacacatatactctcttttttattacagttcacgcattgattgcaaacaataaaaccaatattgaccaattaactagaagtaaatattattaataaaaatattttttaacatgatgcactcaaataaaaaatatttttagattttttctttcttttgtatataggataaagaaagaccattcataaattgataaatcttgccagtaccaaatttaggtaactagtgattctgatccacacgtatactctttttttttgtacatatatttaaatggggaatctaagctaatggaagaaaataaacaataaaaataaaaaagataaacagaaggagaaagtagaccaaagttacatgacaactaggaaacaaaaagttcgaaaagaaaccggatttgttctgctcggttaagttccggtttagttcagtatgaacaaataaaagtaaaacaaacgagggacgtgtgtatggaagaggcaaaggctgagaaacttttggttgggacaatttgcttaagtaatgactaatgaatgacccaaaagaaaaatcctattaactctttcttcttaagccaacttgctttcttcttcaacattacacattacgtgtaactgtaattaattaaaaatctttacacattgaattattagtttttgtttattcgttgatttaggcatttagcaattcaattcagtctttggaaactgttcttatgactgaccctttttaactttttgattcaatttccttaaaatattagtttttattttgggttatatggtaaattacacattgccgtctcgtcctaataatcctcttttctgttcccatttgtgttgttgtgctttgcttccttcctttttcctcattctctcttcttctccttcttccttctcctccaccacaaagcggtaggtttctctcttcaacaatcggtgagtctctttcgttttcattaagaatcttcataaagttttgatttttattgttcttagatcgatttatgttctgtatctgtttggttttggttttgattttgatttttgtgtcttttctgggttctattgggttttcaaagctcgatcgaaatagataagaatcggttggtgggttttttgaaaaatagttttttttttgaaattttgtgtcaaattctgtagaattgttgttgtggtgaatttattattcatcagaaggtaaaaaaattattttttgttattgggttttagatgtttgaatcggatctttacttctatgagcttgttttatgagaaagtttgattctttgaggtttttgaattgttttttattgtgatgatgctttatcttcaagctgtgggtttcttttgtctttgcttttaccttgctgtttcaatacatctttgcttggtattgaggatttgtgaaacttcatacgctgttgcatctatgggtagttgatatgtcattgatgaggcagtgcttattttgatatttctcttgtttttctgaattgccattgtggtggtagttgagtaaaatgtttttcactcttttccttgtttcaaaattggcatgcttgttacgtggtcctggattttgtttgtacctcattttcattgacgctttgtttcgaagttggcagttaggtgtcaatttgataatttagacttgaagttcttttgtgtttagaatggttgatcatatgaattttctatcgcatctgtcctcttattttttaagcttgttaataactcatgtgtcattagtttcctactgaatcatttgtgttttagttaggcgtcgcatctagaagtaagttgcatttagtagtagttgcagcggtcttgctttgagtgacttttgcaccttgtgctcttctaggtgaagcagattatatgactgtatatgcaatctcagggtgccatttattattacaattgtaggagctatgttttgattgagtgtgtttatatgtttcttattacagttgacatcgtgtagaagccttttccttgtctttgttactgaaagatctactgtctttgttgttttgcagtctccccattaggcacattgttgagggcagggtagtctcgtgagttctcttctcctgagtgtaactgtggttaaaagcttagccaagatg

SEQ ID NO: 963 - DNA, 3000 bp, Unknown
  misc_feature (1)..( 3000): cDNA_ID_3059866_gDNA_ID_1620342_Annot_ID_154021 3000 nt of promoter + ATG
ttgattcattatcaaatcaaacaagttcaccatagcttatagaggcttggttagaaatgcatggtaactttttgttttttaatgcaactttataggtgtatctggaaaggattttaaggagaccagagattgatgccttttcagaagaactaaggccacatcaggtatggactgtgaattaagatttagatgtagtttttggataacatctgagttggtaagtaggttcataacaagttattacactgttgatttcaacagaaagcatctttgcctgacaaatccactgttcttgaccgtgctatgattgagcataaccttcttagtgcaagcaaactctacacaaacataaggtatgagatgtcgaattagtatcttctttgtgtgtctagacttgtttgattttctcaactattttatatcctaggtttgatgaattgggaactctgttggcgattgatccaagaaaagcggagaagatagcagctaatatgattgggcaagaccgaatgaggggttccatagatcaggtaagcaataaaaaatactttgttggttgagctatgtaagagccctgaagagaattctcgttagtgttgattttctagaaggaggttcctagacgtgttttaatattttatgttactgttcaggaggaggctgtgattcattttgaggatgacgtggaggaactacaacaatgggatcaacaggttttctatctctccctcccactctttgtctctttagagcaactatatatgattgtttgttttattggcgtggaatatgactgaaaagtggaatctgtgcagatatcgggattatgccaagctctcaatgacattctggatgggatggccaagaaaggcatgtctgttcctgtctgattgactcccaagccgtgagatcgcctcatgatgattaatttgtattagccgagcaacggatcgagtctcatgccaaagtttttgccaaattgctgtgttttggggacagtcattttcaccttatttactttcttgcaaattcatgtctatgtctttaggttaattgattcagagaggaaaagattaggcattgaatgaggatttttaagaaagttgaaaagaggttcagggtacatttttacctcagaacaaattattttatgcatagatgaacctttcttgtgcaagagaatgatgaaactagtagttttttttttttttttggctcaacaacaacttctcatttaccaaacggtgattacacagagtctgaatacacacaatcttttatccaagccggcacctttagaatacattttaggatcataattcaataaagaaagagattccctagcaattctatctgccacactgtttccttcacgctttatatgcatcaccttcacctcctcaaattgttggaatatatgtctaatgtcctgaattcttggggccaaatttggataatcagtatcatcccctaacagagacactagatgttgggaatctgattcaaagatgactttcttatagttaaatcttgacattgaaagagctgcccatctcatagcttcaagttccacttccaacactgtctgaactctcgggattgcacgaagtcccagccacaacattttcccctcatgatttctcagatgaaactagtagttacatataacattttcccattcgttgtttaatttttattcttgaacgatcaaaacttatgcgaatttaagaaatgatcaatgataacagacgaaactgctagtaataataatgagaaactgttgcaacaaaatttcggaagattcgcaagaaccgactagtaaaatgtgttgcaacaccaaacaattgaagtgaaacttagctaagtagtgtaaagaagagactacatttcaaggttccatgtagtttctgcggtcaatttcggcgttttcagttcatccgcaagattcacagacgcacatacctgttgaaacaagaaaataaagcccatcaacgaccaaaacacatggaatttctaaagttcgtaaagcggtaaagcttcttcacgacatagttgttgctcaaaagaaagcaaatccaatgtctaaatatgattgccaatacacagaacaatctaaaattactgattatgatgcagcaaagaatacatgaactatcctaacccaaagatgatgccttattgtcaagaagctatgcatcccatgtaggtagcagtttcatctatcaaatcaattctatttctaccaggtttaagtcactgatatcaccgtttaactttaaagaactaagattgtcatcaaaatatagtaaacgatatgaactttcgactgaaaatgttctttcttaccttgaatccacttgctttgttgttccttgaccattccatacccaacaacttactagacgtctgataagttgccctcacattatcaccactataaaatcttcgagaaaccgcaaaatcccatgtatttttcgccaagtcataacacggctcgaacgtagctaaccctccatgagcataggtatacttaatcttacagttgtttgtcccaaccatgtggttagcagagagtttgtttgcagaatcaatcacaaggctcccatcgacaattgttctgttatcagctctgctatgaatgtaagtcaaattcaaaggcttctctgcaattcttactgtgttcatgaactgaaacctaacatcctgtaaaccaaaatcaccaacatagttaagcacatagattcttaaatgtctgcctgcaaatctctttaaacttgtggagaatctaaaaaccctaaactccagaatcctaaatcctacttcaattcaagcattagctgcgtaatttctaggtttgtttgctttgacttgaatcctaggtttaatcgtaagcaatcaatctcatttccatgggaattgaaaaatttctaagatttgtttgctttgactcaaatcaaaagagttgttctgacctttttagggacgttgtactcgacgatg

SEQ ID NO: 964 - DNA, 3000 bp, Unknown
  misc_feature (1)..( 3000): cDNA_ID_3059857_gDNA_ID_1620342_Annot_ID_154025 3000 nt of promoter + ATG
taaagaattccgcaaatccaaaataagcaacacaaaagaacatagagaggaaactaaaacaaaattctgctcaatgccacacacctcattccagaatccagatcaattccactcaacatctgtgctgcttttgaccattcctgctctgattcatacaaacccgcaagtttttctctgataacaagtgcctgcaaatacaccacaaacagtttcatctcttagaataaagagattgaaaaacaacacaacgtacattgtctcagttatcccaaaatacagcatccttagtaaacaaatatctcaaattagctttcagtgtagatttcacataccaaagcggtacaatagcaaagcgactctacatacctctcaacttatgttaagtaggtaaactaattagggtttaaaaagtacacgattgctgctaaacagtaaggtatcacgaagagaaaacaaacctgttcctcaaaggaaacaactctaggctgaatctgggtaagagtaaattgagcaatctccttctgcgtctccggttctaatctcccaagctcttgtgcgaaagactgcaaaagctgcctcgaaaccaccaacgggacatcatcggaaagaactggaaaaattgtgaggaagcaaaaatcaaaatcaaaccagaaattctgatataaaccgaattccataagaacaaaaagcagttgtcgaatctcttatgaagttgaaaccatgagaaagaagggagatgcgaaattactgtgatcgatgaatctctgagcttggagaagatcgttggaagagagaacagaggagaggatgagtttgtactgttcgattttctggcgttggtcaccgattgcagaagcgttcgtcaaagcttcatccatggcttctcttctgagattttctctcccgcttcgattgaaaccctaagaaaccttacaaggttttgatttctctctcgctttttttttttttttttttggagtttgctctctttttatattaaaaaaataaacggggactagattctgtgccggtgatcggagaggcgctttacaaaatttacttaatatggtcacaactcatatgagattagtacccaaaataaattaaaatatatatatatatatattaagcataaatactatatttttttttgttagttcataaattttataattaatttgtgatggtaagtttaccaaattgattgtagattaaaaaaaaaaatcaacaaataatatattgtttagaaatatttttatatgtgagcctaaattactacagtaaatcttttacacaaataaaaaaacacgtcgtgatttggaaaacacgatgatgaggtattttatgatgacaataccacgtttaatattatgataccagatcggaaaaagatgatatgttatgtgttttagagcttagggagcaatttaagatggaaacgtaaataattatttgttgagaaagaatcgactagaagcaatcgaaaaattgatcgaatggtcaagatatgaccgagaagtcatcggaaaagttgtgagcccaaatcttgagagcaatgacatgcaaaatgttttgaaagtgctctcatgaattaaaagtgaaaaaagaaccactctctcgttacatagagggtagtatataaagaaatttacctatctcagactaggaaaccaagtctcgcattggaatacgactttggtttaaacatgtgagctgactgacaaatcgattttatgtgctttacaacttagatataactgaacatattggtattggatgaggttggacgatagactcatagacacaatcgttgtctcgaaaaatcacgagtttctctcgcttaaaggattttttttgatgaagtttatggtgatcccgttcgagaacatcacaattgtttttgaatcaactttacagatccatattgtaactaatgattatagactacatagtttaccaaaattacatttactcaaaagaacagatgcggttgttgatggcaaaacttttttggaatggtagacatcccattgaaagaaaacaaattgccatggtatggaattcatgataatgatttaactcgttatagtctggacaaattgtcatggtagggtttcattgctctttctttgggtagttacctcaagatatctctttgttcttccttgtgatagttccaccttgatatgtacaaccccacattaatctgctcatttcaacattaattttctctattgtttttaaattgtgtgtataagattatttcactaactaggaaaacaatccatttctttgacacatgggctttacttaaacaaaagcccaataacttgtgtttagaagtcacatgatcaaatctcaagacctattataaattaacaaatttcatattgataaattttaaaagatttcctattacaatatttaaagttgctacaaattatagattcttttgatcttttctgatattgtttctcaaataaaatataggaataccaaattacaatatgaaagttgcttcaaattatagattcttttctgattttgtttctcaaataaaatataggactgaactaccaaaggcaataatattcaatgtgaccaacaaaaaaaaaataaaaaataaaaagaaatactcaaatctcataacctttttgactaaatatatcaatttcttctattttcaatgagcataaattacacgcgtcctcagaagctgaatccgatttgcaattcttcaatctcaaccgttagatcaacaaatccggcatcgaattcctccgcgtggtttggtccatttttttaatttgagtattaattcttttcctatttgacaacatgttttattaattattattattattccatttgcattaaaatataataaaaagatgtaagattctctccgcctccttctctctataagaaccgacacagagacgaagaagaataatcactcgaaaactcatcaaatcaaaaatcaaacacagagaagagaaa

SEQ ID NO: 965 - DNA, 40 bp, Unknown
  misc_feature (1)..( 40): cDNA_ID_4359773_gDNA_ID_1620342_Annot_ID_154028 3000 nt of promoter + ATG
ctatctgtagaagaagcagatacagaattcagaaacgatg

SEQ ID NO: 966 - DNA, 3000 bp, Unknown
  misc_feature (1)..( 3000): cDNA_ID_2128873_gDNA_ID_1620342_Annot_ID_154026 3000 nt of promoter + ATG
ttttccttacattgctgagatagtgaatgttgcttttcatatgtaagtttctcaccaaatgtttccttggtccaaaaaaagggattcaatggtgctgatctgcgtaacatatgcacggaagctggaatgtttgcaatccgagcagagcgggattatgtgatccatgaagatttcatgaaggtatgcatatatattatgcatgagaataggttaaatcatgttgtaatcttggttgtgatatggaaatgaaccaactttttgcaggcggtgagaaagctgagtgaggccaagaaactggagtccagttcgcactataacgctgattttggaaaagagtgagagagtacacactctttcttgtgctttagggatgaagaaaggacattgcaatgactgtctcgtattctttattagcaatgtgaaacttgtttttttaactctttcaaaagcaaagcttgttgtgaagtgtgtgcttagttactacgtttcagtaatttagtgcttcaaacaagcatttacctcttttctcgttggtactgtggcttaaatattgttgcttctggaccctgattaacatcaattagtccaaatcaaaagaattgcaaacatcaactgaaccaattatttcagtcaaatagtatgaaacaaacaaaaatttcttaaacatctctatagtacacgttaatatattttgttcattaaatcttacttggatcagttcaaataaaatcggacttttacactggatacttctgtatttaacaatataaatattcataagatttggttaagatttaaaactttgaatctcttatcatttttgtttgattttgttttaactgttttaaaccatcatatagtatataaagttaagaaaaaacttttttttctacatatattgtgattcgaaattttgaaaacggacatatattaattgataaacgaaaaatatatggatttaagctaaaatgtttaaatctgatgacaagaaaaagaaaaaaaaaagctaacatgtttaggggatgattcaaaatcatatcataaataagatcaacattaataaaataatttttgagtgggacgtgtttgacggtatcttacttaataacaattgtaaactataaaatataaatattttataaataaaaacaatttgcaaacttttatatatactaactttaggaaaaaaaattgtctcactcatgatgtacctttattataaaaacataaaattaattaagtaatgatattttcgatttttttctagcgcaataagaatagaattaccgtaaaaaaataaaaataagattaggattaaattagctaggacaactttttcaaaaagaaaattaacatgccgaaatcatgaacgtcgtaaatcatcaaacagctaggattcgttgtatcatacacttaaaatgattagagagttgatctattactctagagtttacttgcaatgatctcaaacataaaaatattaaaacgtttatttgattccctatgcaatgaaaagtgaagatctttatgattagcacggaattttccaagcttaacttttgacttttgtctccctaatcattcattaataaccacttcatgtctttataaaaagcaccccgtacgaagttcttcactcaaagctcctcataccatagtatattttgagctttctaatcacatagtaataattttgaaaatggcgatcctaactcccgtcattaaactcgttgtttttaggcaaagtctacgaccacattctgctattgcattcctcgttgagtttctttgcttcgtcttagaattactcgacaaggagaaagatctagccaaaatattcggtatcgtatgtgcttgcgacacattaatcttcactttgctcgatcttatccaaagtttgatcgaggaagaagtgaaaatacaaagatgcggccgagtgttttggctttacacaaacgatgggagcctctattggcacacattaaacgcatatcttttgatgttatgcattgtccacgtcatcggttccacgatctcttacgtttctcataaacattatctagtcttgctcccgcttttcgcagccggactcgaactcgtcccacaagaagcctatcgagttcttggaccggatcaagagtctggaaattctattgagcctcttaatggtccattaaatggtattgagcttgaacaaggaatggttgttcatgttgagcctcttcaagagccactagatggtattgagctagagcaagaactcgtcccacaagaaaccaatcgggttcttggaccggaccaagagtcacaaaactgtatcggggctcttaatgacccatcagatggaaaagaccaaaaccttcaagatgatattgtgctagatcaagagtcacaagattgtattattgcacctcatcaatgtccattagatggtattgacctacaacaagaaacggtagttcacgttgagcctcttcaagacccactagatggtattgagctagagcaagaagtggctattcatgttgggccaaatgatgacccataaactattagaagcctactatagaatgaaagctgaaacattatatagatggagacgtatgtttaatgtaatgtactttgtcttaaaaacttatgtacttatgatcgtacgactttggtagctacaatgtaagagaatctttgttacaaaaaaaaatctataaataaaatcgactcttcaatgtcccgtggagtcagtgaaggataaacgacacgtgtgaacacgaaggaagattaatagccgtccgatgaaaatggttaattttgtaattttgactctttcacgtgtgccctttcctcaccccgaaaaatatttttatttccttttgtttacactttttgatttcattttcaataataataatattcgagtagaagaagaaagatccagacaaaagcttaagcaagacctctctgtcttcgtctctctctctctctctctttgtctccgccatg

SEQ ID NO: 967 - DNA, 3000 bp, Unknown
  misc_feature (1)..( 3000): cDNA_ID_4359722_gDNA_ID_1620342_Annot_ID_154022 3000 nt of promoter + ATG
aattgaaattccaaactatttttaagtatgaaataaatttattttttaaaatataagaagcctaactcacattgtatctaaaacatattatttatttttaaaaaatctttttttttctaacaataatcttaattaaaaagactaataaatgttagtaaaaatgtattggacatacaactaattgaaaggatttcaaagtttctctagactaatatgaggttcacaagagcaaatagataaatttagaatatcaagtatagttttgctataagatttatgttaaagatacaactatcacacctagacaaaatttaaaagcatatcatttgaaattgcatatgagctaaaacttatagtaaatatataccgatcaatagaattaaagaaaaaatgctttaaatttatatattaacgaaggattcaagttgtttacgtaaaaaaagaagaaggattcaagttaaatggtaaagacacatatagatatctaactagttttatcactaatcattagatatgatttgatactaactaagatacgtgtgaactaactgatccataagaaaatacaatttttgctaaatttttaaaattagaggatttaatagatattatctttaaatttgtctcacccttcaatttttcaattttgcattgaaattcgaattaaaattttgtaaatatgcttgcttatttgtgtgagctattggtctaaggtcattaaattatagtataatgataaagattgtaaattaatctttcctgaatttttaaaatgaagatctataaatgctttgaaaaaaagttaaactttgttgaattatgaacaacatactactctaattagaaagcaaatacaaaaaataaattccctaaaaataatatttagagctcctcttaataattaagtattgaaatattctttcactattcataagaaactatgttttaagttcaaatagaaaatcacaaatttatgttatattttttgagaacaaaattcgttttggatgaaattgtagtaaagtgaaaatatataagtttgtgtgaagaaatcagtaataacagaaaatatcaatttattggctcaaaatagtaaaagcattccatatttgaagcacttttggaaattgagacacaatgtttccacaagtcatcactcttcttcaagtattctctttcgtgggcaattaacatgggtttatctgcaatatatttaataagcgtatcgtgacacatttttccttctttgacgagatccttgcaacaagggtcaggcatggttccattttcaaacacagcagcgattatatccaaagcacacttaggagtgattttaacaaaacaagtattccataataatgttgcttcagcttcttcgactgagaaagccggaacaaacgcacacaccaaagctaaaacaatgaacaatgtagtaatctgagtgttaaatttagacatatctacttatggttgaaatatacaagaaatattcttattttactaaagaaatcgtaagaaagaatgattagtatttgttatttaaaaaatggggtaatctaacttttatataggaaatcaaaatcacaacgtaacttctaaaaaaaccaaaaaagattaacgttatatttaatggcaattaaaattttgacaaataaatatactaccaaacttaaatttaatagtttctattaacgttgcaaaattaaacaaaaaaaaaccctaaatacatgtaacaatatccaattcaatagatagaagaaagcaatggttaacttttttatattttgatatctaacaccaaatagttaatgggtataaggttcaaattgacatattttatggtattcagccaaataaattttaatttcaaactattttaagtataaaataaatttatttttaaaaatataagaaacataactcacattgtatctaaaacgtattatttatttttaaaaactttttttctaataataattttaatcgaaagactaataaatgttagtaaaaatgtattcgagatttaacttattgaaaggatttcaaagtttctctagactaaatttaaaaatattaagtataaggttcacaagagcaaataaataaatttaaaatattaaatatagttttgctataaatctgttgagaatataactatcaaataacatattatttgaacttgcacatgagctcaaacttatagcaaatatataccgatcaatagaattaagatcaaatctttgatgaaaagatcgaacttttgatgattccatcaggactccaattcgcaaaagtgctacttcgcacacgtgccaactcgcacaagtgccacttcacacacgtgccaactcgcacatgcgaacgaagaacacgcaacggagaataataaacaccgtcagcttttatcgtcatttttcgccgctctcaccgaacctctgctttctctctctctctctctctctctctctctctctctctctctctctctctctatctctactgtgcgaaaatggcgatgaaggcttctatcaaaggcaagtacgatactgacaaaaccagtggaatcggttcacttgctttcaacgccggcgatattaagctacgcgccaccatgaccgatgctactctcgtcgccggtcctactttgaccggtctcgctctcgctgtagagaagcctggttccttcatcgtcgagtacaacgtccctaaaaaggtcagaacaactcttttgatttgagtcaaagcaaacaaatcttagaaatttttcaattcccatggaaatgagattgattgcttacgattaaacctaggattcaagtcaaagcaaacaaacctagaaattacgcagctaatgcttgaattgaagtaggatttaggattctggagtttagggtttttagattctccacaagtttaaagagatttgcaggcagacatttaagaatctatgtgcttaactatgttggtgattttggtttacaggatgttaggtttcagttc

SEQ ID NO: 968 - DNA, 3000 bp, Unknown
  misc_feature (1)..( 3000): cDNA_ID_2128857_gDNA_ID_1620342_Annot_ID_154018 3000 nt of promoter + ATG
gcaatcaatttctttattattttctgaactgtaaataataaggttcatccccttaaataaattttatcttcttgaaacgtttttttaagaagaaatttcattctattcatacataatatttttatattttaagaaaaatcattttaaatttaatgttttgtttaaattttataaaatccaaatatggttgcacattttaactttgatatatggaaattaaagtaatttcatatacccctgaaagcataatttaattttaatttttgaaaagtatttgaatattaaaatttgttttgggatgtgaaatgtttttgaaggcatatgttgatttcattgtgaaaatcaaagtgtctttgtttaattagtgaaaccacacacatgattataaccatcttactttgagagattcgaagaagagagaatttctatataatgttgtaattgatcatgatttaaatgagtttttatatacattttaaaatgatttggtttagagggttacttctctaatttttagagagagaattgaattactcaatatggtagagaaaattttggtcaagagtgaaatttttatatctaagttcgaccatctttggaaaaaaaacacatttgtctgaaaagtgtgttagttgggttttggctaaattctaactggtttacatggtagttagaaatgcaggcggtctgattatccatgaaattcggaaaacactccaaacttgggacaaactttatggtggtctttcggagagaagtctactataaaacaggtgcaattctaccgaccagatcagctgatagggtttatcaaaaaaaaaattaattttaaaactttataaaagctacttgtctacaattcttgataaaagatgaagcattggataagctgctaatcaaagctcaccagtaaaaaatgatcatagacaaaaaaaagtggatggaacatctgaagcacatgcactagaagtagcaaatgaatctttcggattatgcgcatgagcttattctttggatctagctattatatagctcattggatatcaatggccataacgaaatagtaaatcacattggtggtccaatagtagcaagttaaagttcaaaaagaaggaggacggaaaaattttcacaaacctgcatggaaaatttattgatcttctcctctttgttaacaatggaacccatgttacgactcatatgccatgattctttggatctggttgtggtagagcttatcattgtatatttcatctgtggtttcagaatatggttggtagttgaattagatgttaacgaaccacatgcattttaccttgacggaatttgataaatcactttctcataggggctaacatttttatatctgagtcaatcatatggcataagttggcttgcacaacaaggtgtattagttactccaagtaatatactatgaccaaaccacgccaacaaacctcgtcctccgccaaactagagccacaaatacatcgatgggaaccataccgccgtcgacggaggggagtacctactcactcatgaaacttctttaagaaatcttgacatgcgatgaaaatcaaagagaaccaaagaaactagacctaaaaaacttcttcaagcgagagaaaaaactcaaaatttgatctaatgattgtctccaccataatactgtttaagcctttaaattttaagctttaatattctttgaccgtttatcatcaattataactaataagtaataactaatgctcatacaatcgttgtaagtcaatcacattctctcttatcgcttccaagcttaacctttgacataattctatgaaacagaggtattagctctcaaattttgaggctcattttatgtagatttgttagtgttttttttttaatgaattttctaggctctataattaaccaaagttttcataattagtaaaatagaccccaaattaacaaaatatccaaaattagccaaaaaaaacataattagcaaaaagtcccaaaattaagaaaaaacagtaaataaaaattatgaatctcccataattaacaaaataattaataaaagtaaagtttacttttaaaaaaggcccaatttttttttcctattcagcctggattttataagaccggctacgatcgcttctattcaccttcattgtaaaccgataaaacaatcatatatatatatatatatatataattttggcacaacaatcatatattaaaccgatagttttttttttggtgtgtttgagatgggtatcaattgttatcttaaaaggaacctagaagtaaatttcgtgacctttacacaccacacatgttgacgtagatacgcccaaacgcatgtggtgttgtatcaagacacaaagtcacaaactgtctaaaaagtcaaaacccaatccaaaaccatcatcatgttttcggcttctttaaaatcccggtttagggttctttcgtagcaacatagagtagacggtcctgactcgtgctctgcctctttaatttccggtttagtactctttcgtagtaagtagaaactctatccatatagacccaaagaagggccactcttctattctcaaaggactcggtaaaaaaacaaatgcgaacgagacaacaaaaacaagtaagaacactctacgcgctccctccaatgcgcgtaaaccccacgtgagactgatatccaaagacaagtgagttaaacgctctgtttaagcgcgtgcgttcagacacaaagtggataatcatggggaaactgtctaaccctaaagaaaaaaaagagaaagatttctaattttttttaatagctaaccaaaagagatggagaatgctaaaatacgctagatatgaaatagtagcttaacctacgccgtattttagtcgttcctctcttttaaacctacgttcctcgtcaccgtaatcgctctcgctctctctcttcttcgtcgcttcatctttctctctctctttgtaacttcgaaaccgatcaaatcc

SEQ ID NO: 969 - DNA, 3000 bp, Unknown
  misc_feature (1)..( 3000): cDNA_ID_3059887_gDNA_ID_1620342_Annot_ID_154013 3000 nt of promoter + ATG
cgtccaattatttaacttatctaatagcatgatcatgcatgatttccattgattattaaatcatgaaataattgtgttggacttataatctctatgtttttattaaatgtggcacagatggacttattaggtttctacagctgttggaatggtgagactaattcccttttttttttatattattgatgaataattaacttaatgggtccgaagaaggcaaataccacgtgaaaacactgtctgaaatgtgcaatatattatttttcttaactaaaaagaatttgattccaataataatactcaaatcaatgatagaccaaaaaactttatatttagttcaatttatatattgtctttcctaaaaatcaatttataaaaagattaaattctcttacctttttgcctctaaattaaacataaaattacgactagaaattttatgtttgtatcttttaaatagttgtctatgtgtgctaaaatatttaaaatttttagagacaataacctcaaattctctagaatttaaattttcctaaaatacttcatatacagttttttttttcatttttttcatatacagttttaagatcaaattcatttttctatttatattatataaacaaaaaaaattaatttattttttcttccttggtttttaggttaccagaaacaaagatcaacggaggtgattgttataaaggacacaagtacagatccaaacctcatcatcgttagtttcagaggcactgatcctttcgatgccgatgattggtgtacagacctggatctctcttggtaattttagtttcttttgttataatttatttccacacacaaacagtctaggtttttgtttttatactctttaagttcatcctttagcccccctaataaaactagtattgatttccaaaataggtacgaggttaagaatgtgggaaagattcatggcgggttcatgaaagctttgggccttcaaaaagaaggatggcctaaagaagtaaaccttgacgaaacccaaaacgcaacaactctatatgcatactacactgttaggcgtcacttaaaagaaatcctcgaccaaaacccgacatctaaatttatattgaccggacatagcctaggtggggctttagcgatcctattcacggctgttttggtgatgcatgatgaggagcaaatgctagagagactagaaggagtttacacatttggacagccacgcgtaggcgacgaggagtttggaaatttcatgaaagattcactaaagaagtttgacgtgaagtatgaaagatatgtttattgcaacgacatggttcctaggttgcctttcgacgacaaaacactcatgtttaaacactttggggcatgcctttactatgacagtttctataaaggaaaggttggttgcatatatatgacaatcttgtttctttgctttaatcactcatccgtctaatgtcgcttacgcacttaccctactgatgatatctatctacattgttgttgtttaatttgtattatgttcaggtagaggaagaggaaccaaacaaaaactactttaatctcgtatgggttttaccaaagataatgaatgcactgtgggagttgatacgtagtttcgtcatgccttattggaaaggtggagagttcagagaaggatggttcttaaggtgttttagggttgttgcattgttgattcctggattacctgctcacttccctaatgagtacatcaatgttactcttttaggtgacttacctgactcgcatcttgattaaattttgacgaagtcataaattcttttgaaaagttgatgtgtttagcttttctagggtctcgtttcggtgatgtaggtgttattttcttattttggccttagatcatcctttctttctcgcaatgattctacgtctcactttatctttatctgcatcaagaaaagaaatgcataaatatttcaataaatacttagtgaaacgattctcttacctgcgagttatacacacaagcaaaccaatataacaatcaacaaataaatcatgaaataaatcaaaccaatgaacaatcatccattgacacaaccatctcgggggattgaataatggtaccaaaaatactgcctatacatacaacaaataaatcacacaatctcaattgcttagataatctcatggtcacatacccacctcgaaacaagaatgattttgaaaccaaaaacaacaatcccacaacgagcagtaacttcctactcaccaacaatatctcaactcaccatacatccaactacaacagcaaaccaacctttaacctaaattggaaaaaatctgaaaataacccaaacaattggtctcaaatattgagtcacgaatcgcaatctaaccgtccaattcaaatctccaccgttgaaactcaaccctcaagatgtcctgaagctaacctcaaagtttagtgatgatctgaccgcaggtgcactcgagataatttgtttaatacactctggtctaaatcacgtctgaaacagaggactttacgaaaacacagataacttttagaatattaactcaaatccaaatccgcaaagtggtaaatctagttataaggcttagctacaactcaataaaatttccgtaccatagaaggctatttgattgatcaaacctctgttctaccacgacatatctgatatgtctctctcttccttcaccaaaattatcaagtagtttcctttttggtgttttttacataatatttttgatatcaaaccaaattttttcttgtctttatacagaattttctgaaaaaaaatgttacataatctcttttacgcaattatcatcccatcatggagtagatataatatttgtaacaaaatatagtttacataaaaatcataaatagtttgacaaaaaaacaaagaacaaaaaaaaagaagaagagaaaaatcataaatcctgtcagaagtaccggagcgagcctgactggagaaatcgagaatg

SEQ ID NO: 970 - DNA, 3000 bp, Unknown
  misc_feature (1)..( 3000): cDNA_ID_1013653_gDNA_ID_1620342_Annot_ID_154006 3000 nt of promoter + ATG
gcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaaggtattagtttatcaaaaatgtgtttctttcctctgtttagatatgttgtttctattctaaatttgtcttgtgatgttttaaagcagaggtatcggatcagaactttgttaacgaaggaataaaaggcgaaaacggaagctcgaagaagatgaagacggtgatgatgagtgaatcgtcgagtaccgatcaggtaacttcttcctccactattagtttgatcatattagtgaatgtggtgagttattgatccaaaatgtttccttggcataggttgttccactcaataaactcttgcaacatgacgtaaatttgaagtctgtttcttgagaggtcagatggtgaagctttatatgaggagagaattttgtaatgtatatatatttgcataacttataagtcaaatttactatccttagttacaagtttcttcatcatatatccctaactataaatatatttatatgctcatgtgagtggattcatttgtactgtaaaacccttagaaagacgtcaaattagtatttgatggtttagtgttgtcttgttaccactatagtataaaatttcaagttccttaattttcttttatgttgcccatacaataaaaatggtggtcgaataaaggtaaaagataataaaaaataattgagccggttattatacaaacggtgttgtttggataaagctaattggctaagggttgtgtatgtgttggaatcaaaccttgattaatttcgaagaagaatctaggaatgagaaaagaaagtgaagaggatcaaaaaaaaaaaaaaaaaaaaaaagagaagaagagaagaagaaggtgtctcagaagagtcgatcgcgagagtgagggagaagagtgctttgggccattaagttgaatcagcccactatgttagtgggttgactttgatgataaagttatatttttttcttattattatacaaagttgggtttgttatatttaacaccaaaaatagaaaacattttttaaccatatcggaaaaataaaatatataggttgtttatatattcaaatttttattttaatatagtaaactattaaagtaattttaccaaaaaagttaatatattcaaaacataagtaaaaatttggtttcgaatgtataaaattgaaatttgattttttaaaatatatagattattatttagaatctaagtatcagaaaaagaaaatttatttatttttcacacctcctatttatcggacattaactagtcaatttaataatcgttcatagattttgtgttacgacatatttaaaagatttatgaaaacaattttaagttctgaacattgcaaggctaaattaagtatggactcaatgtttcaaattgttattcatcagatttaaagaatgagtaaattttgaatacaaatatgactcttttattaatgtatcatcatgtttttttttttttttgagtataacatgtaaagtaagctaaaagtttaaaaaataaattaaaaagaaaaaaacaaatatttttaaaatatattaaagctctattttggtgtcggaggagttgcaccagcaattcttgaacattgttcctttagcattggaggaaaaagcggaatgaatggaattttgggcatacaattggcttcagcatccaaaaatgctttgcaacaagccggacctaaattaccgaattttccaatgaaaatagattgagaaatttctgtaatgcatctgggaatatccatcacggatgacaaacattttgttatgtcaagtaatcctggcataccaggaatcggttggaacggaaatggaaaaggaaacggaccaggaatctgtggcaattgagcatttacagaaacaatgatgcataaaaccgcaagaagtgaaagcacatttttgatagacataacgagaaattgaataaaaaaccttagtataaccaaatatatgcttaatgcatgttctgtttgtttttattgataaacaacaattaaatctttgcttatttataagaaatgaaatgtgaaattgtgatctgaattatcttagtttaacgtctcagaaatgttttaattaggtctttaattagtcgttttataaattcaaatagagctgaaactccataaaactacaacatttaggaaataaaagtataatcggtttcacataataaatcaatgaacgcaaacaccttttccactaaaaatacaacattacaaggcaaaaggcccatacggccaaaagcccaaaagcatgaaatcaaacacaaacctgcgagaacgaacaaacagaacaacaatcctcctgaaactaatcttttcttcttcgtttttttttactagtccttttaagtactgtcccaaagctttctaattgatgtcaaagcaaatcacaccaaataactagataagtaacatttgctttttaaatacaatacatacatagttattcaatcttcattgaaaaagttggttttataattaggggaactaacaaatattaggacaaaatcgcaatttgcagaagatgaaaaaaaaaattactgttgtttggtttctggtcaacataattagtctgctaaatctccccaaaatagaaacagatagaaaaacagtaatcatgaggtaagaataagcaaatagggaagcgtgccagtctctaacaaaaatctcaatctttccatacttatcgatcacgtcacctcctttgtctctattacctaactccatccttaaaaatccaatctttcacctttcttctccgagatttcactacactgcgcaataaaaaaatg

SEQ ID NO: 971 - DNA, 3000 bp, Unknown
  misc_feature (1)..( 3000): cDNA_ID_3059853_gDNA_ID_1620342_Annot_ID_154001 3000 nt of promoter + ATG
aaatatatttacccgatcattccataagtttttatcgaacccttaaattcaataatgtaactagtgacacataccaaaaaacggtcacacaagatcttataaatttaagagatattattagaataagtaaaatttatacgaaaagtgaaaatagatatttaaaaattaaatcatatgagaactaatacgcaattgcaccattaaaccattcttcttaattttgaaagtcattttcctcgatgtatacttaactaagtgttttattttctccctcttagtatgtgtatatatatagtacggtgttgtcatcttcatcgatcaacttcaataataaattttagtacatccttagctaaaccagtactataccaaaattcaagagtcaatttttttgcttttttaaatagaagaaaattttatatatttctttgtttacatgaataatttctaacaatcccattaactttgactagtaagaattaatttgaataataatagtatatatacatatatatataaatatatatttgtttgtttacgtgaataatttctaacaatcccattaactttgactagtaagaattaatttgaaaaacaataatatatatatattaaaagttatactaaaacttttaatatttgtaggaatgccctacagatataaaacatttatgccctttatttgttttttgcataatcaaaaaattaatagtatataaaagttatactaaaactttatagatttttttttttgaactttataagcattttgtaagcaaaaaaataggaaaaaaaaacaaaattatattttttaaatatacctctatttagatttttacctccaaaaccattcatcaaattcacgtaatcgagtttttcaaacataattgtcttaatggatagcaaagccaactcatttatttgattaataaaaacaaagtttttattttgtaatcaaagttcaagcaccttacattagaaagtctttgactttttttttgtaatcaaaattttagagtttaaggttttatttttcttaaatctaaaattttactaaactaaattcattaataagacattttattaatttaaaaagatgaaaaaaagatagtaaatgaaaagtttaacaaatataaatatatagaaaaatgcttataattgattttttttataacataaaagtcttaaaacttttttataaaaatatgctcctctactataatgtcctaagccgtggcttcacttgattgtgtagaatgtcgaacctggctacgaagcacctaataatgttagacattttgacgtggtaggagttgtgaaacgtctgactttttcttcaggcattggtattcctaaaaattatacatgtggccgcaaaactgcacttgttccgcccagagtatacaacacttgctaaagatgtaagtgagtttagtttaaattaattttatatcgtgtgaactaagatatcttaaaaataattatttcagtgaattccatccttttttttaagaaatttatcgtgggtcaaaatatatgagctctttttacaagggagtaatagatgtgatggtttgtaagactagaatagcgaaaggggagtttgttgcgttcgtgaagttgccttgctcaaaagtggaatctctatatgtctcattagacattttgctaatccaagcgaaacgaaaggtgcgtggtggtcgtcgtcttactgatcccgacacaaagttagctacgcatacgcgtttgttaatagattttgtagcttttgctcctcctaaatagtcttttgctcaaatgttacccacgttgaggaaaattgtagggtttaacagaaaattctaacggaacgttaactctgtttacgaaaatttcacggcatgtccgaattggcccagtcaataaaacttgaccattttatcaaagaataaaaaaaatatgatttaaataacatttcgaaagttcatgtttttttcgtcccaaatttaaaaattagcgattttttcaatatttttcccgtaaatcaaattatccgaaaagttttgattttgactttgctaaaagagaaaatctattttattttacaaattgatcgtgtaggaaactaattcaagttcaaagaatttggaaatctccaaattcgaagtgctgagagacattcaaagagcacatgaataatttatcctttttcaactttttcaaagctacaaattctgatctcactacaccaaccagattcggaaaaacatattatatcctaactattgagcatctacgttgcttatgtttagttcaaattttgacatcatcctagttgttcatttgatttaaatttttgatacctaatacagtaatactaatgccgattataatagagaaatatattactttggcatgttttaacgtgttgaaatgtgaaagtattttatatttttaccttttagacatgatcaaatgtttatttctcgaaagtggtaaacgacgaatattaaaaaaaattgtattaaaataaaatcgtaaaaaaatcagaaatttactaagtttaatctctgagtatatatgtgtgattatttgtggaaacgtattcagctattgtgttccgtctattcaatcattttactattccattcatagtcaaatcccagtgtttcaatcctaatcaaatttggatctcgaaccaaccttccaatacgttattagtacttacaagaaaggtgtagtagaaatttgccagtcggataagatcatgtcattcattcgacaaattcattgaccaagaccaagaccataagaaaaaaataattccaccaactcttgtttttttttgtcaaaacgtgaaccaccaactctttacttggtcaaaaggttatttggactttttaaaaactccaaagtagtataggataaacgaaaatttccaggttcaccaacctagacgtttgtctcctctcctgtctatatattcactcatgcaaggccaccagacctcattcttccaca

SEQ ID NO: 972 - DNA, 3000 bp, Unknown
  misc_feature (1)..( 3000): cDNA_ID_3059894_gDNA_ID_1620342_Annot_ID_154004 3000 nt of promoter + ATG
actaaccatttcaatctcttctctaacagaccgtaactcagaagtagccgagacttgcctcgctttagctacctcgagctgtgttttaacagcaacacttgcctcattagctacacctttctccatctcctcaacacgcatctgcgccagctctgaatcctgtttcgcttgttgctcttccttttccgctttctccaattctagtttcagctcctcgatgagtccctttgtgttctctaactcctccaacgcatcgtatttcgcttcttcagctaactcagcttctctcttgtactcaggcattgcttcttgtatcttctcaagctcttcatctaccatcttccgtctctgaaacacacattttcgtcaaaaccaagatctcaaataaacacaaatcatgtgaagaaacaaaagcttaactacaacctctatagtctgaatcttatgagctttccaatctgtgatcccaccaaacttagaaactgcttctctaaccgattcgaaaggtgaagctgtatcgataacaccaatcggagacccgaaacaaggcgattcgacagatctcggagaaccaaaacgaggtgattcgacagatctcggatacacaaatgctcgaggagaagcaggaactctaagacgaggagaagcaggcaaaatcctagcatcttcgataacatcggttcttgaatcttcagaaaacgaatcttgatgacttatcatcacccttggtgcaacataaaccttaggaggttcgttgataggacttgtctcacaatcttgaaatggattatgtaaatcttcatcgtcgaatgtcaagaagtcgatgtcattgaaagacgttggaccttcttcatcaccagcttcaccaatggcgttgagaaataaattaaggtcgtctgaatctttatcatcgcccaacattgtgatgattatgaactcagaaactggtcatgtgttgttcctgtttacatggtcaaaattcaaattcatcgcatttcttgtttcaaaaggatgattaatgaaaccaagaattggattagtcaatgtgagaatgagttttttcggacaacataccttaaatctgacaaaggagatacaaattgatgtctgattatgaggttgtaggagatagctacatcattagaatggaaatattttgaaggaaacaaacaagagaaacaatcagcttgcgatgtgacccgtcgagcattggaaaatagaaagattaacgaacggccaataataatgagcgtgaaacgtacgcgcctatatctctccttctccttcatttttttttgggttcattctttgaaaagtcggggtttgacatatttaattctttacaaacatgtatttatggggtaaaatggcatgtttataggtattacatgtcgaggtagacacagtcgagtggcaaagttcattgcaatcagagttatgagaaaaagttgtggatgtttgagactaggcctaagttttatatctattatctgcggatatcaatattcgggttttgatctgaaaaaatagatatctagccaatcgtttacagacaataatagaacacactgtatagagtacttcccctcttttctcgaaatttcaaaggcccgttactcgacaacttaaatctgacaatagtcctcgtttaccctacatgtattatttagctctgtctgcttagattacgcttttatttgtctatttttttggctaaagacttcggtcaatccttactcgacagttccgtcctttcttagatgagctaagaccgaaattagttctcttgaatttcaccggaaagacggaatctttccagctcactctctcaaaattgaggtcaaagttttacaaatgaaataaataaaagtctatatattgaaaattaaccttcacgttcacaaaaaaaaaaaaaaaaaaaaaaaaaaaaaaaattaacttccacttctttctttaacgcttttgagagaaaaataagtttagaaaggttcgcttcaaagctcccatttgagtaagggtaatgataagtcatcctctctaatggagtaatgggtcacaaacatccgttataaacaactttgatttacgaacaaattgaagagttattttatactttttgaattttaagggtttggagaggaaaagcattgaacttgttgtgcaagtagaaaaagaaaaacactaggcaaattgttgggattgaaatactcactttcctataactagtagtaattaagaccatacttcatgtctttattttgaacctttgtttcgaagttatctcaaacctatatataccttactcatcttactaagaaaatgaggcttgtgtgtttttcaaccgcattcgcattgaaaactttgcaatatcttatatcaaatcacattgcataacttaatccactgcattagttgattcttattcagtttaatgagattaatatagtgatttagatattcgaacacctatatccactcttttagattgtaattttaaagctatatatcaaaaaattatacgatttttatctgaaccttcgtcgaaacattaattattgactaatgacaataaagaaaacaatttaatccaaataggcaaatacattgatctctttgcagattcacatttttaaaaaacattagtcgaaacattaattaatgacaataaattattcaaaaaaaaataaaaaaaaatagagtaagaagagaagaagggtgttgaattggatcactacgaaacgaaccccaccgaaacaaataatgtccggcggcaagaattaatgatgatcttcgtctctgtctcctcttccttctctggatctttcttacagaatatacctttttgcttcttcctctaatccatttctcctcttctccgtttctgggttattcaaagtttcgatttttattaacaaaccatgattgatcgatccacatcataaagtttcctaatttatctcaaagatcgtaactttcgttgacttttccgatcgaaatatg

SEQ ID NO: 973 - DNA, 1746 bp, Unknown
  misc_feature (1)..( 1746): cDNA_ID_2781324_gDNA_ID_1620343_Annot_ID_154045 3000 nt of promoter + ATG
gatctattctctaactgaccaatcaactatcaccaacgtgtaaacaagctaacacataagtttatggagttagagaatatcttctaccacttaaaaagaaaaagaacgaaaaacatggaagagaaatatcgaataaggaggagacagacaaaggaggcttctaaagataatgaaggtatatgcaaaagaggtttggtttatatagagagaggcttggaaattaggtcaatggtgtttattagtcggtcgatggaaataggcagaaattggaaataatataaaaaggcaattttctaagaaaagaaggaaatctgtttggtcagcgggcagctacccggtgaattaaacaattcagcaacttgtctgaaacaggcagcctcgagactcccacatgatcttcccggttcaatttggtttacaagtctaattgtattttagatttcggtttggtttgatttttcttctttttctttctcaagggcccatttagcatgatttctcgcaagtctactattggattaaccgattaagcattaggccgaagcctaggatcaaaattcagggtataaagatccatatatcgcttgactaagttgataaacatccgaccacaaccccttttaagtccaatgaaatcaagttgttagttaattcattgtgaaactagagattcaagttttggttccttcaaagatattcgatataaaagagaggacttcaagttttgagaacgtaattacatgtttcacgtcgtggttttcaaaaaaatgattataagaaatgttattttcgtgttgattgtatgatttgaagaaacaaaacatcatgtaaatctaaatgtaaagagcttttttatcttgaaaaaagttgataaaaaagttgtgaaagttctattcaaatgatttttttttttgttaagactatgttcttcaactcgttatttgactatttaaaatagaaaatcaattgtgatttaataaaaaaaaaaacttaatagtaatttctccgaaacgacgacgtttagaggtgttggtattaaaaaacctttgattaaccgcttgcctgcaatctgctctcctatctcttccaatctcctctcctctctatctatccgcgtccccatttcttcttccctctaaaattccaatctttcttattgcttttttttattcaaagcttcaagattttcactagggttctttccctttctcttattcgataaattctgttcttttctttcgtattctcacggacgaacaaaccccaaggcaacgagctcatgattgaggtccgttcttctgctctttccctctcagtttcttcgcagctgttttctaatttgcaatctattttatggatttggggtacttttgttaagggaacaaaacctatcattttccaggtttcttatggttgcgctttagattttatagtttagtgtaatttaatctgatttggggaattgggtgttggataagagtgttttgcagctgagaggattgaaaaattgaatatttatgatatttaagctcgctaatgaggttctcttacttcggattttgctcagcttcgctcctgtcaagtaatttttgttgtgatctatatatgaaatttccttttaatgttttatggtcgctacttgtgatttcatcatctttggaggttacaatcatcttattcaatcctttcttcggcctcagattgtggcttttgagtaaatgattcactgctcagctagagacaatg

SEQ ID NO: 974 - DNA, 3000 bp, Unknown
  misc_feature (1)..( 3000): cDNA_ID_2992740_gDNA_ID_1620343_Annot_ID_154076 3000 nt of promoter + ATG
tcttttggccggcaaaattagacatttgtaagatgaaatgaactgatataatctgaggttagagaaacttttggtatatagtttttttttcaacttatttaactggagtttaggcttaacaagttcccacataaaagcggaattagaattctaataagatacgaaaatacacgagccatggcttgggtcggtagaaacttcaatgccagtgttatggaaattgcattgttccttggtggcaccaaggttctggtaatacaagttcattgcgaacgacgcgtgatctcttaccgtgtttggttcaaagcaaggtccaccggaattgagcgctccacagtcacggaatcctccttcgtcgctgcaaacccaatctatattcgcttgcagttgcttatctgtcgctttgtcacccgctatgcaccatactcctttgttttcagcagcctgcgagaggtttcttggtgtcgagttcacggatacggtagatacgaggaggacgaagatgagcgtcaatgatagagacatcagttttgtgaccattatattattgcttatagattgatatttgttcacagactaaacattttatgtgtttgtgtcaatttatacgctaaatcaaaaggtgataagaagaaaagaaggtttggtcataatttatgcaaaaatgtgtaacttctcacttgtttgtttttcctcgtcatatatatatatattattaaaatttatttcttttgttatattataagtaaaatttaaaaggtataaaggaaaattcaatatagtttaatgcatcatttaagaaaatcacattttctagcaacgtaactgaaattttcaactttcttgactctttttttgtcacatccacgtaactgcaatgtaatccaactttcagtccacttgtctctaatcgataagccacagcatgtgctcctttccaatgtaatactctcgtgctaaagattccataccttctttttcataggattaatcgaaattttagcctatttttttttttgttacgagtccagcaagaaaaacctttcctattagcatcaggtttaatgtatattatcacctcaaaaaacttgaaatgctctttcaagatacataaagtcattttatgagttggatcttgcgtttatgaagtctttagccatcaatacaagtattgatctgatcatgtactaaaaatgattaattcatcaacaacatttgagaaatatgaagatgttctataagttgagaatatactccaatatatagttacatataaacttatacagagattagagatatttgatcaatatatagcattttcaacttatttggagattcggcttaaaaatctaccacacatacattaatcataagatatgaaaatacacgcgtcatggcttgggtctttagtaacttcagagccagaaccgttgaaagtgcattggtctttggttctaccaaggttctggtaatataagttcattacgtacgacgcgtggtctcgtagagtatttggttcatagcaaactccaccgggattgatctgtgtacaatcacggaatcctccttcgtagctgcaacaccaatctatattcgcttgtagctgctcatctgttgcttttttattcgctacacaccaatatcctttgttttcagctgccggtgaaaggttttctagtgttgaggtcacggagacggtagaaacaaggatgaagaggaggagtgtcaatgatagagacattgtttttgtttttgtgaccataattgcttgtatatgatttgttgtttgattgatattgttcaagagtaaatattctggatatgtgcttgtgtttatatatatactaagtcaaatggtgacaaactaaaaaataaggcaaaaggttttgtaaaaatttctatcattaaaaattaattttattttgttatatatattataaataaaaatctgaaagatagattaatactccctctatttcattaattatatttgtagtttaaggttttttcatacatattaaaaaaacacaaaaatctcatttagtttctctattttctataaaaacatcattaactacacctaattcaaccaataaaaaactatcctgtaaaatataattggccaaaatttattaaatgcatttaatttttgcatagataatgaaaacaacacttattttgtaaaaagtaaaaaagtccttaaactacatataatcagaaacagaggaaatatctaataaagtttaataaaccatttatgaatctgacccttcttttattttattttataaatacgatcttatcttatcttgataaaataagaaacatgataagtgttgtttgacacatcagatctattatgatgatgactttccgaccgatttccgatgaattctattcactggaaatcttcgactgattcaacgaattcaaatttcaacaagaatcagtcgaaatatcataacagaataatgacaaatgcgtaatcatcagacaaaaagtcgcaaattgacatttaagttaacttcatacacatagttgaagatccaaagatttgaagtttgaatgcgataaaaagaattgagtcttaaaactcttaatttgacattctacgttttaaacatgaatgatatttagttatttaccctcggtcaagatttgctaactatttgtaaaaatttcaaacttaagaatcgaacatcattcaaaattatataatgtgttacgagagatgcgagtggagagacaacttcagggtctaaattgcaaattttaataagtatattgctttttgaaactaaactatcaattattacacttttgagacacagtttctttctgattctcacttgtgtcgcttttataaaaaagataaaacgcaaattgatttcttcttattctgcttcggtcttcgtttttctttacccttttgatttgatcttctcttctcggttgaaattagggatttctgtaaaattgtaatgtgtttctgagtaaatc

SEQ ID NO: 975 - DNA, 3000 bp, Unknown
  misc_feature (1)..( 3000): cDNA_ID_3059934_gDNA_ID_1620343_Annot_ID_154072 3000 nt of promoter + ATG
aggagtttggggaaaaaggaagagtttttttggttggttcgagtgattatgaggttatttctgtatttgatttatgagttaatggtcgttttaatgttgtagatggcatcgggtgagggaattttgacggatggacagtggaaaaagcttgaaatagcaactcataattctggaagtttgtcatcatcgcctaaatctcatactctctttgctgatctgaacattaagtctcccactggtggcaaaggaccagttgctgggattcctaataggcatgtgcgacgtactcactcagggaagcatattcgtgttaagaagggtattaaactttcttcaaccttttgtgcttgttatttggctaatagatccttttagggagtgatatgactctttattagttcctttcaaatttgctttagtgaaaagacttaagttttcagtagaagagttcaagtgtgtaggtgatatatggtttacttatgtggcaatgatatctgcagagggtgctggtggcaaaggaacttggggaaagcttcttgacactgatgatggtgactcctgtattgataagaatgatcccaattacgatagtggagaggtactttcatatttgcgccttttgttttgtgttggatacttttccttgtttctttagtgtatctaacatcccttgattttatcttttattagtagtttgcttttttcattcatatactcaatttaacaggacgcatatgatggacttgttgattcaccggtatcagacccgttgaatgattacaaaaagtcagtagtttccatcattgacgaatactttagcaccggggatgtgaaagtggcggcatctgacctcagggaacttggttcaagcgaatatcatccttacttcaccaagcgacttgtttctatggccatggacagacacgataaggagaaggaaatggcttcagtgctactctctgcattgtatgctgatgttattttacctgatcaaattagggatggatttataagacttctcagatctgttgatgaccttgcggtggacatccttgatgctgttaatgtccttgcattgtttattgcacgggccatcgttgacgaaattctccctccggtttttctggttagatctaagaagattcttccagaatcttgcaaagggtttcaggttattgtaactgcagaaaagagctatctctcagctcctcaccatgcagaactagtggagaagaaatggggaggtagtactcacactacagtagaagaaacgaagaaaaagatatctgaaatcttgaaggaatacgtggaaaacggagacacttacgaagcttgtagatgcatcagggaattaggtgtctcgtttttccatcatgaggttgtgaagagggctttggttctggcgatggattctccaaccgctgagtcacttgtactaaagctgttgaaggaaactgctgaagaaggactgatcagttcgagtcaaatggtgaagggattcttccgagtagcagagagtctcgatgaccttgctctagatatcccatctgccaaaaagctgtttgattcgatagttccaaaggctatttctggaggctggctcgatgattcatttaagataacctctgatcaagatggagaaaaatcgagtcaagacggaaagctaagacagtacaagaaggatacagtgaacataattcaggaatatttcttatcagatgacattcctgagctaatccgcagtcttcaagatttaggggcacctgaatataacccggtgtttctgaagaggctcataactcttgctctagacaggaaaaacagagaaaaggaaatggcttcggttcttctttctgctcttcacatggagctattctcaactgaagatttcataaacggtttcattatgctcctggaatcggcagaagacacagctttagatatcatggacgcatcaaacgaacttgctctgtttttagctagagctgtgattgacgacgtcttagctccacttaaccttgaagatatctcaaccaagctgcctccaaaatcaaccggaaccgaaacagtccgctcagccaggtctcttatctccgccagacacgcaggagagagactcctaagaagctggggaggtggaaccggctggatagtggaagatgcaaaggacaaaatctcgaaactcctagaagaatacgaaacaggaggagtaacatcagaagcttgtcaatgtatccgcgatctagggatgccttttttcaaccacgaagtagtgaagaaagctttggtgatggcaatggagaagcagaatgatcggttactgaatctgcttgaggagtgttttggtgaaggattgattacaactaaccaaatgacgaaagggtttggtcgtgttaacgacagcctcgatgacttgtcgcttgatataccgaacgcgaaagagaagtttgagctgtatgctagtcatgccatggacaatggttggatccttcccgagtttgggatttctgcaactcagtgattagtggttctcttatcagtttcttgtgtttgtgcttacgatactttcctcactatctacatatatgtatggattcagttagtagataaacatgagatgtttatatgttcatgtgtttctgtctggttgttgtgttttgtctttgtactgatatcttttagtgtgttctaatttctgatggatttttgttacattgaaaataagttattagcatggttaatttgtgttaacttattactcttgtgatattttatgaaaattatttataaatatagaaaatatggtaattaaattataaaaagataaataaaaatatatttgttcggtcggtgagataattatgactccggttccgggatagagcaaacaaaaggatagaccaatactcgttgccaaacagctttatcctcgtttttatatttgttttgattctttcttcttctgctcaactttactgtccggcgtactcagcaccatca

SEQ ID NO: 976 - DNA, 2133 bp, Unknown
  misc_feature (1)..( 2133): cDNA_ID_2045194_gDNA_ID_1620343_Annot_ID_154080 3000 nt of promoter + ATG
catgacttgcatatttcacttattcgctacatttgcgtaagatgacgctgcctcatttttttttcatattcgattgacataattaatattcttgtgtgtttatctcaattgccaggagcattataaggatcttagtgctaaatcattctttcctaacctgattgagtacatcacttcaggtccagttgtgtgtatggtatgggtataactatgctctaatttgatttttacttgttttcaagttgtaattagatgagttaattgcatgtgatgttttaaacctggtaaaggcttgggaaggtgttggtgttgttgcttcagccaggaagctaatagggaaaacagatccgcttcaagctgaacctggtactataagaggagatcttgctgtgcaaaccggaaggttggacttctatcatctttaaaattgttggaagtaagcacttaaaataattctcatggtttgatatttttaaattatgcaatttgcaggaacattgtgcatggtagtgacagccctgaaaacggcaagcgtgagattggtgagatttcttgttttttgttcaaatcattcacccatctttcattgttgagacattgactatgtccagtttaggggcaaatcaacgtggttcaaactgcttcaaattaacttgataacataactagattagatcatacttgattactgaaattgttaggttcaatatatctgttttaaaccattactatcacttcttcatttacttagtttgaccaatcactctcattccttagtatgctaaacttttagttttcatttgctgacattttggctcttgtggttgtggcataggtctgtggttcaaagagggcgagctatgcaagtgggattcggctctagctacatggctaagggagtgatccttgagaagacagagtcaattataatggtgtccttacttgttttcttgttaccgatgatgagctttggtgttttgttcctgattttgggcggcaatataatataactgccaatctatggcttgattcttctcatatctgtgatcacttgtcatgtaatcaaaactagttacagattcatctgcatttggttctacgttacagacacctccaaaatcattcatcttcactctacaccgagcaatgaaaattttctaatctcaagctaaaagaacatacaaaagagtggctttacaaaacgcagatgctgcgtgattaagattgctcagatcagtgtaccggaatatcattccggtttacttctaagaccggttggtatatggaatctcaatgtcctcaggaggaagttcccagtgatcgtcttgttcgtcttctctggatgcatttctgttgtgcttgcggatctctgaagttgatagtggttttggtttagggtttggtctcctgtaaaatcaaaatctattgactcaacttctccaagtgtttttcgaaagaaagaagaaaaagtgaaaaaaaaatctgaccttttccgatacttcttcgcagcttctttggtcttccgcgtcttcttctccagagagctctcgaagaagcgtcgtcttcgagattcctgcaacacacccgctctgaaacacgacctcttgaaatcgttaaccagctgctcctccgattcgccgtctttaggcaccacctcgacgttgtagtaactggacttgaagaatacgagattcgcgttcgccagcgaaggatacgccactcgattgatgacgtcatcgtgctcggccgttaaaatcttcgtcgtcatcgacaaatgctgtgacgttctcgcggatacggaagacggaagcgtgataggtttcagactcgacggagacggtggtttcgacgagagaagggaagagagaagctccgagagagagactatcgattctagcgccatttttttttccgtctgaataagtgaataatcgtttcattcttattataatatttttcaattgtaattagtgtgttaattagatggtcaagtctttagtgagtctactttctgactaaaacgacgacgttgaagcatataaaacgagaccagtgaactttgatctttgaaagctttctctcttcgtctctctggctctctttctttttctctcgttttatttggtaattatg

SEQ ID NO: 977 - DNA, 3000 bp, Unknown
  misc_feature (1)..( 3000): cDNA_ID_2045137_gDNA_ID_1620343_Annot_ID_154058 3000 nt of promoter + ATG
cgtagttaattgtctcaatctcatggtgttaattgtgttagtgtattgacattgaattttatggtttatagattgtagtgatttgatgatgatgacatttttcaaaatttagaccggcctgtacatgccaactacgggtaagatatttgaccagaaataatacaaatttaaacgaaaacatatgtagttgggttttacgtgaataaattttatttggccaaaagcataaaaaacaagaacatgattggttgtatgaattaataatttgagattcgtttctgactttaaatatgtataaaaatgctaagaaagcccaatttcgtgtgctggttggttgatatttcaacaaataatgctgaaaaacaagaaatatgtggtactgttacttcaaaatttgattcgaaataatcaatgaacaacttcaaatattttttgtggagttccaagttttcaagttaagatgggacaatttgctcaccaacttattcattctttagttctccactcctccatctgtcccattcacaagttgcgaatatttaggaagtcaactaaaatacgccgactaacatttctttttccaatagttttctgattaattaatatatttgatggtccttttctcaagtcgggcaaaattttgaatcgaataaacaaaggaactccgtgtgagactgtgagtaatctcatgtccttctctaatcctgatgagacagacaaaaaaaatcgaatattataaagttgagaaaacaattaaaaaattacttatcaaacaagtaaaataaaaaagaacctcgttaagaaaaacaaactccagaagacgaaaggttgacacgtgtgacgtaactaatccacggacaacacacgtgttcacatctccgatatttacacgagatgatctcactattcgccacgtatcacgtttaacaaaaaaacaaacgtcgtacgtgtaaacacgtcgtaacggcgactctaacggttagtaacggccactaacgtcccggtatatactccgtctaaattaatttctccgtcggttacgtctccgaccggtaattgtataggaaaattttaattcttctcttcacaaaaaatcaacacatcgtaaaaatttctaaaaaccctaaattaaatcctttaattgcgtcttcttcgtcattatcatggtattcgtatctatggcgtatattcgattatttccccaatctccgtcaatgccaaacgagcctagagtctttgtgtacacgacacgcatagcagcaatgcgattcttccgctctctgaatgtatcttctcggaggaagatccgtggaaggtaaacaataccgagattgtagatatcttccatacgccggcgacggagaatttggcggtgaaggcgtgacggagaacggcgattttggagatcgatcaccgcttgaagacggcgaagattcggtcttatgcgaagatctcggaggtgatagaacggcacggatcttggctccgcagatgcgatcgtactcttcaacgatctccgctagttcttcttctgatttgacggagattagagtctcgagatctccgtttggtaattgacatcgtaaatcaacggagtatccacagaattcatagagtttcttcatcagctctggagaaacaaaattaaaaaatcaatctcagattcggcgaaatcggaaatagaatcgatttcaatacgaaattgaagtggagacgaacctgagaaagagatagaacgatcaacggagaggactctggtgtgacctccgacgtaacggagcttgccgtcggtggagcgagggaggattctgccaccgtaactgcatagaaacttgagactgcttccactgttcttctcggtataatcaacggctaccattgttagttttttttgaatttttgaagatttgggagagaagagggaagctttttataattgagtgtttgtttttggtgtcttaaaccaagaagaaaggttgcagatggatgggttttatagggaaggagtgatgtcatggtgggatattacgcgtatgggcaaatagaaaattccttggatcttctatgggcattttggacaattctgttatttccaacaatggaatattcttttgtttaattgattccattttgaagaaatcttctttcttaaaagtcgctcatcattatagacgtttggtcatcaaagaaaactagtcataaaattttaatcaaatattgaatgctgaatctgatttgtaccttcctcttggcagtctcttccatgttaatgttattgttaattaccatcaattttactgattgctctgaacatgattttgtttttttattattttttttgctgcaagaacattattatgtttgaaattataaatatgtcaagtatgaccttatggccatgtaatgttaatgattcgattttataaatactgtgcattatgggtcaagtcaaatgtatactttttcactagttagaaaataacatacagtatatggtattattccagaaaatatgtattatgactaggattggtgtagtcacatgactcatgagatggtatgtctgaaaaatcccatcgcaactttaagattttccaaatttgattcgacactgttggcaaaatgtttaaagcaatagactcccccatcacaaaacctccaataatttaagttaaacaattgtttgggtccaatttgtagcccattaagtggttagtcatggcccatatctgattaccaacaaaataaaggaaattaattaaattcgcgcaataaaaagaacagaaaaatggtgggacaaattagggttactaatttgggaattttactgtccaaaacgaatcaaaaaaaaaatctaagctttttgttccttttgcggcttttcgtcgtcttccttgcactatcttccttctgtagcatcaattcgtttccaaggttacgtagtagaatttacgcgagagagcgagagatcaaaaaccataaccatcttaagttacaatg

SEQ ID NO: 978 - DNA, 3000 bp, Unknown
  misc_feature (1)..( 3000): cDNA_ID_3410221_gDNA_ID_1620343_Annot_ID_154061 3000 nt of promoter + ATG
tcggcctcaagattatttatccggtttcttgctcaaactcttcaccatctgattcctctgcattatctgcatcatcatcctctgcttcattatcatcctcttcttgttcgttgttgacgactggttttccaattaccggtaaagcaggactcatctttctgatctcgttgcactgcaccaaacccaagacaacaagaatttacttagaacttgtcttaaaacattcataacaacaacactgaaactgacaattagctctactgatctctctcacttttgagctcccacgtctatataatcacacaatctaatatatttaagaagaacatataattagaggtaacaccaacacatcacacgacaaggagacatgttgtctaaagttcacaatggctaaattccaaatctgcaaattttgtctttgcttctttcctttcacttgctagtgattcaggaaacggaactagttttcaaacattggaaaacatgtaacaataaactcaaatccttttccatactaaatctagaaaccaaaaatctctccaatttaaactcgaagatcacccttggatctttatacattattacgggtctaaagctataagatgatagtccaatgaacacaaatgcatatatccatagagtctacactggaaaaaccactacactagaatcacaactcgacattggtatccactaaaattctcacttttgtactaacttaaaactcaaacataggacccaaaagaatatgttccaaagcagaaagattcagaaactcatattcatcttatcaatatgaagtagagaagaaagtgatctgcctaaaaccaaaatcatcaccacggatcgaaaaagattgatcatttacaaagtagaaaccacttataatctcgaacacaatcaataaatttcactcataatcagctcaacttacatgaaactaaagatctaagattgaccttttatgctgcctgtagtgacagtcgaaaactgaaaatttcctattcagcagattccgaaggagaacgaatacataaataaaaaagaaggaagctaccttttcttcgaactcagcttcttccatggcgagaagaatctcctcgttctgcggctgaggccattgtaacggaagcaaatacgatgccggaatcgtcttcgtcgacgacggaaattgggtcatcaacgtcggaaactgtaacattcttcttctcttcctttttctctcttaacgaaaattgatggaaaagtaaataaagaccaaaaacacagtgcatttattattgggcttttatctgtttagcccattgttattgggtaaagataaatataattttgactatgagtagggactaaatgttaaatttgggcttgtaaaattacaaaagcataatttgaaacccattgggccactccctaccttccgcgcgtgacttaaatttgaaactaactaacaacgtcttaaaaattaaaactctaataacaaaaacgtaaataggcatctgatcttttgattggtgatggaatagtaacattccaaatattttgattacccataaaacatcgaatcttgcgaattcatagtactttttgtattattttttgaaagctatattaacattttcgtttatcatttatggtagtatttatgtatcttgttttaggttttcgaaataaacttgttcatgtcaaaagaaattgaagaaattcaaacgaataaaattaatcaactctaataattttcttatatttcaccagtctactatcataatgaacatacttaattgtaatgtttgttagtatgttttctaaaatccactatttaacttgcatgccattgctgtttatatacggtctctaacccccaaaggagccaattatagataaaatactgactatcaattttgcaaatttggtggtgtgaatagttgtaaaggctgtacattgcgtaaaaaaacttagggtaaaataaaaaagcatcacatagttattttaaaaaggccaaacacacctttaaaaaggataactctttacacctttatcccacaccccatttccttgtgagaaagaaactatgcatgcgggaatataacaatacggctttgcttctcaatacaacgacataaaaactctctttataagactctcacacacacatatgttgatatgtataatacacgtctctaaatttgtgtatctatctacattacaatatatatagtttgatatcaatctacaattgaaagcatatatatataagtatgtttcttgcttcagttcttcaccaaaaacttgtgttcttaatcttggtttatcacgatgaaattgttgtcgatgatgatgatgatggaagctattgtcctggctaactcaccttgaggtcctcgattccattgatgacgctaaatggggaataagcattcctggtccgatccatttcatgtcacttaaatcttattatttcgtataataatcaaattcaatgttgttcaagtttgtattcgatgttttaatcacttacgtatgtattttctcatggaatgtatcgtcgaactaattattcaaaacgacctttattttgaaaggaatgcttttttattaattggaaattacaaacgaaaacaaacaatttgtgtccccaactatattttttggaccaattaactaatcactaaaggtctcatgtggagacttaataaaccttaaatgtaattgtcattatgagtttgaatgacgttatgctgagttcaatgagaaaatatggttggtaattggtagttgtgtgtcataactcgtaattaaatcacgccacaaataattaactcgatgctaattaagaataaaacctcttttcaaaataaacaaaattaaaagctttccatgtcaaagttgcttcctttggcttcttcctacacacttgcttcacatgtctactacactgactgactgacacaacgataaagtacacttatcgtgtttcttggtctcatcataagttca

SEQ ID NO: 979 - DNA, 3000 bp, Unknown
  misc_feature (1)..( 3000): cDNA_ID_3059942_gDNA_ID_1620343_Annot_ID_154067 3000 nt of promoter + ATG
ctaataacgatcagtaagaacatgagaaatttgtatcccaacgaaatttcttcccattcaatgataaaacaaagaacatgaaacccataaacactgtgaatcataagaacacacacacagtgatattttccacgatttctaaacgagagaccttaaaacactccaaaaattcgattaagtaaacaaaacatcacaaagaagtatgtatacaactatacaaaacaaaatctaacctgtcatacctgtgatcgcaggaatcaaattccaaatcgtgaaacaaagtcgtcttctttactgcttggctcggatctcgagccaagacagaaaagataaggaatcggatctccagcaccggagaaaaacgaccggagagtatcaaagtagataacgatcaatttatcactacaagagagtcgcaaagattcaaaagtcaccgattcccagacaacgacgagagaggaaatggatgaggatcgccaataaaagtactactttacaacaatataataaagttttgtgcatttgtttatatacgatggtacacgtcatcaacgtaatacgtggagggcttagaatatttccttctttttttaatttagcctccaatttttttaaagattttaatccaaaacaatgggctgtattgggtaggttcggcccattgaattagatattttgggctggacaatatccaatggttgactacgttaataaaagttttatgcttcatggaatcatattattagatcatggccatcatgtttatagttttaaaacagatatggatattgtattttatatttttcaaattattatgactaaattatatcaatattcattttaaattgttattttagtgaacgtactatgtgtataaaaaaaacaaaaaaattataacactgataaatgagtagagaagaagttagcaagtagttttcaagcaaaaaccggtcacatgcccttttgtctctattttctgatccgacggttttctttatatctaccaccttaaatccaatctaacgactctatttctttatagaaaggtcaattctctacattttttcttgtttttttttcacaagacaatgtcatgaaacttgaattgatttcgtatagaagacaaaaaaaacttgtaaagttgagcatttgttcaaaacattaatttgttaagtttgcttatccaaatgatcaagtttcagtttgataagccaatgtagtcaataattaaaatggttgaattagatattatcatactctatatttagttacttattcaaatgcgttcaattatttttgtattctatgaatcatgtaaaaagtagtgaaaaatgtatatagattagcttttgagcgttgagaatattctgaaaaaggaacattaatgtcgatcggttctcgtgtttcatcacgtacgagaacgaaatcatttactaatcgaatgaatgtccaaaactgtctaaaatgtagtgagaaatgtcatttaattgttttctgcagtttatgtaccagaatacacaatttgcttaatgtataaaataatttgctactaacagtaatttaaaaaaaaaaaactagacttaaactcatgatccatatttttgcccgaagtgaaaattcatcaacatgaatggctctagcaaaaagaaaaatgtcggcgagacttgtaatcgaatagttgattaagtttttaaagacattgttctttttaaagtgtggaggaggaggaggatatagagtgatgatgcaaatacttcccatgtgcattgattgtcaacacattttgtaccagccaaaatttcaacatagggtctgattgttagatatgaatgaatacactactattctaaaaacgttatatgaatttaagaaaattatatgtgtagaatttattgaaagattggactcgagcacatggttcggtggtcccaaaatcaaacctctatgggccagtgtcggctcagttctcctattctattgcttttggtgggtctattcttttctcttttcctgcaagcaatatctctttgagacaccaaaagaaattcattttgtataaagataataataataacaaacactctaaaaccaacttatcaaacaattcaaagtgtatcaaatatcgtattcttacaattacaatccatatacgtttagttatcaaaatatggtttagtagatagcagaaacactaaagtatctcgaaatgtaatactttactatatgagctttaacaaaaaaaaaaaaaaaggaaaaaaaaaaaatcagttaaattgagctaactgctatgctattgataatattcaaccgttaaaacgtaaaagtaatgataaaggtacaaaaattaaaccgtaatattaaatattagtactaaagtacattactaacacagtgttgacttttggtgcaccgtacttagtgtttcaccaacattcagctttaagttcgttgagattttaattacgagttctgtgttttttttctttaagccacgtgactcattcctagcgttacctgaatgttgaatacagtattaagtgctatcggtttgataatcttaattattagaactgttgagccaattatatttgtaatgatggctgatattactccttccgtttttaaatcataaccagctccgtttagcttgatcagaattacatttctgaacaacactttttagttcagccaaacactttttatcaggtatcatgaaatttgaatcttaggaaacattttgcattatttcttcttctctaaaatgacttgggttgattccattctcacacaccaaaataatttcacaagaagaggaaaaaggttaagcaaggtgggtccaattaacgtcaagttgcatgcgcaataaatcacccgaagtgttcatatgctatatagtctatcgctttgctttgtctttctctcttcactcatatgtttcgtcccaattctcttttaataccttcaaatttatcaacaacaaaaagccaaagaaacacaatg

SEQ ID NO: 980 - DNA, 3000 bp, Unknown
  misc_feature (1)..( 3000): cDNA_ID_3059938_gDNA_ID_1620343_Annot_ID_154071 3000 nt of promoter + ATG
atagactatatagcatatgaacacttcgggtgatttattgcgcatgcaacttgacgttaattggacccaccttgcttaacctttttcctcttcttgtgaaattattttggtgtgtgagaatggaatcaacccaagtcattttagagaagaagaaataatgcaaaatgtttcctaagattcaaatttcatgatacctgataaaaagtgtttggctgaactaaaaagtgttgttcagaaatgtaattctgatcaagctaaacggagctggttatgatttaaaaacggaaggagtaatatcagccatcattacaaatataattggctcaacagttctaataattaagattatcaaaccgatagcacttaatactgtattcaacattcaggtaacgctaggaatgagtcacgtggcttaaagaaaaaaaacacagaactcgtaattaaaatctcaacgaacttaaagctgaatgttggtgaaacactaagtacggtgcaccaaaagtcaacactgtgttagtaatgtactttagtactaatatttaatattacggtttaatttttgtacctttatcattacttttacgttttaacggttgaatattatcaatagcatagcagttagctcaatttaactgattttttttttttcctttttttttttttttgttaaagctcatatagtaaagtattacatttcgagatactttagtgtttctgctatctactaaaccatattttgataactaaacgtatatggattgtaattgtaagaatacgatatttgatacactttgaattgtttgataagttggttttagagtgtttgttattattattatctttatacaaaatgaatttcttttggtgtctcaaagagatattgcttgcaggaaaagagaaaagaatagacccaccaaaagcaatagaataggagaactgagccgacactggcccatagaggtttgattttgggaccaccgaaccatgtgctcgagtccaatctttcaataaattctacacatataattttcttaaattcatataacgtttttagaatagtagtgtattcattcatatctaacaatcagaccctatgttgaaattttggctggtacaaaatgtgttgacaatcaatgcacatgggaagtatttgcatcatcactctatatcctcctcctcctccacactttaaaaagaacaatgtctttaaaaacttaatcaactattcgattacaagtctcgccgacatttttctttttgctagagccattcatgttgatgaattttcacttcgggcaaaaatatggatcatgagtttaagtctagttttttttttttaaattactgttagtagcaaattattttatacattaagcaaattgtgtattctggtacataaactgcagaaaacaattaaatgacatttctcactacattttagacagttttggacattcattcgattagtaaatgatttcgttctcgtacgtgatgaaacacgagaaccgatcgacattaatgttcctttttcagaatattctcaacgctcaaaagctaatctatatacatttttcactactttttacatgattcatagaatacaaaaataattgaacgcatttgaataagtaactaaatatagagtatgataatatctaattcaaccattttaattattgactacattggcttatcaaactgaaacttgatcatttggataagcaaacttaacaaattaatgttttgaacaaatgctcaactttacaagttttttttgtcttctatacgaaatcaattcaagtttcatgacattgtcttgtgaaaaaaaaacaagaaaaaatgtagagaattgacctttctataaagaaatagagtcgttagattggatttaaggtggtagatataaagaaaaccgtcggatcagaaaatagagacaaaagggcatgtgaccggtttttgcttgaaaactacttgctaacttcttctctactcatttatcagtgttataatttttttgttttttttatacacatagtacgttcactaaaataacaatttaaaatgaatattgatataatttagtcataataatttgaaaaatataaaatacaatatccatatctgttttaaaactataaacatgatggccatgatctaataatatgattccatgaagcataaaacttttattaacgtagtcaaccattggatattgtccagcccaaaatatctaattcaatgggccgaacctacccaatacagcccattgttttggattaaaatctttaaaaaaattggaggctaaattaaaaaaagaaggaaatattctaagccctccacgtattacgttgatgacgtgtaccatcgtatataaacaaatgcacaaaactttattatattgttgtaaagtagtacttttattggcgatcctcatccatttcctctctcgtcgttgtctgggaatcggtgacttttgaatctttgcgactctcttgtagtgataaattgatcgttatctactttgatactctccggtcgtttttctccggtgctggagatccgattccttatcttttctgtcttggctcgagatccgagccaagcagtaaagaagacgactttgtttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtag

SEQ ID NO: 981 - DNA, 3000 bp, Unknown
  misc_feature (1)..( 3000): cDNA_ID_1442548_gDNA_ID_1620343_Annot_ID_154060 3000 nt of promoter + ATG
taccataagcatgatacccaaatccaccaccataacatagattcaaacctttaagttcaccgcagaagtcgttgacatggtcgtgacccacaaacacagatttcacatctcctctagctatcaatgttgtgaagaaacccgagtttgtagaagccgcggatgtaccttcttgtctcactccttttgtagcgttctttgagtcaaaactcaaaaactccggtaatggaatgtggaagtaagctagtcctggagctataccttcttgaggattaggctttgcgttgtactccctctgcaatatcatcaaaaccagggttaaaacaacaatgtcatgatcaaaaaacaagattgatcatgttcatcattgatgtaccttgagacgttttgaagtgcggtcgaaccaaaactgctgagaagttttgatccaatcataaccttccatgtaaggaacactagaataatctccactatcgagaaaataaagattaagaacagatttgttctgtagtttcgaatcagcagctccatggatttggagattgtaattaccaaaaccatcaatgtaatgagcagcttcaggaggattcacttgagacaaagtgttgggaagcttcacaatgtgattcataacttgttgtcttgtaaatgtagattcttggtcatggtttcccaaaatagcaacccatgggattttagacgcaatcgctggagcaaacgcagcgtttatggatttcaaagcgtcttttacatcaaacccaaatatgttatcacctgaaacgaaacaaaaccccaaaaagattcgaaatttcacaattagggtttatgtaaacatcctgaaagttaagatttttcaaatcacgagaagaaaagttagggttttgttcaatttgggggtcttaccggtgaagacgataagatcaggcttctcggcggcgatgactcgcgacatgaagatggtggtgttgaggtctgagcaatgagctctctggctaggaagaacattttgacactgcgtcttagcgccgttagcaaaatgcatatccgccacttgtagtatcttgaactcgccgttaacactgaacctgagtttccgacgttgagctgttgccggaatcggagataaacagagacatgcgagtcctagaaacacggagaaaagtaggaagtcgaataggcttcttcttcttcgattgtccgccattgaacttatgatgagaccaagaaacacgataagtgtactttatcgttgtgtcagtcagtcagtgtagtagacatgtgaagcaagtgtgtaggaagaagccaaaggaagcaactttgacatggaaagcttttaattttgtttattttgaaaagaggttttattcttaattagcatcgagttaattatttgtggcgtgatttaattacgagttatgacacacaactaccaattaccaaccatattttctcattgaactcagcataacgtcattcaaactcataatgacaattacatttaaggtttattaagtctccacatgagacctttagtgattagttaattggtccaaaaaatatagttggggacacaaattgtttgttttcgtttgtaatttccaattaataaaaaagcattcctttcaaaataaaggtcgttttgaataattagttcgacgatacattccatgagaaaatacatacgtaagtgattaaaacatcgaatacaaacttgaacaacattgaatttgattattatacgaaataataagatttaagtgacatgaaatggatcggaccaggaatgcttattccccatttagcgtcatcaatggaatcgaggacctcaaggtgagttagccaggacaatagcttccatcatcatcatcatcgacaacaatttcatcgtgataaaccaagattaagaacacaagtttttggtgaagaactgaagcaagaaacatacttatatatatatgctttcaattgtagattgatatcaaactatatatattgtaatgtagatagatacacaaatttagagacgtgtattatacatatcaacatatgtgtgtgtgagagtcttataaagagagtttttatgtcgttgtattgagaagcaaagccgtattgttatattcccgcatgcatagtttctttctcacaaggaaatggggtgtgggataaaggtgtaaagagttatcctttttaaaggtgtgtttggcctttttaaaataactatgtgatgcttttttattttaccctaagtttttttacgcaatgtacagcctttacaactattcacaccaccaaatttgcaaaattgatagtcagtattttatctataattggctcctttgggggttagagaccgtatataaacagcaatggcatgcaagttaaatagtggattttagaaaacatactaacaaacattacaattaagtatgttcattatgatagtagactggtgaaatataagaaaattattagagttgattaattttattcgtttgaatttcttcaatttcttttgacatgaacaagtttatttcgaaaacctaaaacaagatacataaatactaccataaatgataaacgaaaatgttaatatagctttcaaaaaataatacaaaaagtactatgaattcgcaagattcgatgttttatgggtaatcaaaatatttggaatgttactattccatcaccaatcaaaagatcagatgcctatttacgtttttgttattagagttttaatttttaagacgttgttagttagtttcaaatttaagtcacgcgcggaaggtagggagtggcccaatgggtttcaaattatgcttttgtaattttacaagcccaaatttaacatttagtccctactcatagtcaaaattatatttatctttacccaataacaatgggctaaacagataaaagcccaataataaatgcactgtgtttttggtctttatttacttttccatcaattttcgttaagagagaaaaaggaagagaagaagaatg

SEQ ID NO: 982 - DNA, 3000 bp, Unknown
  misc_feature (1)..( 3000): cDNA_ID_2045174_gDNA_ID_1620343_Annot_ID_154047 3000 nt of promoter + ATG
gtgctgaagttacaaaggaattatcccctatgtgggtggttggccccttgatcatcgccctttatataaaaatgttccaaggactatgttccctttacgccttctgcttcaaccaaaccatcaaaatgataagaaacctaccatcgtattatcttgtagcataccaatacattgccgatggaaagctcaaagacgacgttaaagctctagtgtttaaaccagtggtggccatcaagaacacagactacaaagagctcacacgcacgaagctgaaacagttccaagaatggatcattgagaaatacctggattttgttgaatctgtatggccttattactgcagaactatcagattcctgaagagggctaacctgatttgaagatcttcaacatggaaccctcaaattctgacttctcagggcttctctatgatttctctctgtgctttgtttacctttttttttttttttcttaattttaggaaggcttttcatgttgtttgttcttatctctatgtatactgataccttttttgaggttttacaatgagttcttttaatattaagggttatcccttttctccatacttaaaaattatctatacacatataaatcgacaacaacagaagaaataagtgcttaaaggtctcttataaacctctttagctccggaaatttgatggtaatgtttcttcagtaaagtactcctttctgacggtctctgctgagcaaaacttgaccttcacataaagcaaagtataaaaatccatctagtccagtcctctgaataaccacactatgtagtatatagcaattagaatcgatgcataaaaacatagcaatatggtatggaagttaccagagaagcgtattgcttcaccaacggtttagtgaattgccaaattggctgaaatatgaatggagcatctacaaaaaggacttcatccaatcggcttggatagtaatagtaaaatacgtcaaactgcagaaacaaaacaatggaaaagacaacaataagatcaaagaccattcacctgtaagaagatacaaaaaccattcacctgtaaggagaaagaaataccaggaaagtcaagaacttaagatctgcgttctgagatccgaatccacggagatcaaatatcccaagtatcttgtgttgtcctgctggtaacttacttaaagccttttcaagtaagaacacacaaagcttttcatcttctattggatcaagcagctgcaaaacgtcagacatttcacaaatcctcagctatagtaaatctgcattgctgaaatttaacaagaaaactggtgtctaacttgccccggggatgtgctttgcaggagctacaataaccactggccgacctttaacatctagaaaaccatgtacataggcttttccagtgtcagtagctgctttaatagaatcttcagaaagctcatctaccttgaactcatgacgccatttctaagcttttaagtaaaggataacatggaaaccaaaccttatcaatattaccaaaacaaaaaacaacatgtgatttgattctacaggttctacataaaagtgaagtctctggcaactttctagattcattatagtgaagaattgatagaagataaagaaaacacaaggaagaggatacaatagctttagttagctttccaatggcttcatcaacagaaaatctgcgatctttcaaaaaccagaggatcatatcctcatcatctcttccatatttgccaagtgggagactagtacaatctttcgcaagccgttcttttacttccaaaactagctgcaccacatgttcacaaacccaaactttcattacacaatcccctcagaactcagaagacacattccatagtctaaacatccaattcaatgggtattgtggaactcaagaacccaattctgagaccacataagcaaaagactaagtttttattttatttcttaaacagagcttccaatgccaacaatggaagaaagaaacagaggaaaacttgctgcagatatcatcagaaaaaagcataaaaggcatatgcgaagaagaaagccattgcgtaagaaattaaaaaaagtaacgtcatcgtaacattcatccaatttccatgattctcgctttttggctaaaagagaaaaaacaaaaccttgtgcgcatgttgggattcagacacgcaacttcggacagagaatctgcagttccgagatcgattaatgttcaaattcttcgagcttttgaaattgactgaagcagcaacgatggttgagctgaaacgaatcgacattgactacaaggagtaaaaatttactctttagagtttgattctcagaaattagattgatgagaggaattcggaagtttcaaaagctgggctttgttcaccacagagcaagaagaattcagaatttggaattttgcgatttatagatacagaagcgaaacagaggcatatgtttttgtttcccctttttatagactcttgcttcttatacacacgggtacgggtctttttatctgggtttagatccggttcagggtctcggatccacgttcggatccggtttggtatttctacattattaccaaaatttatttgcttagccagaagtttgtattttgtaaagacatcatcatagtactacatatataactacacactcgcagtaaatctttttttctctctgtataattgaagttaaaaataacaacaaaaatggcagtttatatggaggatcacataaaaatagttaaaaataatttagtcctagtaattataggtcttctctaattttatttggaactaaatttcagaaaacaaaatatcgtatcaaattttgatgtaaattataaaataatagaaattagtgagatagcattctaaatgaggattgcatattttggtattagatatgtcggattttatctgatatggtagttttcagtgtatatatatatctctaaagctttttcaagccaaataagaagaaaa

SEQ ID NO: 983 - DNA, 10 bp, Unknown
  misc_feature (1)..( 10): cDNA_ID_2105695_gDNA_ID_1620344_Annot_ID_154092 3000 nt of promoter + ATG
gatcactatg

SEQ ID NO: 984 - DNA, 3000 bp, Unknown
  misc_feature (1)..( 3000): cDNA_ID_3059994_gDNA_ID_1620344_Annot_ID_154098 3000 nt of promoter + ATG
aagaaagaaggaaagatgaaagggcaggtctcttggtgaaagaccccacgatcacgcatccatatggaaaatgcaaagagacacgtatacctaaacgtcatcgtttttgcacattaccccaaaaccccaaaaccgacctacaaaatcccttcttcttcctcttcactctttctcattttccaccattaaaaaacctctctactctctcctcaaaaactcaaaagagcaaaaaaaagagaagaagaatcaaaatcccacacaatggcaacacactcttccttcaccgcaacaacacctctctttctcatcgttcttctatccctatcctccgtctcagttctcggcgcatctcaccaccacgcaacggcgccggctccgtctgtagactgttcgactctcatactcaacatggctgactgtttatccttcgtttcgagcggaggcacggtggcgaaaccggaaggtacatgttgctctggtcttaagacggtgcttaaagctgactctcagtgtctatgtgaagcgtttaagagcagtgcttctcttggagttactttgaatatcactaaggcttctactcttcccgccgcatgcaagcttcacgctccttctatcgctacttgtggatgtaagatctattcatttcttaacttgtttgtttcttagatctcttccggttttgtagatcttaatttgttatgcttaatcttcgagagcggtttcttaaatccacattttttctaattttttcagtttaattaagaaaataatttgtagatttttcgaaactgttttaagattctattttttgttgttgttgatgttgattaaattacttataatgcttttttattttatttttgttcttacagtgtctgttgctccaagtactgctccaggtattttgtctttcttcttggttgatttttaattttactcttaagttttgtctcatgcaatgctttattgtgtttttaaattcccacttgaaaattttgaaaagataaaaattgtcgattgtttgactttgatcatctgggttctcacttaaagtgaaaatgatttatctaagattctacaatacaaaaaattataattaatacgaaccatgacaaaaatttgtgtgaattccttatttgtgattttctttgtaaaaatttgctcgagtgattggaaatctctgctctttttctccatgttagttatgtgatttctcgttgagatgttttacgcttttgagatttcttaatgtggaacctaattttatcaggtcttgctccaggagtagctgctgctggacctgagacagccggatttctagctccaaatccttcttcagggaacgatggatcttctttgattccgacctcgttcacaactgtactcagtgccgtactgttcgttttgttcttctctagtgcgtaaaaaaaaacctgaatcttttttcaccagctagatttggctgtatgaaattgattaatggtttttattagggttaatctatgtatgttttggagtgttctgtttttagaccatatcggtttctctattactagcgtttactcttttagtttatgttattactttgtctcacaacattggtccttttattcgatctatcgcttattccttcatctatgttttctctcacaccctcatagttatattcgccaaaagctcaggcagaaacattctcaaagtccactatacaaaaaagaaatactacaagtaacatttatatattctttttaagaaaattatggtgtaatattgcaatgactaacaacaaaattctttaatttcgttttaattttctcataaaaactgtgtaataaaatacaggaaatcatatgatatcattttagtagatgaaattttctcataatatcgtcattgtcagtaagtaagtcccaactttttgtcaagagtatcatatttatattttgttacagtgtagtttgactatagtaccaattacaacttgttctatgaaacgagtacaaaatttcttcatctgaaaaggaaatgcatgtgttaagaaaattagagacgtgaaagtgaaaggaaacaaaatgtttcgtggcatcgtgaaagatataaatatatatcgtattttttaaaaatcagattattacttcttgtaattagcttatcagattcaaaattcaaaatctcaatagtaataatcttttgaaagaaaataatgaaaaatcaactgtcaacaaaagttaatcaactgtccaagtgtcccgttgtggacaaatcacgtttacttcccaccaaggattttcaactttattatgatcgcgtggactttccagcgcacgttagatctcctccctcgccaaaccaaaataataattaaatagtacgaattactaaaaaccaaaaaattaaaattaataaaaaaatgaaaataatttaaaagtattgcgaacgataattactttcccctctctctctctctctctgtctgccaccaacagccgaggacgacgaccgtatcttccaccacaaactgcttccggctgagacgacggcgatctactccggctaattctgttacttgattctgctctgaattttaacaagcagaatttctcggatagcaggaagaacgggattaattagctcatcgcttggttctctacgtgagatttagttttggattctggagaaatttccgatcgccttcggtttacggcgattggagtgagtaggatacggagaaatctctattttctgtgtttttttcgcgatttaggaaagttaagcattataaagccaaatttcgtcgatttggcattgagattttgagctttgggtggttatagataggttttttgagttaaggttttacgggtaatcctagggtttagttattggggaagagagaggctccgttaatctggtttgttggaagagtctcctggatctgttgtctcgacggatgatttgggtctgtgagctagggctttttatgcttggctgattaggatg

SEQ ID NO: 985 - DNA, 3000 bp, Unknown
  misc_feature (1)..( 3000): cDNA_ID_2128919_gDNA_ID_1620344_Annot_ID_154100 3000 nt of promoter + ATG
tacacagtttttatgagaaaattaaaacgaaattaaagaattttgttgttagtcattgcaatattacaccataattttcttaaaaagaatatataaatgttacttgtagtatttcttttttgtatagtggactttgagaatgtttctgcctgagcttttggcgaatataactatgagggtgtgagagaaaacatagatgaaggaataagcgatagatcgaataaaaggaccaatgttgtgagacaaagtaataacataaactaaaagagtaaacgctagtaatagagaaaccgatatggtctaaaaacagaacactccaaaacatacatagattaaccctaataaaaaccattaatcaatttcatacagccaaatctagctggtgaaaaaagattcaggtttttttttacgcactagagaagaacaaaacgaacagtacggcactgagtacagttgtgaacgaggtcggaatcaaagaagatccatcgttccctgaagaaggatttggagctagaaatccggctgtctcaggtccagcagcagctactcctggagcaagacctgataaaattaggttccacattaagaaatctcaaaagcgtaaaacatctcaacgagaaatcacataactaacatggagaaaaagagcagagatttccaatcactcgagcaaatttttacaaagaaaatcacaaataaggaattcacacaaatttttgtcatggttcgtattaattataattttttgtattgtagaatcttagataaatcattttcactttaagtgagaacccagatgatcaaagtcaaacaatcgacaatttttatcttttcaaaattttcaagtgggaatttaaaaacacaataaagcattgcatgagacaaaacttaagagtaaaattaaaaatcaaccaagaagaaagacaaaatacctggagcagtacttggagcaacagacactgtaagaacaaaaataaaataaaaaagcattataagtaatttaatcaacatcaacaacaacaaaaaatagaatcttaaaacagtttcgaaaaatctacaaattattttcttaattaaactgaaaaaattagaaaaaatgtggatttaagaaaccgctctcgaagattaagcataacaaattaagatctacaaaaccggaagagatctaagaaacaaacaagttaagaaatgaatagatcttacatccacaagtagcgatagaaggagcgtgaagcttgcatgcggcgggaagagtagaagccttagtgatattcaaagtaactccaagagaagcactgctcttaaacgcttcacatagacactgagagtcagctttaagcaccgtcttaagaccagagcaacatgtaccttccggtttcgccaccgtgcctccgctcgaaacgaaggataaacagtcagccatgttgagtatgagagtcgaacagtctacagacggagccggcgccgttgcgtggtggtgagatgcgccgagaactgagacggaggatagggatagaagaacgatgagaaagagaggtgttgttgcggtgaaggaagagtgtgttgccattgtgtgggattttgattcttcttctcttttttttgctcttttgagtttttgaggagagagtagagaggttttttaatggtggaaaatgagaaagagtgaagaggaagaagaagggattttgtaggtcggttttggggttttggggtaatgtgcaaaaacgatgacgtttaggtatacgtgtctctttgcattttccatatggatgcgtgatcgtggggtctttcaccaagagacctgccctttcatctttccttctttctttttttctctcttccttttcaagtttttactcatttgttttttaattactccattttgaaaatttattaactttactaggaaaaatttattagctttcatacactaactaagaaaaaattaaatgcacctccgaattctttgttctttcgctttcctattatgcgaaatttgcgggatatttctaacaatcaggggtttccaaacaaaaatctaaactaattagtaattagagtaaaaaaattgagaaaaaaacaacgagaataattgatcgagaaaaataaactattgtttgttactatgttagtgtactctcttgaaaataacaaaccacatttaaggaaatgttttatcctcaaacccttattgatgtttggccttttcagtttctatgtggttgtgagtctgaggccgttcattttttaaaccaccgagttaagtcatggaacttgttgtttgcctctgaatggaatacttagcatgtcaaattatcaatattgatagcttaatgtacgcaagtgaatagataaatattacacgtaaaaaatagaggaagattaatatgagttctatatttagcctccacgattcatctacagagaaagaaaaaaagtaagttacttcgtcttttgttttaaaacgaatttggaaggtcgagagtagagacatatgttattatataacttactctttactctttagctccacacatggatttgtatttatactcgagatgattttccattgtatgataaaagcatcaaatcttatttccaaaaataaaaaagattccggttggtgatttggtcgacgtgtaaagagatcacagaatcgtagccattcggatcgtcaaaaaacactacctaccgacttcaagcaatactgacggtaactaatatttgggccgtaaaactcaagcccatacaatatgggctcattgttctctactcttttgaaaccgatggcctattgtggcctagttgaagagtaaatacataacaaacccacctcataacttttattatcttcccgaattgccccattagaaacaaactgtgtaaatcagtcctcatcctgaaagaaacaaataatttcaatctttgcttctatatcggtactcctaaaatctagcgaaaacttctcttttgtctctcaagtcagactcaattccc

SEQ ID NO: 986 - DNA, 3000 bp, Unknown
  misc_feature (1)..( 3000): cDNA_ID_2128923_gDNA_ID_1620344_Annot_ID_154101 3000 nt of promoter + ATG
aaattacatattttgaaattgtcatgaagacacctggctaattcacatagagggcttggtatataacagctggacatacgataggaacggccggatgtattgtgtttagggacagattcttcaactacgacaacacaggaagtccggacccaaccatcgccccgagttttgtccctctgatccaagctcaatgccctctgaatggtgaccccgcgactcgtgtagtgctggacacgggaagtggtgaccaatttgatacgtcgtaccttaacaacttgaagaacggtcgaggtctcctcgagtctgatcaggtcctatggactaatctcgagacccgacccatcgtggaaaggcttctaggactacggtttccgtttcttattttcggactggagttcgcgaggtccatgaccaagatgagtcaaatcgagatcaagacgggtttggatggggagattcgtagggtttgttctgcggttaactaattaatataagattaattaaccattacaatatgatataaagtaatgaataaaaatggagattatatagactctccagcttttaataataaaccagctagtttaacattttcttttaatgtgactaagaggtttaattacgacgatgtgagtgtgagggaatacgtgtttaaatcacacataagaaaaaagaaatcctatgtaattgtaatctcttaagaaaatttaaaataagctatatatgtgtaatactgaaattctcctactttagaatattttatggctgttaattatgaaaaaaaaaattggactataaacagaaacaattaattaatggatatatcaaaaaaaaaaaacgcaaacgtaaaatagaataacatttaggtcaataaaattaaccaattgagttaataatatatataacgtctaaatatgtacattagtttccaactcgaggcaatgaaagtttttttttttttaattcaataaaggatgtaatgaaaataaggatgattggttttcaagatgaagttaaatttcataaaatagtatatttggtatcacgagattttcgccaatttccggcagaaaactgggtgatgaatattagtctcatctcatattgtataatgtacatgtacgtgctcggtgatgggtgaaatttgtcctctccgtctctggtttttataactagaccgatattaattaaaattatgtgtcctgtataaagttatcgttcttaattatacttgaaatgtgaatattggttcctttctttatcttaatctataactcttaactgtaaagtgaaatttgaataagacttttacaaaaaacataaaatacaattagtgaagtcaatcaaagttggaacgattcagtttgaattcactgttcgaaatgaatctaatcattggtggaaaatgattaaagggataatagtaaggataattatatatcagtggttgactttgacaataaagaaaaagacaagtcaatgatattatgccttcgaagttgtctcttggtggtttcattaaacaagacatcctcattcctcagtcaaaattatatgctctttttttttttacccaccgactatctagtaaacattaaacaagacatcaagcttatctctttacagctttgataaattcgtaacagttttgacaaaaaaaaataaaaaatactagtttcatacggttttcattaattcgtaacagttttgtttttagttaatatttttcaaaatggtaatttctctgcagcacacttttaaagtcgaattcatttacaagttgtgatttagcggtcacacacgtttttccgtcatcagaaaattacacatacacatacatatgcatgccagctgcaagtatatcatataatgttatactgtattactttgtaactcgttaattactttaattaagggaactgaataactaactacagccatcactatacatattctctttgttttgtactttccccatgcagaaacctacttagtctattattgttcaatggttcaatttttttattttatttgtatggttcaaattttccatggcggtgaatactttaatgttttttatccttcaaagaataaatagtagtattatatattggctaatccaaaagagtagagaaacaaatataccattataatagacgatttgatcattttaaaaagtcaactatgcccgttacattttcatcatccctaacgttctgaccaaaactttgtaatctatattatcgccacgtaactcattgatctaatctatgaagcaatatttgaccctaataaaacatcactattgtggtaccaactggtatcggagattttactttttaagccaactgattaatattttgtcacgaataatttgcgtttatatttttcaaaatcacattttagtttttacaaaaaaaaaatcacattttagtgtttcttgaatagatttgatcacttttcttaatgtatcgttcatttttttccaattaatcaactgcaattttggccgatttagctacatgtcgaaaaacactaatcgatttttcttccagagttttaagatgctttacgtttataccattcaccttatattagttttcattttgttttcgaccaaaactattgatccaaattattatagctaggtacgatttgaacaaactttgattctcttaccaatcatctacaacttaaaaccaagatagcttcgctcaaaaagaaaaaaataatgacaacatgtataatacatatatgttcaatggaccgactcatctacactgttattcaaactaattattttataaatgattactaaatcagcttattaaattcccataatttctgcgtcgtgtgccgaagttgctcgttacaattgttattcccacaactttttttgcctatatatacaaaccctttaacatcaaactcaaaacacacaacaaacacaacttctacaagactcaaatagtttctatttaattactaaaaagaaaaatg

SEQ ID NO: 987 - DNA, 3000 bp, Unknown
  misc_feature (1)..( 3000): cDNA_ID_3439285_gDNA_ID_1620344_Annot_ID_154110 3000 nt of promoter + ATG
cacagagtagttcgacagatctttctcgatttgtggattctctaactcaacctaatcttatgctagtacgatcgataatcgagcaacgtgttaattaaaaaatgtagaacggacaactatatacaaaaccacaaggagagatctaagaaattcaaactccagaaacaccacgcaatgattctacgaacatgtttaggatgagaatcctaaaagagaagaagaagcggctgaagcacgacgatattaacagagcgacggaacaatggaacgaacctgtagacggaagcggcggatgctcagaagaagctaggcgaaatcgagtttgccaaagaaaaaccctagaatcggaaaactgagcgatggatttattggtgtttatatactctaaatgggccacacttaagaagctaacgtcaatttttaagcccatatttatattttatacttttgagagttagtatgaaatacaaatatgggcttttgagtatggtccttttaagagaaaaagcccatactttagataacatatgggctttttaagtccattgaaattcacattagcttctacctttttgtcggctagcttctacctatttcacaggtataaagactggttcgaaaggcgcgtctagccctcttgatgaatgaaagaaagggtttctgagccctagccctgtaagcccacacctgtgtagagtagatcgttcaacacctgcggcacaaaccaatttttgacacatcacaactcacaagtccttcattacccgttcttaatcaaaatctctaatgtatcgtttcaaaatgtgtattttctttcacaattgactagtttctaactaactacttccaaattcttccatgacgattccgttatcataaggtcatgattttgagaataataacttcacaaaaggcatacagtatttagttcaattagaagttagaacacatatagttcaattaaattattagtactgcaagtatagggagcaaggaaaggaacaaaaaaaagaaaaagtattgggaagtacactacagcgagttgtgtaaaaaagctcagagacgaaagccagtcacgaaccgattgattccagcaaaatcagaaactatcttcaaatcagagaaacagtctttgagatcactggtcatcatgtaatctacgatcatcttgctttgcttctctccattagtctgcatcatcataaacaaataggattaatctttcatggttgatgtgattattagtatatacgcaaacatcttccaaccaaataaacatataatgaaaattgaccaatcaagactttgatctttgagtggcaatcataatcttcttagaacgccaaattcttactgataaagtgaaagcaacaataagcaacaattgtttcttcggactcatacacaagaacgattatcttaaatctcttttcaatactaacatttccggttttagtatcagagacaaagagaaaaacatagtaaacccaaacgattgtatctttctactaaatattttggagaaacagagtgaaaataaggtaggtacctcgaaaacgaaaaagccaccaggttgaagcatccgagaagccccatgacagagatgaaaaagactatcagttccatcaataccaccatccaatgcaagtttcggttcgtgtctaccaacttcagcttgtaggcctggaatgtcatcacttggtatgtatggtggattactcacaagccccacaagttttccttcaagatctttcaaaggctcaaaccaagatccttctctcacttcaatcatcccctggataagtccaatttcatcacaatggcaagaagtaaccaaagctgaagaatctcatacatatatcaaaattcacaaccaccatgagaagaaatcaaactgaaaattcttcaatccacaatatactgcttttatctaccaaatcctctaatccattacaactttgatgttgaaaattcccaattccatgaatacaattggtataatttgtcatgattagctttagcaaaaaaatcaactaacctcaaggctgtatctctgcacattgtggccggcgacggcgatcgccaccggactgagatctgtagctataactctcccacggcttcccaagactttagcaatgccgatcgcaatagcaccacttcctgtcccaagatcagcccaaatatctttcttaaaccattcatctctcgttacaagctcctccaccatatcgacgatcagttccgtctccggtctcggaattagaaccccttcctcaacgcacaacactagatctctccaatgctcgcatccgacgacgtactgaaacggccgacgcttctcgatcctctgcctccataaatcgtaaagctcctccaacgacgctctcaatttcacattcttctcgccgttgtccgcgatttcgcttctatgaagaatcactaaaggatcgtctacgattgagtcttcgatcagccattttagctcacggtggagaatgacagagtcaagagtatcttcggaattcttcgaagattcctctacggaggacgccagatctttcgcccagtcgtgccatttccaaacctccgatagagaagttgcgtgcgacggcgtcctaaggtatagcggtgtcttgggagttatgctgagagacttagtcggccgagaggattttgactctgtaagcgacgtgtattgcggtggttttttcgccggagaagatgagcaaagaggtttagcggcagagagcaaagaggttaaccgtagacttgggaagattcttatcatttcaaggtttttgccgcacaaacagaccaaatcggtttataaatatattaccaactaaaccggataatccggttctgtttttagccgggttttgaaccgaggattgaaataagattaacaaggaatataaggggctaaagcataaataaagaaaagttcttcttatttttgtttgcggctccgatagatctttggagcaacgaacaaac

SEQ ID NO: 988 - DNA, 3000 bp, Unknown
  misc_feature (1)..( 3000): cDNA_ID_1023208_gDNA_ID_1620344_Annot_ID_154103 3000 nt of promoter + ATG
tgtcatttttttcccatgcaaatgcatgaatcaataaactttggcaatcctatataggctattatagttaatacatggtgtgtgcgttactaagtttgattttttctatattaagtgaatgtattagctgtattgatttagaccaagaaaaaaattcttttcacacctttaaagaactagcttatattagtctttgaattgatgtcttgttcgcaatatgttttaaaatttgagttggatcagaaaccggattattattagataactagattccaaaacaaatggtcataaggtaaatcaacgagtgtagattttgatgttaggatatcaattttttttaattttttttttggcgtggttcacgcgttttaccaatatattgattcaaagctaaaaactcagaaacattttgagttgaagatatcatccgtgtaaaacgtctatcgtttcaacgattccatttatttaatatcgttttcaatcgtactccaatcattttagaaaaaaaaatagaacgacataatccaattgagtcattgaccatcgaatatctccaccaccaccactaaaaacattcttttctgatatttgattatttacatttttcattatggaaaactaaagaagttgagttttttttttttttttctgctaaagaagttgagttgtgataacgaactaaataagttgatttgtgtattttcatactccctctgttttatattagttgtagtttaagatttttacacacaaattaagaaattataaaaatctcatttaatttacctcttttatataaaaacatcatttattataaccaatttaaccaataaaaaatagatgattaaatataattggttaaaaaatattaaatacatttattatttgcatagaaaattgaaaacgacatttaaattgaaaaaaaataaaaatccttaaactacatttatatagaaacagaagaagtatatttatcttaaagttgtacgtaatgtatagttattttgtgtattttcaaacgtgtgttataattaggatggattgatttgattgctgtacatggtttttccgaaattctaaaaatataccccgtgacaaaatttgatgacttttgtgtcagaagacaaacagttgaaataaagttggggttgtccatgtatttagtactatttacgatcaaaagactaaaaatagaaccttctcggtatttaactcaaacttctttcgtgtttaattattgtcgtataccatctatatccaaagtagcagtttcggaatttagaaggctaaactaaaactaaattattttttaagcggtaaaccctaaactagtcaggatggggactttaatattgactgatacatagtattacacgcagtattgagtattaaacttcattttttaaagtatattagtaatatgtttaaaatctcaagaaaaaatagcagtaaacacataaatatttagaattttatcctcatatatactatacttttagggtaagttctcgttataatgactgtgtgttgaaaacttaatattaatgattgcataagtgatttaagaattgatgttgaagacagtcctcgtgccttcgtacaaataaaacgcgtgaaaaaataacgagaagtactttagaaaaagaaggataataacgatacgtgatttttacgtaattaccagagaaaatggccgacaatccgtcttatccatttatagtatattttcctttttccagtggttttatgaggaattatatcatagatttaatttgattagttacaaaattgtaaagatatttaagaaatacaaaaattagaaattctttcaagcaaagaggtatcaaattttgatgctagataatttagtttaaaatttttcaaactttctagtcgtcccgttacaacatcaatttttttgcctacttgatcgactagttgcaatataaatatatagttaactacatccaactttattaacttctttttttatattctttgtcaacacattaatggtactatatgatatatccctgcttcttcttcttcattttttttttgtttccgtcaaactcaaatccatatctataggatccgcatataataagttttcgtgatgttgacaaacattcgcaaacaaacacaaattgaaggaaaaaaatcaatatttaatatggttgtccgactcgtcaaaatattattaaccctatgcgttgcgtgtatgatacttaacgcatattgactattaactaagcaatgcaatgattataattaaatcccatactcatttcagggcaaacccattaatcttgaacggacgattatgatattattaagtttatatacacacatatttgagtcattgatcaatgcaccacagcacctgatcttgattgtggttcaaataatactaatgtttcccaaaattatctataagctaaatagcataaaatttaattaggttaaaagagagagaacaaatcacaaatctacttataggtagttaggcacatacatggaccatatttcatatgcttaattacaatattaacaaaataaatcaacaaagaattaaatatcacgactaaatacaacgtagctccaattagttgatgagtagcccggcattgcttactcattaaactctgcgaatcttttactcttttccactataaatatatatacacacacaattctcaaactattaaacgcaacaaatcaaaagtaataatccaaattatatatacatatatgcaccatttggttaaaaactaagaagaaaccaaaatgagaagttttactaatttaaatccttgctacgttctcttaccgttcttccttgtcctagccacgaatgcaacacatacaaacaatttcctcccaaggccacggactgggtattacggtagtgcatgctggaatgtagaatcgatagttcggtccgtggttgagtctaactatcttgctaatccagccaatgctccaggcattttgcgtatg

SEQ ID NO: 989 - DNA, 3000 bp, Unknown
  misc_feature (1)..( 3000): cDNA_ID_2128900_gDNA_ID_1620344_Annot_ID_154096 3000 nt of promoter + ATG
atgtttgtcacatccaggtcatggactctgatgctgatggggttccaagtgagttctttgactatttcaaggtatctgcatggcttaccctctcacctttcacttttaaatgactattattgtttcatatatatgtggaatggccgttaattgtcaactcttcttaattaggtgctatgcattcaaggattccttacatgtagaaagcacgcggaacggattattctcttagttgaaatgttacaggttcataatttctagcttctttttactatacccgaataagttataacattgcagcaagcctaattatttgccttctgaattatatatattctggtgttgtttctattaggattcgggtttcccttgcttcaaaggtggtccacgaaccattcaaaacctaagaaaaagattccatctaagtttaactgaagaggtaagcgttttcttttatctttgtcgtatcaatttatataatccatttcacatgatccacgacaatatcctcattctttcttttttgtttattttttgggggcaatcacaaaaccagcaatgtgtctcgttggtcctctctctcatcagcagtagcttagatgcttggcggacacgacaatatgattactaccaacgggtcttaaatggaatattgtgatgttccaaagaaccaacctaataagggtaaaaaactcacaacatacattggtatgttgggttagctcataaaacaatacgttttttgaggaacccttttcatagtagcaatcagaatccttccaaaggtgggggaagatgcctgaagagatcgtgtgtgcacgcatgggagaagaaaccggtcacacgtggaggagaaaactacagtttgtgtacagagtatgatttttgcagaggtttgattgttatctttacttacttgctctacttgcaggagaaaagaaggcaaaagcctgaaattttcttcctcccaaaagctcaaaacaaagcccttttacagaggttaaaaagggtaatgttttgttttaaatttgtttctagtcaaaactcatgatgtgatattgttgtataaattgtgtatcatcttcttttcctttgtgttaaaattagagtctgagcacggaaaaaccaaacagaacatgcatacatgatatttcattaagatgtgtgttatatcactcttcacacatatactcaattttcataatgtcgtatcgaattgttcactgatgactcttatccaagtatcaaatggtaagtaggattcactagcttctccatttgaattgatgttcaaaagaaaaacaaaacaagggttatattggaataaaaataaagtgagacaagaaaaatggtcataactagcagtttattactagggatattttgaaggctattcattttcataaaaaatttgaaacgtcttgattcatgcactgatacacaaggatcgtactattatagaacgtaccgtataaaagtctaccgtttactctcgctgtttacaaaacaatagcaaatttgttacatgtaattggggagatctacaaaatagaaaaaggaaataaaaatcgtaaaagaattttcccattgcctttttacatttcataccaatgaaacaaacaagcatagtcaaattgttggagaaaaaactatttaccaaaaaaaaaaaggggagcgcaaaactgaggcgggtgaagtcatcgggccaatgagagggatgctctttcggttccttagcttccaatttatttttaaatacataaattgatttgcatatatctttctcaaaccttgacaacataactcgttttcaaaataaatgaattttaatcaaatttctaaaagaaatatactcattaccaattttcctttttattctaagatccatactcttattgttattctaatgaatcatcatatcggaaatcaataatttattttatagttatacaaatttttttttttttttttgatcatagtcataaaatctctctttcaaaaaataagattaaaactataaaattaatatcacaaatcttcaagttgttgtaaaccagtaacactatagaaaaaatagactgaactatcgaattatatactttacaaatcattaacttatggtaaaaacgtttataatttttttgttttatggtatatggtaatagcttttggaacccgcacaactagaagtaaaagaaaaaaaacacactaaaaaagttaacttttatacattttggtttttggccgattacatttatgatttatcattgaattgcaaaataatttatttctgtaataataaacgcgtaattagatctatataaaccctaaaccccatcactcacttactctacccctggcttctccttcaagctatactctcattctctctcctccgaccaaagttttctgttcctccgcttctccttcccctaccggtgcgacttctcctctcttttatcttctctctttgtttattttaacgccggaaatgtttctcacttgtacgttttggtttccgatgtaatctctcgtcttctctgtttcttgaaaatggggttttgatttctgggtttgatcttagctccatcaactttgatgcttccccttgatcaaaggattaaattctacagtggagattatctatctgcttaccaaattttgatcagttacaacaaaattacaaaatcagaattagccctagaatttgttttttgttgttacagtcccattcattgaaaagtgtcttcttctatgtgtaggtgcttcgttttgtgttgtacagcagatgtctgttgatatctgcaagaagaatccatcgtttctttggtgtgactgtggatatatgagcagaggaaggttgtggtgctttcagaccatcatgttttcttcttcttcttagctttttgtctctgctagatcttgttattgtgagttttttgctttactggtgagggaagttacttagtgtagtgaaagttttccccttgtcttccaatg

SEQ ID NO: 990 - DNA, 3000 bp, Unknown
  misc_feature (1)..( 3000): cDNA_ID_4256566_gDNA_ID_1620344_Annot_ID_154093 3000 nt of promoter + ATG
ctgttgattttgatcaattgttatgttatgtaggaacttgtaaagatgaaggagaatgcaaagttgaaacagttgcctccagtatataccgggaaatgggcaacagcttctgatgctgaaatagagcaagagttagaaaagggaacaccttttacttaccggtttcgtgtgccaaaggaaggctctttgaaaattaatgacctgattcgtggcgaggttagtattataggtttttttgtgtgcttaatcatcaatctatgtttagatactgttatttaaagctcgatagtaccttcttgtaattgaccatgtgtgatagtgtcttgaaggtctgttggaacttggatactcttggggattttgtggtaatgagaagtaatggccaacccgtttacaacttttgtgttacggtagatgatgctaccatggctatatcacatgttataaggtagtgtcttcttttggaatttgagtttcttctcttaacatgtttgaatgttatcttgatcaaatctattaactttcatttcagggctgaagaacacttgcctaatactttgaggcaggctctaatttacaaggtaagcactagcttatgtttgtttattccaattgctttcggaagttatgtgatccagaatataggaggaagaatttgatttattgctgtctgtatcaatcaatggcaggctcttaagttcccgatgcctcaatttgcacatgtttctttaattttagctccggatagaagtaaattatcaaagcgacatggggcaacttctgtaggccaggtgattatagctgttatttcctttactgctcgtagatcatagattactccattgctgattcttcatctaatttctgctttatgtccctttcgaaaaaacagtacagagagatgggatatctacctcagggaatggttaactatttggcactcttaggttggggagacgggactgaaaatgaattcttcacactcgaggatcttggtaggtcgtttttgttgactgtagttactttgttgccatccctagcttttctgatttcttcattgaatgtttgttcttgatttgcagttgaaaaattctcgattgaacgtgtcaacaaaagtggcgcgatttttgattcaacaaagttaaggtgattatagattttacttagctgtttgaattatccaatcttattctctcttgtttttcgtatctctgtttgttctctacctttttcttataagtagcttcaatgtggcatatttataaactcaaagatggatgaatggtcaacatctgagggcacttccaaatgagaaactaacaaaacttgttggtgagcgatggaagagcgctggtatcttaacagaatccgaggggagttttgtaaatgtatggtttctaatcatgactccgcactttcttctgatcctaacataaagctttggaattaggaacaacagattttttctgtatagacttacccagtttgagcttgttgttgaagtacaggaagctgtcgagcttctcaaggatgggattgagttggtgacagattcagacaaagtacttttgaacttgctttcatatcctctacacgctacattggctaggtaactatcaaaccgtttgttcctcctgcatcacctcttttctttcaataaatattttttacggttttctggagctctgcgcttgtgttgatttgagtttgctgcacctgatgcagccctgaagctaagcctgctgtggaagacaaacttcatgaagtagcagccagcctcatagctgcttatgacagcggagagattccaagcgctttagaagaaggacaaggtgcttggcagaaatgggtgaaagcctttggcaaatccttgaaacgcaaagttagtcatctctctaatgcagttaataccgaaacaaaatctactttacttgagtgaacaaaccttacaagagattcttctgatgctggttacagggtaaatcacttttcatgccactacgagtgttgttaacgggaaaactccatggtcctgagatgggcaccagtattgttctgatttacaaagctggaagtcctggtatagtggttcctcaagctgggtttgtgtccatggaggaacggtttaagattcttagggagatagactgggaagctttgaacaaagatgagagtgtgcctcttgaatctacagccacagtatcaacctgagaaaactcccctttttttttttttttttttttccttcaatatttggttagttggtgagagaaagacagcccagagattttgattcctcgtgcatttcttgtttcccgaaacaaatggcacaaagaaatttgtagattataatgtatcagcaaagcaaacttaggaacaaaccagagagcttgtaacattatcaggccagttttaatttgctttcaatgctctgttttcttaacattttcttctttgtctgttttttttttggtcattttttttcttatttgtttaactgtactttctctctaaggataaaatcttataatggtaaaagctctcttttgttctttctatgaaacataggctttgccaaattagagtcataatccgaaatctttacctgaccgggataaagttcagttaaaccggatcagactaagaaaacagagtaccaaacagagatttttgtgatttttgagagagtttgtgtggtggggactgaagtgaatctaaccacataaacacttggaagagagaatctgaaaaactcaaactttaaaagcttgaagctttgagtaataagaaaaggtttggacttttgccaataggactgaagggaaatctcaccttatccacactccaaccacaatcccttattacatcttagtccacgtcatcatcatcatcctcattcatctctaatactaaaatctaatctcttccttgctcactcaccaatcaaactcaaaaaactcttgaatttttcaagaacaaaagaaaaagacatctttaatg

SEQ ID NO: 991 - DNA, 3000 bp, Unknown
  misc_feature (1)..( 3000): cDNA_ID_2045289_gDNA_ID_1620345_Annot_ID_154123 3000 nt of promoter + ATG
caaatcaatacatatcctcatcctcacccccaaagtttttcagatctacaattaatggaggaagagattgctgatggtggaattctatctccgtttcacaaccatcctttatacccaacagacgattcgtcgactccgtgcgttgggtgtggtgaagagacagctggaaaacacgcttgccatatttgccatgagatcaacgtccataagggttgccttgaaatcatcaacccttccagtcccgcacatcctctatccttaaccgacagatttgacgattatatcaaatgtaccatatgtcactgggtatttcacagatatatgtattattgttccttttctggtctccctgtttgtaaacaatgtgtgaggaagccctttattcttgacccggaaaaggcacacgagcatccactcctcatctttcttaaagggtctttctcttttccttgtgatgcgtgtggagtgaacgatgctaattcatgtctttgtctatgtatcccatgtcgtttcaccatccacatggactgtgtctacttaccgcgagtcatatgtgttaaccgtcatgatcaccgcatctcgcatgttcctcgtctaggctcaggaaattggagttgcggggtgtgtcgtaaggaggtcaacggcatgtatggggcttattcatgcttgacctgcactttcgttgttcattcaagatgtgcaataaggagtaatgtttgggatgggatagaattggaaggggtgcctgaagaagacccggcaaatcttttgccattctatgtggtagaagaggggctgatcaaacattttactcacgaacacaatctaagactcgtcaatgaggatgatatccttcatgatataagcaagcaatgctatgggtgcgtccttccaatcttttttaattcatgctacatatgcacgctttgtgatttcgtactacatgaaacatgtgctaacctctccaagaagaaaaggcatccgtctgagagtcggagattgactctgtatgatgagtattacgtaaattcacttatgaggaagggtcctttcatatgtttcgtatgtaatcaacgctgcagcggcttcgcatacgtggaagacagtgagcgtcgtgacggcttgaagattgatgtacgatgtgtttcaatttacgatgggtatgtccataaaagtcaaccacattcaatgcttgtagttcccgataattggagcacatgctcgatttgcggaaaaggtggtgagcatatgtggagtttgactgggcaggatgatttatttatgtgctacaagtgtgctactatccctgaactggcaatgcacaaatacgatgttcatcctttgtccttacaattcggtgagatggccaagggtgattattggtgtgacatatgcgagaagattctagatccacaaaagtggttctatacgtgtgacttgtgttgtaccactcttcatattgattgcgtacttggaatggagccatatatgagggttggatccaccttccatttgaaacgatttgtattggaagttctttccaactatagtgcttctcggccacattgttacacttgttcgtctcgtatcaatgatcttatcgtctacaagagcaaggatgtttacttttgttctttaatgtgtattaaaaagagtccaaaactcgattctggcttgtattggtctaatatgtatgacttcactgagcctgatttgcatttgtctaacttttttcatgatgattcttgaaatttaattttattgagtttttttttgtgttttctaaaaatttgtactaccattagagaattttatcaaataaactttaaattagggctttaattacatttatataaatagtactccctattttcttttttatttgattgtttaggaaaaacacacatattaaggtaaacatattaatatgtaattaattttcttctgaatttctttttttttttcttttttaaatataatattaaattatagtaaaaaaaaaaatagctttttacaattggtataaacgattttttaaaaagaaatttatattttacatagatttcttagttgaaaataatgatccaagtgaatcaagcacggcctgcgagccaaacttgaaatgctgcatcattattcctttttctttttcctatttttttccttattcttttttttatgttttattccaactcccctccagtcacaccctccatacactttaaaacagaattgttagccaacttcaagccaaaaactataaccagctttgggctatctttactttacggtttattatctaaattcaccttaaccaacaggtatgtaattgttccaaaaatttcttgttgatgatatcttcccgctacaacaaaaagaattaaaacacatgtatacgtcactatccaaattcaaaccatgtcttttattttcgccgacatccaaatcatgtttaattctcaatagtaaagttcatagttgaaacttcaactggaagcaaaaaaaaacaaactttccaaaacaattaagaaacaaaatgctattagttgaaaaataatctttgtcacattgttaactaactagcttttaagtgtcaaccaccatatggtccttaattagatcttatatctaacctaaatcataataatattttttcttcattacagtagttagatccgtttctgatagaaagaaaacaagagttagatctcttcctacaaaatcggcgttaatatatttgaatctgatccatactatccttttacttcgttcaacagttcaacaagtatcataaatacactaaaataattacacaacttctttactttatcagtcttcacgtgactctgaaaactttccagtccccgacagctacttctctattgtttcttacatccttttgtcacgtacctcctgctctcttcacctctctcttgatatgtaataataatcagacagacatttacatgcttctttaacacattcgtcttacaagctatg

SEQ ID NO: 992 - DNA, 3000 bp, Unknown
  misc_feature (1)..( 3000): cDNA_ID_2045216_gDNA_ID_1620345_Annot_ID_154146 3000 nt of promoter + ATG
cccgaataaatcgttgttaagtgtttttaaaaaacactaaatgattgttcttttgtgttgtaggacttttgaggttagaacatgacgtgagttcttgcgagtatgaagacatacacataatgtggaatttgttacacaagaatgaagatcttacacgcgtaccaatccaacaacaacaacaacagaggaagaaaccttgttggaatcttcttggttcgtatctttgccaaagattctgatccgttttatgatataaaccaaaccattgttgtatttgagagagccttgacgggtcccttgcagtgtggtgtggttttattgacaaatttcgcaaataatgaatccgaggttgcagagttttaaattagctgttatatattccattgcatacctctatgtacttatcatcacatgagtgttgtatatatattacaaaatgctttacatagtttgatactacctatgttcatctacttggtttcattgatcttgccttttcacataagaaaacagaacaaatcttaacttaaaactcccaagttgctaaaaaatggattttgtaatagaaggaaaaactttcttgagaatccaatgataaatttatcaaattttaaaatcaaagcctttttccaaggaaaaggaataatatagtggtatctttatttaataggtctctttagaaagaaaaaagacatccctattccataaaaaagattagacttccaagttccaaattagtggccattattaaaagaaattaaattagcaaccaatgagaaagatgaaacgtcagaatcaattggttagatactgatgtccaaacaagtgtgtgtgtgtttgcttcatatatgtgtgtcggctgcttctaggcttattaaaaggccggtctttaaaagagtattcaacaagtattgtgtgatgatgtgattgctttttctcttttttggttagacatttcacctaacgactctttgatttcattatatgtaactaacgcatgttgatatctatatactctttgcctcttttttttttcccaatgtcaaacttacatattcttttcgtgtgaatcttttatctttatacttgtctcaatcttttttgtcaatcacatcatcacacaataatttgagttttttttttgttaatgaaaatttcacatgccttcatcttctttccaccaagttcttcatttgtcatgacatctaagttcttgtcatttgtcatgccttcatattcaacagctccaaaggtggggatcgcgtcgttgaacactttaatcgcatgtatctcgctggaatgcaaaacggcatcatactgatcggttatggagttataccgatcggttctctatttggtctcatacttatcggttgttgtaagtaaaccgatcagtatcaatctccgtttccagcttcttctcattctcgaatgtgatggtattgacatgctacttagactttgagtaagaaacgatatcagagactcgcttcaaacttcacatatctcttcatcttctgttggatttaataattcacatatgacttatcatatgaagaaaagaaactttgattatgtctctcgtttcgattattttcctactaaaaataattctcattttacaaaagtttctttcactcaaaccaacataaataggtatactcctattttccccaccaatacatgtaacaactctcaacgtgatattgaacatgttaagcatgccttagaccatccttattacatgtctcatactataaatcttaggtataatataatcaaaataacatgtgaatagtttagaagtgtttcttagctaagagataaaagaaggtttaagagcttcaaaccattacaaaaattcttagctataatgtttttcaataaaacaattcatcataatagttaagagacaaaattaagagtctaccattaaagttgctcttagactcgtccaacagtttgaatcctatatttcatcgtccaaattcttttaacgcaaagtgcaaaatcttgaaccctacacctcttaatatcgtgtttccacaccaagattctattgatcgtcaacatttagacatgaattccttgttatcaaagcacaatctgtgttttccaaggtggtcgatctttgatgaaagtgtccaaaccagccaatctttttgaataatctatttattatattgattctgaagaagatgagaaaaatgataaggatcaatatgatgttcgtacgcatagtctaccatatgaaaaatacggtccatatacatgttctaaatgtaaaggtgtgtttaatacttctcaaagttttgctgcacatatgttatctcattacaatcatgagacgaccaaagaaagagaacatagacttactgcaagaaacaagaaaagatatcgtaattacatggaaaatctcaaaagatcacaacagaaggtgggatccatattagtgacataagtgacaatgaaacttttcaaaatcttgtatcataaaagaagagtttgtttatgatttatttatttcatatctcttattcaacttattttatttaaataaataatgcaaacttgtcttctatttatagtatttcataatatttgttattaccaggaatggatatgcatatttgcacagaaaattgtaatctttatttgctctttatattttaaggtttggttttgagttttttttataaaataatttcttaaatttcaataaataatacgcatacacaattacgcatgttaagccatattaattaataaaggaaagagacgacagttataccctcacaaaacttaaacgtaattatctccccaccttccccactctattctcaagttcgccggagatttatactaacactgcaaaattcactcacatttctactaaaatcaaaaccctagtctcgccgggaatctctcaaatccgtaaaaatcttctctattcaatctctccttgctcacattcaataacgaggcaatgttgatttctca

SEQ ID NO: 993 - DNA, 3000 bp, Unknown
  misc_feature (1)..( 3000): cDNA_ID_3060042_gDNA_ID_1620345_Annot_ID_154136 3000 nt of promoter + ATG
tcatcatcttcctcgtttacgaattaggtcttcctgtgataccaaatttaacatttcccggtgaaaatttcgaagctcaaaactctaatcaaaacatcgcgccaacacaattcagcttcatttttcaaaaaatcaaaacctgtaaagaattcggaaaaaccgccaaaatccaaactttattccaaaaaatcacaaaaatgtctcttcgcttcttctctttttctcacccttctcacttccattctcatccacctaatctcgatctcaatccctctctcttgaatccaatcaaccatggccgacgaaaaagagaactgcgtgagaatgacaagagcagcaacaaaaagaaaagcttccatggaagcggcaatagacaaagaacgaatcaacaagaagagagtcgtactcggagagcttccaaacttgtccaacatcaagaaatctcgaaaagccactacaaaacagaagaagaaatcagtttcgattccgacaatcgaaaccttaaattcagacattgacacaagatctgatgatccacaaatgtgtggtccttatgttacatcaatcttcgagtatcttcgtcaattagaggtaaagaaacaaaacccatctctagatttctagatttcacaatctgagttagtttctcgattaacacaattcaggtaaagtcaagacctttggttgattatatagagaagattcagaaagatgtaacttcgaatatgagaggagttttggttgattggttagtagaagttgctgaagaatacaaacttctctcagacactctttacctcgctgtttcttacattgatagattcttgtctctcaagactgttaataaacaaaggcttcagcttttgggagttacttcaatgcttattgcttcgtaagctttttcttgttttgtttgtttgaatctctctttttttgtgtgggtttgtttatttggattttggttttgaaaaatttgtagaaagtatgaagagattactcctccaaatgtggatgacttttgttatatcacagacaatacttacacgaaacaagagattgttaagatggaagctgatatacttcttgcgttgcaatttgaattaggaaaccctacaagcaacacgtttctaaggtttgattctgattcttttggtgctcattgagtaatgtttttgtgtagtttattgtctcattgcgttttgctttgtgcagacggtttacaagggttgcacaagaagatttcgaagtaagctctttttgaattgtggtatttgcaatttatagagagtatcaaatttgctaagaatttctcttatttgtttcagatgtcacatttacagatggagtttctttgtagctatctttcggagttgagcatgttagactatcaatctgtgaagtttcttccgtctactgtggctgcttcagcggtgtttctcgctaggttcatcatccgtccaaaacaacatccctgggtaaagcattttgcaaagcggttcttgttctaattctctgtgttcactactttatataagaagctaaagctctggtgttgaatgtaacagaatgtgatgttggaagaatacacaagatacaaagcgggtgatttgaaagaatgtgtggctatgatacatgacttgtatctgagtagaaaatgtggagctttagaagctataagagagaaatacaagcagcataaggtaaccctaaatactattaaatgataatttgaagaacaatgttcttgagattcacatgtttctttttctatttggttcaatacagttcaagtgtgtagcgacaatgcctgtatcaccagagctgcctcttacggtttttgaagatgtcaacatttagagacaacttttggtaatcggcatagatagtataaaaccaggtagcggtttcgttggtttctttccttggtgttttggcttgtacatgtcttaggactactagtgtgataaaggatcttaatatatgtttaaagattttggttacttaatgattttttttgtttgggttataattcaagcgttcaacaccaatgttgaaccatgcatttccataaatctatctaatgggttgatgcctaagccaaccgatgcaactatacgtaaaagattgagatcttgtgcactacatattccattctttgacatccaaagctttccacttatcttcagttttcttcgttttgataaaaacaacgctccatctttgttttacattatcgtcatccagacatccacactagaactcgccatcagtcaaagaaaaacttctcaaaccaatattttgcagctgttcactattaggttccactaggttgtatatagaaaaagaagattggtttgagaagtcgcttcttgtcaaaccaatattttgcacctgttcactattaggcatagatagtaaccggcatctgcctatgcactcatgaaatccgtgaatcatatcagcttactggtttaggcgttaaaaatcggtgttaatcggctaaatcggccggtttagtgtttattatttttctttcaaatatgacatctttataagtaaaaaacatttaagtaaaaatataataaaaatacttgattactaaaactaaaaatttaagccaaagatttctatcgataaatataataaaagaatagatattaatttaataggtgataaatgcgaagtttccacgcgactcaaatacatcaaaactttgactattgaaatatttttgactatttattgtgcatgggaaagattttgactatttaatgtgcaatctctttttttgtttcttttcttttttttggtgcaattaaatctcacttatttaccttaatcatgatttcctctataaataaatcacctttccttcctttgtttttgttttcttttcttttcgtattaaattttcttgaacaaaaaaaaaaaggtttatatcttttttacataaagagatttagtgattagatttttcagcttcttcttctttctttaacc

SEQ ID NO: 994 - DNA, 3000 bp, Unknown
  misc_feature (1)..( 3000): cDNA_ID_3052024_gDNA_ID_1620345_Annot_ID_154137 3000 nt of promoter + ATG
ctccaagtggttcttatcaccactatgaattaaaagacttgcaaaggtttaaccagaatcaacagagattgtcatatcagaacgattatgttaatcaatcttataggtatgatactattggtggtggtaatgggatgcttaacaatagtttcttgaatggagttccttgtgcttcaagaaacaatgtttcagattactacactaatatttttgggtatggagttaacaattcttggaggagtaatgaaggttgtacctataatcaagatcaggcggcctcgtcgatggagaatgggaggggctcgtacttttccattgctacagaccgagtatggagcaaggaattggagaagactatctttgtgggtactaaagagacgattgatatgattttcgatggtctcattgtcggtatttgtgagttgatggttgatccttttggtaatgatgttgttaagctgcttatcggaaaatgcagctctgaacagatcattctgattgttgatgttgtcactcggcacatttctaagtttgttaacatatgctttaatccgatcgggtacacacttctaatcattattctttaactttgagatatgattgtgcattgtttccttggatcttgattttctataattctttcttttggagatatcagaactttggcaatacaagttctgttaactagtattcatgagcgtgctaacaatcaaatcccgcgcattatggatgctataagctcggtagcacttcaattgacaaggaacaccaatgccaaatatgtgattctagcatgtttccgcatgtttacttcgtcgcagtgtagggtaagcatctcattcacatattaatctacttcagttctcaaaacctatatagaatatttgtttcttgtcatggagttgtttgctagttttgtttaagcttcaagtcactttcttataccatatagttgatgaaagaatctactatagaacacctcaagtagattaatcaatttgatgtttgagtttgcttgttatcggttaattttgcaatgtttgttttcttaagttcctagaatctgtatgttttaattgagcagatctgacctcaattattttctatcacgtggtataagtaaaatgtgccattattgaccatggatcacaagtttaatcttctttcacaagtattcttgagaaatgacaatctttcttctgtttttacagcgtcttcttgaagttgtctctcaacattgttaccagatagcgattgatcaaaacggatgctgcttgcttcagcaatgttttgacaaggaacgtgttccgaatcatgagataaggcaacgtttgatttcggaagttatcgaacatgcgttgaaactctgcttgaactgtcatgggtaaacatgatatgaatgatatctacacaactctactttctcatatatgatccactttattttttactcacaagtatgttctccttcagaaactatgtggttcaatatgtcgtggagctcgataatcaacatgaaacagatttgctcgtgaataagctacttaggaactatgcgcatctagcccgcaacaaatatggaagtcatgttgtgcagaagttgttgaaactaaggggtatcgactctaagctgattgttgttgacttgcttagagggattgatacacttcttcttgacccgtttggtaactatgtcattcaaaccgcatggtttgtgtctaaggtaatgtcttacagttttttttcattacggtgatctgattagagattttgcgagattatgagaatcttgtttggtgtgtgcaggaagatgtgcgccagatgttgaggtattatatagagcgtaacattcgattgatgaggtgcaacaaatttgggaacaaaattctggagaaactcaatatctagagagagctgaatggtagaaagaagaatttgtttttgatgttgtttagttggtttgttatgattgattcattgtgttgtcattggtaatgatgatggttcttatgtgttttcttgtaactttcgttgaatcttaggaaattgttagacaaaactagacaatgttctcaccaaaacagaatgtctttctcttgtaaggtttgtgtgttgtgttgtgtttttagctttttttctctatgtaaatgattgaattgttcaaagtttattttattttttattttttattttttatttttttttgtcaaggaattcaaagtttattcattttttttttttttataatgtttttctgctctgttttttttcattgcttacttaggtaattttctatattttgatgatatttcttttcgaatgatttgagctttttattctaatttcgttcagaaagaattctacgaaagctaaaaaagataaatacaaataataattactggttgtgatcaaatacaaaattgagactagtcggttgagttggtttagcagatacaaccaacgatagtagatgtgatatattccgaaaagtatttggtttaaatttttgtgaacttcaactaatcaaacttgttttaatgctcgtctagtttaataattcgcaaaaagatttagaattctagaaattaggcataactaactcacgacaatggcttccacaatctgcatatcataatccacctttttccgtttttttccataattactttgtttgatgtgtttaatccgcaccgtttctcaatttgccggtctcccactcacatacctacctttatcagacatggtaagaagagttatgattcgttgacttcacaagacttgttcaaacagacacgtggcactacattattcgttattctaaccaaaaaaaatattgaatcatgaaaccaccgtgagagacaaattccattcactctctctctctctctcttcctttcttctcatttttcaaggacgacggagccacggtggagttgactccgcttaaaccccctccgtcgccaccggcgttcttcaatttcaaaccccaatccaccaccc

SEQ ID NO: 995 - DNA, 3000 bp, Unknown
  misc_feature (1)..( 3000): cDNA_ID_3060034_gDNA_ID_1620345_Annot_ID_154140 3000 nt of promoter + ATG
tccattggagggaagaaatggaaaccaattaaaatatctcagactgagccgaagctctcacacatctgttttgcagacgatctgattttatttggagaggcttctgttgaaaaaattcgggtgatcaggggcgtgctggaaaggttttgtgttgcgtcgggccaaaaggttagcttggagaagtccaaaatctttttttctaagaatgtctcaagggagatggggaagttgattagtgatgagagtggcataaaagctacacaagacttgggaaaatatttggggatgccaattcttcataagaggattaataaggatacttttggagaggtgcttgagagagtctcgtcaaaattggcgggttggaaagggcgtacattgagtttggtgggcagattaacgctaactaaagcagtgttgaattcagtcccggttcatactatgagcaccattaaactgcctcagtctacgcttgagaatttgataaaatctctcgctcttttctttggggcagcacagcggagaagagaaggcagcatttagttgcttgggacagagtgtgcttaccaagatgtgaggggggcctaggcattcgttcagcagctaacatgaatagggctttgatcgttaaaattggatggagagtattacatgatcgttccagcctttgggctcaagtagttcgaagcaagtatcgagttggagaagttcatgatggatcttgggctctcgctaaaagcaactggtcctcgacttggaggagtgtaggcctggggctgcgtgatgcattttgcaaggtgttaaatgggtaatcggggatgggagacagattcgattctggacaaatatgtggttatctaatactccacttattgatgaaattacagctccaattccaccgaatttggttaattgtacagcccgacatctttggcagaatggagagggctgggacatgttgagagtagcgccgtttgtcacagagaataagtggttggaactcttggcagtggtagtagatggcctcacgggagttttagacatgctagcttggggagagtcctcagatgggctctttacggttacatctgcttatcatatgttgactggaaatgaggctccgggtcaagatatgagtagtttctatgggagtgtgtggaaagttctagtgcccgaacgggtaagagtctttctctggctagttgtaaaccaagtcattatgacggattctgagcgaaaacgaagacacttgtgtgagtctgatatttgtcaagtttgtaagggaggcgttgaaacaagtttacatgtgctcagggattgtctggctatgacaggtatttggctccgcattgtacctaggcgcatgcaaccggggttcttcactatgtctttacttgagtggattcacacgaatctgcgacagagtggtaataaagaaggtagtgattggtcgactttgttcgccttggcgtgttggtggggatggaaatggagatgtgggaacgtttttggtgataacaggagatgtcgagatagagtgcgtttcttaaaggatgtagctgccgaagtttctttagcgaattcaaaaaaaagggaacttaggccggtggtggatcgagtgggcaggttaatacaatggacggctccaactgtaggatggcacaaactcaatacggacgatgcctcacgggggaacccgggcttaacttcagccggaggggtattgcgggatagtgagggcgtttggtgcgggggatttgcggtcaatattggtagatgctcggcccctttagcggagttgtgggggtgtactatggcttatataccgcttggggaaaacggattacgcggttggagttggaagtggattcggaggtggtggtaggttttctcaaacaagggataggtgagactcataccttgtctttcctggtacggttgtgccatggcttcttatcaaaagactggatagtgcgtatttctcacgtttatcgggaggctaatagtcttgcagacggtttagctaaccatgtgttctctttgcccttgtgctttcatatttttgattcggttctttttgttgttgatacgctgtttatcgaggataataacgggcctgggcgcctgaggcatgtacgtttgtagtttttttttctttagttttttttaatacaattccggggatttatccccgggaaatcaccaaaaaaaaaagatattctagaagattttatactcctaattttactccgagctaaactcggatctttgtatttatatagatacacaagagcaaaatttttagtattagcacgaaactccattcgagctaacacacctccgccgtttttgtctcttcttccgatctcatctcatctcatctcatcgatcacctactctcaaggttaataacctaagacttgatccttagaaaaaaacaccaaagtccatgttttgattgttcggtcaatatatagtcatggttaattgattaagatgtaactgatctatatgcttcggttcatctgttattgttatatttgattatcgatcatcgttattacgagttgcttgtcaatcgttactacttattagttctgtgtcataattaagctttattagggtttttatttagaataatcgttcacaaactgacatagttcatattgttttactaaaggcacgttttatagatttattgattcatgtattgtttggtttggtataaatcgttggtttaacctagtttgagattctgatgcttaacggtttttttttccgatattcatcatcaagattgtttataattatacataaatgccttcaccatgattggagcatgttacaatacattcactgcataatattgaagattcacagttatagttttactcatgattactctttcattataaatatacaatataaatctctaattaattaatatctctctctctttttctgtttagatttttcagctcctccttgattttcaaaacc

SEQ ID NO: 996 - DNA, 3000 bp, Unknown
  misc_feature (1)..( 3000): cDNA_ID_2045228_gDNA_ID_1620345_Annot_ID_154142 3000 nt of promoter + ATG
aaaaaaattggttcaatttaaattggttcggttcaattataatggtaacaaaacaaaaaaaaaaagagttttcgactttcgatttgtgaaggaggataataaaggaaaatcacttagctgcgtcttctccctttcggcatgctgacgtcataccaattagatttgagccacgtatgataagattcagtatgggtcccaaatgtcgagtgccgttgtatacgacgaacactattaaattgtcggtagctcctagttgcctccacgtgtagatttcctgatggctttcatgaaatcaaattgggtttttattcattttttgtggaagaaaatacggaagaccaaacagtatcatttttttttctgacggcaaatatctcgtgccaattgttattttcttaaaagtatagtaggacaaaagtgtaagggcaattatatatacttaggacgataaatagtgttttattttggccacaatgtgacaatggaagaatgatgttatatgattcaaggaggcaatatgacctaaaacgtggcctaagtttggtttcatttgtgaattatgtggttaacctcatactagttttacctaccctaatttatttttggcattaatttaaataaacaaaaataaaccaaattatttttttagtcaaaatgttacaagaaagtaacaaaaagtaaaagaagatggtgaagcaagttttcgcagtaaaacgcgatggaactttgagacttcctgataaatatatgcttagatgatcaaaattcatacatgtttatgtccatatctatgcgatacttttgctgcattgtagacaccaaaaaaacaaaaaaaatctactagtactgatggttggttcaattgaataaaaagaatgcgattgcgtgtgacccagaacactcatacttgtcattgttcagctgtcagctttcgtctggtttgccatatatgtcaaatagattgtccatatatatgcgcacgagctattcatcagtggctgcaaccagaagattacaagttgaagttaagaagtgtcttcaaacatcccaaacaatagagaaagtaataagatagatatttggtttacctgtagatgaactggcacatacttgaatgtaacaaaatcacagaccggccaatacataagtccatttttcaatgttggcagaagatctctcttcaatctcgccacaatttcctcagaattttcgccttaaaaaggaccaacaacgtgccagaaccaatctcataatgagcaccataaatttacaggcagagaaaccgtaaaaagctaaatccgttcaatccatagaggtttgattatgttatgtaccttgtaaagcagcattgtaggaatagaagactgtgttgctaacaggtccgaaaagaacctgccccatcattattttcttaaaggttgtcaacacgtcgcgctttggcaatatcttcgaaagataactgaaccacagatgctgagacggcccgagaaatatcaacccaaagctcgccattctcgctgttcttatcaagtcaaaagaaccagttggctccattgtgatcatctgttgaagaatttagagagtcaacacaaataaaacaaaacaaaaggttctctagtttcgctctaacatattactgggggaagagcaccacaacatgatcataaaaagactcaaaagagaaatccactaatgacaagaagaaaaacagagtttacaagaaccccaacacacacacctaaagcttttttcaccttagcaataagtattcacaagagataataacaagaagattagactattcggattggagtgtgagttttctgagtaatcaaaccaatactaaattcatccattattcagtacagaaagacttcaaattcacaagagtacaatatacagattcagtaaacactgtaagtacagtctcacacatcaaagaacaacagttgagaacacagactaaaccaaaaatatgagaataacaattcattaaaaaacaccaacttttagtgctatctccacctattctttactaaagtattataacttcttccactagtaagattatgatctagtttcaaatcaaatttggaattgtcttggtataataacaaatgaagattagtcttttcttcctaaatcaagagataaaattcaaaactttaacaaaattctctaattagtaatgaaatgagaaagaaccctaaattccaaaaactacaaagattcaaaaaaaaacctgagaagtgagatctgcagccatatagatgacagaagtagtgatactcttagtcataaaaggatgtgattcgagctttctcaaataccatcgtagaaacgcaggttgtttcgaagaagaagacgaagccttcgtcgttagatttcgcgacacggagaaaacacgagggattacgaaattcccagttttgcgtagctcgtgaatcgatcggccggagaatccgagaatcggtttccgaccggtgaacactgttttcaagagagcattgttgatcccgtgaagagagcgacgatcggagaagaaacgtttgctcaatccaacgatattcatcttcttttttcgccgatgcttcgttaatggcggcagcttacactgtacttttgatgtatctctctctctgtaccagaacttttagtctcaatacacgcaaacaacaaacagtgcttaaccaaaaccaataaacgacataaagtttgatatatctctccacgcaataaagcaaacgacagcgtttttcgtattccattaaacgtcatgcagtttttaaaagaacaccaataaacaacatgaggttactcatccataacaaacggtatcgttttttttcgatcaaaattaaaaacgacatacagtgctaaaacaaagctaataaacgacatgaggttagtttaggactaatcttataacatctgtttcctattaattcatctacgccgagagctctctttctctctttgccttccccagctatttcaatg

SEQ ID NO: 997 - DNA, 3000 bp, Unknown
  misc_feature (1)..( 3000): cDNA_ID_2045232_gDNA_ID_1620345_Annot_ID_154141 3000 nt of promoter + ATG
atacattcactgcataatattgaagattcacagttatagttttactcatgattactctttcattataaatatacaatataaatctctaattaattaatatctctctctctttttctgtttagatttttcagctcctccttgattttcaaaaccatggacaagaattttcgtgtcaacactaacgacgaacgtaacatctggttgtccacggcggtgaatgagaatctgacaatggcgtcgtcgtcatctcagccacaaccaatatcgtctccgtttcatcaaccagagaatcaggtcaacagagttaatcctggaagtcattattatgatttggaaaccctagaatcttcttttggtgggctttctttcaacgattcaagtgttggtcagaatggtgattcgattcacctccctcgtcgaaccaatcaggtattcactggcagtagttctggtggtgctggtgatgacaatggctacttgttacctccgatgggttctcatcaccaccgtgaattagaggagttgcaaaggcataattatctgaatcaactgagaatgtcgtatcagaacgattatgctcatcaatcttattggtataatactgatggtgatggtaatgggatgcttaataatggtttcttgaatgatgttccttcttcttcaagagaccgtgtctcagattactacactaatcgttttgggtatgaaggttacaactattggaggggtaatgaaggttttgactataatcaatgtcaggcctctttctctgcctttgctaaagacaaagaaatgagtgagaggttggggatgagcatctttcagggtactaaagagacagttgatgcgatttacaacggtctcattggcgatatttgtgagttgatggtggatccttatggtagtgatgttgttcagttgcttatgagaagatgcagctctgaacaaatcgttcagctcgttgatattgtcactcagcaaatgttccagtttgttaacatatgcattgattctctcgggtactacacacttctgattcttgtttaactttgacgtatgattatgcatttgttttcttgattgcttttaatttgtatttgtcttttttttggagatttcagaaccaatgctatacaagttcttttgacatgtattaatgagcgtgctaaagatcaaatcccgcgcatcgtggatgttgtaagaacggtagcacttcaattgtcaaagagcaaccatgccatctttgtgattctcgcatgcttccgtctatttcctttgcactgtagggtaagtatctcattcacagtaatactctgctttagttcttaaactactatgttaaagatctatatagaatctttgtttctggtcatggagttgttttctaattttgtttattgagctttaagtcacttatttttataccatatagttgatgaatttgagtttgcttgtggtacaagtaaaatgtgccattatagatcctgaatcattagttaaatcttctttactagtatttatgaaatgacaatctttcttctgtatctgcagttacttcttgaacttatcgttcaaaattgccaccagatagccattgatcaacacgggtgctgcctgcttcagctatgttttaacaaggaccgggttccaaatctagagataaggcaacgtttgattatggaagcaatcgctaatgcattgagactctgcttaaactgctacgggtaaacatgatatgaatgatatctttattatatactttctcatatatgattccttatattgttttactcacaagtatgttctccttcagaaactatgtggttcagtatatcgtggagctcaataatcgttatttaatagacgcgctcgtgagacagctaatagggaactatgcacaccttgcccgcaacaaatatggaagtcatgctgtgcagaagttgttgaaactaaggtggatcgactctagggttattgtaattgacttgcttagagagattgatacacttcttcttgacccgtttggaaactatgtcattcaaaccgcatggtttgtgtctaaggtaaggccgaacatttttttcattgtactgatcaggttagagactttggcgagattacgagaatcttgtttggtgtgtttgcaggacgatgtgcgccggatgttgaggtatcatatagagcgtaacattccaatgatgaggtgcaacaaatttgggaacaaagttctggagaaactcaatatctagagagagctgaatggtagaatgaagaatgtgtaacctaagaatgtgttttgattgattcattgtgttgtttttctttgttttttttttcttttttaggtgcgggttcttgatgtttttttttttagtttttgttaaatcttaggttagtcttaacacatcaagactatgctatcacaaaacagaatgtctttgtattgttgagatttactaggccaggcctgtttttctatcattgcttatttatgttaatttctatgttttgatgaatttgaattctctagtaatacatagacaacacttatagaaaatagtagaaaaatgtctctgttacacatatactatcgatttacaatgataaaatagtataaactattgtactaccaagttatttttttcttgtaaagaaatgtactacaaagttaaaaaccacatagttttttgaattgtttaagcgaaaaggaccatttgcatttcactttcttatgcggctgctagatgtcatcacattactaggccactatagttcacatttttaatacacaaaaacccacttggatctgtatatccacctggatcacatacaaaaccctattttccctttttgtctttaaccttctttaatcaccaagaacagccaaaagaccaagcaaatctcagatctttcatggaccacttctcttacaggaatacaaacaagatggtcaggacccacgttgttgtcggttccagaccctgttgtttctcttgtgcc

SEQ ID NO: 998 - DNA, 3000 bp, Unknown
  misc_feature (1)..( 3000): cDNA_ID_3060052_gDNA_ID_1620345_Annot_ID_154128 3000 nt of promoter + ATG
actagaataatatcgtggcctaatggtgtgtgcatctgaggaaaacaatacgttactggatcgaatcctcgtggacttactatcgttattttattttagattttcaaaacgacgtcgttttgtctgaaacagaacatactaaacggaaaattaacgctgtgttttttttgttaacggaaacttaacgacatgtctaaaatggcgaagtcaacgaaactttactattttattaaagtcaaacaaaactttaggatgttagtggcatttttgaagttcatgtttttttcatcccaaatttgaaagttcatgctttttttgacatttttcccatttacaatttgtaaagtagtcaatttaaactgtttgattatacctagattgaacaatatttttagtgtacatatgtaaatatacgctgtgtatattggtacactaaaaagtataattaaatagtaaagtgattattttctagaaaaaaataaagacgctctttcaaccattattatgggaacattaattaattatataggaatatcaatgtggaaccccaataagaccaattctacctagcacaaatgcaacaaggaaagtacttccaactgaagtcgttgttacaagccaagctagaggggttcaacaccactactaataacaagaagaccaacaaggacaatttgttcaaaagcatcaattaaccaaaacttccaaaggcacatatctcttctttaaaaccagtttaagattgtagatagaacttctagtgcaaagagttgtggaggtacaaacagaaaactatgcaaacataggaaagaagtttggaaagatccacattacgatcaatggagtttaaaacgataagctagaagggaagataatgcgcttaactcagtaaagataatagacttgttataagcttaaattgcatcgagttctaagagtctaacatagattcttctcggaaaaccggagaaaaaaacaagaaaatattttaaatttataattggtcttttccaagagtgaagaaagagttgataccaaattttgatcaaaggccattttggaattttgattgaacatgtttttttttttgtttttttttttgtttttttgtcaaggagtatggtatttctttaagataattgaattgctaaggaatataaaaaaagaaagaagaagaagcatgtctgattttgttttaattattttaggggtataatgcaaattttgagaatagagaaaattgattattttttctaaaatatttgtaagtaaactcattatcttcacgagggatcttaaatatttgtaagtaaacggttttgtccggcaattatttgtaagttctaaaaattatgatcacttaaaaacgaaaaggtcccactatgtgtcttctccacgcaaaagaaagtttcattttcttcattttattttttatttgtaatgcagtttcttattctaatgtaaattataaattaaatatttccatgtcccttattatactcaaatgtatataaaattttagtggccccataagaatctcttataacatgaatgataaacgatgacataaactaataaaaacattatcgtaattacctaatggttaatggtcaattttaattttatttccatacttcagatttgacatacaattctaaagttttataagattaataatctgtataatgtttcatatgattaataatgtttataggtttatacagtaaaaatgttttgacacacggattagctagcaactatgatgggtaaaccacatggtccattacattgtaaaacatatatatttgaaattgtcccttttctattcgacacttgtattacttgtaggaaattaaattttagtttaagaaatacatataaattaaattttagtttaagaaatacatataaattaataccttaagatattaaatatacatcaacattttcattagtattttcgcaaggaatcataataatagagacgaccatgtgaactaaaactcgagtaaactattcttccttttttatttttattttgtaaatccttaatctattcttcttaaaatataaaaatccacattatctgtcaatttttttttttttttggtgcaaccaattttctctcaacatttatcaaaagaatcttcttgtttggaaatcaaagaaaatcttgttttaacaattctatcatcaaacaatccgatccttcacgtgcttctatttacgtcccctatttgcttgggactagaagatatgtatttctaatttatcttcaccccaacccaatctaaccacatccacttggcacttctgagctgtcccttcccaccttgtcttaaccaataatagtggactcttcacaatttttacattttcatttttacctcactacttctctcttatttctttaaacccctcaattctttcgattggctccatcagccccatttaaaaataaaaattattaacttctaaacttttttgaatattggacaaaaacaataaataaagattattgactaactaaaaacatgattttaaatcattgtaggttgcatcttttttctcttacaaacaaatagttttggaaccatatacagtttttgagttaaaaaatagttaaaaaacgataaacatatgaatgtgaaaaataaatcaaaatgttgagtgtgtagatgaacatctagataaagaactaaaaaaattggacggctttaacaaatgtaattgactcttacaaattttattattttaattttcaccccactatttctcacttatttctttaattccctcatctcttataattgaccccactagcccattaaaaaccaaaaataactattttaaaatctttttgaaaagtggacaaaaattaattaataattaattaggaacactaattgagttttcccctttatatacaccaccatcaaatctctatctcgatcaaaacaattgtctacattcatcttcttcttcttcaaacaaaaaatg

SEQ ID NO: 999 - DNA, 3000 bp, Unknown
  misc_feature (1)..( 3000): cDNA_ID_3060056_gDNA_ID_1620345_Annot_ID_154126 3000 nt of promoter + ATG
agtaattcctagagatttcaggaacagatcttataatgtctatcaatcttcttggcgttggaccttcagtctcttgtaaagctctaatgcttcttgcaaatctcctctttcgtttaaatggcgacgacacaaacgttccgaaactctggcactgatgatggttaaggactaaactgttcaagttggtggagatgaaactcaaagaatgtgccatcctgaaaacaatatccaacaaaccaagaagtttatttcgtgcaacaatttctactctcttttcattgccatttataataaaccatattcatcattggttgctgcaaaaaactgtaactcaaatcttacactacttaagaaaaaattaataatgcaacgcaattatattaaactccaatggagatataaattggcttcgaaattgaggtaattgcgatcaactcttgaaattagggttacatttaggaaataaaggtgaagtatctatactatgaaaatcaatacagccatgggaaaaggaaataccaacacgagggagatcgaagaagattgcttggaacgaattaatgggagccaacaagggattgaagccgtttttcaaagtctggatttttgtttaacaaagggaagaagatgagaaaaatcgaagaggaagccactgaattgggccttcaactgggtcgaatagtttagattagttagttaattactatccaaattttcactatttcagagaagattcgaattttggatcagaaatattggattattttgggaaattttaagtattatatttgttgtgttgtatattgttgggccaatgggcctactttagatatcaacgattcaaaagttaaatacacgaagatctaacactttcattcaattggaggtttctacacttcccgtaaaaaacataaagatatttttccatatttttcagttaagctgtggtccggatttttttctttttttgagtttaatgctaatatccgataattctaaatctggaaaaacccacaaaaactcgccattaacttacgttttgatgaaccggttaaactggatggatgtggattttaaaaaagatatttgattttagaataaaatattgtattttaaactttatatagttatttttacaaattaatttactttttaaactcatttgatgttttagattttggtaaaaacttgacaatgtcgtcttaaaagaatgaatgtaatggtgagagagacaaccgatattagttgttcaaattcgcaatgtttttttagtttattttagacattggtgattttctactatatttgttacggttttaaactttaaagttggatttaaaaattttagtcacttttttttattgtttaatttcatattttgttaaacatgatatgattgtttttgttttttttttatatatttataaaacctatatcatctctattaatattaaatctattacataaatttaaacacccaaaaatcatcttgttttttgttttccatttctaaactctttcttttattccaacaagcataaaaacctaaaaatataaaaaaaatcaccaaaaatcatcttgtttttacttaaaaggttcaaatttcggtattaaaaaaattaataaactgatgaaaatataaactctatatgttaaaatacttgcattgaacttattgaagaaaaatgtttcaactgtttaattaacccaattaggatgttgaaaactaaacaaaaaaaataacaaagattttatggtgttgaatctatttaacatactattttttgttttttggttcgcacatgtcatgtgtcaccattttattctgtttgtttttttttggtcaaaaacaataattattgaaaaattgatacttctcaagtcttcaaatacttgttttccatctttctttctttttaatatcattttcgtcattttagtgccaataacctgaatataattcttcagagtagaaatacttataaacactcgagaccatataaaatgttttccaaaaccatatagaaatcatagtgaaaacaaataaaaataaaatgttaaataaaatcaaaagataaaattatttattaatcatctccgatttggcaactgcaagaaccacacaaacctcttgaaaccatgaaacttttcaaattggaatatcatttcaaattttgtttgtacaattactaaaccacgcatgcaagtttatcatacattcatactagtatttgaaggtcatattttctgcagcaaaatttaagttgaatgaattagtatccaaacatacaattctgtgaatctgagttttaaatcaatttttaatacataggaaagtaataaatcaaataattgttttagtaatatgctaaataactgtactttcattatgtgaaatacatcaactctcaccaaaaaaaaaaggaattacatcgattattatactattttcatttttataatagaataaaatttaatatttaatgaccgattgtaaaattattctacgcttcgagacatgtggttacagctatcacccattaatatacaatatcaacttgtttaatctcggttgattataattaatatactcttaaaatttcgttgacattaggggacagcacgagagcatagttgttatcagatccaataaaacttaacatacagctagaaatactgagctagaattaaatatgatgaccaactgtaaaatatattcttcaatagatacttttaaaattatactagtgtttagggacatggttacagctttcacccatttatatacttgttcaaaattaatagactcttaaattttcgttgacttaaattttcgttggcctaaattttcgttggcctaaattttaaaagctgaaggaaattgagtattaatgaatcaccacatgactttgcctttatctttatatatataagcacaatggttgtggcaaatcaatacatatcctcacccccaaagttttttgatatctaccattaatg

SEQ ID NO: 1000 - DNA, 3000 bp, Unknown
  misc_feature (1)..( 3000): cDNA_ID_2129056_gDNA_ID_1620346_Annot_ID_154157 3000 nt of promoter + ATG
aaacaatcaaatctgagaaatcctcagctaccgctgctatggaaacactgaggataagaaccaaattttctaattaaattcaatcgaaatagattccatcaaagccgaacgaaataagctcacctgtgagacagattcttccactagcaactccagaaaactccacagataaaattgtttaccagaaaacaaaaaactcagcagatagaagagattgtatcaattcatcgaagctagatcgaaaaaaaaaactgtgtaggactttctagagatgttcggcagaagacgatgaaggcttcctatttttttttttttgacaaacattttaaattttaattaaactattgtttttgtttcgggagaatcaaaagacaagtgaccatgatatcaacacgtggcaactaaatcaaaaggtttaacaggcttgggtttttaatatcagaattcgtggacgagagagcagtgtgagatcctatcagttccagttttattattggtacacgtcattagtaccttctcgaaactgggcacgcctcatcttcttattggcttacatcgtaatgatgacatcagcctttatttacgtataacaaattaccatgcggttaaaaaaaacaatagttatatgggccgaagaaagcccaaagaatctttagttgtttttccgatcgatctgcgagtcgagtagtttttttatttgccggcgccgggagagatcctttgatctttttccgatggaggagcaattcggcgggagcgatgagagatggaaaggatcattggagaatataacggagatggcatcgaatctcgattcgcttcagaaacttctcctcaagaaagcagtcttcgttgaagaagacactttctctagagcttctctcgtctccgagcaagcccgaacaatcaaggttaatcctttttcctgtgataaaatttgaaattatagagcttaattgtctgaattttgagcttcttttctttgactttgatgattgcttctgtgatttgtggattcgatctagttgatcacgatcgcactttttagtttgctttagtactactatagctcagtgtaatagtgtgattctggaattgcatttgacggtgaatttgggaacttgtagttgatcataaattttgaatcttcgattttgtgatctgttaatggtacaaatgatcaccaaatccttgaagactggacttgaggtttcactatgaaaactcccaagtgcaattatgtgtattaagtagaaattcttcatgttgtaagtaaaaaaggactgtgttacatgtttgagataagggatagtttcagattgtctcttaactctgttcaatggtttgttttaggttcttgagcaaagagtacaaacactagaaagagaactagatgctgccattacagctgctgctcatgctcggtctgagaaacgccaagctgagtcctctcaaaaggctgctgaatcacgtgcccaagatgtcacaaaagagcttgaaaacaccacaagtatgcacttgataatcacttcttgagttgatgcctggtggcaccattctctcccgcacgtttatctgcgttccagtttcatattcactctcactcactgacttatacaactcttggtttcagaggttttcaagctgcatatggaagagcttcgaggaatgcaagaacagatatccaaacgcgataacgagatcaaactcttagaagctataatccaaacgctcggcggcaaagagcggttgggaaaaagcgacgtgaatggatgatgatgatgcgttttttcacttgtaaaggtttgtactcctgagtttgtggagatgtatcacttcgaagataaatgtatttttgtctgtctatttggtacgttttagaatcttgcctgttctttcaagaaatgaatgttacatgggcctgaccctataaatgggcctaatgtgaatcgatcgatactaaaaatgggttttataggtgtgtgtgtgtggttttcacacgtttgccgccgatagtgctgcgatgccatccagattcagtaacgcggcatctccaggactccagccgtgtggagcaagaaactacgtaaatttgacagctgaagatgcaatttcacaaaaagagaataaaagaaacaaaagaggattatgaccaatttagaaaaaacttttttcaaaaaagtgatgcttcatggtttttagcgtgtggggtgtctctctatattatctaattttttggtagaaactagtgtacaatatctaattttgataaaataccaatgaaggaagttttgactatttctgattgctttatttttgtttgctttgttatagtatatacaagcatataatttttatttttaaggctcgattaagtaaggtaagaaaaatgaggattgtgtctaaaactaggtgggggtgaaccaaagaaatacgtaaagtaataaattaatgcaaaggccattgttgtttacttcacgctgcgaaagtggttaaaaagaatctatggctactaattattctcttacaaattttctttatacatttggataaaagcaagaacataaacactttctgattatgacaaagaatctgaatttcattttgctgttactagtcaactctagtcaattgtcatgcatatcatagcacagtaaaccatctctatcgactatcatattaataaagagtcactaatcaaatttccaatattcaaaaaaatatatcgtaatcatgcaacatttaagtttcgataatcattcaatacgagtatatccaaacccttgatatatgaaatatgtattcctacgaaatggccaagtttattattccacttttaactaatttcaagcttatcacttcatttttctttttgctaaatcctgcacatgattcaatgttcttgaccccatttgacgtacaaatacaatataacgtgcatctatttatacgtgtatatatatgcaatcaaacctcaaacacaaccacataacaaaaaaa

SEQ ID NO: 1001 - DNA, 3000 bp, Unknown
  misc_feature (1)..( 3000): cDNA_ID_1471148_gDNA_ID_1620346_Annot_ID_154162 3000 nt of promoter + ATG
agcttacgataaacttgctctaaaaagaatgtccactttatattaatgattagtttagtcgaatgatttagtgaatacagtatcattttatattaaaggagagctttaaaattgtgagaggttaattatgtttcgtatcacgattaacaaaaagttaattatgttttttggccgacgttccaaattcacaaggaccagtacatttcttgtatctatcatctcaaccttttcggtttatgtcactggataagatacatgtacaatatataaccaactgatataattagtgtcacgattattagacagtgttttaagtcacaatatttactaaactactaaaaagaattgtttaacgcggaattaatgaatttgatacccataaagaaattatctaatcaaatcaaatcaaatagtaagagaaaaaaaaaatactccaaaaaggagtaaaagagaaggcaaagggggagtctcacgtgcggatgggaacttgcgtagtcggcacggaaagcgacaaaacattggtgaaagccacgcgcttctcgtactagttctttatatcacccacgatcatcctttagcatcgtgacacgtcatgtcttcttaacacaaacgtgtactactattgatgtttgtcccaattatttgtagcgacattttatgagacatctctcgctaggccgtctcaattatatacccgacctatattaatcttacacactcattaattgcaattgtttgttttttgtatgaatatttattgcaattgttatacattgtcaaaataagatatttagttaacaaaggagttggctagatttcataaaattgggaagtaattagaaacgaatgcattgcatggttggctaggtactttgattttgacacggaactcagcctacttgctaattaaatcataaaatatgatgtgtgttcgatgatttctaagtacatcgataatgtgttacacataactacataagcaagagaatttgaatatttttgaagggaccattcacatataacgattatagtaattatgcatgccccatatatggggaattagtcaacaaagttcaccgactaaaatatttagaatgttaaaatgctaattcccctccaactcctaactttttgactctgggggaggggttttgtgtgccgacccactttggctcgtcttgtttatcgtacttctctatgttattttctaggtaatacggaaaaaaatttggatacaatggaaaacaagattagtagaaaacttttttttctttttttaaaaaagaaaaattttacttgttgacaagaaaagataagtttttttattatgacttgcaccagtttttgtgaaggcaaatgatatacttgttcgtacggaaatagcatgctcaatagtgaaaatgacaaagcaataattaagcataatagtttcgaccccgaatttttgttttatgaacaatttcaaacgaaaaaggtccaatttttttgacttttatatcactcgacgtataggaaaagatgataatgatagtcctagctcgtaaataataattatctgtacatattgaagcggacgtattccaaacttacgatactgtcatactgtgtaatatttattttcctagacttagaaagtgagatatcttccacactacacatatagccaattaattttcaaattaatactcaaatatatacaatcttaattcttaaacaaaaccaaacaatcctatttcgcgtattatataatcctagctacatctaagtaatataaacttagttaaatctaaataaccaaatgatgaagatactactttcatatgtaatctttgcaaacgatagatacaaacaattatacaagtggatatttgaattgggattatgattatcttttattaattaatccaatcttatgacgaacttatagcttatattgccgtggaccgaccgaccagtttttcagattattgatttggtcacaagaccaacccctacgtatacatgtattgtccccattatacgaccagacttgtcataaaccacacttaacagttaacaccacctaagattaaaaagtccactttctctgaatcttccccatatttatgtaatttcgtaaaagattttgtttaaaaaggtgttaatgagttatatatcttaaaactgatttgcgattttggaagtatattgattttcagttaggctagagtttgtatttttataattttttcaaatgttcaaatttattgatttattataaacttagaaaccggatgcaaatgatctcctccgatttccggtttgtctgttttttcgtatcaatttttctggtacaattcggttctaatgcgttgcataataaaatccccagtcagacgtcagctaaccgagcaacataatgggcccttttaatatctcagcccattagtttcaatcaaaaacccaataaagtagtttcttaacagtcttttaagaagaagaatataaccgataaatcgaattttcctggaaaaagttactcgaatttcgaacatcctgtgtgttgtgagctgatcgaagagtatagaggatcgatgaatgtttccagaaaccgtttatatagatagagtggagtgatgtagtatgtgacgaaaagcttcgaaatgtgttcgtcattgcttagaaagatcgacacaaaattattttttatctataaaaaaaggtagccaagtaaaattcgattacgactctggtttttttttgtataaaacgaagatgtgaagagtgaagaccgagagagatttatagcagaggaaagtgaaatcatgaaagggattctagggtttgaatacgggatagttcaggcgccattaggaccagatatctccggaccagagcttgtagccgccgtcgctaatgcaggagggattggtcttctcagatgtcctgattgggtaaattgcaactttttcgttttctttgatttttgtttatagatatattgaattatgtgaatcaatg

SEQ ID NO: 1002 - DNA, 3000 bp, Unknown
  misc_feature (1)..( 3000): cDNA_ID_2129087_gDNA_ID_1620346_Annot_ID_154166 3000 nt of promoter + ATG
cctcctcctcccccatctccgtctccgtctccgtctcctcaaggagcgaaactcatccctctgattctctcaatctccgtcggcctaatcctccgattcgctgttcctgtaccagaaggagtcacaccacaaggctggcaattactctcaatcttcctctcaacaatcgctggtctcgtccttagtcctctcccagtcggagcttgggctttcattggtctcaccgcttcaatcgtcaccaaaacgctttctttctccgccgctttctcagctttcacaagcgaggttatctggttgatcgttatctctttcttcttcgctcgtggattcgtcaaaacaggtcttggtgatagaatcgctacttactttgtcaaatggcttgggaagagtactttaggtctatcttatggtctcacgcttagtgaggctttaattgctcctgcgatgcctagtactactgctagagctggtggcattttcttgcccatcatcaagtctctatcgctctcggctggaagtaaaccgaatgattcttcttcgaggaaactaggctcttacttgattcaatctcaattccaggttacttctttgttttatgtcctttgattcatgatttggctccaattattagttagtagtgtgatcctgagaaacaaagtttgaactttgcatcaatttgtgtcttaatctgagggctgctttgatgtttctacctcaaatgcagaatctttcatttttcttataggttgctttctagtttagatgaaagattctttcttgttgtttgtatttgacttgagagacttttgaagttttcgaattttgttctgcttctctaattttgttctgatctttgacagtgcgccggaaactctagtgcgcttttcttgactgctgcagctcaaaatttgctgtgtctcaagttagcagaggagcttggagtagtgatctcaaacccgtgggtttcttggtttaaggctgctagtctacctgcaatcatatcacttctttgtactccacttatcctctataagctttatcctccagaaacaaaggacacacctgaggctccaggtattgctgcaacgaaactcaagcaaatgggccctgtcactaaaaacgaatggatcatggtcggtacaatgcttcttgctgtcactctttggatctgcgggtaagtcttagatcactttcatgttttgtatcataccgttgattaaaaaaatctgagtattccatgggtttaatattatatgcagagagactctgggaataccaagtgttgtagctgccatgatcggtctctccatacttcttgtgctaggtgtccttaattgggacgattgcctaagcgaaaaatcggcatgggacacattagcttggtttgctgtcttggtgggaatggcaggacagcttacaaacctcggtgttgtaacgtggatgtctgattgtgtagctaaagttctacaatctctctccttgagttggcctgctgcgtttggacttcttcaagcagcctacttcttcattcactaccttttcgcaagccaaaccggtcatgttggagctctcttctcagctttccttgctatgcatatagcagcaggtgttccaggaattctagctgcacttgctttagcatacaacaccaatctttttggtgctttgactcattacagtagcggtcaagccgctgtctactatggaggtattcccattgattgatgaacatgatagagctctctctttatagctaagtctctttaacttttgcgtttgcttgtgtttctttttgcagcgggttatgttgatctgcctgatgtattcaagattggattcgtgatggcgacgattaatgcgataatctggggagtagttgggactttctggtggaaatttttgggtctctactaagagctcctcagaagaaagttgttcttgaagaagctttgcaaagtccggtacaattcttttgttgatcattcggttttgaggcttcatttttttctacttgcaattagagaatcagacaattctttgtcaaatagatatacagaagatctatctcgatttgttctctttatgaaatatcgtgtttctttttcggagaaagagtaagatacatgatgaaaatctgttttgggggcgtttttgttaaaacgaaaatgtctgggtaataaaaaacagagaaaatagtcataaaaaaggagtgaatcttcaaattacctattacagaaggactgattttcaaatttcgagagcaacgaacatgaagctaaacgcaaaataagttagcgccacaagcatcactctcattaattgtgctttgatgatatgatgtttttatggtacaatccccaccgttttgttgttttgttattcaacaatgtctatagaatatgttataaaaacttgaaaaataacttcacaagggaaatcctacaaaaaaattataaaataaatcagcttatttgacaaatttgaaataaacttaaggataaatatcggattaacgactaggattcttgtcactttttcttaagatatatattttgatatatggtatttcatgttcaccatcattatcttgattatgatcattatcaacatttatgatctcagaaactaaacaagtcttcaaacaatcatgaaaatcaagagagagtatttatagtaaacaaacgatcatgagtttttacttgattcagtaaataattctgaattttcgaaaagataacacatactgtaatttggtaatttcgttttatggtcatacaaaatacaaacaagttaatccaaatgtgaaaattttgaatacttcttaattttaaagttttagctaaattatcttttaattagtaaaatatgaataatggggaaaataagaataacgtttttatttaacttttttttataaagacaacaaacagagagtttcgctcctccggtgagaaagtaacactttgatatcggagaacacacactctctctcccgggatg

SEQ ID NO: 1003 - DNA, 3000 bp, Unknown
  misc_feature (1)..( 3000): cDNA_ID_2129094_gDNA_ID_1620346_Annot_ID_154168 3000 nt of promoter + ATG
gatcactactccaagctcctctgctaacttgagacacagcaaattttgagctgcagcagtcaagaaaagcgcactagagtttccggcgcactgtcaaagatcagaacaaaattagagaagcagaacaaaattcgaaaacttcaaaagtctctcaagtcaaatacaaacaacaagaaagaatctttcatctaaactagaaagcaacctataagaaaaatgaaagattctgcatttgaggtagaaacatcaaagcagccctcagattaagacacaaattgatgcaaagttcaaactttgtttctcaggatcacactactaactaataattggagccaaatcatgaatcaaaggacataaaacaaagaagtaacctggaattgagattgaatcaagtaagagcctagtttcctcgaagaagaatcattcggtttacttccagccgagagcgatagagacttgatgatgggcaagaaaatgccaccagctctagcagtagtactaggcatcgcaggagcaattaaagcctcactaagcgtgagaccataagatagacctaaagtactcttcccaagccatttgacaaagtaagtagcgattctatcaccaagacctgttttgacgaatccacgagcgaagaagaaagagataacgatcaaccagataacctcgcttgtgaaagctgagaaagcggcggagaaagaaagcgttttggtgacgattgaagcggtgagaccaatgaaagcccaagctccgactgggagaggactaaggacgagaccagcgattgttgagaggaagattgagagtaattgccagccttgtggtgtgactccttctggtacaggaacagcgaatcggaggattaggccgacggagattgagagaatcagagggatgagtttcgctccttgaggagacggagacggagacggagatgggggaggaggaggaggagcgttgtcttgcggtgcggcggcgattcgtgtggagaatcgaggaattggtttgagaagagggaaggagagaggttgaacggagagagatcggagggagattgttgaaggcggagatctcgaagaggtacgacggagaagagagagacgtgagggatggtgatgatgatgatgggagagtaaggtggaagtggcggtggtggagagagagtgaagagcgaaactctccatcgccggagattatatatatagagagagtgtctgtgacggcgaagtgtttaattttcgtcagtcgctcgctgtgtttttgtcgccggagagatctcgatcaatgatgatgagtggatgtgtgaagctgaaagtgaaattacactgagaatctaaaaagtcttcggttctaaccaaacaaaccgaaaccatggtaaacttgaaccgaaccactttttctaatttggttcatttttctagccctggtttaccaaaatccgaattcttttggaggcaatcaaaactcaaaagtcaaaaacactatcatcataaattcaaaatcatcgggtgggtattattttttaaatcatcggtttatcttaaatttttgaaatgatatgttttttttttttttttttggaaacttgagaacatctcattactaaagtgtgaagctttgtctgatgtaaaaccaaatgagagattcatgtcatgaaaattgaagagtagaacaatgctccgagtcaagaatgtagtgtcaattcgacggatcatggaagtactgatcttctttgtcttaaacactatatgaatctacccttaaactaaaataaaaaatacacatcctattcgtacgtcccattgttagatgtcaccaccaattttcgtgttaagaataccaacgacgcatatataaactattacatcatctaacaaaacttatagtataaaaccaacaaaaatgaaaaaataaacttaaagtatgttgtatatgtaaattacaatatattatcttgaacgacgaatacataatgttgcatgggtcatccgaccaaagaagcgaggatggaaaaacataaaaatgtgcggttggtatgtcacgggaatgggctgccactcaaatagtttcctatatcacaattatcacttatgatcccaaggattgttatttggaatctcggatggtcattttttttttgacattttcttcataccatacttagcatattagaggatacgatgggatccgattccgatttgtaaagtggaccatatttgtttatcgagttattagcatagtcatgagatcacacatcaatgtaaaaacaataaagaatgttaaatatgtcgtatgtgattgaagttgtactattgacttagatctgtttacctgaatttatagtctaaatagttttgcagtattttcaatcttttgataaaaaacaaaaatcaattgaaactatttttttcatacaaactatatagttgagcaactttgttacgtcaaggcagagacacatcttattatcagtttttttcaacatctgaaaatttaccactaaacttcaatctctatactagtagtttctgtactaatgacaaagatttaaacgacgattattttgaccagtgtttgaagcatatgattattattctcttttgtctccaaaaacataattagagaaggagacttttctttggtgtaagtgtaactaaaaagaagatgaaaatgaattgaaagtctataaaagttggctttgaagagaagagagccaagcaagtgtcttatctcctccacaccgaatcacagagatccttaaattcttcatttttcccaatttgcgccgccattaaaaaagcttagctaatcgctatcgtcatccgcaactaacaagacccatcctctctcttcgctacacttttccccgcatcttcttcttccaatctctcctattaatcggtactgtgttttcttctgtgatcgtgagattagaaaatctacccaaatttttgattttgcgataagggtttttcttaatttcgtctacggatatagaaa

SEQ ID NO: 1004 - DNA, 3000 bp, Unknown
  misc_feature (1)..( 3000): cDNA_ID_3060096_gDNA_ID_1620346_Annot_ID_154173 3000 nt of promoter + ATG
ttgaaataatatctaatgtcataacttctcaaaattgatagtatgactttaatctactttttgtaacccgtaggtggttagtgcttttgaaagtaatcactttcacatttcagtatttatagagaactcatttagatgtaacagtaactcaaggtttctataattggtatagaactaatcacattggaaacatttatgaattgggggaaagaaagaggaataatatgaaagaaagtaagagaaaagatatgcaagattgagaagagaagttagggaaatggacccatataagagaagcctcaaagaggaaaagaaagcaaagataccaaaagaaagttaaatgcaatgtacatagagatgattcaacattttatcaaaaaacagacaggcaaagaagaaggaacgaggctttgtcatagttaatgacactcactctccaacttgtccctccccaaatcttatatatatattttatttttttctctacttaaccaactcatatcttcactaaaaaacatactacaatgtcagtaaactaataatgtttaatgtaaaatctaaaaaagacagattgaattatatgataagaatgggcaaaatttatatcactaaatttcaaaaaaattatgataattgaagaagcagagagttttaagcccattacatcacaggctgttagatatatgagagactttggttttgaaaatctctctgagaaaatagacaattcagagaaagctccaattctcgaagcatcccatgtggggataatatctccctctctcttctctctctctttgccactctctctttcatctttataatcaaaactaatcaatctctcttctcttggaaactctttgtttcactttgatcttctcatcctctatatatcttcccttggtcctttcttgcttccaactacagagagtgttaacttgtgtatgatgtgggaatctgagagcgacggtggggttggagttggaggtggaggaggaagagagtatggtgatggagttttgagttctaacaagcatggcggcgtcaagactgatgggtttgagcttagaggccaatcttggtaatatcctcacactttctctacagtctctgcaaaaagaacatgtttccttgttaaggaagttaatactcatatcaaaaacctttgcctatgattaggtttgttgctacggatatccccagcgatcttctggttaagatcggcgacatgaactttcaccttcacaaggtaacttcatattcttgagtcaatatttttaagctggaactagagaaagtttatggatttaaaagtgtttctttcctttcagtatccgttgctgtcacgtagcgggaagatgaacagattgatctatgagtcacgagatcctgacccgacgatccttattcttgatgatctacctggaggaccagaagcgtttgagcttgcatccaaattctgctatggagttcccgtggatctcacggcaactaacatatcaggattacgttgtgcagctgagtatcttgagatgacagaggatcttgaggaagggaatctaatcttcaagacagaagcttttctcagctatgtggttctgtcttcatggagagactccatcttggtcctgaagagctgtgaaaagctctcaccttgggctgagaatcttcagattgtgagaaggtgtagtgaatctatcgcttggaaagcttgtagtaatccaaaaggtattagatgggcttacacagggaaagctccatctccatcaacaacaaatttcgcgggttctagtccgagatggaacgaatcaaaagattcaagtttctattgtagtccgagtaggaacactaatagccagcctgttcctccagattggtggttcgaagatgtctccatcttaagaatcgatcatttcgttcgtgtaatcactgcaatcaaggtactactacacataggttatttttctctcaagcattttcacaaacacttggtgtacatatctcaatcctctatccattgaaacaggtgaaaggtatgagatttgaactactcggagctgtaataatgcattacgccggaaaatggcttccgggtttgatcaaagaaggaggagttgcaatagctccagcaatgtcctccgccattggaggaggattaggtttaggaggagacgaaatgagtataagctgcggaagcaacagcagcggaggaagctccggaccagattggaaaggcggtcttcatatggttctctccgccggaaaaacaaacggacatcaagattccgtcgcttgtctcgccggactaggaatcagtccaaaagaccaacgaatgatcgtcgaatctttaatcagcataatccctccacagaaagattccgtcacttgtagcttcctcctccgtcttcttagagcagcaaacatgctcaaagtagctccggcgttgatcacggagctcgagaaacgcgtagggatgcaattcgaacaagcgacgcttcaagatcttttgattcctggttataacaataaaggagagacaatgtacgatgttgatcttgttcagagattgttggaacattttcttgtgcaagaacagacggaaggatcgagtccgagtcgaatgtcgccgtcgccgtcgcagtctatgtacgccgatatcccgagagggaataacaacaatggtggtggtggtggtggtaataatcagaatgcgaaaatgagagtggcgaggcttgtggatagttatctcaccgaagttgctagagatcggaatttgccgttgacaaagtttcaggttttggctgaggcgttaccggaatctgctaggacttgtgacgatggactatacagagccattgattcatatctcaaggtatatatatattgaaggtctttttggtaaattcgtagaatagttttcaacatttttttggcttaattttgttgtgataggcgcatccgacattatcggagcatgagaggaaacggctatgccgagtg

SEQ ID NO: 1005 - DNA, 3000 bp, Unknown
  misc_feature (1)..( 3000): cDNA_ID_2129131_gDNA_ID_1620346_Annot_ID_154179 3000 nt of promoter + ATG
ttgcggttaatatatgttatggcagacaccatcctctgaattggttagcttttggtctaaatggtgcagagattgtcttcaacccttcagcaactgttggtgaactcagtgaaccaatgtggcctattgaggtttaacttctgattctccactttactcaatttgaagctttctttctttagtaacactgtctaacaatgcaatatgttccttaaaacttgcaggcacgaaatgccgcaatagcaaacagttactttgttggatccattaaccgagttggaaccgaagtattccccaatccttttacgtcaggtgatggaaaaccgcaacacaatgatttcgggcatttctatgggtcaagccatttttctgcaccagatgcttcttgcacaccgtctttgtcccgttacaaagatggtttattgatctcggacatggatctcaatctctgccggcaatacaaggacaagtggggatttagaatgactgcaagatacgaagtctatgccgatcttttggcaaagtacataaagccagacttcaagcctcaagtcgtctctgacccattgctccacaagaattctacataagaagaaaatttcactctgtgaatcttcaaagaagaaaagtccaataatcaatgttcaatcatttgtgtaaatgtaacggtaactgaaaatctgtttgtagctgaatatatgttgatgccaaaaggcagctcctttgcttttataatcgaaccggtttataattgaaccggaatccaattccaaaaataaccgtaatcagatactatgaactgtggggttttctactcctcgtcatcttctattcgttatccgttttgaagcgtactcggatgggattgagtttcgcagatgctttaaattctagaaaataatgcaatctcttaccttaactcggtacccaactccaatttccccgccaagactcaatctttacccgctaagacaaatcgcagcttctgttctctctgctccgaccgccggtattaaccgtcgcgatatggcgtctcgccatcagtcaacttcctttaagccccttgccgttggtcggaatttgaccggagatgatgatgatggttactgtactcttatagactttgcaggtaacaaactgctctgtctgaacgaacttagcactgtctcgataattcaagttaatgtgttgtctgtcatccattgtcaatctatgtccgaaaatccgtaactttagtggaaataccctgaatttagcatctaaaatgtgcttaattgagtaagacaaatcttggaaactctcttagacgaacaatggttgggttttgacttttgacggttcctctgtataagcagtttgattgaagtcttaaatttattattattttaagttgttctatgaaattttctgataggtagtggaggaggagaagggaaaaatgtaggagaggatcttgtggtgttgctttaccacttacaacatgcttgcaaaagaatcgcttctcttgtcgcctctcctttcaattcttcactcggaaagctctctgttaactcctctagtgggtcagaccgagatgcgcctaagccgctcgatattgtctcggtctgtatcttattactctcttttttatcatgattcatatcaagattcaatcttacaattcatgtttccgttttgcagaacgatatcgtcttgtcctctcttagaaactcagggaaagtagcagtaatggcttctgaagaaaacgatagtccaacttggatcaaagatgatggtccttacgttgtggttgtagatcctctagatggatcacggaacatcgatgcttcgattcccacgggaactatatttggaatttacaatcgtctcgttgagcttgatcatttacctgttgaagagaaagctgagctcaattctttgcagagaggcagcaggcttgtagcttccggttatgtgctatactcttcagccactatcttctgtgttacacttggatcgggaacacacgccttcacgctagaccattccacaggagaatttgttcttacccatcaaaacatcaagatcccaactcggggtaaaaagcgtctaatgacacatatgacttgatccattgcgacattcctattcatggctctgaacaacctgcattaatcgttgttttttgtatgatcaacaataggacaaatctactcagtgaacgatgcgaggtactttgattggccagaaggtttaaggaagtacattgacacagtgagacaaggcaaaggtcaaaacccgaaaaaatactctgcgcgttatatttgttctctagtagctgatcttcacaggactctcttatacggtggagtggctatgaatccaagagaccatcttcgtttagtctatgaaggtaaccctttggcttttctcgtggagcaagctggtggcaaatcctctgatggaaaaagagggatactttcgatacaacccgtgaagcttcaccaaagattgcctctgtttcttgggagcttagaggatgttgctgagctagagagctatggagatgtgcagcagactgtgaaccctggctatgaagtttaaacaactcctctgtttcatattatctgtaaaaacaataaatgaatcgatgttagatttggttgcttgtaacattatgtattaggaaagttagatccgtgtatatatctgtttatcaagattcaagatcgactggtataatcacaattcacaagtttattatgtttctttatcagaagcaatctttcttcgatttctaacacagtcccactcccataaattggttgttagatttcggttaagtttagtaagaatttttaaaatcggtacggtatggtttgccgttaaataataaatatataatgcggatatttggcgcaagttagcaacttagcgttaaagaccaccaaagacttctctcaagtcctctgcgccggaaaccgccgtgacgagattggagagggagagagaggagagata

SEQ ID NO: 1006 - DNA, 3000 bp, Unknown
  misc_feature (1)..( 3000): cDNA_ID_2129123_gDNA_ID_1620346_Annot_ID_154177 3000 nt of promoter + ATG
tcaagcccagacttgtagctatcaaaatttccttcgcatttttgaaagatacatggtcaagaagacagagcaatatagatacaacgaaccttcttcatcacaattacagaaaaaatgattatgtagatatcatgtttagagcctaaacggctaaacagttccatcattaatgtcttaaacaagcttttatgaacagacaatggaaccttcactgcgcaactggagcgtataaaagccagataacgtgcacgaatcacctcttggatagcttctgtatcttctagattctgcagaatactcattacaggtaagtgagaatacctagctactatgactacacaaaaaaaactctacatagccgtttaggtctttaccttagaccccagcaagaaattcttgacaaaaagcttacttgttttccttacctttcaaagcatcaaggatgaatgaagcaagcaatgtgtgttgtcactttccctcttcgtttgtcagtccagaacacaacaagttatctagtgaatgaacagaagcagcaattacgacatggaaaccacctatgttttgcaatttgctgctctatggccttttgagttggaggaacataattcttttggaacaaaatgaaacctgagcaggataagtaactcactttactttagataaggcatttggctagtaaggttttatagtctaataaacccgagaaagataatcttaatgcctttactcagaactcagaagcagaagactatataccagaaagcgacgaaagcatccgaattttgagcaaaataacatcaacagattccaactacagggattccaaggaatcaaaatgctagtatttccactacagttaaacatcaacaggaaacataaaagctaaggcctacaacaacgaaacacccgcaacctaaacaaagagaggaaaaagccttacttcactaagtagccttgatcttatcatctccaacaacagaaagtatgggcaaactattcaagaattcatcaagtccctcaaagaacccaatcccttccatattatctacctccctgttacttccgatcccattgcctgcatttcccccacctgccacaccaggctcttccacttcattactaaactccacattcaaatccaacctccccaggttcttagcgcctgttcccattcgttttctagtaatataactccctggtttagacataaccccagttgaagacccaacagccgcagcatttgaagcaattgaaaccgcgtgattgctagcactactgatactttctacattttggacttcttcaactccatgtttcttgttacttctcacatatgtttctttccctttcccaacattcgtcttcttattcacttgtaccacatcttgccaatcaccatcatcaccagcgtcatctccatccgaaatcgcaacataaatgtcatcatcgtcatagtaaatcctaggaggacccggttcctttctcttctttggttcaccatccaacttttgcagaggacaggcaaagagaggtgaaataggtgaccaacttggagcttgaaattcaccggaaaaccccaatggaaacaaagcccatgagcaaaagtaaacgtcttcgtcgtctttcttatccaccggaggttttggtatcgtcacagcttgaaacgctcttctacattcttgacatttcaaagtacattcttcgtaagccttagggtactcaaagagtacaaagcagtaagggcaagcggtccagaagctcgtcgccataggatccgccgaggtcccagcctggctctgagaccgcggtggcggatatacggcggtgctactgctaggttcccactggaaattttgatgcgattgggtttgaggatggaatccagattgaccgagttgactaagttgcaattctcggtcgtagaatgatttcttgaacggatcagagagaacgaaccaagcatcggagacgattttaagagctcgatcggcgaatgggagacgattaacggaaggattgaggagaagagcgagtctacggtactgagtcgcgacgtgttcagggttttgagctaaacgaccgagtcggagaacggcgtaccagtctggcaagttggaatcacctaaacgagtctctccggcgagaagaatgtcgcagattgcgaggatgtagtctgcagcttctgctcgggtcgggtcagcttcgcatgcgcggatcgcaaatgtctttgctccttgaagatcactagacgctagaagcttctccgatgttacaagccactgatccgcctccactctgttaccaccaccaccgccaactccgccgcgtccgcctaccatatcccctatttctttttgttccctttcgtttttcctctctccccgttgaatttatttattattttatcggtaaagagtaaatacagatctaaaaattaaaaggacgaaaacatgatggatcgtcaatgggccggaacaacaacatgatggatcgtcaatggcattttggtccttttcattttatataatatgtgcaatgtgatggatcgtcaatgggccggaacacttttttctaaatttttcacttacaaaaaatattaataaaataagatgtaatattattctcttaggacagtttctctaaacaattggaaaagtttcttgtaatctctcaaatgagagactcactcatctttactgagagatttttttaattaaaaaaaacattatttactattttatttttatttttgtagatgagagatttgaacgaaaaaccaccaatacagatgctttttaggatgttgtaaagcccaataattcttttaagaattaaaatataatctggtgggctttaggtctggacagcctaactaaaataaaatattacattccgattcccagaaaataattcgtaatcaattgaccaaaccgatcgatcactgttgtcataaaagtcatcgccatcttggtttcgtgatcgaaaaagactcgtgaaaaa

SEQ ID NO: 1007 - DNA, 3000 bp, Unknown
  misc_feature (1)..( 3000): cDNA_ID_2129101_gDNA_ID_1620346_Annot_ID_154170 3000 nt of promoter + ATG
atggctctgtatagtccatcgtcacaagtcctagcagattccggtaacgcctcagccaaaacctgaaactttgtcaacggcaaattccgatctctagcaacttcggtgagataactatccacaagcctcgccactctcattttcgcattctgattattaccaccaccaccaccaccattgttgttattccctctcgggatatcggcgtacatagactgcgacggcgacggcgacattcgactcggactcgatccttccgtctgttcttgcacaagaaaatgttccaacaatctctgaacaagatcaacatcgtacattgtctctcctttattgttataaccaggaatcaaaagatcttgaagcgtcgcttgttcgaattgcatccctacgcgtttctcgagctccgtgatcaacgccggagctactttgagcatgtttgctgctctaagaagacggaggaggaagctacaagtgacggaatctttctgtggagggattatgctgattaaagattcgacgatcattcgttggtcttttggactgattcctagtccggcgagacaagcgacggaatcttgatgtccgtttgtttttccggcggagagaaccatatgaagaccgcctttccaatctggtccggagcttcctccgctgctgttgcttccgcagcttatactcatttcgtctcctcctaaacctaatcctcctccaatggcggaggacattgctggagctattgcaactcctccttctttgatcaaacccggaagccattttccggcgtaatgcattattacagctccgagtagttcaaatctcatacctttcacctgtttcaatggatagaggattgagatatgtacaccaagtgtttgtgaaaatgcttgagagaaaaataacctatgtgtagtagtaccttgattgcagtgattacacgaacgaaatgatcgattcttaagatggagacatcttcgaaccaccaatctggaggaacaggctggctattagtgttcctactcggactacaatagaaacttgaatcttttgattcgttccatctcggactagaacccgcgaaatttgttgttgatggagatggagctttccctgtgtaagcccatctaataccttttggattactacaagctttccaagcgatagattcactacaccttctcacaatctgaagattctcagcccaaggtgagagcttttcacagctcttcaggaccaagatggagtctctccatgaagacagaaccacatagctgagaaaagcttctgtcttgaagattagattcccttcctcaagatcctctgtcatctcaagatactcagctgcacaacgtaatcctgatatgttagttgccgtgagatccacgggaactccatagcagaatttggatgcaagctcaaacgcttctggtcctccaggtagatcatcaagaataaggatcgtcgggtcaggatctcgtgactcatagatcaatctgttcatcttcccgctacgtgacagcaacggatactgaaaggaaagaaacacttttaaatccataaactttctctagttccagcttaaaaatattgactcaagaatatgaagttaccttgtgaaggtgaaagttcatgtcgccgatcttaaccagaagatcgctggggatatccgtagcaacaaacctaatcataggcaaaggtttttgatatgagtattaacttccttaacaaggaaacatgttctttttgcagagactgtagagaaagtgtgaggatattaccaagattggcctctaagctcaaacccatcagtcttgacgccgccatgcttgttagaactcaaaactccatcaccatactctcttcctcctccacctccaactccaaccccaccgtcgctctcagattcccacatcatacacaagttaacactctctgtagttggaagcaagaaaggaccaagggaagatatatagaggatgagaagatcaaagtgaaacaaagagtttccaagagaagagagattgattagttttgattataaagatgaaagagagagtggcaaagagagagagaagagagagggagatattatccccacatgggatgcttcgagaattggagctttctctgaattgtctattttctcagagagattttcaaaaccaaagtctctcatatatctaacagcctgtgatgtaatgggcttaaaactctctgcttcttcaattatcataatttttttgaaatttagtgatataaattttgcccattcttatcatataattcaatctgtcttttttagattttacattaaacattattagtttactgacattgtagtatgttttttagtgaagatatgagttggttaagtagagaaaaaaataaaatatatatataagatttggggagggacaagttggagagtgagtgtcattaactatgacaaagcctcgttccttcttctttgcctgtctgttttttgataaaatgttgaatcatctctatgtacattgcatttaactttcttttggtatctttgctttcttttcctctttgaggcttctcttatatgggtccatttccctaacttctcttctcaatcttgcatatcttttctcttactttctttcatattattcctctttctttcccccaattcataaatgtttccaatgtgattagttctataccaattatagaaaccttgagttactgttacatctaaatgagttctctataaatactgaaatgtgaaagtgattactttcaaaagcactaaccacctacgggttacaaaaagtagattaaagtcatactatcaattttgagaagttatgacattagatattatttcaagagataaacatatgatgttgtagaaattgtattcacaatagttttcaatggttgttggttgatgacaaagataatagaaggaaaagttagaggaaatttaaaagagagcattaaaaacaaaggttgttcatacatacataaatg

SEQ ID NO: 1008 - DNA, 3000 bp, Unknown
  misc_feature (1)..( 3000): cDNA_ID_2129091_gDNA_ID_1620346_Annot_ID_154167 3000 nt of promoter + ATG
ttgaaatcctcaggctttgaatctcttgatgcaagagacaatatggttgttgccctgtcacgagctgatactcccgttgttgtaccatgttttgcatcctacgaaggcgaaagaatagaacaaacaaaattaaataaaaaccacaaggcccaagatcaaaatctttattagagaaaaagacataccacagtcactgtaaatgcagtagagagcttttcttcgttttccttctgattcaccattagaggaaggtgcaacctctcgagatcatcttctttcatgctcacacaaactatcccagttccatgtctcacaataaaagccatagcttcaggtgttgctaactgagcagccatcaccaaatccccttcattttccctatcttcatcatccacaaccaccacaagctgcaacattaccgccaaatcaatcaagggaaaaaagaaactaaaaaaggttgactttcacaaagcaaaagaaaaacgaacctttccttggcgtatatcttcaatggcctcagggatagaagagaaaccaggagttggtaaatccaactcaaagtcatcatcttcagcaacaaaaccattggctggtgcaggagcagaatcagcagcaagtgttccaagtgaaaccgaatcagcctctaatggctcttcggtccgatcatcaatgagagacccatttgagagaggagtgtttccgttggtgaatgagagcagatcatcttctctagagatcactgcagccttaacttttccagtattggttttaatggaaaaggttgacaatggatggttagatggtaaagtaacacgatgtagtccatggagtaatgtagtagagctttggcttagtctgcacagaatcatcaaatcattaaacgagagaagaagcaaagcattcgatatgtgaaaactatgaatctcaatgtcatgatcgattttaaatcacaaaatctaaggtcactgaagcgcaattacaaatccttagatcaggatctaagctgagattagaattgaatatcttctcgtgtcgatgcaaaatcatatttccccaacatcaattaaccaatgagcaaaaacgaattggtaacaataagagatttggaagaaaaaacctcaccttgagcgggaaagagagatggtggaaggagatgatgaggataaattgatggaagacattttctatatccgtagacgaaattaagaaaaacccttatcgcaaaatcaaaaatttgggtagattttctaatctcacgatcacagaagaaaacacagtaccgattaataggagagattggaagaagaagatgcggggaaaagtgtagcgaagagagaggatgggtcttgttagttgcggatgacgatagcgattagctaagcttttttaatggcggcgcaaattgggaaaaatgaagaatttaaggatctctgtgattcggtgtggaggagataagacacttgcttggctctcttctcttcaaagccaacttttatagactttcaattcattttcatcttctttttagttacacttacaccaaagaaaagtctccttctctaattatgtttttggagacaaaagagaataataatcatatgcttcaaacactggtcaaaataatcgtcgtttaaatctttgtcattagtacagaaactactagtatagagattgaagtttagtggtaaattttcagatgttgaaaaaaactgataataagatgtgtctctgccttgacgtaacaaagttgctcaactatatagtttgtatgaaaaaaatagtttcaattgatttttgttttttatcaaaagattgaaaatactgcaaaactatttagactataaattcaggtaaacagatctaagtcaatagtacaacttcaatcacatacgacatatttaacattctttattgtttttacattgatgtgtgatctcatgactatgctaataactcgataaacaaatatggtccactttacaaatcggaatcggatcccatcgtatcctctaatatgctaagtatggtatgaagaaaatgtcaaaaaaaaaatgaccatccgagattccaaataacaatccttgggatcataagtgataattgtgatataggaaactatttgagtggcagcccattcccgtgacataccaaccgcacatttttatgtttttccatcctcgcttctttggtcggatgacccatgcaacattatgtattcgtcgttcaagataatatattgtaatttacatatacaacatactttaagtttattttttcatttttgttggttttatactataagttttgttagatgatgtaatagtttatatatgcgtcgttggtattcttaacacgaaaattggtggtgacatctaacaatgggacgtacgaataggatgtgtattttttattttagtttaagggtagattcatatagtgtttaagacaaagaagatcagtacttccatgatccgtcgaattgacactacattcttgactcggagcattgttctactcttcaattttcatgacatgaatctctcatttggttttacatcagacaaagcttcacactttagtaatgagatgttctcaagtttccaaaaaaaaaaaaaaaaaacatatcatttcaaaaatttaagataaaccgatgatttaaaaaataatacccacccgatgattttgaatttatgatgatagtgtttttgacttttgagttttgattgcctccaaaagaattcggattttggtaaaccagggctagaaaaatgaaccaaattagaaaaagtggttcggttcaagtttaccatggtttcggtttgtttggttagaaccgaagactttttagattctcagtgtaatttcactttcagcttcacacatccactcatcatcattgatcgagatctctccggcgacaaaaacacagcgagcgactgacgaaaattaaacacttcgccgtcacagacactctctctatatatataatctccggcgatg

SEQ ID NO: 1009 - DNA, 3000 bp, Unknown
  misc_feature (1)..( 3000): cDNA_ID_2129068_gDNA_ID_1620346_Annot_ID_154159 3000 nt of promoter + ATG
ttgattagaggttgagaaacagaaatagggacttgagagattacggaaggtgatgttaaggacgagaagtgagtaggtgtcgctgatatccggtggacctgaccttccgaagtgcgacatggttttcccgccggcggagaaattgggagcgcgagagagagacgaagtgaaattaggttaaagcttttctgaaacaatggaatctactagatacggggacattttttttaaagcttgacgttgttgttaattacatttgtaccccttgacgaagacacaaaaaaaagaagataatcgaaccggatgataccgagtttggttcgtatcggttcagcagcgattgggacggttgagacgcaattttattatagtctgaaacatttttaccaaaacaattctgcaatttacaaacaccggtacatctctaacacctttaaaacatattttagcacattcaaacaaattcatatccaaaatcattaaaaaaaacaaacagaaaaactccaagtaggatactcttttgaaattggtttagtgataaccaatcggagctgctgcttctcgcaactcttttccttgattgcgaatgtcctgcaaataactcacaatattaacaattcaaaaacaccacacaacataacaaatccacagatttttaaaattcattgatttatattaaaaactatgaacttgtatgtatccacacaccaaatgtcgttgattctactacttatatcatttgttattttaatatcaccgaaatggacccgaagaaatgtatgaaactcgggagttttggaaaaaaaataaaagggttgttgttttagactcacagaagcaaaatggttgacatctcgatgatgagcttcatcagcacgaatcaccgttacaacatctttcaacgtagcatctttaggcaatctccaataatcaatagcaatcgcgggcgcggcaacattctcgatcttcccattgtcgatatctttaagaaactcggtgtaagaatgtatagcttcttcctctaaatatccaacgaccctatgagctaaccgcggggaaatcacgtaacaaacgaaaaaagagttgaagaatattccttgaacaagcatcactagaagacgctcgtaccatttgggtttgactaactccatcatcgtcattagatgcatcctctcgttctctgcttcttcgagtaatgctttgatccaaccgccgctatgttcgaattttcggattgattttaggtgaagaagcattcctccaaccattcctggtactgcagctactgtctctagcatcatcgctctgcatccatatcgtctctgctgaccaaacatatatttaacattaaggaacaaaaaatgtaaaacattagcatgtgaagtgaaacagtgaatccatacgtatgtatatatgtgaatcatggtaggataatatgtgcatacaaaattacaaaccaaaccaaaccgaatcagctaaataaaccaatgaacatattaaacgaatcaacgtttcattttaaaatttgaaattacagtcatgcctgaaaaaatatatcggtgggaatacggaggagcttgacaatccggtaagcgactttgtcggcgatattcttcggaacgtggtgcttcttcaaatctatcgacagatttgcttgataagtctcccatggctgttcaaaatatacttaagtcatatatctactacatataaaagagtgcttaatttgtctacgaactttgggatgtgtataagtttaccataaaacagttccaaggccaatccgatccatctttccgagtaattttcatctttgctgtctctattccccaataacttggaaccgctactgaccccccgccgttttgacccttctttaccgtcaaattttcatctttcttctccatcgccgatgcagaactcatacccatccacctcaagttaaaatttcctattcaaattttagaaatatacaaatcctaattatcatgtacaattgttataaggttgtatgaggatcatctacagatatgcacaccttgcacatgcttagagccgatcttgaaatcgccaaaaccgccgcaccagtcatgaattcgcatcggtgccgttatctcatacggacttttcataacagaggtggaggaaacagaactcacgaacatgttacagtttcctctgccgcagacaagcagaactcgtaaagctgctttcgtaatgagttgactcatcttacgacactctctcgtatacttatagattcacttctcagataagaggcttgttctctgactgaaagaaaatgattcaactctgttttttctcgaaagaaagtgtaagtaggggaaacaagaaggaaataaaaaatgacgttatcagctgatacgcggcgaatactgctgaatacacgtggctcatatccaactgttgctttacttttaagataactatttttaaaaaaacgaatgcacattttttaagtttgtccgaatcttgaagtggcgttcagcagacagagcgcacgtgaatctggtcttgactgaactgtccggtccaatatcttttggtttggtttaattcggattaatagattgtctccttaagaaaagttcctaaaaggaacattaattataattacattcatgaatcaatttagcaaaagtacacacattgaataaaaatttcatccacgtgtccacgtgtaaggtttgtattggataaaaatgttttggttcactaaatttataaaacaacctccaccatatcggcgctttccttccgatttcgtcctcccccagaaaatagagaggaaaaaaggaaaaaaagtaatcatcgattcgctttcacaacctggaaagctcgaaaagaggaaaaaaattctaaagagcttatcaagctcacttcatacacctagatcgatttagggttcgtttgatttttttttttctgtgattgcgacagctagagatctatctctggtggattttgggtttatgttcc

SEQ ID NO: 1010 - DNA, 3000 bp, Unknown
  misc_feature (1)..( 3000): cDNA_ID_1444123_gDNA_ID_1620346_Annot_ID_154161 3000 nt of promoter + ATG
gtgatcaaccattgcgaagaatcgggaatcggtcgagcaatttggcagttattgtcagcgatgaatgaaattccggtgagttctagaaagtaccaagtggttcgatcgttggcggagagactaatcaacgataatcaaggagaaaactcagtcgccttgttggatttgaaccgtagggttttaaacgcgtcgtttcgtacaactctaagccggttagagacggcggttgagcgtaaccctaaccggagagatatagatgaaccggttcgtcgtggattaaaccgggttgtcagagctgtggttagagccgtgggagatgggtttatcggttggggtggagaagagacggcggatcagacggcggaaacgtcggagaaactggcggcggaattgctttggttggcggagaagatggcggtttatggattcgtggatgaagccgttgagaaatgggcttcggcttctaacttagcttggcttgctctttcgtgtgagccacgtcttcaatgctctttgatccaaatctctggtaaatatttatttttaccgcatgattttttaatttttcgtaaatatggtaaatactatatagaataatctctttcccaatctggaaaaaagaaagaaaataggattatactctttttctgttcaggatattctttttttattttgtatgataaaaatattttgactttccaaaacaaatttcatttttactgtgaagccttactattcaaagaagccaaggacattaaaaagggaagcgaagaagaagaaggagaggaagcaaaattgagagagataaagaagaagatgcttatttcgtggattccgttgctgtgccgagccagcaacggagctgataaaccggtgttaagaagtgcggaacgagcgtatctagagaaagtgttggagaagatgatatctgaactaaaagaagaggagcaagaacgagttctctcactctggcttcaccattacacacattgcgcttcctctgactggcctgacctcaacggctcttatgttcgttggtgccattcttctcgccagcttttgctcttaggctagtcgtctcatatatctccttgataaacacaagtagaaagttgctacaatatttgcaatagcattgatcttttgtatgtcttaatcatatgtactaagttttgccctttagaaatcacttttatcaataggaaattacttttgtccacccactgatctcatttatgttaatttcctccagaaatttcttgcatgttttgaaggtgttattataccttagggatcaagcacaaaaatgagttgtgggttcaatgttggacatggcttgataaagggccaatattgataaaatcaggtcctaacgctttgtctgttatcagatccaaatccagtccattcataccaaatttcccttgtgctagctttgggatagaaatcaaactacataatcacttacaaaaaatgaaaattgcataaaaatttagattttcatatagtattttataagagaaaaagggaaaacttaaaattaacaaagttactaaagttactaaactagtacagtaattaagtttccttgtgaaatttattttattaggtgatacttataaatatatatataatattcaatactgcctcattatccacgctcaatggtcgaatcgcacggtttagtaccattcggataacgaaaacgggtggcatgaatcctacaaggaggtagcctggaggagtcaattctgatgaagaaagttgataagacgaagagtattaagaggcaacatactacaattcctctccatgtattattcatctcgtctcaaacaacacgaaaactttttattttctttttcaaattttcttttttctgtttttgttgtttgattttcctaaacagatgattatgtgtttaataagaaatgtaatttactattaatagtctggagtgttttttttgtggtgttttttttgtgctaattttaaggttatgaaataggatgcatggtttacgccttaaacatagtattatcgacgattggttatgaacacaagaagaatattgaccaaaaatctgtaattcctacggcctatcaacaaaaaaaaaagaataagaagtaattgatgatctttcaaatgaatgttaaatgtttccaaaataaatatatataaatgttacagtttcatcgctaaatggcttgcaattcttgtgaaagtcaaagaaaattctagcgggtatcattacaatttacaatttagcctagagatcatagtatttgtgattactaaatacaaatgtgaccttatttacgtggtatgtatataatttttggaatactaaattaagtaaattttatttattttcataataagttaaccactaatcgtctcaccttaatcacatgaatttgcattagaacaaaaaaatattacataaatttttaggaacacacaaaaaaaaaaaagatgaagtatcatcgagatagttttatgtcgcaatagttaagttttaaacttaatttattttgttcattagtaataccttttaactgtaagataattttattaaaaatgaattattcgtttgtgttatgaaatataaatgcttaaatattatcaaaagtcatactttttaattattattttccaaatgataagcttatataataagtttaatggaccaacccaaaattgtaaggaagtgactttagtggaatagatacgcgatagactttgacaagaaaaaaaaaaaaaaaaagatacgcaacagagttcaataataaaataaaataaaaactttcaaagaatcaaattccgttccgaattgattcacataacaacatgcatggaagcttaataacgtggacaaatcaacattccacattttattcttttcgtagataagaacgaataatatcattctctttataaactcatcactcaaatgcatttgttgcaattgcaaaaagaaaaccaaaacaaagctcaatc

SEQ ID NO: 1011 - DNA, 3000 bp, Unknown
  misc_feature (1)..( 3000): cDNA_ID_2128985_gDNA_ID_1620347_Annot_ID_154197 3000 nt of promoter + ATG
aaaagatcgaccttgtttagattcagatattgatacataaaatgtgtagtgtccgtgcgacatgtctattagtggacttcttcgaattagctatggcctatggactatggagtatgttggtgtaactgtggatctctcttacattcttttcagaaatatgttcgtcgtgtcttattattagctgtctatctacaaaatattttgaatgtattcttgtttgttaaagaataaaaataaaaatataagctctaattgatatgcatatatttaattagttgtgtctcttctgataaccgatattgtagaccaccccttatgacacaataatgctgataaaatatttaaaaaataaaaataaaatattcgagaattattgtcatgcatccaatgattcaacaagattttatcatttaagctctaattgagtattcttgaaatagattacccaccaaattaaagtgagtgagaattacttcaagaataccacaagtggtggatcattgtgctgttatactttatatagccgaaaagtactagaacagaacaagatgatacattattgattaaatgggactcttgtgtagcaaagatgaatatccaaattcagattaatatttgaagtctacatattttcaatctctagcaaagatccatatgtcactgactactaaactaatattatacttgattactcttctttggtttataaaagttattattgagtatgctttctaaaagagttgttatgatatatttaataaatgatattttgtttaattacgcagtaaaagaaactgtaaaactttctattcttttgtcagaggaaaaatattagtgggtgcaaattgttagatagtggagttgaactcctcactttgaaggctttgcgggagaatctcaaacaactttgccacttaactgatttttctaaaaactttttttggttcaagaagatatgcttgtaagaactttacagtagagtttaacgtgttatctcactaattaaaatcaataaaatcacatgggaatactttttgccagtattttttgatcatttgttaataaactatataccaagttgtgatcttttgtgtgtgttggttttatcaatttcctaagaattataaatatgcactatatcttgtcagagcttatcttcgacaacaattttaggtttccaactgctcgattttacattcttgtgctttgcaatgggttgatttatcttattgcatcgggaatcagaaaggatccaacatgtaccacaaccacatgagatcttcacgtcagtccctcgtagtttacatacgtgcaataacttttttactaagaacttaaaatccaaaatataatatgttcgtatagcggatgttggaagacatatatattaattcatacacaaggtttttagacccttttaactttctatccttttttttttttttattacaattctacacatatagtttgatataaggacgaagacttttttttgataaaggatgtaaacttataactaaaggtgagcacaaacttgtgttttcatatatgtcgtcctgtttttaatttcaaacctcatcccatataaaattaatatccaacaaaaaatttgtatcacaaaaagcaaatttttgctaacaaaagaagagtttttgaattatcaaagaaaaaaagatttttgtatcaaaataaattcgtcttggatcacaacggtccggttcaccagtccaaataacttcaccattgtagaggatacttgatcccaaaagaagtgatatatattttaatttggtagacctttttttttgctaagatatttgaccccaaaaaaatgtatatcaccccaaaagacgtttctgtagacttataattattattagaccgcaatcattttttcttggtatatcaaatcctccagacatacatttatcagtgatcttacaatcacatttttttttgttaaatggtttttccttgtttaatagttaatcaatgatcatactagcttcccttaatcatactagctataaaattaaagatgaaaaaaggttgtgcctttaaaatcaaatcctccagacctatgctataaaatatccgatacattttaaaatataatgtcatagtcatggactcatagttcaaccttcactagtattaaaagtcagtaatattattttgaaagaatacaaatagcaatagtataatgatagtagcattaattattgattgaatgaatcaattattattttagctgaacaatttttgtgaacaccgtatctcctagaatcgataaaaacttttacccaaaatctcaatgttccttgatctcgcaagaaacaaactaaaacggacaagagcatcagaacagtgtcatcactcatcagtatatgcatttccgtgtgaccgcgaactctgacagatgctcaactgatccaatgacaacactgcacgtggcatttccccacagtgacttagtggcctgtgtatagaaagatttaaagaacgtgtaatcccaaccattcctccatcaaagatatatcgatcatttctttttgacagcaataatttttaatcattttatctgtctctctgttctttctctctcccgcagtccctctcgtaattttgctatataagagcacctctataatctgtgtgagacagaattataaaaaaaaaacattgatagttttgtatctaaactcaatatataatgataacacgttcacgtgttcatcgtcaaaagagtgtctcagtgagtacaatcttcaggtgtcttctagttttgatcagacgctctattcaattctcttaattagtcatatctttctttcttttttcctcgtttcgtgttaattttattttaaaacaaaggattaaagagtcgttctttcttttggtaacatggagccttaatgatcctttgttagctctagctaggattttacgtactacttagggtattcaaactaaaataaaatcaagaagaagagcagagag

SEQ ID NO: 1012 - DNA, 1915 bp, Unknown
  misc_feature (1)..( 1915): cDNA_ID_3060141_gDNA_ID_1620347_Annot_ID_154214 3000 nt of promoter + ATG
ttggagttgttcaaagtgtatctcctaccatgagtattagaaggagaactgacaatgagatgattcctaagagggatataactttggctgatgagtcaaggaaaactgttgtggtgtccctgtggaatgatcttgcaactggcataggtcaggagctactagacatggctgatcagtcacctgtgattgcaatcaagtctctcaaagttggagattttcaaggtatgatgtatttggtattattgaacagtatggataaatcacacttgtttgaaccttttgctcatagaatccaatctctccaggtgtttcgttgtctaccatcagcagaagcaatgtggttattaacccggaatcaccagaagctaaaaagttgaaatcttggtatgccttttggattgagccagctgataaaataaaatgatgaaacttgtctctgttattcaattaccattctctttgacattggcaggtttgattctgaaggcaaggaaatatccatgtcttctattggctcagggatgagcccttctgccaaaaatggatctcggtctttgtatactgaccgagtgcttctctctcacatcacaagcaatccatctttattcgaagaaaaggtactaaacactgaaattcaaatcctgaaccaaaagtgcttaattatagagttatgaacttattatgaacttggattttctggatcagcctgtatttttcagcactagggcttacataagcttcatcaaaccagaccaaacaatgtggtaccaagcttgtaagacttgtaacaagaaagtgacagaagcacttgactctggttactggtgtgaaggatgccagagaaagtatgaagaatgcagcttaaggtaagagagatactcttttgattcataatcaaacttggttataatctttacttcctttctccgacatcttacaaatctgtccactttggttgtcgctaggtacataatggcggtgaaagtcaccgactcatctggagaaacttggatttcgtcattcaacgatgaagcagagaagattcttggatgttcagctgatgagctcaacaaactaaaatcagaggtaaggaaacaaaaccctacatgagcttttattaattgtcagaacttaagaagtatagtcatcattttgatgtttacatttgtttacaggaaggtgaagtaaatgaatatcagacaaaactgaaagaggcaacatggtcatctcatgtcttccgggttagtgtcacacagaatgagtataacggtgagaagagacagagggtaactgtaaaaggagtagctcctcttgattttgctgctgaaacaagattgttgcttcaagacatctccaacaagaacaaaacatctcagtagtagcttttacttctttttttttctctattggcctaaaaaagtctcaaaacttttccttgtataatataagcctttctgcaatttataaaattagggttttgcttaaaatttgttctttacattgtttacaagccatccatttcggtatcattaacaaataaaaacaagcgatctattttgtgtttacagctgtagagtcatagagagttgtgtaatttgtgaagataacttttcatcgaccactgtaatttgtgatatctagtccaaactttaagaaggcaggcccatatttggcccaattaggttattaaaataacaacataactaaaacccttgatagctagaactcgctctcttttctcagccaacaaacactagtctcttctgatttgtaccctaacgtttactcgacttatctaaagccgtgaacctcgccggaattcttaaagtcgcgatttttccttaacgccgtttgattcccttacggcctttgaggtccaggagatagcaaatttgttggtgagtactgaaaaatg

SEQ ID NO: 1013 - DNA, 3000 bp, Unknown
  misc_feature (1)..( 3000): cDNA_ID_3060145_gDNA_ID_1620347_Annot_ID_154213 3000 nt of promoter + ATG
caataccttaattctatatatgtgtaaaaatattcagcaaagtaattaaagggacaatatgatttttagggttttatggatcaataaaataagaaaatttgtcttgattgacctgaaataagaattcctcaacccattggataaactttaaaaagtcaagatttctcaaatagatccaattagttttactgacttattgaacattattaatgtactgattaagaagtagttcccgcactaaagtataggctatatgcaatactaagactgataaattggtagacaaaaaaggtaaacaaaaaatgcaacaaattgtcaccttaacacaattttgtactaagcttttacttttacgactctccgtcacacgcgttctcattctcttgaagttggacctcttctacgggttttctagttaagccatctcttcttcttcaacatcagaactacattttccggattcaaagtgtttatttcaatcggcggcgttgaatatacgagatggtacgttgtctccggatgtaagagagccttttttaaacgagttaagaggaatgaatataatcaaatcaaactgaaggattaataattggttaaattatgagctattccggtttggttaagtcccaccgttatattcatctcctctgaattaatcaaatagtcaattattctaattactgttgattgtctcattaacttggaatagaggaggtttggactctatttcagttttaaaaaactgctaattaaaccagattaaaaaacgaaactactaattaaatacagtaaaatttcgaagacgtttcaatacacaattaataccatagctcaatttcttcccctataaaaacagccaaggatcttactattattcatcattcaaagacaaactcgagaaaaataaactttgaaacttttttttttgtgttttcatcatggctatcaaaaacttgatttttattatagcggttatgtgcgtttttgtctccgtaaatgctcaactaccacaatttccttttccattttcattctaaccgatttctggtatgccaggattacctgatattacaaaatgtttgtcatccgtgatggatattccgggatgcattgcagagatttctcaatctattttcacaagaaaatttggtaacttaggtccggcttgttgcaaagcatttttggatgtcgaatccaattgcatgccaaaaattccattcattccgttatttccgccgatgctaaaagaacaatgttcaagaattgccggtgctactcctcctacaccaaaatagagtcttagtttatttttaaaacatataaaatatgaattttttgtcttttcaacttctttcttaaattttataattctcagattactcaacatgttttacttaaaaaaaaacgatgatacattaataacatttgagaagtcgtatttgtgtttaatttttagtcgttctttatttctaatgaataataccttcaaacatcgagtagataattaatttaatattgcaatatttcagaatttgttgttttcataaatcttttagatacgtcgtatagtaacacaaaatctgtcaacggtttataactttttatatacgacccaaaaccattctcaagatcaacacaagtaaatcctatttttgtaagtttctaataaggaaatgaacaagaaagacccaataattcaagaatgatgaagcccaaagtatgagtcttcttgcttcttgggccgaaccgaactgaactgaactgaactgaactaaagctaaactaaaactaaagttggtacggttccttctcttctctctctctctttctccgtctgtcgctgtctctctcgtcctctcctctgtttcgtagcttctgcagcagatctctctttgtccttctctctccctcagatcactgtaagtacacgacacttcacttcatttcctaattcgatctgtttcttttactctttctcgatttgcttccaatcttgatctcttttctctttctatatcgagcttgatctgactcattctttattatatacttctcttctcgattccttttttgtgaaaaaaacatctttaaaatttcatttttgttagttgcttcgtgtcttgattagtgttgttcttgtaataaatgttgtgatcttatattcattctagggttttgtgtgtgtgtgtatgagcttaatttcatacagaacagtgaaatcttagactttcgattagatcgttgacttttatctgaattattggaatttaggttattgaatcagtctttaggttattgatcaaaatgatttacttcagagaagattgtctcaataattactaacacagtggttgattattgataatgttattaatcctgagctatgtaaattttgattctcaccgtatatatatatattgagtgtagatggcacagcaggaagctagtccttcccctggtgctgaggttgttggtcgtgcctttgtggagcaatactatcatattcttcaccaatctcccggtttagttcatcggttttatcaagattcgagctttttaacccgacctgatgttaccggtgctgtgactactgtcacaactatgcaagtgagattatcattaagtctattactttaacaagattgctatgatgttctcttttgatttatattaacttggtttcgctatggatttcaggcgatcaacgacaagattctgtcgttgaaatatgaagactacacggctgagatagaaactgctgatgctcaggagtctcatgagagaggtgttattgtgctggttacaggacgcttaaccgggaacgataatgttaggaagaagtttagtcaatcttttttcttggctccacaagacaaaggatactttgtcttaaacgacgtgtttcgattccttgaggagaaagaggtgactgcacaagcccgctctgtccccatcaatggaaccactagggatgttcaggctcctattgaaccaggtagg

SEQ ID NO: 1014 - DNA, 3000 bp, Unknown
  misc_feature (1)..( 3000): cDNA_ID_3060162_gDNA_ID_1620347_Annot_ID_154198 3000 nt of promoter + ATG
atgtgtattgatcgtgacttcgttattgctcatataagtttatgacactatacggttatgggggaattgtgtcttggatcctcataaagttcattttctgttgtcaatttgatcataaaaactaaggcatatcaatggtttctaccttagcaacaaccacggtttgcttatataagcagtagtcacaaaatacgaaaatgtgtaggaattttatgggggaagatcttgattcgttgagcttgaaggagctccaaagcttggagcatcagctcgatgcagctatcaagagcattaggtcaagaaaggtaataggacaacatggatacatagttacatacgtctacatatgtatgtaaagctttcgatcgagaagttgagtttggcaaagaattcagaattttaaatttgagatgttattaattaactaatgtctgatgttcgcagaaccaagctatgttcgaatccatatctgcgctccagaagaaggtaaagtttcaactttttgtttagatagataatatatataacaaccgaaaagtattgttttcatatatatatataactatgtttgcaaccaatatcaaatcacaattaggtacatcgtaaaaaaatcattttgaggcataattctacttgtttcttttaaatcatcaggataaagccttgcaagatcacaacaattcgcttctcaaaaaggtaagtacaacttatttttgatataagtggttatatatgagtttaaaattgatagaagttgaaataattaactacagtatgtcatctcaccataattttttaaaaagattaggtttaacaatgttttatatattataaaagtatttaaaaaatatgtgactttactacatatataattctctaatttttgtaattaatcctattacataaacaaaatataatagcaaaaaaccggtactaatatataatggagaccaaatatatatttatattaataatgtttccataatatctgagtgaagaatttaagtagatgtaagataaaaaaaattagaaatggtttttagtttttttagcattagaaatggtcattatctaatcccaaaaaatggtcattatttaatcctctattgataacccttctaataaaaatcaatgttgagatcatgcagctatctagacgtaaactagttatacatatatcaaaagaaaaaaaaatgtttagatcgattttagtttaccttagttcttgatctgtatatatatgaagttgatataaattcttcgtaagactcaaagtggtaatgttttctaatatttgtataatttgtttctgacaactcagatattttatttatagaatttttgcaactgtagatttatgctggtatatattattactaactaatggcaaaacaataattttagattaaggagagggagaagaaaacgggtcagcaagaaggacaattagtccaatgctccaactcttcttcagttcttctgcctcaatactgcgtaacctcctccaggtctcgtctttctctctctcagtactagtccaaattagattaagaggttgattaattgtgccatgtgcatatatataattcaaatttgtacatgtatatctatgaatgattctgattaatttaattttatgggcagagatggctttgtggagagagttgggggagagaacggtggtgcatcgtcgttgacggaaccaaactctctgcttccggcttggatgttacgtcctaccactacgaacgagtagaactatctcactctttataatataatgataatataattaatgtttaatattttcataacattcagcatttttttggtgacttatactcattattaataccgatatgttttagctagtcatattatatgtatgatggaactccgttgtcgagacgtatgtacgtaagctatcattagattcactgcgtcttaagaacaaagattcatatcttggtaatgatttctcatgaataattaatgtaacttttactttttaaactgtggtgaacgcaatatatcaatattctatcatttgtaaatgcgatcactatgttttttatgactgatattcaaaattgctcaaatttagtcttcttgtaaatgtgctcattatttgcgctttaaagttgtcgcagcaaggtaccgcatggcacaaatgattatttgatttttgaaaaatggaaaaaggtttgtataaatacgataattgttcaaaatattcaaaaatattctaaaagtgattctatattttttttataaacaactgaatatggtatatgcatgtgttttaaaaatttataaaatattcagtgagaaaacaaagtatgtgattctatgatggtatataatccaaaaataattaacaactgaatatgatgtattatcatccaaaaatgtcaatgagcaaaattgttcttttactattcaaaatccaaacacaaggaatacaaagctattacgtatacaattcaggaatgtcctatcacaatatagatacaaccacactttgttcctacccttaaaagactttagaacacatgttcacgacttaagtaatattgtatggaggagaagagacttttgactctttcaaaatctggttcattgactaagagaaagaacaagaaatgtctaagtcttctcaacccctttcctacgttcaatagtaacgaacaaatctacattatgcaaacacacacacacacacaaacaaacacacacacactcgcatgtaatctcaagttctagcagaatggatttactttcttgtttgataatccatcttttacgtttacaatcagaaatatctaaagacaaaacacacacaaccacaatgtagtctatttgttcctacccttaaaagtctctgttggcttttcaaaacctggtccattgagtcattgactcagagagttagaactaaaaagtctttatatttacacatatacgcagatttaatctctacatctttgcttcagtaaaatg

SEQ ID NO: 1015 - DNA, 3000 bp, Unknown
  misc_feature (1)..( 3000): cDNA_ID_2129017_gDNA_ID_1620347_Annot_ID_154204 3000 nt of promoter + ATG
tttagcaaatcaactttatttttgttaaaagacttatatatatatatatatatatatatatatatatatattaaaattctattttctaacaacttttaaacaatgatttcttatgaaagaaggaaaatgtggcatgtatggaatttttggcaagcagtaatctctggtatgtaaatatgccttgcaacaataaggactaatcacccatcgcctattagatacggattgagtagtttctataacgcatattggaaatttcatcacagatgaataacatttgaatatacgagaaaatactggaaaactattaagtaacggatatggatcagtaaaaatagacgaaaatggtggccttgcatttacggagactataatgcatatgaccattaaaagtgaaatcacatttttaatagacatactgagatattgagaaaaaataaagaaaaaaaactttgttagtataacaaaatatatgtttagtagttgattgatgaacaacaataaaatccttgcctatttaaatggaagggaacaaaactatggtattaattatcttgattaacgtctttgaactcttttaatagcacttattaattagcagtttataaaattgaatagtgttaaaacttctagaaacgaacaacatttaagtaacaaatataggaatatgttaattctatgaggactctatgtattaattaaattaaaaaaaaaatgaataataaaattataacatgattattattagagtaggtggaggtgcggggaatcgaaccccgtgcctctcgcatgcgaagcgagcgctctaccatatgagctacacccccattttgagtaaaaatgaaacagatacataataaattcaaattaaacaatcaaaaggggcttaagcaaatcaaggcccgaaacgaagcccaattactcaagatgttcctaaatcctgaactagggttttattctatttccctttctcactaactctctagttaccaattttctctcactaaatcagaaatgccgccgtcgttaccgtctctgcaactccgacggcttctcctccgtagcttcatttcctcctcctccgtcaatactcttcaatctcagccccgtatcatttcttccaagccgttgttttctcctcttcccccttcccgttcctctatattctcaacatttccttctagattcttctcatctgaaacgaatgcggaatcggaatctttggattcgaatgagatcgctctctctttctcgaaggagctcaccgggaatccagacgccgagtctcaaaccatttcgcagagattcaatctcagcttctcccacatcacgcctaatcccgatttgattctccaaactcttaatctctcaccggaagctggtcgcgcggctctaggttttaacgagtggttagattcgaactctaacttctctcacaccgatgaaacagtttcgtttttcgtcgattactttggccgtcggaaagatttcaaaggaatgctagagatcatctcgaaatacaaaggtatcgccggaggtaaaacactagaatcggcgattgataggcttgttagagctggtagacctaagcaggtcactgatttcttcgagaaaatggagaatgattatggtttgaaacgtgataaagaatcacttaccttggttgtgaagaagctttgtgagaaaggacacgcgagtatcgcagagaagatggtgaagaacactgctaatgaaatatttcctgatgagaatatatgtgatttgttgattagtggatggtgtattgctgagaaactcgatgaagcaactaggttagctggtgaaatgtctagaggaggatttgagataggaaccaaagcgtataacatgatgcttgattgtgtttgtaagctttgtaggaagaaagatccttttaagcttcaacctgaagtagagaaggttttgctggagatggagtttcgtggtgtacctagaaacacagagactttcaatgtgttgattaacaatctttgtaaaatcaggagaactgaagaagcaatgacattgtttggtaggatgggtgaatggggttgtcaaccagatgctgagacttatcttgttctgattaggagtttgtatcaagcagcgaggatcggtgaaggggacgaaatgatcgataagatgaaatcagcgggatatggtgagcttttgaataagaaagagtattacgggtttctcaagatattgtgtgggattgagaggcttgagcatgcgatgagtgtgtttaagagcatgaaagctaatggatgcaaacctgggatcaagacttatgatttgttgatggggaaaatgtgtgcgaataaccagctgactagagctaatggtttgtataaagaagcggctaagaaaggaatcgctgttagccctaaggaatacagagtagatccacggtttatgaaaaagaagaccaaggaagtggatagcaatgttaagaagagggagactttgcctgagaaaaccgcgaggaagaagaaacggctcaagcagatcaatatgagttttgttaagaaaccgcacaataagatgagacggagaatgtgatgctgatgaatcttcaacatctgatagaattttctaaagattattgtctttgttctttcctttttaagatattgtcaagagtactcatcattttgcttgatcatgagcaaattgtcccaataatcttttgttttgtctcagtgtaacgtttactaagagttcatgcttggctcaagaatcggaggtaaaattaggtttcttggttaattgaatgcttctcttgtacatccaagttgagtttaattataacggatcaagtcagctaatctttgttaattatctaatatattaaagttaaaacaagatcccgtgtataaaggcatatcaacgtgcaaatgtatactagtcaaagtcgtcgccttgatctatattcttacaaagtctctctctgtctctgttcacatcggaaccacaagaatg

SEQ ID NO: 1016 - DNA, 3000 bp, Unknown
  misc_feature (1)..( 3000): cDNA_ID_2129013_gDNA_ID_1620347_Annot_ID_154203 3000 nt of promoter + ATG
aagaaaatgttactagaaaaactgtcactatttgtctcagatcagattgaatacctggagctcatcaaaagcaccactatcacccctatagaacaagagttctgtttgcagttgctcaatttggctccgcattctttgcatttgtgcggttgctgggtctcgattgatctaagtattagaagaaatgacaagaatgttaggccacaaatgatatctatagttgagaattcataattaaaagcaagaactaacatataagtaccactgctttgttttgaatattgcgagcacgatttgcgtatttgagcgtatttaaagtttcctcagcatttgtatcagcgggacttacacaagctgcaacattcagagatcataaattatgtgatccaatagatgggtgaaaacagttctgtctaatacttggatcataaatgaaatgtttgagaaaccataccaatcatcacagttttgctattgccaccaagagaatcctaaacaacagataattaccattagtttttctttttcataaccatatatttacaagggcatgtagttcaattgaaaatgtatttacgtgtataaacaaacacatagggaaccttgatacctgtagcaaacgagttaacttgctgtcacggtaaggaacgtgacctccttcctttctctttttctcatctccaagtgcacttataacatttccaagagctaatagacctttgttgatgtgaatacctgtgtaaatattgatgaaataaaccttatagtttagtcatagtctcttttaagaaaccagaaagaatatttatacaactttatacatcataaagataaacatgagatagataaccttcttttaaacgcatcccatcagctcctgttcgttttgcacgttctgaccccgctaggtcaaccaaatgaagctttgcacataatatatcttcacctccatcttcagttgttgtgcaagaaccaccggcaatcttcttttgttccagagtgattgtgaagattgcatgggaccgactaaaaaagcaagaaacaaacattacattagtatacttgtaagaactataatttcttaatattggtcatagaatatgatctaataatgaaattttatcttgatgcaaaagtactcataactctactagtggatcagccacattagctctttcaagtattgaagtagttataaagaaaacggaatgaaaacagtgcatttcaaattacaaattcaccttgactggctattcatgtttgtgctgcctgtagctcgagacaaagagcctcgtgctagaaacgagcccatctcctctttcgtcttgacttcagcctcagtaactccagccaatgttattcctccactggcagtttccctgatttgaattggagctcgtgagagagcagtgtgctttgcttgaacgccactgtcatttttaaggagggccgaagaatttgagtccagcaaatcaaaaacttcttccttaaaaatctgcatttaaaggtaaaaatcagcaagtgaaatatacaaatcaaatctcaaataacaaacacagaagctgtttctacctcaataaaagacactcgtatcaatagttcagatgaatctttggttgtctccactcttctaaatatatcctccataacgtttggtataacgccaccatttgtgcaatctccactataattagtacccatggtataggttttacctgaaccagtcttcaattacaacaaacaaacaatgaatttgatggatcaaaccaaaaaaaaaaacacgtagctaaagggaactgcagagtttagagaatttaaaaacaaacctggccataagctagaacagtggcattgtatcctttaaacaatgcatccacaagtggagcaacacagtgattgtaaatctccgaacacggatagccaccatttccgtagacgaaatcataagtaaatgtatgcgaaccaatatgtacctgtttcagttcataagaaattccaacaaaatgagttttatcaaagttcgaatctttaaacatattttcagcaaaaaaaaaaaaacattcacgcatcaattgatttcccgaattgaaccgaatcagttctatgtgaaaacaaatcccaaatgtttcaaaattcgaatcttacagcaaaactattaactgatgaagaataaacgttatttctcattcgcgcataaatttgatttcccgaatttaaccaatatataatcccacgaatcttatcaaaactgaaaaactctcagaagaaataaacgcagaaaaaacgaaaaacccttccaattgaattacctgtggctctttgggagccacggtgatgcaatctgtgcatccgttcaaaagctccggtgtaattaacggacggatgttgacggcaaccctaacgcactctgtgctctccataaccgccgagcagaaacccagaaaacctctggttacggatctaatccagaaacgaaacctcaaatcaacaccacgaaaatgtagatccaatccagaaacggaggagctagggtaattttcgagaagaaaattctcaggaaatgcgatttttgagaattcaaattttgaagagagagagagaaagagagaagggggacttttgtttattttgagaggtcaacaattaaaaaacaagaaaggcaaaacttaaaaccattatggaaattaaaattataagcgccgctcaggtacgaattcaaattttctttgagaccgttacgcacgtgtcatgcacatgatcatcactaaaatatcataggcccattattttatatttcagcccatattttaatatcaaaggcccattagtttatatttcagcccatagttttaaatattggcccatgttgatctttgtttctgaagaggaggaggaagaagacgatggttgacacttgacagagtaagctcagaaatggcgactctggtttcgaattgaacttgtgaggaaggtttttagggttataaggtgataaagaaa

SEQ ID NO: 1017 - DNA, 3000 bp, Unknown
  misc_feature (1)..( 3000): cDNA_ID_2045322_gDNA_ID_1620348_Annot_ID_154227 3000 nt of promoter + ATG
aagaactttattcaacaacttgtcagccatggaattgaaccgtaccacatgttacattgcatcactacgatcttcctcagtatctcgaggatgactatggaggatggaccaatcgcagaatcatgtaggctagcgataacaaaaaaaaaaagcagcatttactaaataattagctattgagaaaagataataaaacttactattgtttggcattgcagcaaagactttactgcttatgcagatgtttgctttagagagtttgggaaccatgtcaaattctggaccactatcaacgaggctaatgtattcactatcggaggttacaacgatgggacttcaccgcctggtcgttgttctaactgctcgtcagggaactcttccactgaaacatacattgtaggccataacttgcttcttgcacacgcctctgtttccagactatatcagcaaaagtacaaggtttatattagtatatagtttacataaccttataatggatgtttgaattgatcatgacaaaggagcaacatgttatatataatgtgtaggataagcaaggaggttctgtagggtttagcttatatgcatttgagtttattcctcagacaagctcttctaaggatgatgaaattgcaatccaaagagccaaagacttcttctacggctggtgagtgcagacacataaaaaagataattttcaaattgggaaacatatctaaggctttaagttaaaaataagttatctgctctttattacttaggatacttgggcctcttacatttggagactatcctgatgaaatgaaaagagctgtgggatcaagactgccaattttctcaaaggaagaatcagaacaagttaaaggctcctctgacttcataggaatcatgcactattttccggctttggtggaaaacattaaacttaaaccgtctctttcaagaaacacggatttctactcagacatgggtgtatctttgacttgtaggaatcaacacttaaatcttttgtataacaaaacaaactctattgttgttgttttggtttttgctaatcatctcttttcttttctgcttgtgggggacagaccttggcaatttttcaggtttcggggtaagagtttcaaggctaccaaattcagatgctaaaactcttttagagttaagtctttaaatacataaatttccccaatcaatattctttctgagttctttttttttgtttttgtttggacaagtatgatgtttttccatgggctatggaaagtgtcctggaatatataaagcagacctatggcaatcctcctgtctacattcttgagaatggtatgatcactgtctttctctatatattctgatctatgtctcttgttttttgtataagtcttctcatttcttttgccattgcaaacgaataggtacaccgatgaagccagatttggagctgcaacagaaggacacacgtaggattgagtacttacaagcttacattggtgctgtactcaaagccgttaggtaagtaaagtgtttcttactgcatcttctcttctctactcttgtctgtgtaataaataaacaaaagacattactacgtgtaggaatggatcagacacgagaggctacttcgtatgatcatttatggatttgttcgagttactaagtggatacgagcttagttatggattgtaccctgtcaacttcagcgatccttatcgcaagagatctcccaaactctctgctcactggtactctgattttctcaaggggaaaatcaccttttttggttcccaaggcatcaaacaattgcatagcaacttctcttattcctccttgtagtgaattgcatttctaataaatccggctcagtttgataaagtccggttactgaataaaaagattattaagaaatattatgtttaactataagaccaatcattttattagtctataatgttgtttattcataaacttagaggcgcgtaacatacccgagcaaacgaagagcgtgagtgattgtgagagattccttaaaacacaaagaatctttagaagataaagtttggatctcgaaattagtggatgcttattgctcaccactcaaaaagtttgagcaccacgactttgggaaaatattggtccaaaagttaaatcagaaacaaaacaaaaattcagattaaaaaagaaaacttgaagagaaaatttcataaacaaacaagtagggttccaaaatatccggattatcttttgataaaaataacataaatctttgacttattttgttttcttgggatttacataaactgagtatataagaacgcactcttccaaaatgttctaaaaatatcccaatttcccacttaggaaaaaaatgagtgcacgaacctaatttatttagttcccctataataaatctctctctcaaaagattcgtcgattgtctcgttcgttagctttcctatttttgatatataaatgggaaagattcgtcgattgtctcgttcgtttcctatgttcgagtaccatttattatttccgttggaatttacatattccaagcaaaatttggtaattctgtattgaaagagaactagggttaggtgagaaactttatatggtactcgaacatatcaggtcaacattttcttttaataacaaaatcatgactatttatatggaaactaatgtgataataaacttgtctttttaaattttaaaacgggaaaacaaaaaaaaagattctgtagatgatgttgaaaataaaaaagattcagctaatatagaatcttattaagctagaatctcctgataattcgcatttccaataatagcccgatattttcgcattctccgtttcgttaccaaaaaaaatttcaaagcatagcaaagtcaagcacacacacctacccccacctctctccctatatataaatacctgcaggaatctctttagtgttaccaaaaaaaaaaaggtttattattctttgagattcctaagatatg

SEQ ID NO: 1018 - DNA, 3000 bp, Unknown
  misc_feature (1)..( 3000): cDNA_ID_2045304_gDNA_ID_1620348_Annot_ID_154233 3000 nt of promoter + ATG
tttggaacaccggaggacaatattaggagtccgacgagaaaacccagtagggtttttcagcgaggaagtgaaattgcatccaattaacagctttggagaagaagctgagcaagaaactagggtaaggttctccatatctaattgtttctttgggagaaaaagaaacagaagaaggagagcctaaaacaaattctggtggagaagatgaaagatatgatgaggaagaaggaaacgaagaagaagagattttggtctaaaaccacgaggtttgagtttagcactagacttggatccagtgtagctaagtgtactgaaacctttttacaaattaacaggtggcgatattttcaccgtcaagatcaatgagttttatttataaaccaagggtgtgatgtgagtgagaaactctttcgagattattgcaaaagccatcccccactttttctttttgttatgttatagcccgtatctattttaagaatcagtgtacactcatttttgtagcagaaaatcaatgatgttagtactgtgattcagatttttctatatactgtgttctttttctttttttcatccagaatttttccattgtattataggttgtgaaatacaaagggtggaatacaaatttgaaacacaaagccggcggaaaacaaaaatatctccggaaactaaacctaaagaagggaaaacttaagacgaaaaacgaataaaattacgaactatggaaacaaggggaaccacagatggattagtccccaattaagcccatacatgagaacaacaaaattggctaggtttttcgttgtgtttctcgtccaaacgaatgagactacgcccaaatgggactaatccatttgtagttatactgttgtgtttttcggattgtccaaaaaattgaatacttagttcaaagctcacaatgaacaggttcaagagccttacgcctttaacattgatttaggattagagagtctggaaccgttgccgagttacatagtttacacatttcttattagaaaagagttttagtaataaagaaagatacactttcatatagtttctgaatattattatggaagtgtaagtctcctatatgtaactcgttcaccttcatcatcaaattggtttacacagtttgttccatatgtcattcccaaagtacattgttctgtcaaattattccaccatgtggtaaacatcgaataatgctctcttctattttcccaattttttgtgaattttccccaattcgaacataaaatgacattaaaattcctaactcaatatctttgtaagaagaaacccactcttggttggatacatatcaagcatccaaaaaagatcacaaagtaatcttacaaatcagctacgtttaacaatatcgaagacaaaaacagaattcatagctgcttctcagacaaagggcacaatgattccacatatgagtgcttgagaaaatgataatgttcttcaagatttaaactaagaaaaatatcgaacaagagctctacactgatctcttccttgatctaaaacacaaagggaaacaaatccccttcaagtattttagatcaaagtgtcatcaagcaatacatatagctcaagaactctttctttggattaaatcaagaagaaccacatcacattctcaagcccatcttttcagtgtggttaaagcaatataatcatcatagaacagccaaaaaaacaaaccaatttttttttttaaaacaacaaatttagaaaaactgaatatgagaaaaagctgcttctcagacaagggccaaggttgtccacatgagtgagcttgaaaaacgtgaatgttcttcaagcctcaaaccatgaaaaatgttgataagagctcgacattactctctaccttaatctaaaccacaaaggagaaaaagaatccccttcaagcaacttagatcaaagtgtcatcaagaaactccgagatcaaatctaatctttctctggtttgaatcaagaagagcaaaatcacattctcaaccccatcttttcagtgtggttaaagcaaaaagaatcatcatagagcagcatcaaaaagcaaattttcacaaaacctttatttgagaaaaggttaacactttatcatagaaattcgaagatctaaaatatccaaacataagatcagaattaaaaacataggaagatgtcgaatctcgagaaaatgctagaatccacgggaaaaaaaattcccagaatgctacatgtccagagactccaaaccatcaatgaagatgtttgatttagcatcggaacataagatttcttttaagctatacatgagtgctaagcttaaagactcctatcacaaatctgttccttatatgctattcttaacctaagatttcgtagcgaaaaattcagattttaacagaaaatcagaacaaaaaaatcggatcttttcgtgaagataatatcttgcggcgaaatcaaagacgaagtcttttatttatagcttagggtttacatctatgggcctttaggttctatttttattggcccattagcccaaataaaataacctttctcttcgctccctcctgtttcccctctgtttcgatgataaacacacacaaaaaaaaaaaacgatttctttcttaacttgttaatcagtaagagcgtctcaatttcagtgtttcatcgaatatgctgaggtaaggtctccgtttcactggttatgtttcaatttggctaaaaacaacttttttattgttcataaaagtgagtgacacaaaagcttcttcatgtttattaccagggtttcgacaatctgagattcttctccttgtgttcatgtccaaaggagattcctttcttcattctccttaccttcttaacaaacccttctctcttattatctaattcgcttttgtagctctatacgcaattagcaaatttggagaaatctcgattatagcaattttcttcagtctccatgtacttttcctctgtattactctaattcaaatg

SEQ ID NO: 1019 - DNA, 3000 bp, Unknown
  misc_feature (1)..( 3000): cDNA_ID_2045296_gDNA_ID_1620348_Annot_ID_154235 3000 nt of promoter + ATG
ctccttcaactaaaccgaaacctacacctgcaaaggatatagaggtggataagccaagtgttgtcttagaggcaagcaaagagaagaaagaagaaaagaactatggtagattctttttctgtttcagaaatcaacgtcttttcatttgtattctcaattttgactttcttcctttctcattttccaagcttctaacttggaagctgatttacttttggatgcagcctttgaagacatttcacccgaggaaaccacaaaagaaagcccatttagcaactatgcagaagtctctgaaactaattcccccaaagaaactcgcttgtttgaggatgtaagtttcgttttcttttgtatttccacagcacaccaagtggtgatttaaaaacgtgacatagttttgctaaccttctatgctctcttattgatctctgggtgaaggtcttgcaaaatggagctggtccggcaaatggtgccactgcttcagaggtttttcaatctttgggtgagttattgaatttcagttttcatcactatcagcgcactgtgcatgattcatgattaaggctacggatttcaattttattttatagcatatgccaacaattataaacaaaggaagatatgaaattggtgataaagaggaatgagttggcttcaaaaggatctactccgttacttttgtccttctgctagtcgttgatctgtattggtataaccatataagacttgcaggatattaccttggcaatctgtttcatatctcatgtgttatgattcttttttcttatatgctcacgttattgtctctcttttccttattctaaatttaaaactgaatcctgagtctgtctattgtttacacaggtggtgggaaaggagggccgggtttatctgtagaagctttagagaaaatgatggaagatccaacagtccagaagatggtttacccgtaactcatcttccctagcacattgtctttaaatgcatccattaagtttatctttaaaactggttgcttagtggacatttggtaacattgcatgtataaatgcagatacttgcctgaggagatgaggaacccagaaactttcaaatgtaagtcttttaatatttaatcctgctatcattcttttattagtcctcatttttacatatttctaaagactaaaggttacatgactagcttttgaatgatgtaattcgtttataggttgatccaatggttatctaaatttaaaatacagtttggtacttattgtctccgcttggaattttgtagggatgcttaaaaatcctcagtaccgtcaacaactacaggacatgttgtaagagctccattttacgaacaatttagttgtttccattgcttttaagaatgtctaaactatgtaattaagaaatactcttgtttgtttcttttcatgaatttaggaataatatgagtgggagtggtgaatgggacaagcgaatgacagatacattgaagaattttgacctgaatagtcctgaagtgaagcaacaattcagtaagacaaatctcagtttgtaccaagttaatagtacgttaaataggtctgatactcaatgattgaatctgtatttgtcagatcaaataggactaactccagaagaagtcatatctaagatcatggagaaccctgatgttgccatggcattccagaatcctagagtccaagcagcgttaatggaagtacgttttcttttaacctgaataagagaattgcttaattttaccccacttctttcttcatacaaaacagaaaccaattacattcttgttgttgttgcagtgctcagagaacccaatgaacatcatgaagtaccaaaacgacaaagaggtaataatactgccacttctccattgcccaaaaaggcgattacttttttaagaaatttgaggttattatacattgattgcaggtaatggatgtgttcaacaagatatcgcagctcttcccaggaatgacgggttgaaaaagctcacgtctttggttctatcaaaaatgtcacattgtctttagctttttgtagggagaaaaaaatgtttttttttttgcaaagagtcttcagttttggtcagatcagagaattgtgtaccatgttaatcttaaacgcggtcgggaattggagtcgtgtgaaaacgccgctgctgttgtttggtatgaatattatacaatagaatttgttgtcttaccaaaaaaagtctatgaagacactgaagagcaaattattatttttaagggaaaatttccaaaataaacttcatgtattcaaaatttgcttgaaaaaacctcaattttttttgtttgagattgtgtgaataaatctgccaatattttgttttagcaatttaaaaaattgaagtttttttctcgcaaattttaaatagttgtgatttattttggaattttaccttatttttaatatccaaaaggagaagtgacgtggcgatatcgaagcggtttaatgaagtgatggccccatcttaaagaaatcaatgacccttatcgttccacttctatcggagtcggagtttttttttgttgttgttgtattccgtacgtcggtcgttgtcgggagaattggcgcgtgaaatccttggctccgtcgaatacgtctgcctccgacggctgtgagtcgcatgattgagtcgtgggtaagtatccttgtgacttcaaatttgtatttccgttctttataatcccctgactcttgagaaaatcgaggagaaaaaaccatccttgcttggtattcatttgaagagtgttttagttataaaatcgtaatgtttgacggtatgtgatattctgtgagcatgattattcagaaagcttttgtctttttagtaaatattgtctctttcttagtcttaggtaatgtaacctcaagaactctatgcgagaacattacacattatctttggaattggatattatattgttaaagtttaatcattgatgaaagttgcaaagagttatg

SEQ ID NO: 1020 - DNA, 3000 bp, Unknown
  misc_feature (1)..( 3000): cDNA_ID_3060181_gDNA_ID_1620348_Annot_ID_154229 3000 nt of promoter + ATG
aaaacttatataacacagagatttgataattttttaattgttgaatactttttttttgtgctaatttttatatgattaagatttaattgattttgtatattaaatattaaattgttttacgaacttatttgtttataatttggtaacagatagatatttgagtattcagtatattttgcttcagtttaggaaatctttgatgacccgtctttagatccaataagccctataatctagatattaacctgtagtataacgcaggtaggctaatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgtcaattctaggattttccagcttgtattaaaaaatgaatcacatcatacacataaaaaatctaatatgttattaattattatagtatataagattataaattttcaatataatatgtatgaaattaaatataaatatttcaaattatgacccgttactcagtagaaagttttcttaaatctatttttcacccgttataatattttttcatgtattgaacaatttatattcgtttttaaaaattctaattatggcatatgcgaaaaaattctaattatttttttataatgatgatattattttttcgcaaaaatagaatcatataaagatgagaagtgaattataataattaataaaaaattaataaaaaattaatacaataatttagatatcaaatctaatttgttgattttaattggttacttttttggaaattaataatgtatttcatttttctaattaaatcaaattaattaaaatttagatatcaaatcttatatgttgattttgattggttattatttttgaaaattaataatatatttcgtttttaaattaaatttaattaattaaattagtatttgactttttaatccttaaagagatacattaatttactctttaaaattttatttctaatggcatacctatgtaattacttacaaaaattaagattatatttaaaatgtatttcccaaataatatagtaggactaaaaagctttgaatcttataatactttaacgaaaaaaaatttgaactaaaccaaatatcataactgtctgtgagctattattgtattcgcaccacccaattagaattttgataggtactacaatattaagtttgtgataacagccaattattacaattgtttggtgggtcattatgttcccgtgactctgggctattttgtatatatgtcactatttttgcctttcttgttgtaaaatttcgaaagctctttattttcattggtgggagagtcctaatcttcttaatttcttatcatatagtcccaacttgtatgttttgtaattgtaataacaagttggaccgacgggatattgtgtaatatgattggtaatacgcaaacgcaaagtaacatcacagaacaatgctcacacggaaaatatgaattcataaaattttatcattatatgaatggaaagtgggaaaaaagcatacattacgaaattgttttttgcatgacataagaagaaccatttaaaaacttggtaacgtcaatttatgctagttaagtactatactctttcgtcaaataaagaaaaatgctagtagtagtagagtagactgatattgttgtcccatgaaataaaaggggcttcaaatatatagtttgatttaagaacccattcttgtataagcctattttatgggccgtaatcaataataataatgggcttactttctacaatgtactcttaactgaatatcaattatagtttgggccgaaataaaaacgttggtctcatcaaaatcctaattgttttactttaatatcatgtcttcagtactaaaatactaatgaggtaatctaatttgtatattttcttcccaaaaattttcgatatgagttattccattttaatacagaatatattcttacttttagaggaagtaaaattttgaaactactcaaatcctattctatatatgtacaaacacattttttttctgccgatgacttagatagacacaaagctaagaatttcatattgtaaaaaaagttaacacgtaaatatgttccacatatccgaaaggaatttaaattagtagtggttcagtattattaagtcagacatttttaggagacgttcaataatataacatactttcccaagagttgcatgtttccatcgtacataataaaaccataactaaacaatttaaattattcattaaaaataaaaaaacggatagtatttgtttaattttcacattaaagtatcttttaattaagtatttattattatcttttatctacttatgtaatgtttataacacttcttacaaatctctccagattccttcataaatggaaacaaaagcatttaaatatgtaaatcatatgatttgttactgaaaatgctaaattacacaataataaaaagatgtaagaatatacagcaaactcatttcttcttgctgtaaaaataatcgcacggaatatttaaataaattaataaaagattctgtatctcactgtaaaaactaaaaaggtaaaaaattgaacaattaactttttctttccattcactgcagtctgcaattaatagcctctctctctctcctccttcatcatctccccatagccgtcgagacagatagagagagctgaaatttctgtgagaagattttcttccgacattttctctttccaaacactgttctacacgtagtcggaaatctcggaaaaaccaatctccgagtcagagagagagagagaggcgttcactgttgtaaaggattaagctttgggtaagaagaag

SEQ ID NO: 1021 - DNA, 3000 bp, Unknown
  misc_feature (1)..( 3000): cDNA_ID_2045313_gDNA_ID_1620348_Annot_ID_154230 3000 nt of promoter + ATG
ttaaaaacgtgcttaaactagtaagccttgtgatggtgaataatccgttgaatattgaacttttgccatcaaaaatataatgaagaattaagtcatggtatattgttgacaagtcttctgaaactttgtagattagctaagtgatagtgatgaccttgtacgagaatgactgaatgagattcatatgcctataattagacctagagagataaccgacaaaatcagtcaaagcatcatattttcatattgaattaattaacatccaaaacattttataactttaggcttcacataactctatgtttctcgttgttgtagcatttattttggaatttaatgaagcaccatattataattgtagctatttgtatttttgtcagcagaaaacttagtatttgaaattacaattgctactaaatgctaaaaaagaaagaaaaacaactctgtattttttgtgtgtaaatttcgaattttttgtttctaaagctgtgagttcttttttaaatgcataaaatatcatatatttattaaaaatgacgttatttaatattaaatatgaatgtgttacgttttgatcagttgttaatcaggtggcataaatcattttacaccgagtcatggacacagcattttttctcttgttctatctagctcatatccatgtgggttcacatgcacttgtatatgttaagagtatttattttattttattgttatcaaatgtgcccaagacaatgccacatagcttatctaccctgtcaaatccatataaaactattgaagcctttacaacttgtgattcattttcctaaagtcttaaattttaacctttgccagctcataatttattccttatattgtttagtgcaaagtttgtttgaagatggttgccgaatatcataataatcttttaattttatcgtatgtgacaatcataactataatttattaaaaaataaaagcttatataaataacatattctaaaaattatgcatgctaattagacatgagctggaaaatgaattaattgaggtaccatcaaatgttcggtcacgaaaaaaagataaacacataatccaaatagaaatttagttctatcagaatatgataaaactaattatattagtttattgcatcaacatataaataagatgcatacttatgtggacataaatagttatacatactcgtgatgtttgagattcataaattatactccagaagtttgtttgggaccgatagggatatagaacatggccaccgcatcaaggcagtattggacgcggtttctcctccagtgccaatgattatgccaacaatacaaagtgaataaatatttttgacaaccacaaaaaggagtagaagaaacaatatggcaaagtaaattgcctaattggtatttttttcatatgtctaagaaattactgatcaaaacacatacatcttttcgggccacgaatcaaattagagtccatttgcaacgttttaacttttaactcaaaatctggcctgactcttacgaaatctgcttatgttcgatcgattgagctaccaactcatgaatttatatttaacgatctctactaatttagttccttaatttaccttaaatttccatgttacattaattggtttacgttgtacaagttgaaattttcttgacattgttgttgttgttgttgtcagaattatttatctctttccatatcgtttttgtcttaccttgagttggacctttgttgtattcgtttataccgatccatttaaaagaaaaacaaagcaacataatcatcttggagtttacccaagaaaacaaaattcttggagtttgaaataggttaagattcaggcgtgtccaactacatattaaatttatttatgggccattttgtaatgttggccttttgttcttaaactgggccattttactgataatagaccaaagttggtgcaatggctcgagcttacccatttgtttttcgtatgaggacatcctattggattagattttttcccactgaccaaataataaatttatagtattttgttgtatataaatccaaattaatagagaatatttagtctcccagcgaatatcgaagtgataaaaatacacaaaatatcaaattattaaataaactttaccatatcgaaataatgacaaaggtgggattatatattgggaacacgtaccactatggtgacgtcatgggtaccgtaggtttgtgttggcaccaccaacaataacaacaaacaaacaatacaaaacccaccacttagtgctaactaaaacccgccaatcacattatacttaattacaaaagtaaaatacgatttgtttcttctggtttgataaaaactaaacagaactctctttttttttttaaattatgagattcgagttttgagacataagcgaagaagacaacattggctgatgaggtgtttttgtctaaggaaaaagaactttaggcgtgatcacactcgcttacacgtatttgtttttaactccaataatttgactaaaatgttgcaagattttttttgttttacatcaaattaaatgtgatatagaaattggacgatttattaaaagaattatatatatacacatttcatacacagtttcatcatctgctttttttcttcagtttaatggtttttttaattagtatgttatgtagaattgtagatattccgatggtccgtaaaacgacatacatgatctaaatgtcgataaatatcacttatgaccatatgtaaaaatatggattaaaaggttggatagatttataattaatagaaggaagatacgagaagaaatgtaggtccaaccacaaacatggttttgacatctctctcactctctatatataggttgttgtgtagcctctttagtcttggaaatacaacatattataagtatattaggtaacatatatgatcatatctctatatataaagtaggtatatatatatttagcgagagagggagagag

SEQ ID NO: 1022 - DNA, 3000 bp, Unknown
  misc_feature (1)..( 3000): cDNA_ID_2129155_gDNA_ID_1620349_Annot_ID_154240 3000 nt of promoter + ATG
gaatatgagagacagcttgtggaggttttgcaagggcactgtactgctagagagttcagggacatgaaccctctgaagccagagactcttgagtttggccaaattggtaaagatggagaagtcatgtagacgcgcaggagacataccattgttgatgatcacgagcgctgtaagcttgcccatcttagcaatgaaaggaggcaatacatacttgtcagaagagaagtgtagtatcaaaacttcagccttagggagttccatgtcaaaccaatccatctgagtcatttctcctgtaaaataaaacagaaatccatatcaaaactttattattctagtaacaaaccaaattattcattagaagatggtcgtgtaacaaatccttacctgtgtgaatggaaactactctggctttgtatggctcatcattgttcctctcccattctctcggaagcattgactctctttttggcatcaataaccgctctctgttatttactttcccatgattgctaagacgaagtgctacatctcttagaacatcatgctgcgtgacaaatatatcatagtagctagtgtacatatgtccaaacctgaaaatttatcgatggtaattacattagctaagaacgaataaaaccgttgaaagtggctacaagagatcagatcataaagagttttataaccaaccgtaccttggatctttcacaagagtaaggagattcctgtttgctaaatcaacaataacagcaaaagcagttgcatcctcgagatcatgcaactcaaccaacacgttgatgagaacatcaagagggatcttcttatcttcagggaaagcaccgagaaccaagaaacaatctctggttttagggtcaagattttctagagttgcttcgatttgagcaaacactctactctcatgagtttcatcagcaggttcacctcttgatagcctctccactgcaccttcccaatatttttcaggtcgttctttcaatgaagcaccaatgactttcagagacaaaggtagacctttacactccccaacaacctaccaaacagagtcaatacaatatgagtactgaaagcaaaaaagaacattgctactatgcatgtgtcacctaaagcagaccaattacctgcttgaccaaactttggctgaaccctgaaggcactaatttctgattgaaaacagagagacagaacagggccgttgcttcatgttcattgagtaactctacatcataagtgactctagaatctgcgagtttagaccgtgagaccacaagagttgtggttccaggaatattttcgaacatcagctggtccagagattcccttgtccaaacatcatcaaggatcactagcttcctcgattctggaagagtagcaccaaccccagcctcataactagtaagaaatccccatatatgggctctaagctcctcaagattgggagattgtgacacagtcagaaacaaaaccttgttcccaaagtggcctgtataaaagcagtaaatgaaagcaattttagcaactcaactatacaacaaaacaatagaagcatgatcatcaagataaaccaacaaaatataccattaagaaacaccacaaagccactgcaatagagatcacaaagatgtaccaagcaaattaacaaacgatatggaatcagaggccagcaaagaaaagtcattacctcgaacctcctcgtcccgggcaagctctttggcaagagtggttttccctgaaccactcatcccagagataccaataagtctttccccatcaatggatttaaacaacatctccttcaccttcctctttcccaaatccaatcccacccccaaatcagcaccatcggttgtcaccatctcaacggtagcctcggccgtcttcaacgcctcacgcaacgattcacttcccctgagtttcatagaaccaagcttctcattcaaactatcaaccttcctatcaatccgatcgaaccggaattcagaatcggctcgaacatgatgaacatcagcgagaacatggactaacaattgaccgttgagaaagctagacactttactctgaagattctccattttcctaacatggagtagctgtctaaccatgttccaacggctggatttaagaactttctcggtgagcttcctacacttgtctaaggtttccgagaacatacgcaactgagcctggcgatgaggtgtgagctcgacgccgctgtattggatctccttgatcgttggttgaagaccatcgatcatggtggcgagatttttggcgatgcctctgcatctgagggttttttgagaaaccgcatagagctgcctcacgagctccgtcacaacttcgccgccgattatatctgccatggcaaaggccgatgagaaaaagagagagagataagtggagagaagaaaaggcaaggaagagtggagtaacaagcaacgaagtaaacaaaacaaaaggaagtaaacaagtaggtgacgttgtggaacccattaacgaagcttcgttgcagtcaccttttggtaaagtctacggagacccaataaagataaagacttttggcaaattaatgtcatcatctttcatgtaattatgtctaataaggcccaagggcaaagtactgaagcctaataaggcccaatacataaagacacgtccttaacacgcgttcaataaaattggaatgatgcaagtgtggaccataaaaggcaaaggttctttggtccaaataaaatcatgtgaagagtacatgggcccaaagcccatagaagtggcaccatagcccatataatcctcatgggccatggccctcagctcagctcctcaagattagaagactggggacacacagtaagaaacaaaatccggttctcgaagtcgaagtggtcttcaaatctccggcggatggtaatcgtcggcggatggtttagactttagagataacagaagaagacctcatctttagagtccggagcgaaattaatg

SEQ ID NO: 1023 - DNA, 3000 bp, Unknown
  misc_feature (1)..( 3000): cDNA_ID_3060206_gDNA_ID_1620349_Annot_ID_154259 3000 nt of promoter + ATG
gttagccgtgattctattggatattatttctgtactaagagagcattagctaaaatttctgacaagcttaactaattccaattgtgtgaatcatttgcatcattgctgatatttcctaactaatattatgaaaggttgaggctcgtaagttttttgcttatgaacacattttttcaaggtaagtttctcaatcttcatgttgttgaaacatatgattcctagagtatctctactcgtacccctctcataaatcattgtgtttaaagccgagcatctgcatgatatgtaaggatctcttgcggttctcttcttgagtctccaaactccagttgagatccctggtgttagcaatatggattttctcgagaatatagtatttgatgctaggaacagaaaacctggtcagccaaagattgagccaatgtaggtgtcttcgcgcattagtcagttagatggttttggactgttacttagttgatggtgcacactcatatatctgatatagaattgtgttcatgcagttggaggatttagaggtggcgaaaagaagcataaagagattcttccatttccaagcgcaacacatgataagaaaggtgagggttttcttaccttattttccggtcaatggaagacacacacttgaataccgtcatttccctttcccacacttgttctctattagtgtcataaacagaatgccgaataggttacttttcattttatagtcatgactaggaaattttgttcctcatagcaagatatggaaacagttgtcaatttaatttcgtcatagtgaaaaggatcaatcaaggaacaagtacggaaaagattgagaatctctgtaataaggatcatctgtttttggaggtccttggatgtttacttgatcaggacgtggcagaggcaatgaacagacttttgtcaccaaaaaacgctgttgtgatgattgataatctactatcagaacatactgcactacatcaaaccaagtctcatacacatcatagtgagcgtctttgccacaaatcatatcttcttaaatactgattcaaaccaccatctcttgataacaatagtgagcttcgtttttgttttaggcaagcattctttccatatcaaatcaataacagagtgtccagagattcataccgttctattgcagtagggacatctcattggcttatctactggaaaaaggaagggtgcttgagtgttccgttaggaccagcaaaaacaatggaaagtggtgatcatgatgtttagaacaccaaactcgccgtctctacaatattagttctggtctaggttttgatcttcaataatagctgtggtcggaaggagtaattagggtaaaacataagggcgaagacaagaatgtgtagagcatgtgatttgttcaagctttaacatgtggatgtcttatttttaatgactgctctttaatatgtgggttttgtttgcgcatttttcacttgcgggttatatttttcaaaagtagtaaatgatgggaccattataaaaaggatgttattaggactccagaaaggaaattgattttatggaaaatcacctttttacctcaaagttttaatatattactaattaagtacccttacataagaagctgcgttgccaagattgaagagggtggtggactttgtaatcaaagattaattaaaaagagagttaagacaaatctcagcggaaaactcggcggtgatagataatcaaaacaaaagaaacgcgtttttcaaactggttcaatcttcttcttcgtctttcttcatcgtcttcttctctatacagaccttgactctctcattaaattaacaaatgtccctacggtttatgcaagtgtagtgctattaaactatcccttttattttcccacccaactcaatttattttctcattctttctctttactcttcttcagatctctctgtttctttctttgttgttgttatctggggatgctttctactctctgtttggtttccttcattgtgactttctattttctgggtttgtttcaagtcatgatttttccgatacccttttgatttttcttgctatttctcacctctgtataagcaagctctctgctgtttctcctcatccaagttgggtttatcagttcagctgtgtagaaattcaatcgtctgagaagtccgaggtttgatgtctgatggttttaagatcgaaaggatttgacttttatcagattagtaatgagattagattgtttttgaggttattgtaatcagatcttgatgctatttctggtgaaagagatttaagacaagttagggaatgggtaatacttgtgttggaccaagcagaaatggcttcttgcaatctgtttcagctgcaatgtggcggccaagagatggagatgattcggcttccatgagtaatggagatattgcaagtgaagctgtttcgggagagcttcgatctcgattatctgatgaagtccagaataaacctcctgaacaggtcacaatgccgaagccagggactgacgtcgagaccaaggacagagagattcgaactgaaagcaagcctgaaacgctagaggagataagccttgagtccaaaccagagactaagcaggagaccaagtcagagaccaagccggagtcaaaacctgatcctccagctaaacctaagaagcctaaacacatgaagagagtgtcaagtgcagggcttaggactgagtcagtgttgcagaggaagactgaaaacttcaaggaattctattccttgggaaggaaactcggacaagggcaatttgggacgacttttttatgtgtcgagaagactacggggaaggagtttgcctgcaagtcgattgctaagaggaagctattgactgatgaggacgttgaggatgtgagaagagaaattcagataatgcatcacttggctggtcaccctaatgtcatctccatcaaaggagcttatgaggatgttgtggcagtgcaccttgtaatg

SEQ ID NO: 1024 - DNA, 3000 bp, Unknown
  misc_feature (1)..( 3000): cDNA_ID_2129163_gDNA_ID_1620349_Annot_ID_154242 3000 nt of promoter + ATG
gtctgcgtatgagttttgtgttcacgtgtgctttgagatgacatttgctggaaaatttgatcgcagaaatcggaagacgatgacgacgttgttccaatgccaatggttatgatagaccaggatgctgaccctgaagctactattgtacaactcagttttggaaatcgtcttggggctcttattgacacagtgagggattctatatcctgttttggttttttgttctatcttatcgatgtgaaaaaactttagcttttcttgatttgtagcgtttttactatcagaatcagatgtaaacttgccttgttttcggcttatgaatcatatgtgtgtggcagatgcgggcgctgaaagatttgggattggatgtaataaaaggaactgtctcaactgaaggatccattaagcagaccaaattttctataacgaaacggtaagaaaggcctttcttttcctggtctccctttgctttagatgattttctatcacttattgacttctcacttgttcaataggatgcacaattttgtctcaaactgcttagtgctgatatgatcttcccttatctcaaattatgctagtatagaattctgcagttgtcctatgaagttcatgcttgacattgggctatatcatttctctggagaattctttctaaactagataattagcttgagacaagtgaatctgataaaaaagaactttctgtttttgagaattattggtgttgtgtgcatatatcatcttcagcaacctgcattgtcagttgttacagatgcctgaaataaattttctttttcacaccagagacactggccggaaagtggaagatcctgacttgttggaacaaatccgattaacaatcatcaacaatctcttgaaataccatccggtctgcctacagttttctttatctctttaccgtaatcacattcacattcaaagaggcttgcatgcagctgtttttttttttttgaacattgcctttggttgttttgcaggaatgcagtgagcaacttgcaatgggtgagacttttggaataaaggctcccgaaaagaaggtaatgtttactctgcttattggatgattacttttgtgtcctgtgttttatacaaactcttttctaatgtcttagtcgagttttataaagaagcttgcagtcattaaaagctagctctaggttactgatgtctcatttctgctttggatttatttggtacagattgatgtcgatatcgcaactcatatacatgtgaaagaagatggaccaaagaggaggtattcaccatatttattagcattattaatgacaccacaaaatcatatataaagaatagccctgttgaaatagtttacataattctcgcctgtttcctgttttctctagcctgcttgtcatagagacagcggacaggccaggtcttgtcgtagagatgatcaaagtgatggctgatgtcaacatagacgtggaatccgcagagatagatacagaggtagtcaaaacctacataagtacatacactgtgattccatttctatgctatgcattataatagtacgtctccattgtctctctcagggactggttgcgaaagacaagtttcacgtaagctaccaagggcaagctctaaacagatctttgtcacaggtaagtttttgtttctgttagtcttgtattttgcacctttaaaagaagagagagaggtaaaaagaatcaactatctcctgcaggttttggtgaactgtctgcgttacttcctgagaaggcctgaaactgacattgacagctactaaatgagcttttgtttgctctaaaacaaaactgctctttatcctttaaagcaatcatatctgtgcttgcgaaactttcagacttctgtatggaagattatgtggaaattcgtgatactataattgaaccactgtggctaaaaaataaatgggttcttgacacttgatttgggtgcgtttagaaaattcgtagaagactcaatttttacaaatctgaaacctcccttaccttaattagtctgtggttaacctgaaaactggacgcaaaatttggtggtttttcgaagcggtctaatttattagaaagaagtataggacacgggcaagcatgcggacttatctattcaccgtaacacacctaataacagcttaatgcaaaacaaagttgtggattagacttattaatctccttaagtggcatgagtgtatttgttcatctccttaatatataactattaatatcatatattctaaatttgggatccaacatgctttttcgtgataacgactcttaataatcgctctatctcaaaccgcattttaccctcgaaccaacaatgaatcctacttggactgtttttttgatcatttaaaattatgaactttcaatcaaactaattaacgagtgaacttttcgacgtgggatccatcataattattcggcaatactcttgcatatgttttttttaattgttttggtgactgattctagttttcttttcccaaaggtcactttacttttgtcgtcccaaatgtcaataatataataaaaggagaaaaaaacacttcgctgaagtttattttattgttttgatgactaattctacttcttggtgacagctttcatattatttaaatttcacaaggaatagaataagttcactagtttgatggattctccaaaagggactaaacacaaacgtcacatataaaaaggacttcttaaaaatatatatgcgaaaatgtcaaaagaatttaaaatgtacaacatgagatatttctaattacagactttataatatatttggtaaaaatgatcgttaaacatttatcaaattatcgttgaccttttaggaattaaaacaaaacaggaaaagaattagagtcaaacaaacaaaatgatcctactgataagaacatgagtcatgccctagttgggagaactcaaaacaaacaaaaaaactgttagtaagaaactagatgcgatg

SEQ ID NO: 1025 - DNA, 3000 bp, Unknown
  misc_feature (1)..( 3000): cDNA_ID_2129193_gDNA_ID_1620349_Annot_ID_154252 3000 nt of promoter + ATG
tctaatgatcatttttcttagttaatgagttaacttcaaagcacaagctaaaacttccattttcattgacattttttgtagaacacaaaatcattgtatctcattgcgaatgctattctgaatctgccagaggatcaagaacagatgtcttggcttattgacttcacgggttggtcaatgagcactagtgtgcctattaaatctgccagagaaactattaacatactgcaaaatcactaccctgagagactagctgtagctttcctctataatcctccaagactctttgaggcattctggaaggttagacgaatcacttcatctatgactcatagttagacaatacattggtttggttaagacaactttgtgtgtgttttgttcgtctatatgtgcaggaacatgcaaagacattcgtcaaggtgaagtttgtttacccaaagaaccaggaaagcgtggagcttatgagcacatttttcgacgaggaaaatctcccaaccgaatttggagggaaagctttgttgcaatataactatgaagagttctctaagcaaatgaaccaagacgatgttaaaactgcaaacttttggggattgtgtaacagtaacaataaccagctgcacgcgagcaacgggttttctggagctgagattgcccctgagccagtccaaacacacccttgactgtttttaaaggcaatgtattgttataaccaacccttttgaatcttagctcttgatgctaactagagaggttgtatgatttagacatagcatttgaataaaataaagaggggttgtgtgtgtgtattagtaactcttgcaaggcttgtaagtgaatccaaaaactctttacactcataagcattttattaacaggaagcagaaaataagattcacattaccagcaacaagctttgtttctttcaatctgaatctgaccaaacacaagaagaagggaaaatgaattctttcaaaatttgaaggcacaaagagattaaaaaaagtacataaaacaaaaattatactagacagcagtattagcttagactatatagcttagagttctgcagtcaaaagtgatgtgcaacggattggagttagagcctagagggagagagagagagtaggcaatttgaatgaaactagataatcctccttctgaagtttctggtggttgattgataggtgcgaaccagcaggccaaccccaatgccaaaaacctacacagacaccaagaccaattcccacaccagcgttgaaccacgacatctcaccatcttcaccatctgcgtactctctattccaatacatgtcgctgtgttctccttcatattcttgtttactgaattggaaataggcccaacaaaatgcgacgaatgttagggcccattaatggaaaacctatatttatatagataagcaattagggattgcgttgccgcttagcttcgtctgaaaaaagggggatcagttccgtcgccgcttcttcgatttttgacgccgccgcttcttcttcttcctcgcaggtacgttctgggtaacttagggattgcgtcgttgtcggaaactgcaaaagcttgtgctgtaggtttcgatttgttgtttttttttttgtctctgtagcttttgaatcttaggtttggttagattcgttaataagataatggaaaagttatgaaatgggttgatttttattaccggatactgccgctgcatcttcattcttttagttttattgtatcaatggcttcgttgtttttataatcacattaggcctctgtcaagttcagtgttatggtgatgtatatttcttgattcatttgcaattctctagacattatttgacattgcatttacatgtgattcctgtgtttgtttagtgttacacctgaatgttgatgtttaagacacaaatcaactatacacttggttgtttcttcatttgtcatatgcttatggatctctattgtttctatttgacattgctgttcatatgtttccttgaactatgattataacaatcgatgctttaggtgcatttcttgatacataaatggttttaatttcatgatgtaattgaatcacggattttgaaccctaactaaagacatggaatttctttggtttttcccctttcagcaggtaagtcacacaggtaactgaaagatggggcgtgttagaaccaagactgtgaagaaatcttctcgtcaagtcatcgagaagtactactctcgcatgactcttgacttccacactaacaagaaaatccttgaagaggttgccatcatcccttcaaagagactccgcaacaagattgctggattctccacccacttgatgaaacgtatccagaagggaccagtccgtggaatctcactcaagcttcaggaagaggagcgtgaacgccgcatggactttgttcccgatgagtctgccatcaagactgatgagatcaaggtggacaaagagactcttgagatgcttgcttctctaggaatgtctgacactcccggcatctctgcagtcgagccacaacaagctatggcaccaatcgctgctttcggtggtggcagggcacccagaagatactgagatggctttgttatcatcagccaatcaaggcaaacgactggctctcttttttcacagttagggataagaaagacatgtgtgttcttggaaagtttattgtttcttttgattcaagtttttatgtcttaaactcagagtgagactctttcgtattaatgggttttgagttatgtggaaccaaaattggagttaaaactttcgatagtaacaatatcttttgcttatcagatccgagttgattcatgggggagaaaatatcgaaattcacctgaaactttctcgaaagttgggttaatacttatttggactttgagaagggcaatttggtaaaatttcaaaagttataaggattatgtttcgttataaccagagagaagagatactagagagaagggaaagatagaga

SEQ ID NO: 1026 - DNA, 3000 bp, Unknown
  misc_feature (1)..( 3000): cDNA_ID_2129201_gDNA_ID_1620349_Annot_ID_154254 3000 nt of promoter + ATG
cgaattaatattagcaacattagccgataaagaatactactcttaagggaccaaagcttatcaatttctacacaaataaagtaatgatgttaaataataatgtcttaagaagattaatgttctctcacctttttgcatttggtatgcccattgaaccacacgcattttcagcaacaggtgaacggttgatccctttcaccgtatcatccaagttctgaggcggtgtctgagaaccataatccgaaaaggcagaagcaatagggttgttagagaagctagagttgttctttgctcttggcgagttgggaccatatacacaagcagactccaagtccccacaagcttcagaactcaaactttcttcatcctcactttgatcaaaaccagaaaaagtagcagaaatgtctcccaaaagcacaactgagtcgctagctgagcggcgcagaggacctcctctagtgagcaacccatcagttttgtcacagagcaactcatcaagccaagcaggttgatcttcgagcctggaatcttgagtagaagacttgtattgaccaatgtatgattcaatgggtgaggaagaagagtagaatgtatctgcaactggactcaaagaaagtttctttggaatcgggcaacgaggtggaagcggagcaggccttgacatgattcgaatttacctaataaatcaacaatccaaaaaagctttcttagctaaaagtaaacttcacttatcatcaaccttaagaagctatagcttctacgcaatgaaagcttccagatattcaattctacagctcttaaagattgatttttattctcagctagcaaacacaaacctcaatcccagaaagaaagaaaaaagtatttttttagtaaaacaaatttgtgaaattccgacaaccattcttgtactaaccccacaagacaaaagagtgaaagaaaaacaaaaatcacaagaagaagaacaacattgaatcaatggaacagttaccctaaaacccattacaagattttaagaaacggcaatgaaaaaactggaaatttcagcagagacattaaagagaagagaaccctgaaatctacagtgcttttgactcgaataatgagatacataaacatcaaacagaccaaagcattcaacttgtcaatcgtcagttgcttgtttacctccagggaaaaagaaaacaaattttcgccggcgaagatagtaacggaggagcaatgcggagtaaaaagagagcaaaaacgcagagtgtaggagaagaagaaaataagcgatcgtctctttctctttcactagttgcaacaaaaaagaaaaggagaagaatttattctgttgcttgctttatctctctctctttctcacagctgcgtataaatgtataacgcagaattgaattgtgtatttgaaagccccaattggctggaggaggaggcgtacggacggctcttttgggccctttgagttttttttttttttattatttggtcaagcaaagggttcactgacccatctccatccgtacttttttgttataaaatttttaaaaaaaattgtttatatttgtgttgtcacattgattaagatatttgatctgattgtggcatttacatttattagtctagaacgttcgggaagaatttattgtaaagaagtgagtcttttaagtgtctttttaaaatgtgatttgtgatggtggagaagaagtggtggaatttatatatttggggtcatcaaaatgttgaatagttaaaaagtaatgatctaactaacttcgcttaacacatatttgttagtaacgttttgcgtattgattaccaaagtggcgatgtatctttaaatagttgttaaccaagagatttttaattcaatcaagggcctcgttttggcctttttttttttttgtttcgggtcaaagatttaagtttaaccaaatagagttgaccaataaaacagctgttatcagagaaccaaataataataaatagagaaaaacagctgttctgcttctccaaacgtttagtgttataatatttattagtactttgtgtcgtttacgcaaagttgagattttttgtattctcatttgtagtattaaattattattatagcatgaaataatgaaaaaaacattattctttctgttcgttattattccaaattttaagttttgttacacctattaaaaatagattataaatttattccttttgtgattaataattttttacaactttaaaccaataattttgtagttatttatttttgaaatctacaattcatcattaataactacttaaaaatacatagaagacttcaaaattatatcttttgcaacattttttccattcaagaatttagattaataaacaaaagagggagtatatattaacagagtaatggtactaatgattagcattggaatgttaagacaaaaatacatgtcaaagtcaaacaaaaattttaagcttcaaaatgaaggtaactaaaatggttcggaaaaagaatagtcacctaccgtatattttgtttgaagatctgaaatctaattattcctcatctttgctttaaatttttgtgatacataaattaaatagcacgaatcacattttcaactttgtaatatttttcactcatactaataattaaaagggactaggaaaaataaaggcacattttctccgttggaataatcaacggttacgtatggagaagattgtgtcacgtggaagctaatccaccacgatccagtttcatctctattaacaaagatcactccttccctcgcttcaattttagtttctattgttgttcatctctcaatcgtctctttcgatattttctcaggaaaatctttacaacatccgtggagaagcaacaccagaatccgaattcaggttcgtttccttgtacgatctgattattgttggtttgtggatgagagaggctcttcatcttcttcttcgattttctggtgatgtgaaaatgaaacagcgatg

SEQ ID NO: 1027 - DNA, 3000 bp, Unknown
  misc_feature (1)..( 3000): cDNA_ID_3060218_gDNA_ID_1620349_Annot_ID_154256 3000 nt of promoter + ATG
attataagccgtgatgggctgatgaaactcacggctcgagtatttctcgcatcaattgatcagagaagcgagagagctgctggagaaagcgcctgcacagctctagttgcagtgatggcacattggttaggatccaacagagacataatcccaacaaggtcagagtttgacagtcttatcagagaaggatcatccgagtggagaaatatgtgtgaaaacgaggaataccgggaacggtttccagacaaacatttcgatctcgagacggttctccaggcaaaagtcagacccatctgtgtagtccctgaaagatcattcatcgggtttttccatccagagaaatcagaggaagaagaaggaaaagaagatgctagtctagattttctcaaaggtgtaatgtcctttgacagtatctgggaagagctcatgaaacaagaaccagaagagtcggcaagcgaacctgtgatctacattgtaagctggaatgatcatttctttgtactccttgtgaaccacgatgcttattacatcatagacacgcttggagagaggctctatgagggttgcaaccaagcgtatgtcttgaaatttgacaaagatgcagagatcaaaagattaccatccgtcatcaaagacaacaaagccgacatgggaaaccagaaacaaggtggtaagaacaagtctgagcaacccgaaagatcaaaagaatcagaagaacaagaagaagaagaagtagtgtgtagaggtaaagagtcatgtagagagtatataaagagctttctcgcagcgattccaatacagcaagtgaaagctgatatgaagaaaggactggtttcatctttgcatcaccgtcttcaaatagagcttcactacacgaaacaccttcatcaccaccaacctaatatgtttgaatcctctgcaaccgaagtaactgtgtcagaagctgctgtgtctgtgacagtggcttggtcattggcgagccaattcagcaatagtggtgggtttagttgcgaaatggctgagcttttgggggttaaagtttaagagaagtgtatagagaaaaggagttttccttctgtgtgaattttgatgtttataacttgataacccctttggtgtttttctggctaatttgatgttcataatgtcttctgtggagatagacttttactcctcactccaataatttgtatttaggaaatttaccagagttattataagtatttaataaaatcggtaactgttttttcttaaatgttattgaatccaaaaccaaaatcaatatataatagaaaagttttctctctattcagaataccgatatcagtgtgacatcgtctacttaagcatccatttaaataaaattacaagttataatttatttacaatgttcaatcaatacataagtggatgtgtctagaaaaccactcaaaccttcaaaatgttaagaaacatccatgagttaagccagtctcaccttccatcttctaattcgtcccaagcaaataataagcaaaaaccaagcaaaacataagaatgaaaaaaaatgttttcaagacttatattttagccttgtcgtctcggtcgatctttggttctccataccatttttccatatctcaatacaaagctaaacagtaaaaaaaatttataaatagttaaatactcatatgtttctaatagattattattttggaataaaagttgatatatttacgtttttcacattttatcaacaaaacaaattttttgatataatttacatatcaaatatttttaatgattatgaattaatatgcaacgggacttgtttcattggaatcgggcaacgaggcgggccttgtcattatctagaattcccaataaaagatcaacaattcaaaacctataaagatcaacaattcggaaaatttttaacggctctatcacttttgaattctaggtaatacgtttatctcaaacttactagaaaaaccaaaaacaagttttcaactacaattgacactcttggcaattcacagtctgtaggttgcaggttttgatcttcactgttctatataatgataagaagaagagtgaaggaaaagcaactcactcaccatgattaactcaacgaatcaagactttccgcttccaccacatcagtctcactcttctttcggcttagtggtgttgttcggagtcatggcggcatttgcatttgtgatcgtggtggttgcggcagtgtgctactgtctgtaccaccgcgagcaagctcgtccatgcgtcgagcaataatgtagaaaaaaagaagcaaaacataagaacgaaaaataaattttttggcttagttaagccagttttggcttccatcttccaactctgtctcaaacaaataataagtaaaaaagaaagtaaaacataagaatgaaaaataatcttttttagactcatatcttagccttgtcatctcggtcgattttcagttttccataccagttctccatatcttatacaaaactaaacagttaagaaattttataaataattaaatattcatgtgtttctaatagattattattttggaaaaaagaatttgatatttttaggtttttcacatgttattaacaaaacaataaaattgtggttacatcaattatttttaataattatgaattaatcgtaatctaagaaatttaattatttctactatatgttaatgaaaaataaataataaataaaaatttgggaacaaagtaaaaaaaagagccggcgccgagaattaccaggctacaagcccaaagtgttttaaggcctgttattgaaaaaagaccaaaaaaagtaaaggacataatttacatgtcaagatttacaaatgatgccgatttattttatttgaatatataagctatggccggacgcaaataagtttaatcgagttcttcttcttcggagaaggctttgtgtctgtatcatctgattatagcgcagagagattagttgatttgaaggagaaacatg

SEQ ID NO: 1028 - DNA, 3000 bp, Unknown
  misc_feature (1)..( 3000): cDNA_ID_1534508_gDNA_ID_1620349_Annot_ID_154246 3000 nt of promoter + ATG
tgataaaaagaaggtatgaaatttctgaattgaaaaaaatacatagaaaggaaattagaagaggggataaattggtgaggtaaattttgaatcaaacattaaattaacaaaaatgtagtaaaatagggggaaaaaaaagttttttttttttttttggaaatgtgtatgggctagtagcccaaaaacaaggaaaacacaaactattggactggactgatcaaaatagttaatgagcggttttggtttatgtaaaaaagagaatgggccttttagatagactctttaaatagaatttgacaatctcttaagttatctatttatggataaataagtgatccaactttaactaggtgaatttgacaatcttaaactagtagggagtctcactcatgaacattttacatatttatttttaaaatactacactttcttgaatacacagctttttttttgggtgatataataaggtatcttcaaaaatttatatatgaaatcagatcctaatatcttgcttttactgaaaccaaaaattgtgtttacaaaacggctcacatatcggattggcactcaaaagtcaaatcacatattttgccacggattttatataacttcaaatatatggagaatggaatttttgtatttttcaattagaaaaaaatactatagggaaaacagagatgggcaggtctggcacagggcgtgtgagacgtggtcggattgaggcaacctgaattttgcatcttatctaaaattcagatttgaccatcccactcactgtataaaccactccacattatcttttttatttatttcattattactcttttgtgtacccaaaaatgtgagacttattggtgaccatacaagtcataatttattcttgtcgaaattaatttatatataaatgtatgcgtatgtgtgttgtagatacgaatatgtgtcaacgttgctgacactaatctaattatcattattgtgaacaaagagaggcttaagagtgttcgattgaagtagatatttaatactatttgtttggataaggtagtgttaattcaatgcagtgcgcggccaaccaaaaaataaaaagatcaattgcaacgtgtatccagttacgggtatgattgggagcgatagaacttttacataaacatacacaaatcattctacaacactttttaatcaagtttcatagatggttagatgagttctattcgaattaaccttatagtgagttttggtgtggtaaaaatagtgttgattttggattacatatacacatgcggttagttggtggtgttggtgattttggattttggatttcagtgaacagcatcaaaggctccgagttcgacccatgaaaataaaatcagtcaatccattgcttcttcttcatcttaaagcgtcgagtctaatgccgatttctctatggagaatactcatcaggatcatgatacaacctgcaaacatgttgcgttgcccttatcacagagaacagatcactcatcttttttttcaagaactcactcatgcatattaccactcacacatactatcaaataacacggcactaacactaaaacaaattactaagttacaaactgtaccaacacaagatttgcggttatttattcctctaagtaccaaactattcgtgtcctcgttttaaaacatttaaatgcagagacaaaatcagttgaagaagaccttaattagctgcaaatatgcgataatattttcctagtaatgccaagttgccaactataaaaaatgagaagattgtcgaaaagaaccaactaattacaaaaactcatttcctcaaattctggtcacgcttcgctttaaacctgtgtgcttatccattgaaaacaaaacaacatcccacgtgtcaccttctttgccacacgtgtgaatcttaaaccacacatagccgttagaggtaacgtcgttaccgtgtcttatgatatacggaagttaacgccgtttgtttagttttttctttttaacgtccgtgacggtttcataacctcgggaactaagtaaggaagagcttttgaagcagagagtcgttacgtttcaaacaaccgatcatagtcatagacacaattatggtattaatttcattaattagtactaattccctatcaattacaaggaacgcaattacaaaattttgtctataataacatcaattttagaccctcatttcaaggaaaaatgtgggaatgattctccaatgacatatttatgattaaaaagttcatttctcaggttcgaaatattttgaccattttgaaatatactaataatgttgtttaaaaacatatcttattagaatgtttatatggtgttatagtgttgagatattttttttaaatataaataattgagtacaaatctataaatttaaacaataaagagtgttattaacaattaatgataagtagtaaaaaaaaaagaatattcttcaataaaaaccgtaattcatttttttcctattttttaaaaaacaaaacaaaataagataaccataggaaatgccactctgttacaactcagcagtctaatgatatttaataaaataccaattttagtggtttatggtcaacaaaaatagtttacaagcttagctagatgtgaatacatactatatactaccaaactagtttatgatttgtatatgaatcaataaaagcgttagcataattagtatatataaatgtaactgtaattggaccaaagagataaagcatcttgggtttagtaagcttttgagctgatgatgcttatgtgattaatgtgaatataagaattagggaacaatcttgttgttaataacaatacttataacatttaaatgcccttaagtatcgtcataattacatctttgtccctatccttctctttttcacttttcctaatctctaatataaaaccaactcttgtcaaattcaacaaaattctcacacaaaccgacccgacccgaatctggccggtgagaaa

SEQ ID NO: 1029 - DNA, 3000 bp, Unknown
  misc_feature (1)..( 3000): cDNA_ID_2129159_gDNA_ID_1620349_Annot_ID_154241 3000 nt of promoter + ATG
tacttctttgaaaagaaaagaagtgattccactggttgcatagcgttgatttgcgttatgtttgattacaagacccttgtgtagttggggacggtggttctcttcatgcttgtctgcaaagttggggtggactccatgagccatgtctgcagacactgcaaccacaagaacccaaacacaagtttcagtagaaattagaaagtaagagataggaaaccatcccaattttgtaaccactgtctcacaaaaattctggaaactacatatgcataaacaactgcaaaagtagaaagtgtgtaccaagaaacgatttccggatagcacggtcaaatgtacactcagtgacctgcttatttcctagggaactcacaatccgtctcattgcttgaaacatagtgggcgccccagcaccttgacatgaatctgaaccaacctattgaaacaacacatttttaggaagaatttttacaaaaaggctcagacggttcaaggacatcatcagctcaaagcaaaaaagttatggaaggttaaatgcaagtcctctttattcaacaattttcaggacaatagtgctgctagtatgttactcgatttgaaggaacctaataaatatcttagaggaaaagggtacctcctcgttgtcaaataaagctatcatccggatatcatgttcagtcgacagattttctgatgattcacatgaatcaatgagagctctcaaagcacagaaacttgatgcaagattatcaagtcttccagagaatatgaattcattatttgctcctccaaggcagctaggttgggtgtcacagatatttaactcaagactcactatatcctcgaccttacagtccaggtcatctgacaaaatctgcaacacgatcaggaaactttgagatatttgcggattttacagttacccaaatttaaactaaatgatacaaaaatttagcaacactaatggattatgatgacactatgatagaaactcgaaatgttggtaatgatacaaaaatttagcaacactaatggatgatgatgatactatgatagaaactcgaaatgttggtaatgatataaaaaatttagcaacagtaattccacagttctcatgatctaatatcttagaaacttggtgcatgttcagaaacgatgcagaggaatgactctagtgactaaccaaattatgtcatactcatacctgcatgagtaatggatgatgagcatctttggaggatacatttttgtccttggactctgctgaggattcatctgattttgttgccagtagcggaacaagttgggtctccaaatttggtttaaatccatcactgttcactgtgctaaacaatacacgaagaacaaaacagcatgaatgagcttcaaaacataactccacttgatggcaaatgcattagcctaaaacttcactagacaagctcatgaaagaaatttaccgatcaagatgaatggccaaagtgggtacccttagtaatggccttttcactttgacaagcctatgaacaaacgagccatcactggctctcacaattgctcgccccgcaacacttaagtctcgatcaaaccatgtgtgccacaaaccacctccataagtctgaacattcaccatgagatagccagacttggatgaagcagacttcggtttaagtttaagacacgggctatcggtgtgagcagctatggcatgaaaaccattaccaggcacatacctacaaaatgaggaacaaatgtaggttccctgaacccaacaaataaggaatctaagaaagaaaaaaaaaacgatttttgtgaagaacccttcaattatcaaagcttgaactagttccaggattcattatcaaagccaaaccaaatcttataccatggaagcataattgaatcggaagactcacttttctccgacagcaaaagcaaccaaacaggacatgtttcgtgtaaagaagtaacggccaccaggtttcagattccagtcttcgttttcactgaggagatcaaacccagcagccaaaagctgtctcttcgcctcagctgccagcaaagagaaaaagaccaatgagagtcgtcacttaaagttgaataccgaaaagaaaacaatatttcaatataccagtggcgtgaaactgtgtccaggattcattaagataatccagaagatccccaacaatcgacgcattagaatcactccccggcgatctcgaatcgcgatgggaggtgcagaggattggagagacggaggagaaggagcgaaagggagagcgatggagataagtaggaaaagagagagactgagagaggaaggatgaaggattgaagatggagggaagagaatgagttagtggaagacgagctatggccgccattaatttcgctccggactctaaagatgaggtcttcttctgttatctctaaagtctaaaccatccgccgacgattaccatccgccggagatttgaagaccacttcgacttcgagaaccggattttgtttcttactgtgtgtccccagtcttctaatcttgaggagctgagctgagggccatggcccatgaggattatatgggctatggtgccacttctatgggctttgggcccatgtactcttcacatgattttatttggaccaaagaacctttgccttttatggtccacacttgcatcattccaattttattgaacgcgtgttaaggacgtgtctttatgtattgggccttattaggcttcagtactttgcccttgggccttattagacataattacatgaaagatgatgacattaatttgccaaaagtctttatctttattgggtctccgtagactttaccaaaaggtgactgcaacgaagcttcgttaatgggttccacaacgtcacctacttgtttacttccttttgttttgtttacttcgttgcttgttactccactcttccttgccttttcttctctccacttatctctctctctttttctcatcggcctttgcc

SEQ ID NO: 1030 - DNA, 3000 bp, Unknown
  misc_feature (1)..( 3000): cDNA_ID_3060279_gDNA_ID_1620350_Annot_ID_154282 3000 nt of promoter + ATG
tcctcactctgagttacctagtaaatcgtacttgttctgcaggaggattgcctgcttgttctttacatgtcgacgttgttgtggttttgacttgagttgcttcgaatcgtcaatactaagatcctctatatagtcaaaggcaaaaacattgcgaaaatattgtcgtttctaatccgattgaccttaatcttcggcaaggagtagatatactgtgaccattcctgtttctcaacatcctctagaacccacacacacaactcacggggatgtccatcaccagcatcacactccaatttagtcacacctaatttacccttgtagtttataaattctctatgaaaattagagaagtcttttccatcaagaaacttgaatttctcagacctaacattaaaggaaactactagaaaacacgatgtcctagcaaagtaatacaaaaccccattgatggataaggctctaccataataaggttcatgggttaagggacatatcatcttcctccacttcaaattttcagttcctaatgtcagaatataatgaacccattctttattgagtctcttgttcatgcacaaaaccttatgttgcttgccaatcggatcaaaccctaaaaagcttcttgacgttttgtagccatttgttcaggtaagctaacatagcgtcctgtgatagggttaaatatcacacaaactgaagcctttgaggtccaaatatcatggacagggatatggaacaaaccagagacatagctacacatgtataggttcatgtcttcatggaacttcatatgattatgaaaatctacttcaagggacggattctgagactgaggcgaagagtagaatatcaaaccacttgcttttaagaccgcaaataaaagacgtggacgagcggatgacttcgttatgaacaactcggtgaaatcttgacggtaaagtatggacgcccatagcttcgacacgcaacgacaccgagcgattgactttgaagacaatctcaatgctatctccacaaagagatcatctggaatggaatcaaaagtttttctactttccatgatcagacggagaaagatctttgagaataaaaatctcacaggctcactctacaaatagatttggaataaatctcttaagaggtcgacctaattaattagatgatgttaattaatcttagggaggtggtggtgaatttgaatcctattaggatcgatcggcactaattaacctaaggcccaaaaaatatgggctttttaaccatccaaatcttgcttttttgaagaccctaacatatagtatttcacaagaagtcaatcaagaaaggacatgatacttcatttttggtcacgctgcttcgctgcgtgactcacgcacatgttaacttatacctaacatatatttcccaagaagtcaattaagaaggacatgatacttcgtttttggtcacgctgcgtgactcacgcacatgttaacttatatacctaacatagtattgccactcattcatgaatttttttttgaatgaaattatgatatgatactgtgaacgtgttttttcttattctattcatgattttttttttgaatgaaattataatatgattctgtgaacgtgttttttcttattctatgcatgcttacgttgtacgtagtgttggctaaatgatttgaggggacatcactttaggttttagtcacaaaatcttttaattagaaaaaataaaccaaaatgatccctcacgtataaaatatctaagtctgaagattattacaaaaaaaaaaatgaagaaataataaattttcaaaaagaaaacaaattagatcaacgtcagtatatattaagggaaatttgcagaaataactagcaaaaaaactataatttactaactaaccatcctaactatgtaactataatattttctgtataatatgtaatattactaaatttgccattgttgcctcaatactttcagcagccaccaccaccgccggccaccatctattccggccaccaccaacactgatcaccatcaactccggccagcaccaacttcagccaccaccaccaccgaccaccaccaccgccaccatcatcaccggccaccaccaccaccggtcaccatcaccaccggccaccaccaccgccggccactaccaccacagcaaccaccacaccgatcaccatcacttccgaccaccatcaactccagccaccaccgccagccaccgccggccaccaccggccaccactactacaatctccaaccaaagaaactaatttaataattttactaccctttagtgttagtttctacatttgacatattatagtagtgttagttttttaaataaattatcaaaaagtgttagtttcgcaattcacccatatattaaactgaaaaaaacaataattttttctctcacattaaattaaattaaatatttttttaaaatacaaaaagttaaaaaaaataacgtagatcaatatatgaaactgaaaagaaaaaaaaaacatttttactcacagtaaagttaataaatattatttttaaaacacaataaaatgttggaaaaagtcaaaataaatttcgtttgaatgtgcatttaataatttggcttcagcgccaacaaacacaaaagctataattttccctctccttcctttcttcacctcccattctctgcttctttcttcaactaaaattctttttccgcagagatcgatttctcaaatctctgtatcatcttctccattgtttagaaaaactagggttcttatagatcctcttctctctcgtccctcaaatctctcgtcgacatcatcttacgaagatccacaacaacatctgaagaaaatcgcaagaaaacatccaatttcacaaactctaggtttccgatttcttcttccttttctctaatcttcaatttgatcaatccgttgcaaaatcgaacttcaacatctgtatctaatccaagattctcaatgatttcaggatca

SEQ ID NO: 1031 - DNA, 3000 bp, Unknown
  misc_feature (1)..( 3000): cDNA_ID_2129711_gDNA_ID_1620350_Annot_ID_154298 3000 nt of promoter + ATG
tgataatggagagttttgcctttaacatacgaaaccacaacacacaccactgggcgctggctctcacgtccgttagactcacatcatcgactttcatgcctcgactcttcccgtcttccgccattgactcttaacgccatatggacgcacgcttacccattttaggccatttgtgtttatgctcttcttacttttcccccctagagaattgacttcacaataatcacctacatggacccaatcacaacggtcgtcaccttagaggaaaattcttacacaacatgtgatgaccgaaagaatgcagcagcccacacatcacggaaagtctatttaattaaggttttgccacttatacatttttccaaataaacaaaatttcgtggttatttagttctattagtacctaattttaaatatatgactaaataagagttattcgtaagttaaataaaatttaacctagttaaaaaagaaagaaaaagggtattatcattagtatccatgaacttgattattagttggatgattggatcaacatcatttaaatacttttacccctacaacttctcttcccttttttttgctttcttttacttctttggtgatttttattttccgacgacacgagaacacgggaataacaatgacaacataaaaatcaaatcgagtaaaatgttgaaatcagaagctggcctgaaaagcaacttgaaatggactaaaattgaaggatgccgtgtgtttggaagtatgaggtgagacacatgaattcagttccattgtcgttgcagaaggctttaccttgtttaccgaattgacgttcagacattgcacaaaagttacgaataagttgcgaaacttcagttttgaaagatatgagatatgtccaaaccgaatgagaatagtcatcaattaatgtgaaaaaataaacagcacctgatgtggatggagttctgttcgaccgccatacatcgccatgaattaaagaaaatatttcattgttttattattgctaataggaaaaacttgtcgtgtttgtttagaacaaaaacaagtatcacaactatcaatcttgtcaaaaccttacaaaaaagatgacattctggtaaagaaagtaaaatactagtagaaaaatgtcctagtcgacgatgccacaaatcgtcaagtactatgcatcttgttacagaatttatttaatttaaaatattcaatcgttaatgaccggtaccatccgcaaacacagcatttataaatggtaaagaagaaccaatcagcctctaaaagtgaaagatcccgccgagaatccgtttggacccaaagcaatcaaatttggtttttttagaaacctttttttattaaccaaataactgaaaatagtcaaaatacaaatcgtgatcaaagttatcactctatcacagcgataattgaagtacatgatatctaaatattaatttctatccaactatactttaataacaaattctttatttataagaaaacccatcacgattcagttataaagcacaaactttaatatgaaatgaacagaggaatcttcctcatccaactaccgaacaacatattcatgtcaaagatcttgagaaattaactttaaaatctactctttctacttcctactttttcacctttctagtattaaaataaaaaattgcaatgttatttaatttatacctttttaggattttataaattcacctaagaaataaaaattgaatctacttatttttatgttaatggatcaaactggatcaaacttgtcggaccccacacttcacttgatcttcagttttttttatataatgaaattgtactgctaatctaaaatgtaagaagatatacaagactagatcatttcaatttatttttaaaaaggatatttagttgaaaaatctaatcaaccgttatcaactttttactgaattgtatttaatatttgtaaccaatttataaacaaatagaaaaattcttatcagaaaaacatgtgttcgaaaaagcggtttacgcggttgcctaggagctagctgttttggtcgcctaaaatcatatatattttgtttcattgtaaattttcaatttccaactacataaatttaaattataagcttaagtttcctatattgtttgatatgcattaaaatatttatttttatctaatttttgtttacgatttaatatttttttaattttataatagaaagttttatatgatttttgtctataatatcatatttagaatatgttttgttgtaaacgcttaaagtgcctaaaactgttttatgttctgattaagcattttagacgctagacattgggttgttggcgtctagcattttcttgtaaaattcttttgtctagtattagttatcaaaagatttaatggttgaacaccaaattcgaatcccgtatatgatcgcgtttctatattattatatctctacaatatgatcaatgattttgttgtactactatcaaaaatttattctctagaattcacacatgcatatattaccgtgttttgtcatgacactttcccaatattacacaaacgacttataattcgtgataaaaaaatatattatgctttgaaataactcttttgaacaccatcatgcttattttcatgctaggagacaacaaaagtgacaaatatgtcatgttttcccacatactatccgaagccatagaataagaaatatacatagagttggtgtaataatttcttgttttttctctagtaagttcatttatcaatcttctctcttgagcatgctgcacttaagacttgacttagctttctatataaacacttgcaaacacatcctcctagtctcaaccacattccatagccatctctctctccctctcactctttctctctttctctggtctgtttcaaaacatagtacataataatagagacaacaagagaaagaaaaaacagagtgatctgttttaaaacagagcagaaaacagagtgagatg

SEQ ID NO: 1032 - DNA, 3000 bp, Unknown
  misc_feature (1)..( 3000): cDNA_ID_3060252_gDNA_ID_1620350_Annot_ID_154295 3000 nt of promoter + ATG
ttgcaaaggcgttccaggttgacccaagggttgtcatggatctacagaccaagttcaagaaataataatatcgtacttttgaattgctatccctttatatatttgtgcctgaataaggatcgtgtttctccgtccatcctttcgtgacatgatctgtttctttgcttcaccttgattcaattctaaataaattaatatttgcacatatgtttttaaaaatgtattcatgttcctaatgtcagtttggaaattcacaagttatcactattctggtggagttttcttcaacaaaacaaaaacaacaacaaaaaaaccatattcattcattacaaaatatatcaaagtctctagctcattgagagatttttgccttcagaatcccttaacaaaaaacagaaaaaaagaagaagaagagatgtttcgccttgagaccatccacattgaatagcctctcatgttgtcttaaatactaaacatagttaaaattaaagacatcctcctttttggatgtcaaaaatgtctttcctatgacattttagacactcaaaacagaaaatgtctttaattaattaattaattaatttttatttatttttttaatgtctttaattttaatcatgattaaactatttttaccatggttagtctttgagacatccatgagaggttatgcaatggagatactttgaggaattaacgtttttagctaaagaagttaaagactaatcacgtgccatgagcatgggaaattttactcggttttaaacaaataacttgctttgatttatgttttttcttcttctccatcttgcttgttcaatttgtatcaaaagacaaagagaggaaaattcattgatgtggcacatatatatggctagtgctctacgatggatttaccaccgaaatacgggttcggatttatgtggaaaaggtaaaatatactccgaaaacattagttatatatccaatgatcaaaaatcgatatatagacggtaactaaaacatttgataagagtctggggccttattagtataaatatgggttagaatattaccatatatctaaatcctcaatatatttaggtttagccggcgcctaaactatcttgtaatataaatattttcctctagatcaataaagattcaagctattctctcaactttggcatgctagcagagccaaacactaatagagccaaacactaattgatccaaacacacaaaactcttctctcatcacatagattttcactatggtgaaccctcctccctcaccaaactccggtaaaagtacttcgacctccggaataactaaagattcttctcaaatctcaaactctccttattacttatatccatcggatcaccctcatcaagttcagttaagatttgctcactcaaaaacgtcgtctactttttcttgagaacaaaccacacacaaaacacgaacaagaatatgctttgttttcgaaacagaatattgagaacatagaaaatgtgaaaccggaaaagatgcaagatgaaagtgcaagaagtaagaacagagaacacaagagcaggtttgataacctagttcactcccaaaagggtagctacgtctcggccgagactgtgctcggaatccactaaatcagagatagtgtttacaaggagaaatacaaatgaccactcgatacctttcactagtactcaagttcactctgtatcactctccttctaatccagttttccacgagcgtatgaaacacattgaaaacgactgtcatttcattcacattgagctcgtttcaggaaacattgcaaccgctcatgtgggcactaccgagtagctaacggatctccgtactatagcatttggatgttaacaatttcagtatttatttcgcaaattaagcgtttataacctgcacggtccaacttgagggagagtattaggataaatatgatttggaatattaccatatctctaaattctcaatatatttaggtttagcctaaactctcttgtaatataaatactctcctctaaatcaataaagattcaggctattctctcaactttggcaggcctagaacgagagtttaggcagaacggagcctaggccttaagaaatttattgtatttagttatatacatgttaagattttatatatcactaattatatatacctgcctccattttgaaaagaaatctaacaatacattcccttatttcaaatttaaatttgaatttaacatagaagaaaaatctaatatcataaagttcaaacccaaaaaataattaataaacagttaaaagctaaatgtcgagatgatcaattgaatcctttttatatccgaatatttagttaaagtacgtcgtatgatacgacataagcattaaacaaaaaaaaacttaaatattaaccaatttgagcaattttggccaatttgaactgatttagactgcctgaaccggatttctgatttttcccagtgatacgatgaaaatcgtttcggttgagaccacctagactgcctaaacgggccctttgaacgttttttttaaaacattaattatatcttatctctatactattattctcattatccattaattacatttggtttatatagtcgtgtcttatctaagaaacaatcaaacagatacaccaaatgctaacaatttaacacaccccaacacgttcacattgaccttcccttcgagtaatcactcaataaatgtatatcaaacttcaagtgcaccacgtttcgttgggaaataattttttttttttcatcaacttgaattttgaattaaacataatttgttcaagaatgtttttttaaatacttttaaccaagtcaaatatcaagttcattgtattacttaatttcttggattagttcaacacgtaaactcatctataaaattgaagtctatgtctcataagtttcttatctcttcaatacaatcttattccacaaacataaaccctcttcctatctttttaatggca

SEQ ID NO: 1033 - DNA, 3000 bp, Unknown
  misc_feature (1)..( 3000): cDNA_ID_3060244_gDNA_ID_1620350_Annot_ID_154302 3000 nt of promoter + ATG
catttataatgaacctgcaatattaggcccatatgtttattatgatttcttacatctttaggcccagattttaatcgtccaggctcaatattaggcccataacgttcggtttgtagttgtacaatcgcaaaaaacgtaggtagtcccgctagttcagctactgttacttccactaactatccttcgtctctacagagcatcaaagacttccatgtctttacaattcagtcctcacgacacctctgtaattacccttttgccctctgtcctccataactatccttgtctctcttccctctctatttctcgcggcttcaccaaaatcaataccccaagcgttcggatgatgatcattttctctttttattactatcatacacggccgctagtcccgctactgttacttccactaactgtagcatcaacagtagtgggcttttactattttaacatcaacttcaactaaagataatcgacaagttgtaataacgaaattgtacaaatgtttatgtcagtatgtaataaagccacaatattctctggcgaattattggtaaacaacaaaattgtggcaaagaaaaagtgatcctgttacagttatttggaaagttagaaaaaaaaaataaaaaaaatccatgaacaaaaaagaagatggctggcgttttcattgaaaaagtgatttgatttgatttttcttttttaaaataatactttgaacgtaagttaatgaataacaaaccattaaaaaaaaaagtaaaaaccaatatgatctaatatcttataaatatatataatacattaaattataaatgaacctcaatcttgatacctaaatctatatcactagattttaacccgcggtataccgcgggacgatttattttttaaaagtaatatatattaaaacttgcaaattttatttttacataatatttatattttacagtttataattgttattaagtaacgctataccatgaattcatgagacaattgttaaaaaaactgaagttttaacccctattaaaacagtatattaataatattttaaaattttataaatattgattcaaatacatcaaccatataacccaattccaaaataaaacacgttctttaatttatttacccgtcccatgattttttttaaagtagtaatttttaaaatttaaaaattattttttttatataaaagttttgcaaattgtatcattctctaatacatttatattttataatttaattttatatatagtaacattatacatacgacataacatttttggttttatataattttttctaaattaggatgatttgatatgtttaatattagtggtcttaaaaataataaattaaagatttaatccatattaaaatggtggattaattatattttacttttttattaatgttgattcaaaaacccgcccctccaaatccgtcttgccaaaaagtcatttattttattaatattagttttattaatgatatgactctgaattataatctaaatattttagctaataacataggagtgcactttatttatttaataggagaatgtaccatatgacctgaatgcacttttatccaaatccaccaaaaaagtcttgcaaaaatactatagagataagaaaacattgatattgcgataaaaaattaaaaactaatttttatgtgattaagatttaattaatttcgtatataaaatattaaattgacttatttgtttataatttggtaacagatagatatttgaatattcaatatattttgcttcagtttaagaaatctttgatgatccgtctttagatccaataagccctataatctagagattaacctgcagtataccgcaggtaggcttatattttagttaaactaaaaacttttattgtaaagatgatttaaaaatatatgatactattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgttaattctaggattttccagattgtattaaaaattgaatcacatctaatatgttattaattattgtagtatataagattataaattttctatataatatgtatgaaattgaatattaatatttcaaattatgtctcgttactcagtagaaagttttcttaaatctatttttcacctgttataatattatttcatgtattgaacagtttatattcgtttttaaaaattcaaattatggcatatgcgagaaaactctaattatttttttataatgatgatattatttttctgcaaaaatagaatcatataaagatgagaagtgaactataataattaataaaaaaattaatatgataatttagataccaaatgtaatttgttgattttaattggttacttttttggaaattaataatgtatttcgtttttctaattaaattaaattaattaaaatttagatatcacatcttatatgttgattttgattggctattatttttgaaaattaataatgtatttcgttttttaattaatttaattaattaaattagtatttgactttttaatccttaaagagataaattaatttattctttaaaattttatttctaatggcatacctatgtaattacttacaaaaattaaggttacatttaaaatgtacttcccaaataatatagtaggataattataaaaaaaaaaaacttaacaaaaccaataaaaatgtgtattatatatttgttttcaaataattgttttcgctaggggatcaattattttgtattaaatatggaccaaccaaagtaatcagtctacccctatatttacgttccctatccattatcgacaaaaagcaatcactcctcaagcaaatcactcctcacaccacagaaaaacaaataattgaagaa

SEQ ID NO: 1034 - DNA, 3000 bp, Unknown
  misc_feature (1)..( 3000): cDNA_ID_2990560_gDNA_ID_1620350_Annot_ID_154284 3000 nt of promoter + ATG
attcggataatttaggtgttattaagatttgtttttaaagatgaggttaatacagtttcaaactttcaatgtaatagttcaattaaccaaatagaaaaatatacaaacttaatgtaacaaaacgtagtacgttttgagattttttaagctaacgcattagatgtttagaaattaataatatgtgtatacaatagttgtggaattaatctctcaatttcaaatctcttacatatattaattgtaaacatattattttaaagaaaccttattcttacttattataaacgaaattgtcatgacgttatcctataggagaaattttttaactagtttaaataactaccaattcttactagaatattaggaattagtctggactacatccggttttatgttaaaaattgatgtttttgaaatagtttactaagtctttttatttgtttttacgttttttactatgcatagaaaaacgtcatgtgatgtattcttaacattttaatagtataaacttaaatataatattaaattttcacctttatctatctatgtttggtttttttcattgtaatttttttttctttctaatttgtacagattgacaagcctcaatgaacattttttattagtaagagattgtgaaaatcacataaaatactttcaaagtaacaaccacatgcactttcaaccttcatggttttgaactcacacaaaccatcaaaattacgattttgttactttaaaacttcaaatgacttttgtgttcgtggatcaacataaatcagaaaaatttcatcaacacaagtatttgttttccgttataaattaagatgtggttttaataagtaatttttgttttaataaaaaattaattttatttatttatttattagtaatatattttaaaattatggaaaattgaaaaattcagtattatgataaccaattatatattataatagttatggaaaattcaaatttaaaaatttaaaaattattactttctctttggtaatcgatcgctaacaataatattgtatgaagataaccaatcatatattacgtctaatgaatctatatgtgtttattatcttttttgtatcccctaaaataaaccttgaaatacctaagagattttattattttcaatatgcaagggaacatctgctaaaaaggagagacgaccgtgatctttctggtaatttatttgttggtttaaatgtgaaacaatatttttagaacttttattgtttctctttaagactatataactaacatgtcttgtgagcctatatgcaaaaaagtacacaaatgataccttagatatagaacataaaaatactccgacttaaaaataaacaaacaaagaaacttgattatctttgttttttttggagttgtaggctttgatatataacttcatctttactatcactatcatttttatccttttttggcttagtcaacaagaattagatataaaaatccgaaagtaatataatgagggatttaatgtaccttttcaaacatttttgttttttaatttttgttgagataaaatttattgtttaacaaaaactttaatttacaataataaatcaagagtgtgaaaagtttggtcaaaattataatggcgattgctaatttctttcatgaagattcactgttgaaagagatgtcttgtaattgtatttcttcactgaactaacaagataataatattattacaagagatcagcatctttagtttaagtatataacaaaatcataatattaagacttgtaactaaattaacgagattctaacacttgaactcaatggattttaatttttgcaatatgaattattttgaaattataagacatatagcatatatttagatgttatcttacgattttttgtagccaaaaaataagcaatagatagttggaaaaaagctcatataattctttgagtatttgcaattgagagattcattctccaactatcttgtgtgcacattaattctctaatttggtgtccaatcaacaaaaactagacttaaaaaattcaacgttagacaataaaattgaacgttaagtacttcgattacaaatagaataaatccaaagaattcctaaatctttttcctaaattgaaacacaattgaatcctaggcgattttttctcaaaataaagatctataaagttcaaatttgcatagtcttcatcgattttatagtgtgtaaatttataaactgagtaccaaagattcgtagggcgtgcgtattgtagaatgtgtaagcttccaaatcgaaagtccaagttaaatacgaaatagtagaaaccgaaggtgaagagaaagatagtggaatctgatgattatgatgctagtgttaaaagagataattgcctagttatcgtcttttttttttttttaggaaagacttgagaactttaggttttgtttttgtttctaatcaaatcacttaacgtcctaattaattatgcgttgatgtattttaaattttaaatttgttaattcaacaataaatggggatgtgtctttcatcaagtggttaagtccatttgaatccgtttttcctactaaagttgaattctattaaatcacgttactttgcatagtagaaattaattataaatcgaccttctcaaagtaaatatgtcaaaagaaaaaagaattcaacaataagtttgagaattaatatatacacatgttagttatggaattaatctttgaatccgaacataataacaattatgtctccctaaaaattgaaaaattcgggacgaacggtacgggcctaactgggctctaatagacgggccgggccgtttgtacatctatttaccgtttagtttatagcattttctactgtataaagtaaacggcccaaattacaacccggattcaaacccgtacccgatccgagttacaattgccgcctcactgatctctttcttcggccaaatttctgaattctctaatctctctgcaacca

SEQ ID NO: 1035 - DNA, 3000 bp, Unknown
  misc_feature (1)..( 3000): cDNA_ID_3060267_gDNA_ID_1620350_Annot_ID_154287 3000 nt of promoter + ATG
ctggaaaaagtagcacaggtgaaagttaagataaacagactttaaacatatagccatacagtgcaacatatacaaatacagcactagaagaccaaaacatatctttctgaattaaacatttgcctgaagcttaaccctcctttctccatatcttcaaattaacaagaagaaaccagcaaaactagacatagaaagcaacctgccgttcaaggagctggttgttagatccttggaaatgagtatctgtgcctatcttcccgtttccattaaactgataactcaaaggggagctcacatcagaagaagaattgtctgttacacggttgttctcaaacttatacctgcaaatagattgacatccaattgcttatgttagtccaaagcaaccctggaacaagaacttaagaaagcagagacgaaaactgaaaacttataagagacagagatacaattatcattgatcagacatatcttaaagggagtccaggaacttcagcataagtactaatttgctatatgagtttcataatcttccacttgtgtgtcaagaaaattagcaaaaatagcatgcaaggtgcatttgggtgaaccataccctgcagaatcaggagtgcacaataacaaagagtggcataagaaggaaagtcaggacacaccttaacatttcagcatctgctctgacatcaatcttctccatctctctggatatcagagtcttaatgcgtaaagtgtatgcagcaatagcctgaagcagcagaggaggacccctcagggaatttactataacagttttcatctcatcagttatttctccatcatactcaaaacccagcttggcagtttccagctctggaagtgaacaaattccatttccttcgtatgcagggaaggagttacgtattctttcaatcatgcgtgatgcaagcaaatcacatactatcctgatatttcgttctcgggttgtttccatgagaatgacatcatctgcagacttagttcctttgacagtggaataaacagcttccctctcactgttagcactgaggctgcttaacacttcattcgatgaattgacagaccgttgtgcatcatttgcttgattaacatagacttgtagccttttgtgatactctgcaaatattcttgttgcttcatcacattgttgatcatacgcttccaacaatgcttgcttgtgtctgaaaaaaggaaaaataaaactcactaaacaatttgaaagatctactgaacataactacaacaaatattttgatttgttgtatgaacagaatcaatgcatttcaacatagataaatgctgttgattgaggttcatgaagagggcaaaaagacaatcaatatcgccatacaaaagtgagaatcttaagaatgggcgatgtggcatatccatgaaaccagagaaacaaaatagcctgactaaatcccatatattccattctagggtatattaaaatcattggagaatcaacaaaacgaaagaagaatacttcagggctatatatctatggctcctgaaatcatagagaaacgaaatcgaaataccaccaaaactctaagcagctaaccatactacacatagcaaccatacttgtaatggttctgttgaggacttaacactaacgataataaagcataacaacaacaagagaaaatattaaatgaacctgagctgagtggtgcaggttatttctattgtattattttacaagtgagaagcaatgtatccaaatacagtattcaaaattgaaagattcaaaacaaacctgtaatttgctctttcatcaagcatcctcttccgctctgcttcttctctagagacctccaacattctagctttcaaatcttttctttgcctcctcactatgttcctcaatctctccacttcctttgcagctaattccctttcctgcaatgcagcttctctatcctccgcataactcgaactctcaccagtcactgtcttatccttccgccttcctttactcttactctcctccttcccaggatttaccgaactcccaatgctagcattactacttcccccatgaaccgtaatattccgcctaattctctccactgtcttctccgatttcactcggtttatcaaaaaattccatataggtatcatattccctctacaaatcttccttatagcatcaatagaaggaacatgagatttgctcgatccattatacggacctaattgcctgtaccccatttccttctgtaaccattctaatatcgcctccggtgtcggagccgagctcgataaactctgcattctctctacaactacaatacctaactcaatccctcaaatcttcatgaaacttccgaaatttctactcatactttgcgccttttcttcaaatccaaacaatcaacgtagagaaatacctaggttactcaaatcgagcgaaaacaggagttcatagacgctataaacctaatacaattcgcgaaatgcagcaacaatcgagcgaattggtactctgatgaacacagagacagaaggaagacgtagacaaacagatctggaatcccgacgactaactcgccggttccggtgacggtagatggaagattgtgacggagagatggatctggataaagagatttcaaatcgaggtcccgcttgtttattggattttcaattaaaggaatcaaactcgaatttttctgcaagtgtcgtcgactgttgaaagttgaaactgggtaataaccgcgtcggactcgggtatgagatgtatccgggtcggactaaggtatttaagtctaaccgggtcgaattgggtaataagaaaacactatgggtcaaaattagaatagtttaaaattacaaccagaacatttagggtcaaagttgaatttatataacactaaagggatggattccgaattgttttaattttctcaatctaaaacccagaggttccttcctagggttttgtttgatactctcaaatcggaaaattttgaaaca

SEQ ID NO: 1036 - DNA, 3000 bp, Unknown
  misc_feature (1)..( 3000): cDNA_ID_3060263_gDNA_ID_1620350_Annot_ID_154288 3000 nt of promoter + ATG
tagcttgtcatttattacacttgctgctattcattgactcgaacaaaaggtcaatgtgatgaatttatttagatatgttaaaatgtaagaaaaaataagttctatttgattgtttctttacacgactatatcaaccaatataaaaaaaatcccaatccagtcaaaagacccgatcgactccaagcagaaccagtccataatgaaacacttataacaatggtttagctgccaagctgatgtaagatatatagtataattttgttttcttaagttttccaagctaatacgtaaattaatcactaaatagattttttgagcgtattagtgtaacacaattggattcgaagttagattatgacacaacaacaacaaaaacaacaacaacatcgatacatattattcagccacatggccttcaccttcatgccttgtcatacagtttacatggtatatttttttttaaagtgtcgactaatattttgctagatatttttgtttatagttttggtcgttggatatcttactatattatttgaaaagtacattttaaatgtaactttattttttgtaattaattacatgacaataccattaaaaaaatttaatcaaaaacaaaatcttttaatgacgtcattaagattaccaaactcatttaactacaatattcatttcttaaatataaggcttattggatctaaaaacggatcatcaaagatttcctaaactgaagcaaaatataccgaatattcaaatatctatctgttatcaaattataaacaaataagttcgtaaaacaatttaatattttataaacgaaatcaattaaatcttaatcacataaaaattagcacaaaaaaaagcattcaacatttaaaaaattatcaaatctctgtgttatataagttttatactatattcaaataaagtgtaatataccttttcaatttgtattttttaactagtttaagctaactaatatatttgctaatcttatacctatcaaaaccgactatcgtttcttatctctatagtatttttgcaagacttttttggtggatttgggtgaaagtgcattcggatcatatggtacattcccctattaaataaatatggtgcactcctatgttattagctaaaatgtttagattataaatcaaagtcatatcataaataaaattaatattaataaaataaatggctttttggcaagacgaatttggagggacagtaaaatataattaatccaccgtttcaatacgggttaaatctttaatttattaacatatcaaatcatcctaatttagaaaagattatataaaaccaaaaatgttatgtggtatatataatgttactatatataaaattaaactataaaatataaatctattagagaatgatacaagttgcaaaaattttatatataataaataattcttaaattttaaaaattactactataaaaaaaatcacgagacgggtaaagaaattacagaacggattttattttggaattgggttatatggtagatgtatttgaatcaatatttataaaattttaaaatattattaatatgttgttttaataaggattaaaacttcagttttttaacaattgtctcatgtattcgtcgtataacgttacttaataacaattataaactataaaatataaatattttataaaaataaaatttacaaattttaatatatattatctttaaaaaataaatcgtcccgcggtatagtgagggttaaaatctagtacttgtgctatgtttttatcaaaagtcaacgagattaactaagcaaccacaaaataggaaaacgcatcaaacgcacatatatatgagatcatgtatatgattatatcatgatgatactcatgggcgtagtcaatttacattgtagaaagtcttgtcttctttaaagagttggtcaatttaaattgtccaatgaaacaaatattatcacaattcacaacttcttcgtcacaaaaaagatttaaaaccaaatggcccatgcaggtttcgaacctgcgaccttcgcgttattagcacgacgctctaaccaactgagctaatgggccatttgctacaaaactaaaatcatatttactaatctttaaattatcatttttatacaaattattagtccaaaaaagatgcaagaaatgttgaaaaatatttttcatacgggttattggtcaaagtatatgcaagaaatgttgaaaaatatttttcatacgggttattagtcaaagtatatgcaagaaaaaaatggaaaagtttgggatatatcatcgtgcatggttggtcattatgtgtgtatcttttgattttgacttgtctctccattaattagaggtttcacgatcttcttcctccaatctttttccaggtaaacaaagaaacattaaatttttgatcatatcattacacttacacatatgcttagttttgtacaattaggacatattattgttcttctaatcagaaagttttcatccaaacaaactttttagcgttaaagctcatttcttggagaattttgaagtgttgaatttttcaatttcgtgtttgattaaagatttgacagaatcagaaaataagggttgatttagagagtttggtgttgcagattaatcaaattcataagtttttgtctatgagttcaaaaatcctgaagagtccaatcttaagatttttcagaggcaagttttgagatgatccttttgatctgaacaattatgtaattagtacactttgagccacctgatattgaagagcatgtttttgttcagtttttgagtgtaatgaatttttgaatctagaagttctagatgaactttttatgtgaataaagattatccatttgcctttgttgtcttaaacttgaaggtcaagtttctgtcttgttttggttgagtttttaaatggattcttgaattctttaatttgatatctgaactgtgactgaaattggttaggaaaagtcattatg

SEQ ID NO: 1037 - DNA, 3000 bp, Unknown
  misc_feature (1)..( 3000): cDNA_ID_3060256_gDNA_ID_1620350_Annot_ID_154293 3000 nt of promoter + ATG
ccatccaaagcacgttcttgtcggagtttctaagcacccagccgatgccacacttgctgcgttctgcattccaagctccatctgagttacacttaacccacccatgtgggggttgcttccacttgatcacttgctgctcagatctctctatgtgttttggtagaaaactccgctgcagattttgcctccactcctcaacatcctctacagcccgccgaattacatctggtgcatcaaactgtttccccttaaaaacgaggtcatttcgattcttccacagtctccatagaatccatggagctaccataccgtcatctcccaactgtgggtggtactgattaatgttcaatatcctgtgcatgttttggtatagagaatctgaccactcaccttcaggcggggctgggatgggggatatagcccaaacaagtctagcaaaactattcctgattcttagtttttctgattcttagtcagcggaaagtatagcccaaactttttctgattcttagtcagcggaaaaacaatttttccggaaccaaaacataaaccaaaactattgaagcaaaaaaacaatttaaggcataaagccataattaaaataaactcaacaaccgaaactttaaaatgaatccttaattattttccactgagaagcaaatcacaacacaaatacttttttttcaaaaactgaattttgttgatgatgatggtaaataccacaaccggaaaatttggaactacttgtcctcatttagttagtgcttaaaagacttatgaaatcaaaccatctacttacaaactccagtttgacaggcttcgttgaagaaactttagaaacatagaaaacatgctgagatcgataaagtcgagatatgtttaatagggtctataagctaggaaatatgtttttatataaataaataaataaataaaaaaacgacgtacatatgactctcatttctaccgatgatatgatatgatatatttttgttacactttccattttccgcgttaacttcatcactatgatttctttccaattttatttaccaattattgttacaacttagacgaaagtgtgtaatgttatttggatagtttcgacgacgaatttacaaccgttatatggttcatatttatgtaagaaaaagaaaaaagtaaaattttccctaaaaaaattagttatatatcttaatctctatactgttcccaatatccattatactttatatttggtttatatagtcgtgtcttatcatctaagaaacaatcaaccaattttaaccaaaaaaaaattattaaacaaaaccagcaagtgttaacattttaacacaccccaacacgatcaaattgaccttctcttaaagtcagtgatataaacgacagataaaaggaagaaatcattaagaaaaaaacacacttgccatttcaaatttcaagtgcatcatgtttgttggagaaataatatatataaacagtttataatgttcaattaaacataatgggttgaggaaagaaaactaaaactttattagaataattgttatgaatgccttttcaacattactctttttccaatactatccatttttatttttcattttcatttataccctctcttaatgtttaatgaccattttacctctatttggaaaatgttttagataaacaaaatgaaatatttgttttttcccgcccaaaatattctgaaaataaatttcccgccaaacgttttccgccaaaatgtttttaaaaaaaaacatttttcaatttcaaaaaaacaaatttggcggaaaatagattacaagggattttaaaagattttaaaagggctttaaaacattttcaagagattttaaaagattttaaaagggttttaaaagatttacaagagtttttaaaagattaacaaggtttttaaaagattttcaaagaatttacaagggttttaaaatcctttaaaaactcttgtaaatcttgttaaaactttttgtaaaggttcacaagagttttaaaatggttcaaaaattattaaagggtttaccagggtttttaaaagatttttaactggtttaaaaggattttaaaggatttacaagggtttttaaaagattgaaaaaacatatacaagaatttcaaaaccctttaagaactcttgtaaatctttttaaaaccttttgtaaggggttcacaagagttttaaaatggttcaaaaattatttaagggtttacaagggtttttaaaatatttttaaatggtttacaaaagttttaaatgatttacaagggtttttaaaagatttacaagggtatttaaaattcttgtaaatcattttaaaactctttaaaaacacttgtaaatcttttaaaatcattgtaaaaggtttaaaatgatttacaaaggttttaaaaagggtttttatagtatttacatatataaagactttataaagattttaagaggttttaactgatttacaagggtttttaacaaatttacaaagcttttaaaaaactgtacaaggttttttaaagagtttttagagggttcttaaaacttttacaaggatttttaaatgcatgtttttagctgggacttttttgtcgtggagaaaaaaaattggagggaaaaaaaaaatttggcggaattttgtttttgtcgggaaaaaaaattttggcgggaaaatttcagtttattattacatattctcgttagatgagtgtaatttggtcatttgctcaagagaagtgggatttttaaaaatggacaacataaaagggtattgttgcaaaagggtagtagaaaaagggtatttttgcaaatctctaaatatattaaccaagtcaaatatcaagttaatgattatttaatttcttagattatttcaacacctaaactcatctataaattgaagtctatggaacataagttattttatctcttcaatacaatcttattccacagacaaaaaccctcttcctatctcgttaatggca

SEQ ID NO: 1038 - DNA, 3000 bp, Unknown
  misc_feature (1)..( 3000): cDNA_ID_2129680_gDNA_ID_1620350_Annot_ID_154286 3000 nt of promoter + ATG
aaaagcatcaacctttcagataaaaagcatcaatccgatgaaacccaaaaaccatcataagctcatcgatcaacatcagatgatcagtaatgaatggtatcaaaatccaatgatcatcaaagaaactttcaaaggaaaacaaaaaacagaggaatcgatgagtacctttgtgatagagacctgagaaaatccagaagcaagagaaaacccaggaattttccggtattgactaattctaaaattgaagatttttcaggttcgtcgaaaaagtgcaaaatgaagtttcctgaataatagcgatcctttctctctcgtctttgtcttcttctaccttttgatccataagcctttttggtcgaaatttaaccagggaaaaacagaaagtttcgtaaatagtccctttaattttacatatatttagttatgaccccaaacgtttcgattataaagcttaaacttattctaattgtgacccatacatttttgtatacaaaaaccatttcttttctcggcagcaccaagggcatacagatttacatctcttaggaagtttgtttcttgattttctgctaagtttttatactaccaactcaccaagaaattgcgacaatcgaatgaatttttaagttgttccgagctaagcctagcatttccacattgttggagttatggatttatgttcaaattctaacaacaaaatgtctttcgagtttaagaagttgtaagtatcctaataataatagtatcctgactattgtcgaataaaggtcaagttggtctaaagttatctctacacttgataacaaacaacagaagagctcaaaattgtaataatctcaaatgtctgtcttgctgcagagaccacacctcattatgtgagagaagccaagtgttgtcttgaattcaattacccaccttggcaacttttctctgctcggtttggcccgacaaggggcactgcatctctgtccaacttatcggaaccattgtttcgcctgcacaatcaccagaccacataaacatttcgattactcaaacggaaattaacttcgtatagtattataaactgcccaaagaagcaaatgcatctacacattaacatactccaagtccaggacgaaaatatttgttactcataattccataatgagaactacaagttagaaatgtattacaatttgatatgtgatagattagctatataattagtaatctttgccctcattaccctttatttagtttctaagagtaggaaaaaaattacccgcagcactttcagctgagaccacaccaagttcattcttagcagttgacaagtagtaagcccgtgcatcaccaagagacagctttaagagtccaagttaaggcaacttcagatattatcacccaaaacatcatctattattatagactacacctacgctacattcaaattaaactatacaaagagatatgtaagtaaaaagagaaaataaatggcataatgtaacaaatcttagaattgtctctcctctaataaacaatgttaaccactgtactactagacaataagtgtgaaacataagcgcaaggatacaaccatagctctaacaatgtcaccagcatggaaagactgatgcatgtcaactttgtcaatctctgttgctctaacatcttgttgcctatgaaagagcaaacacaagttagatcgacacataaaagaacaaaccttgaaaataaacaccaaaggaggatgagaaattcacctaattacaccagcaaaattttcacgaacggcttttgaaccaacacacaagatatcaacagcagccatcttagtcataactttagtcacctatcacgaataacagagaatagtgagtgatgaaattactctctttttttccaagtatgaacatcaatgaatccaatgaaataagtgcaggactcactcttgctatgacaacagaaccagtctctggaataggaccatgtgccttgtgacctgtaacttccacaatagctctctgcttaccatttttatcatccaataagttatatatccataacaatcacaaaaacaagtataacaatccaacgatttcgatttcgattacgaatagatgtgccagaagaattaatcacttggaacaaagacgaaacctgatcaattgattcgggaagaggagaaacaatccggcaagttcctgtgagggaagcgtagatggtggcgtcgttgacgtaagctccttttccagctttaaactctgtcgctttcccgattacatctcccggcgttactagccccgtcgtcattgtttcaaaattttccgatttgagagtatcaaacaaaaccctaggaaggaacctctgggttttagattgagaaaattaaaacaattcggaatccatccctttagtgttatataaattcaactttgaccctaaatgttctggttgtaattttaaactattctaattttgacccatagtgttttcttattacccaattcgacccggttagacttaaataccttagtccgacccggatacatctcatacccgagtccgacgcggttattacccagtttcaactttcaacagtcgacgacacttgcagaaaaattcgagtttgattcctttaattgaaaatccaataaacaagcgggacctcgatttgaaatctctttatccagatccatctctccgtcacaatcttccatctaccgtcaccggaaccggcgagttagtcgtcgggattccagatctgtttgtctacgtcttccttctgtctctgtgttcatcagagtaccaattcgctcgattgttgctgcatttcgcgaattgtattaggtttatagcgtctatgaactcctgttttcgctcgatttgagtaacctaggtatttctctacgttgattgtttggatttgaagaaaaggcgcaaagtatgagtagaaatttcggaagtttcatgaagatttgagggattgagttaggtattgtagttgtagagagaatg

SEQ ID NO: 1039 - DNA, 3000 bp, Unknown
  misc_feature (1)..( 3000): cDNA_ID_3060275_gDNA_ID_1620350_Annot_ID_154283 3000 nt of promoter + ATG
gacataattgttattatgttcggattcaaagattaattccataactaacatgtgtatatattaattctcaaacttattgttgaattcttttttcttttgacatatttactttgagaaggtcgatttataattaatttctactatgcaaagtaacgtgatttaatagaattcaactttagtaggaaaaacggattcaaatggacttaaccacttgatgaaagacacatccccatttattgttgaattaacaaatttaaaatttaaaatacatcaacgcataattaattaggacgttaagtgatttgattagaaacaaaaacaaaacctaaagttctcaagtctttcctaaaaaaaaaaaaaagacgataactaggcaattatctcttttaacactagcatcataatcatcagattccactatctttctcttcaccttcggtttctactatttcgtatttaacttggactttcgatttggaagcttacacattctacaatacgcacgccctacgaatctttggtactcagtttataaatttacacactataaaatcgatgaagactatgcaaatttgaactttatagatctttattttgagaaaaaatcgcctaggattcaattgtgtttcaatttaggaaaaagatttaggaattctttggatttattctatttgtaatcgaagtacttaacgttcaattttattgtctaacgttgaattttttaagtctagtttttgttgattggacaccaaattagagaattaatgtgcacacaagatagttggagaatgaatctctcaattgcaaatactcaaagaattatatgagcttttttccaactatctattgcttattttttggctacaaaaaatcgtaagataacatctaaatatatgctatatgtcttataatttcaaaataattcatattgcaaaaattaaaatccattgagttcaagtgttagaatctcgttaatttagttacaagtcttaatattatgattttgttatatacttaaactaaagatgctgatctcttgtaataatattattatcttgttagttcagtgaagaaatacaattacaagacatctctttcaacagtgaatcttcatgaaagaaattagcaatcgccattataattttgaccaaacttttcacactcttgatttattattgtaaattaaagtttttgttaaacaataaattttatctcaacaaaaattaaaaaacaaaaatgtttgaaaaggtacattaaatccctcattatattactttcggatttttatatctaattcttgttgactaagccaaaaaaggataaaaatgatagtgatagtaaagatgaagttatatatcaaagcctacaactccaaaaaaaacaaagataatcaagtttctttgtttgtttatttttaagtcggagtatttttatgttctatatctaaggtatcatttgtgtacttttttgcatataggctcacaagacatgttagttatatagtcttaaagagaaacaataaaagttctaaaaatattgtttcacatttaaaccaacaaataaattaccagaaagatcacggtcgtctctcctttttagcagatgttcccttgcatattgaaaataataaaatctcttaggtatttcaaggtttattttaggggatacaaaaaagataataaacacatatagattcattagacgtaatatatgattggttatcttcatacaatattattgttagcgatcgattaccaaagagaaagtaataatttttaaatttttaaatttgaattttccataactattataatatataattggttatcataatactgaatttttcaattttccataattttaaaatatattactaataaataaataaataaaattaattttttattaaaacaaaaattacttattaaaaccacatcttaatttataacggaaaacaaatacttgtgttgatgaaatttttctgatttatgttgatccacgaacacaaaagtcatttgaagttttaaagtaacaaaatcgtaattttgatggtttgtgtgagttcaaaaccatgaaggttgaaagtgcatgtggttgttactttgaaagtattttatgtgattttcacaatctcttactaataaaaaatgttcattgaggcttgtcaatctgtacaaattagaaagaaaaaaaaattacaatgaaaaaaaccaaacatagatagataaaggtgaaaatttaatattatatttaagtttatactattaaaatgttaagaatacatcacatgacgtttttctatgcatagtaaaaaacgtaaaaacaaataaaaagacttagtaaactatttcaaaaacatcaatttttaacataaaaccggatgtagtccagactaattcctaatattctagtaagaattggtagttatttaaactagttaaaaaatttctcctataggataacgtcatgacaatttcgtttataataagtaagaataaggtttctttaaaataatatgtttacaattaatatatgtaagagatttgaaattgagagattaattccacaactattgtatacacatattattaatttctaaacatctaatgcgttagcttaaaaaatctcaaaacgtactacgttttgttacattaagtttgtatatttttctatttggttaattgaactattacattgaaagtttgaaactgtattaacctcatctttaaaaacaaatcttaataacacctaaattatccgaataacccgaattccacatcgacaaaaccccgccaattcatctggctaccgtaattggttgggccgaccctcagacttaggcccgttttaatattgaaatcttcaaacacgaaagagaactgttgaaaagtaaagtaacaacaggtcgcataagttaccaaaaacaattaagaaaaaagggttttttcgtttttgttaacttcgccgtgtagttgtggtggtgagattgtgagagatatg

SEQ ID NO: 1040 - DNA, 3000 bp, Unknown
  misc_feature (1)..( 3000): cDNA_ID_3060317_gDNA_ID_1620351_Annot_ID_154314 3000 nt of promoter + ATG
gtcctaaccagaggaggaagcacagcaagacttgtggctaagtacagaccaggaatgcctattctatccgtcgttgttcctgagatcaaaaccgacttctttgactggtcttgcagcgatgaatcccccgcgagacacagccttatcttccgtggtctgatcccagtgctctacgctggatccgcaagagcctcacacgatgaatcaacagaagaagctatcgagtttgctactcagtacgggaaagagaaagagctatgcaagactggagattccgttgttgctctactccgagtcggtaatgcttccgtgatcaagatcttgaccgtcaagtgatgattccactcaaaaattcacgtttttggcgtttggggaacgctactttaaacgttttattatgaaactattcaagattgtgattaaaatcttgagatagaaaactcaagttctattttttgcttattaccacaactactgtgaccggtgaatccacttaacagctccttttgggatattttggttgtattgaaacctattggatcattcatacacgtatcaattatcatgatttctttttgtttctcaagtatttcttatgtatacgccaatacaatggtgaaaatatgtttatgtttcatgttcttataatcttacaatgacagggacatgaaagacaaaaaagaagacagcgcatgaatcgtcccatacaaaaatcattccgacaaagactcatcattatctccatttttgtaaaattcccatcattatttgggattcatctgaaaatataattttcatatttaaaaacaaagataatggacacacataatttgatcatctctgtacaaaaacatgaaagattgaatcattgtatatatttcgtcattatttggactcgattgacagataatttcatacttgaaaactaaaacaatggaaactgaaatttgatcatctctgtacaccaacaatggatatttgtttttcaacagtctgagtgaaagaacatcatttctatgtacagtaaagcagagaatgaaatgcagaggaaataacaagttcaatagctagaaaaatgagagaacaacaaaagatgaagaacaataacaaaatccaagatgttttagtttttgattgttttgctctcagcgagaagaaccagaagatcttgagaagaaattgttctcaccagattgagatccagaggttgaagaagacgaagaagaagaagacgagaacaatccactaaacggccatggaaacgaaaaccgtctcccatttccactcctcacctcatcctctcttcctctatccgcatttcccacattctcaacaacgtttccgttactcgtttcccgaacatttcttgttctcagcactctctcggaatcagtcttagtctcatcatcatcatcagcactagaaggaagctcaaaacgacacacaggacaagaactatgaagctcaagccagggaacaatacaccgaacatgaaacttatgcttacaaggcatctctttagcttccgtacctttctcaaaatcatccaaacaaacagaacattgcaaaggttccattatcttaaccgttggtaaagcttcaacagcttctttacgagcaggtggagtcccttgcctattaggatcattctcagccaaatgctgaagcaaaagatctaaaccaggtccaatgaagtaatctccaagtgaagtcaatgaaggatgattctgattctgatccgaaggaacaactagcgattggttatacggattaatcattataactctatccctctctcgagaattatcccaattgttatcagagctttcatactcagaagcaatccctgcacgaatcccttgaagcaactgcaatatattccctgagcttcttcgtcttctcctcaagatagattcaaactctctatctaaatcaatctctccaccatgtctcctagctcgatgatgacgatacacgttattattactgttgttactatcattcccattcccatcagcattagtagtcaagtcatcaccattatcatcattctcttcaccaaactctgatcttctaaaccttcttcgtcttcgaggactactcatcattccaagcaagattggtgcccatagagacaatgcacggtctgttccaaaatcggtttctgaatcttgaacatctcttatgcctctgccaccacctccaccgccattaccgctcatttcttcgatgaatccgctttggcaaaagggacatttgatctcagattccattactggattcaccatttgtgaacacatgtgacaccaatacctagctgccattgtttcctccatgttccttacttcacccccacaaatctattgattctgcaaaacaagaagaacacacaatgaaaccctagaaattttgtttatcatctaccaatttggttttaaatttcagatctaagaccctcaaaggttataacttttatacaagtatcaatctaaatgggtagattttgtcattaataatccaaattaaatgattttgaccaatcaaattcagacaagaacatcttttgaaaaaggagaggaaaaagtcaagatttttacataaatttggataaaacccaaaaagaattaaacccagaaaaggagaaaaacatctgaagaacccagaatcttgtaaaagatcaaagagagaaaacaaaacccttaaaaaggaatcaaatttctagctttttgttttcttcctttgtcataaattttctcaaataaagaaacacaatacatgagacaaagataaacccagaaatttacatgcccacaacaaacataaaaatcatacctttaaaatgtctctactttttcttgaaaacccaagattttttttttaaaatctgtccttgcttctttcgattcctttatagaaaataaaacccagaaaaaggctcaatcttttttgtccaacgattagagaaaaaatggagaaggaagaagaaagaaagaggaaatg

SEQ ID NO: 1041 - DNA, 3000 bp, Unknown
  misc_feature (1)..( 3000): cDNA_ID_3060299_gDNA_ID_1620351_Annot_ID_154328 3000 nt of promoter + ATG
cagaattatccagtctcagttcatctatctttcgcaacatctcttgaaagctaacaccttcctttatctcgttgtggcttgagttcgaatccacgcaaggaaccaaatcatctccagcaaagatatctctttctttctttttctgatccttaatcgtcgcttgaggttttggttttctctttatgggaatttctaggggtttctaaattttccctgtttctttggaatctacaagttgtttcgttcccaatataatgtcagattgagaaattcgaatcaaacccatttcccaatttgttgtttttcattcaaagatcgaaactttgtgtttattgactgcattttcaaagatgtgtatttcaaaagaagacgaagaagatccatcaagaaatcgaaggaatcaatcaccattatcgcttcctcaaactctgaaacatttccaaaaagatttgcttgctggtgctgtaatgggaggtgttgttcacacgatcgtggcaccaatcgaaagagccaagcttttattgcagacacaagagagcaatatcgcaatcgttggagacgaaggtcacgcagggaagagaaggtttaaaggaatgtttgattttatcttccgtactgttagagaagaaggtgttttatctttatggagaggcaatggaagcagtgtgctccgttattatccttctgttgctcttaatttctctcttaaggatctatatagaagcattcttagaaacagtagctctcaagagaatcatatcttctctggtgcattagctaatttcatggctggttctgctgctggttgtactgctttgattgttgtttatccgcttgatatcgcgcatactcgtttagctgctgacattgggaagcctgaagctcgtcagttcagaggaatccatcatttcttgtcaacgattcataagaaagatggggttagaggaatctatagaggcttacctgcgtctctacatggtgtgattattcaccgtggcttatactttggagggtttgatacagttaaggagattttctcagaggatactaaacctgagttggcattgtggaagagatggggtttggctcaagctgtgactacatctgctggtttggcttcttacccgttggatacagttcgtagacggataatgatgcaatccgggatggagcatccgatgtaccgtagcacattggattgttggaagaagatatataggagtgaagggttggcttcgttttaccgtggagcactctctaatatgtttaggagcaccggttcggctgctatcttggttttttatgatgaagtgaagaggttcttgaattggggagggatctaagattaacaagctgagaggtaagccttgtctatccaaattagagacagaagaagaatgatttttcattttgttactacaccttaacatggacatatgtagagagaaagctttaggtgataatattcgttttaccgtattcagttttgaggatttggctgaaacactatgcatcttgattcttttctttttgttatagactttgtgtgtatgaggaaagaaaaaagaaggaatctattttgtaaataaaagacatggattggtctaagctcaagcattgcattcgtttttgataatttttgtcatcatcaatctaagttttcattatgtataagattacaaaggttcgaactttgatctactcttgttctgtggatacaagaaagtgggtctgtccaagacatagtacgatggtttagctttttaacccggataatgtggaatttatactcggttacacacgacgtagtcatcttatctctttctcattttcattgtgatctctttgttacatttttgaagttgggtgatttatgataggtgattgtatatgtaaagaagaaataaagcttcatgatttagtattcatctgccatgatgaatcagtgacaccaagtcaaatactctgcccattaccaatatctgaaagccacaaagattccatgtcttccctactttggcaatttattctgagtatctgaaacgaatcacttcaaaatttactcttttttacgcagtatcgaaatcttttggcaaatttatttgttcagaacttactactatgttgcttgtgtctactggtttggttggagagaaaacctaaggaggttgaaagctacttgatcagctaagtggtgatgtatttattagagaactctagacagctaaagacaatggctattatatctttgaaatcgactagtgataacgaggaactcaagatgttgcaagagctatcgtctacaccgaggatttctactaaatctcggctttccttcacgtgaagttccattgatcatctcagagatatagaactagtcgtttttattcttggagcatcatgagcagttatgttttcaaagggacttgtctaattctcatcacttctcacgacaccaatcttttttttttctttttttttttgtgtccaaagttattggtgtcattgccatcatgagaacatactttgttttcagaattgagatgaataattttttttatatataacattttagaattttaccgtatgggtgctgttgacgtgtgctgtaaaaagttgtacaactttgtcccaagtgcaaacggcgtcgtacgatcaaaacgttactttttcctttttttttttttttttcttttttgcttcatttagagttttcctttctgattaaaatttaggtggttaaaaaaaagaggacaaagttagaggttaaactttctcgttgattctcaatttttctttcgtatatatattctcctaagagtcgaagatggtttgatctggaacgagtgcatcgtcatcattgctagggtttggtttttgccttcttgcttgcgaaattgataccgaagatgcttttaacctttttaaatcttactctattatcggcaacaaaaaccactgaggcaaacttttgagattttgaaggattcgtttacaatg

SEQ ID NO: 1042 - DNA, 3000 bp, Unknown
  misc_feature (1)..( 3000): cDNA_ID_2045344_gDNA_ID_1620351_Annot_ID_154331 3000 nt of promoter + ATG
gatcaaagactttaaatttggatgtttctctcaaattcaaaatgtccattaatttaattgttttttttaggttgatatttggactaatctgatcaattcttgcttgccgccctgaaacgaaacattctatgcactcaacaagtcaacatgacgtcaattggttgaaacataatattatctttatctaggaaattctaagcttttgttcattattttcagtattattactattataacattgaccgttgacaatgcaagctgtaattctttctaaaagactcaatgttttatcataactcataatattataactttgttctcatagctaagtttagtagagttcaccgcctcaccggctaaggaaggggtcgaacaaatgagattgacagattgttaataattgaaaatatttgaaatgttttcttgatacatattctttggctggtattatgcaaaatccacggaaaatcttcatctttttaatccttaatatacgagaaaataaaccgtaagatgcaagttaagtttttcttcttacccggcaagaatgtcctttcttggtctacaattaacaaatctaaaatgatataattttttaaaagtaattggatatatacatcttttgtttattttctaattctagttttttttatatatcatggtatttttaaaataaacttatagctgaatttctttttatgctcaatcagtttatacatatatggatgggtatttggtcctctctttttttttggacaaagatttttagtcctaagtggcgttccgtgattcaaatgtaaagacatagtttcttttaccaaaagagtgtaagacagatattgtttagcaatatcttaaggagacttcttagtgagggaaaaaaatagaaaggataaaagaacaagtgggtgtggaatgatctatagcaacaactttacatcaacgaatcagagaaccttttttacttctctaacgtctaacctaaagaatttagaaatttgctattagtcgggaagaaaacaaacaacaaattttaagcttatttaacccaaaaactgagaaaagaaaaaggagaagaaatttcaagcctaacacctggagaatgagataaaaagggatccaagaaacaaactagtgggtgttgaattatatctcttgttgaagcaactttctaccacttattattacccgcacacgtttgatttattgtattcacacacattttaatttcgtgcatttgaatgagtaaacttaaatacaataatattactatatctgaataaaaaagaacctcctaacttcagcttcacttgttcaaaatattcaatcatattgtcttctttttttgacagcacatacaatcatactaacaataacatacaaaaattaagaaatactaaagagtaaatgtgcgtgatgactgatgacataaggaatacataaataagtcggactttaagtggaacattaatcttgaagattcttctgcgttttgtaatgttaggtatggtttttataggatatttacatataattatatccaagttgatgctcattgatccactaattttccgattctacggggtaatatatttttttttttgatgaacattgtttgtataaatcattataaccatacatacatgactaagatgaataaacattcataaatacgacaaataattataaaatttattatgacaaaaaatttcttataaaattttcaaaatatatatttttcctcacgtataagatttatacaataactaggtttccaaacttacatatttacaaaaataataattaatatacctctacttagagaaagaggaataattaaaaaaaaatttggaaagcctaatgcataaaaagtcttgctttaataatggattggatcctttttattctttgtttaaggaaaaataggttcgtcgacagctctacttgtgagtaatgactaatgagcacatccgtttttggagaaattagccgatataaaatattgagccactttctgagattatgcactaacatagtatcgattaaaatgaaatgtgaatgacgccaataatgagagaaatgtgaacacacaattttatcgataacaaaaaacaaacagaaaaagagcaataagaaagaattgagaaaggcaaaggcgcacgcttagacaaaaagaaagcaatcgagaaaaaggaaaaataaaaatagaaataacaagaaaaataaagagacttgtggtctgaaaatgcgtttcatacatgcgcactattaagcagaaaacaccaaaaaaacaaatcccaaaaatgaaaataaaaacaactttttttgggtagagagaatggttcttggtttaatttggatttgaattttgcatggttcaatatttcaattattaagttaatcaaattatattaaattttttttttatatacaataaccattcgactaccaaaatgaattgaccaatcgaaagggattagaattcggtttaaagcaatcggaaactaaaccagagagaattgtaacaagaccggaccggaccaaaacaaaacagaccagagtggactgatgtcttaatcgtttttgttctttattttctctgagaaagagtctctgttctgatttgtcagtggaaaaagagaaagagaagtgggacccatctccgccatagccaaagacctctttctctcccacctcatacctctctactctctgcccatcattgcccccgacgaaactctctctctctcgctctctctctaaaaagagaaacaaacatttctttagtgtctctctctttcatcatctctttaccttttgcttcttcgaaaaaaaaagagaaataaattctaagaagagaaattgagagcttggtttttctttattggcatgaatttgtaacttaccagagataataaagttagggttcttttttttcgttcttataaatatagtaatctttctatttttaagtgtgtgtgtgagtgttgtttgggaata

SEQ ID NO: 1043 - DNA, 3000 bp, Unknown
  misc_feature (1)..( 3000): cDNA_ID_2045336_gDNA_ID_1620351_Annot_ID_154333 3000 nt of promoter + ATG
ctatggatcaacataccgtccttaactgatttatttttcatttgctaatgtgaactggtgatgagctgagaaatttatggtacaaatgtttaaatcagttttagaatattttaggctttgtagccaaaggagaatgcagaacccttcttatttgttgtagccataaaaccccacataattggatagaggtctacaaaaggctctaatcgagttagatgaggtatcagaatatgttattatgtattaaccaatagaaaccagaataattaatagaggtctacaaaaggatcaaaattatcaaaaaaaaaaaaaaaaaaaatgttgtttaaggcttagatgaaatatttatggtaagtcaaattcatatcattttctaaagagaaaaccttaataatgtagctagctaggtccagtgtacacataagttgttccctgaattccttttaatgatttgatctcttttgtatttgtaaaattattttgagaatgtgatgttatataacatataccacataagatcaaattatttactttttcaacatgtacatataaaatgaagaggagcatgaggagtcatctggcgaagcaaacaagaagtgtgtgagagcaaagcgatcgactagcatcttttttgtttggaatctcatacggtgtgaccaataatggtatttcttgaatgtttccatgtaacatttttttcagttatatcactgtaacagtgtaattcctactgcaggcgttatattcacaggctatccggtaatcggaagccaagaccgtataatgtcgtctggtgcgtgtctagacagtcatcagaacggattgattacatcttgtccttgggatccacgcattaaaggcgagttcttttaccaaacagcattaagtgttcctctcacacatgtcaaagatttcatcaacgacattaaagcacttgtgaagattgaaccaaaatctctctgtggccttgaactcaactatggtgttctagtccgttatgtcacatcctctccggcttatctaaggaaagaagaaaaagctttagactttgacctaacttactacagaagcaaagatgatccttggacaccacgtctctacgaggattacatggaagagattgagcaaatggcgatattaaagtacaacgcgttgcctcattggggaaaaaataggaacctagcttttgatggtgccattaaaaagtacaagaacgcaaacacgtttttgaaagtcaaggagagattagatccgtgggggttgttttctacagaatggaccgatcagattctagggttaaaaggaaacgtgacgattgtgaagcaaggatgtgcaccggaagggctgtgtatttgttcggatgattctcattgtgctccgaacaaaggttatatgtgtcgaccaggtaaagtttacaaagaagctagggtttgtactcttgtaaccgcttaagatttatgagtgattctaaactgatgaaataaaaatcctacgaaattaattggtgccaatagcttcacgatgctactgcatcaaatacgattgatctaatttgaagtatatatacctaataataatttgtaacatgcagatatttttctccattaatattttaaaatctaatttaattggccaaatacgtgtttttgaaaacttatcgtagcaatattgaatttgaattattgatactactataagccatacaaactaggcaaagtaccaatcaacaataagatagaaaatagggggcggtcttcaatttttttttgttttaggcgtaattcaaattacttcatgtagacaacttagtcatgatgtctcaatgtctaatcatgccaccgggaactaggtaacctgcgaaaaaatcacaaacatatgaaatgtataatctataagataccacaacctaataactttaaacttatatactaatgaaatgaatgtattaaatttgcaaaccaaattacattgaccgaaaaaaaaaacaagagaattgggacttacttccgcattgtgagccaggagcaagtggacggccacaagcagccgcgacattgactagcttttgcatatcaatggcggcttcgatttccttattgatgacttcgcatacacattccatcccgatgattcggacaagagtgcaacaaccttgggatggtcttggcggagttggcagctccttgtcgatagaatctggacatcccctcagaacttcgatgcctgaatcattacatctctccccctgaatttgagatgatgacaacaacatcattacgactaaaaactgacaaaatatctgttctttcatttttctttatttttattcttctattgtcttctttcttttacgcattatatgtataaaagattgtacggtatattaagtacagaattgagaacacgatcacattttgcttattatggcagtagatcaatctagaatcctttgatataacatagtaagtagtaacaatattgactatatatatactgtatcagtatgagtgaaaattagataacgttattctttttttggtcaacaacaatataggtgaaaattagatacgttactttttatatataaaaaatatttgatctctttttggttaaaagatatttttccgtattttgaagacttagattaaatgtttacagtaagtcaaatctcatattttttatagagatcaagtcagtaagacagtaactatgtgatgtaatgacattccctacatgcccccaataatactgcaatgttttctatccacataagttgtcctctgaaatttcatttaatatattgttttttttttggggtcaaacaatttgatttaatttcttcttcgttatttggtaaaattacaggtcgctattaatatccttctaataaaagccatatggatcacatgatgttatgatatattgaaacttatcataaatacatagatgagtgaatgaatgcttcaaacattgtcaattattttcttgtaaagttacaaa

SEQ ID NO: 1044 - DNA, 3000 bp, Unknown
  misc_feature (1)..( 3000): cDNA_ID_2045332_gDNA_ID_1620351_Annot_ID_154334 3000 nt of promoter + ATG
taggtgaaaattagatacgttactttttatatataaaaaatatttgatctctttttggttaaaagatatttttccgtattttgaagacttagattaaatgtttacagtaagtcaaatctcatattttttatagagatcaagtcagtaagacagtaactatgtgatgtaatgacattccctacatgcccccaataatactgcaatgttttctatccacataagttgtcctctgaaatttcatttaatatattgttttttttttggggtcaaacaatttgatttaatttcttcttcgttatttggtaaaattacaggtcgctattaatatccttctaataaaagccatatggatcacatgatgttatgatatattgaaacttatcataaatacatagatgagtgaatgaatgcttcaaacattgtcaattattttcttgtaaagttacaaaatgtccttttggctaagtttgatcttttgctttttcacatttgcttcctcatctccaccggatgatcctgtcaactgtgaattcggaaacacaatgtgcacggtgacgaactcgtacggcgcctttcctgaccgctctatatgcaaagcagcaaaggtggagtacccaaggacggaggctgagctggtctctatagtggctgcagccactagagccggccaaaaaatgcgggtcgtgactaggtactctcacagcttccccaagctggtttgtactgatggtaaagacgggactctcataagcaccaagtttctaaaccatgtggtgaccaccaacccggaggccaagactttgacggttgagagcggcgtgactctaaggcaactgatcgaagaagcagctaagtttgatctggctttgccatacgcaccgtattggtggggacttacggttggaggaatgatggggacaggtgctcacggaagttctttatggggtaaaggaagtgcggttcatgattacgtgaccgagataagattggtgagtcccggtttggcttctgatgggtatgtaaaggttcaggttcttagcgagactatagatccggaggaatttcgcgcagccaaagtttctctaggtgttcttggtgttatctctcaagtaactttcgaattgcaaccaatgttcaaaagatcgttaaattatgttatgagaaacgattcggatttcggagatcaagcagtgagttttggcgaaagacacgagtttgcggatttcttatggttaccgagccaaggaaaagtggtgtatcgcatggatggccgagttccgcttaatacttcgggagatggcttgttcgaatttttcccattccgttcacaactctctttagtgttagccatagatagatccttaggtaaatctttatttctcaagataattaataccaatatttttgatttgcatagctataatgtttcttatatatatacttttgcttcatgtcatgcagaggagagtgaagagtcacttgaagatgcaaacatgaagtgtgtgagggcaaagctagtatcgtcgtctatgtttttaatgtcatacggtgtgactaataacggtatttcttttacttgcttatacatttgttgattgtttcgatataagattatacaaaactttcactagtaatttccatggacaggcctaatattcacaggctatccggtcatcggaatgcaaaaccatatgatgtcgtcaggttcatgtctagacagtcgtcaagacggactaatcacggcttgtccatgggatccacggataaaaggccaattctttcaccaaacaacattcagtgtttctctcacaaatgtcaaaagtttcatcaacgacatcaaagcacttgtgaagatcgaaccgaaatctttatgcgtacttgaaggcagcaacggtattctcatccgctatgtcacatcctctctagcatttctcggaaaagaagaaaaagctttagattttgacctaacttactacagaagcaaaaatgatccattggcaccgcgtctatacgaggattacattgaagaaatcgagcaaatggcgatattcaaatacaatgcgttaccacattgggggaagaataggaacctagcgtttgatggtgccattagaaaatacaagaacgcaaacgcgtttttaaaagtaaaagagaaatttgattctttaggattgttttccactgaatggactgatcagattctaggtttaaaaggaaacgtgacgattgtgaaacaaggatgtgcattggagggactatgtatttgttcagaggattctcattgtgctcctaccaaaggttatttatgtagaccaggtaaagtttatagagaagctagagtttgtactcgtgtaagttcctaaatcctaatcaaagttttggtcctcagttctgttatatatcaaaaacctcattcctctctctgctttaagagaacagagcagtctctgttcataattgacaagcgaaaacgacgttgtattgaattcgtgacacgtgtcaaacaatgagtagttaatcaaagtgtcactcgcacgtgaagagagtagagtaggtgggtttagggtttaagtgttccagattcttccaaattcagttgatccaacggctcagacttaacctgaaacctttgaagacgcgatcctcgaacttcaccagtccgtttgcactatgcaaccaaacacactttgtatcgaataaattaaacaaaaatcataactttacaatcgcataaatcgactttcatcttcttcacaagaaaacctctctcagtcgctaaaacccttgaaccatctcttgatcgctagcttctaagtaagtgtatagttgaatcatttcgatcaaagtttaggtaaaaagttgtttgctttcagatacccttgttttgatttgtgtcgatgattacaaagttttactttgatttgtgtctttagggtttattagattcattcaagctataaagttttgattttgatctgtttttgcagagagtgaaaaacc

SEQ ID NO: 1045 - DNA, 3000 bp, Unknown
  misc_feature (1)..( 3000): cDNA_ID_3060302_gDNA_ID_1620351_Annot_ID_154324 3000 nt of promoter + ATG
ccaaaatgtaccgctgatgatatcggattgtggattaaactcgcgctggaccgcaacatctgcgagctaataatcaaacattatcccgatcacggacacatcaggttatctaggagactatgcgacagcaaaaccctagtttccttaaaactcaagaacgcaattcttggagctatttggctcccaacatgtttcatttcactcaaaacgcttcaccttcgatatgtgaagtattccggggatgaatctgttcgtactctcatatcaagctgtccttcacttcgaaatcttgttgtgaaacgacacaatgaagacaacgtcaagagatttgctattattgtgcgttacttacagagcttgacggtttatttatcacctctacatggtgtagcagattcagatgcatatgtgataaatacacctaatttgaagtacttaaacattaaggatcattacactgatctatgctcttttgaagatatgccttacctagacgaggctaatctcgacgttgccttcacccatactgagaatttttttgaatctcttacctctgtcaagaaactttccttatgcttgaagaaatcaaatgtgagtctagtaacttaaaccctatcattgtttttaaaacaaattctcatgtacttagaaaagtttgtgtgtcatgtgcaggctcagtatcctgagggtattatcttctctcagcttgatcatttggagctatgtacatgtgatgattcaaagtggttgaatatactcgcaatgttgcttccagattctcctaaacttcgagttctcaagcttaacgataaggtaattagttttccagttcatggctcatcacttgatctgtagttttttttacttgatgatctaactaccgaccatgttttatgatctttttttctcagaaccatgatttcgttgacaagtactgctcttgtacttggaaccagcaaccaagttatgttccggaatgtttgactaaaagtcttgaaattttcgagtggcgaaactataaagcaacattcagagagagagacgttgcggtgtatatcttgaagaatagtacttgcttaaagaagacggttatctcccccaaattaaagatttcaggagagatttgtgatcatcatattatcagagaagacttggcatctttgttcatgggctcgagttcttgtgaacttaaattcgactgagaaataaacaggtagctttttgtttttgctttgggtttccttttcatcgtttaaacaatcaaagaagaatttttctgtactacactggaaaattaactatttcatgacatttgaatcaaaaaaagagagtagttttatcttgtatttgattaactattggacttatatcaaaaaaaacatttatgcggtatatttaatgaatttgtataaacggcgtatcttaaaaactagtaaataatatgaacaaattatttagctttttttctctatccggtttgttttccagtattatatcagtatgattgatctaatccaccatactttcatccatgtatcttagtaccatccccttcgggctaaagaaccgcgcccacgctggaatgaaccaagctcagtacctgaatgtattttatacagtcttgaaaccttcaaatgggtacactacgaaggaatggaagaagaaaaagaactagttggatttatcttcagaaacggtagcttgttaaagaaggcaactattattccccctaactctattgacagcgacacgaaacttgagatgctcatggagttgtctttgtcatcccggcgttcacccatctgtcagcttgaattcagctgaagtcttggtcaattatgatgcttattagccaagtaacattttgttgattggtttttggatctcaatctccataagctctattgaacttgttagagatgttctttctttccaatatttagttctctgaatttcatatgtttttacttggaaattgatcttccttatacatggtctgctctgttggtgattaaacaccttctgctccgagaagaggcttccaattagttacatgaatcatcgatgactcgatgtcaacgattatttatcttaacttcgtttctctttgcacattctctagacaaaaattaaatattgtaagattcttaattatacttacggtgtatttggactaatctattgatttggaggatatggatcaaaattctaatctattgattgttttatcttcttgctatgcgtctctgcttgctggaagaagaaaacataaagatatatcttctctttgttactcttttattatatcttctattaggaagaggttctttgatctctatggatatctattaaacaggaattgctctatttttggtgatttacacactttttgttgcaggagtgggtgtagtttcttttggtctgatattggttcagtttaaaaatttggtaaatctttttttttttgacatcggtttaattgggttatcttggttcagaaattagaaaggaaaccgtgacttttttgttgcgttgcggttagaaattaaatatcgaataaccctagttgatattaatgtgaaaaatcacgctctgatcggtaattaatgatatccagtggttttacaagtcaacttcaacaacaaaacacatatttacttgagattttttaaattgtttttggtgagtgatagagttaagatttatcttatgtactgtattagacagtggatttaatatttaattagggttaatttagtaattaatacagtatttagctaaatctccctttttatatttatcattattttatgaattaaaagagaggttctcggtgcttattattcggaggagttagtttggattttgtttctatatatctcgctaggttttcgcttatgactatttgtttggttcctaagaatctcatatcccttgttcgtcttttttgatgttttcaggcatttggatttctccagatgcagaaatctcttaattatg

SEQ ID NO: 1046 - DNA, 3000 bp, Unknown
  misc_feature (1)..( 3000): cDNA_ID_1020019_gDNA_ID_1620351_Annot_ID_154316 3000 nt of promoter + ATG
aacttccgtgatgagaataactctttctttttgagacttgtctattgcattttttcaataactctaccccttctgagttatatctcggagattattgaattcctgactttttcctaacgttagagtactctacattctatcgataggaggattttgtaaccgagaagaaggaagagttgtcaaaggaagagttggggcgtcttgttgcctctcgttggacaggagagaaatctgataagccaactgaggcagacgatatccccaaagctgatgatcaggaaaaccatgagcacacgcccatcactgcacatgaagcagatgaagatgatggatttgtttcagatggtgatgaggataccagcgatgatgggaaatacagcgaccatgaacctgaagatgattcctatgaagaggagtatcgccatgattctagttcttcatacaaatctgatgcagatgatgatgtcgatttttcaggtctgcactatttccacagatgtttatattcttgaacgatgttaatcatctatcatatttagttgacttgattgaatttcattactgatagagacaacctcaaatcctacttggttggagaagatacaaaagactgtcaagaacattttgctggctgtgaatttattccaaaccaccccagtggacaaatcaggtaaaaaaatagtttagcattttcatcagtagtattagtgatactcgtattctttagtgattcatctatattgttgtggaatgtgcagaggctgatcgggtacgcaaagaatacgacgagtcaagctccaaactgaataaaatacagtcaaggatatcgagcttagaaaagaagctaaaacaagactttggtctgtatgataagacatcctaagccttcacttacgtttacctttctttaagttagtccttatatattgtttataacaggaccagagaaagagttctattcattccatggtcgttgttttgagagcaaacagggcaagtaagaataatcttagcaatttaatgtcacatccattctttattaacattactatcagctattagaattatatatctgatgcatttactgttattacctaaataatgctgtaggtatacttacaaagtctgcgcatataaagaagcaacacaagaggagggctattcgaaaactcggttagggtaagtgtcatgccactttatcttttctgtgcatgctgatctctttcatgatacagataactaataacaaggaattggttcgcagatgataattaaatatgagtgattattttatctgtgcttattttgtcgcttccttattttgtttaatggaatttgctaaaatagggagtgggacaaatttgagaactcttaccaattcatgtcatataccaacggagaaaaatgctggaatggtcccgatagaagcctgaaggtagtgtctgattacattaaatccaaactaattgttcaattaatattttctccaattatatttatataaaaaaaattatctgagaagatttttgcgcttgcaaagatcacagagatatacaaagcttgactgtctcactaaatgcaggtgaaactaagatgtgggttgaaaaatgagcttatggatgtcgatgaaccaagccgttgcgagtaagttcttatcgtaacctacatctcacgggtcatcatctccttttatctccagtttttctttttatatccttaaatttttactctcttgttgcagatatgcggccatcttatctactccagctcggtgtttggaagacaaacttaaagtaagtttttgtgtcatctcaaatctcaaaacagacctacactagttaacacttccttaacctggtgtttgtctttgtataggaactacaacagaagctcgagaagttgatgaaccaagacaaacctcagaatcacgacgaactctgatcattttcacctgaaataattcttaccatatgcgcactgcgcttagatttatgtcagtttagactagtaatcttgctcagtcgcaaacgtcaagagaggacttaaaaaaagaacagagaagttttgggccggaagagaatgaatgatagagtcaagtttacctcatttgggttcaatggagattttctatatcaaaagtatttagacaatgttcaaactctggttaagcacaaagaacaattcttctatataaaaacatgaagaagagctaaaaccttttaacttttttggagtcttaaaatttattcgagattgttggagctcgtcaatattaaggtacatatgtcagttatcaaacatctccaagttcacttttaggtcagaaaatggttttaatgtctaaacaagtggtaggtttggtttggttcagttttaatgctttcttttacagattccattaccaatagagacaaactagaacacaatatttccggaaataaattactgcagttcaacacttaacaccatgaaagaagacaaagaacaaagatcaacttcagaaattagtttaaacactattgccaaaatgccaaaatacaattaataccattttttaatcaacataaacacttaaatgagatatcattataagatattttatatttggaaaaaaacgtggcccgacaatagatcgagaagacataaaaaggtaaacgaaaacgaatattaataaacaatgtgcgtcactccttaattattcaaagaaaattaaaccggtgtgaaccaatcagtaaacatatggtcttttgttgaccaaatctaaaccaataaccttcaatttcatttctcattttttacctcaaaagtcaaaaaaaactctagaagaagactcttaactcataaatctctcattctttctcagattctctctctctgttttccttgttctccaagccagatctctctccataaatctctcttcatctctctctttccaccaaacatccgcgatcctcgattctcaattccgtgtctgttttttttcttcacttagcgatg

SEQ ID NO: 1047 - DNA, 3000 bp, Unknown
  misc_feature (1)..( 3000): cDNA_ID_2129800_gDNA_ID_1620352_Annot_ID_154345 3000 nt of promoter + ATG
gaatttgctaacttgggttttccataaactctcaaatgtttgattttgataaactcttaaatgtttgattttgcaaggaaagaaaaaaaagtaataatgagaagagaaagagagagagagcgaaaagaagaagcgacgaagaagaaggaaaaaaaaggaacgtggagagatgaaactttttttttaattataattttttaattttcaggggcaaattggtcaaaagtttaatgaaaaagttggaaaagtgcctcatccctgacaagtggctcaaaaggaataaaattctctaaaagtgcctaaacgtgtcacattccctattatactccctatgattttttaaaaattaattttctagaaaaaacatacatattaaaatatatattaaaaggtgattatatatatatatataagttttgtgatttacatttcaataattcgaagccaatgattttcaattatttttcttgaagtttacaatttatctatgataactaataaatattgcatagaaaatctaaaagaatcaaattttttaaaacaaatattttttttagaaaaccaattaattaagaacagacggagtaatgtattctttaaagtgtttaaagagaatattatttcttaaagaatgttaaattgttagaaaacttatctttgtgggacgaagaaaatattattttcttttaaaaaaagttttgtattgttaaatctaaacatatacatcaaactttaaaaatcaaagcaaaaaaagaatatctctccttttgcatgcttttgacatattgaatttaatagctaattttcttaattaagatgttaaacttatggattcatgatttgaacaaaactgaaaaaaagtatatggaagcgttggtgagattcatacctatcaaaatgaacaaaaggatcaccaaccgaatagtaaaaccaactactgtattttttcttcttctttcttaatttctctctttattaaaaatttgttaattatatcataatcttaactgttgtatataaagtatttcttcctaaaatatacaaggtgtacgcaacaaatgccaataaaaatggtttcaaattaaaaagaaagaccaaaactcatatgaacctcaaaaacatagtatgctacttttagttaaaataaactttctcatttcaagttctattttttttgtcattcgcttagttattaatgctcaaaaagccatttctgaggattgttatttacataagtgacatgaagcatcacacgatctaaaagctgttagaaccacatacgaaggcaaacacaatcactatgtactaaccgcaaggtataacaacaacaacaacaaccatgacatgtcagactagttgtaccgctaacacaatcagcctcaacttaggtgttgaaatcgcatcggacacccttgaccatacatcaaacgagcatccacatccacatctgcatccgcatccgcattcacatcgtgttcgttctgaacttaaaccagtggaacgctggattcaagtttattcatggaccacccatgggaacctgctatctaagtagcactaatgccggtataatcatcaatataacggttcgagagaaacgatcgaggctcaaacagatgacatctcttcctgttatccgtatatatccacataacatagcaagaatacaatatggtctctagaggaggatggtctgcacaaaccaaccacagtaacacaataaagaaaaagaaaaacaaaggctctatacttgcattatttatcttgattcttcctaggttaggaatggaataacattgttctttgtaatctatgatctatatgtatgtatgtatgtatgtatatcatgacacactaagatagagatattggtcttaatctcccaacatatttatttgttttttattaattcgaaaatgttttgtaaaaaaaaaacacaaagctttatatgtttccaagaaaatctgattgcagagatcatcaacatcagcctgtaaagaatcttctccatgactgccatggaagaaacccacctgcaaataaaacagaaacaaacactaaagtatacttttacattttcaaaatgtaaaagaaagatatagagagaaatcgaagttaccacattcaggacaacgaaaatactttttgtctcgagaaacaagtcctgttcctccacattcttcacatctcttctgtgcaatctgaaaccaaaactcatttttcaatagacaacacaaccaaataattaatgtatgtgtgtaataatacatactattcttttgctgaattcaacacctgcaacaacgaatggtatgattccagctgcaagatcaattgatttattataagcttataagaaaaacacattttttaatcacatcactaattagctaattaattaaattaccaatggttccaactataatctgccacgtaatctccgatttgcctgtctccgccaccgtgtcagctagttcacttagagccgacgtcgttttgagccgtcgattactcatcgtcatcatgccgccgccgccgccgcggcttcttcttcttcccggagaaacgaaaccagccgtggattttatctgacgtggtcttgatctaacggtccacagagacggaactctacacagtgaagaagcctccattgtcgccattatgactcaagaaatcaaattcaccgatgaaaatatgttaaaaaaattgggccacgtcgacgttatttcgggtcgggttcgcgccaaccgcaaataccatcgtgtggctttaaaaaagctgccaatcaaaaatatattctaaaatacattaaaacgacggcgtgtaatcggaaaacagtaaacgccattagagtcttgtgtgtgttaataatgaatctcaaaacaaaacttttttgtttgtttgttttggaattagggttttagggtatattcgcaatcactctaatcggataattcctctactctgttaacattatcttcttcttcgttcctaccgcaa

SEQ ID NO: 1048 - DNA, 3000 bp, Unknown
  misc_feature (1)..( 3000): cDNA_ID_2129868_gDNA_ID_1620352_Annot_ID_154366 3000 nt of promoter + ATG
atcatgtggagcagagtaagccaaaaatatgttattgcgtttctcttatactgtgaccccttgtgattgagagctgtcataatctatccgtatattggaccataaatggtaacaacctttcttgaaatttcgaaggtacctgcgtgatttcgaggtggaaactattggattaaaggagacatcaagaaagtgttctgttgaaaagtgtggagctaaacttaaagatacggtcttggattgggaggtaacacgaaagcgttgcctttgaatcagagtccaccagttttacctttttatgtagttaaagaatttaagaaactgaattatgaaactttctttatatgactcttatgctgcaggatgctttgcctccaaaagaaattgatcctgcggagaagcactgcaaaaaggctgatcttgtactctgtttgggtaccaggtaattaatgactcataggaactctcatgtttgtttccttaacacttttgatcagttagccaaacaactctcttctctagagtatgttgcattttgtttgttatatgtgtctaacctctttatgcagtttgcagataacccctgcttgcaatttgcctctcaagtgtctcaaaggtggaggcaagatcgtcatagttaatcttcaggtaattgtttattttgttcatgtgcacgagatttaatgcgcgccatatatgtaaatgaaattttctccgtttgctgatattttctctggaatgtatatggcagaatgagttttctggactgtgtagtttgtgactgattatatttaccctttcagaaaacaccgaaagacaagaaagcaaatgtagtgattcatggtcttgttgataaggtaagatttacgttttgttgttttcaaaaattctggacataacctaagtgatgtttaacagattaccttcagcactgtgccccaacttgagtcttatagattttttcccttcattattctgatgtgcaggtggttgcaggggtcatggaatcgctcaacatgaagattcctccatatgtcagaattgatcttttccagataatcctaactcaatctataagcggaggtagcttttcctgaatctttcatggtttttgtgcaacatatatgtcttgtcctgcactgtaattgggtgtgtcaaactttttattaatgatgttaggcttcatagctctcactcacatgtttttcatttctgttacagatcagaggtttattaattggaccctgcgtgttgcgagtgttcatggattgacttctcagttaccattcatcaagtctattgaggtaatctctagaaactactaaaccaatgccaaaacaatcaaattcaatttttctgatatttttcatttgcaatacaggtttctttctcagataaccataattacaaagacgcagttctcgataagcagccttttcttatgaaaaggtaaaactaacctcttcttagaaatcagtttcttgtcctatttctaactcttatatatattctcatcctctttcaggagaacagcacgaaacgaaacttttgatatattctttaaagttaactacagtgacggttgtgactgtgtctccactcaacttagcctcccatttgaattcaaggtttattacgatccataaaagatctttgttatcttgactcatgaccatttttctcacaacattttcaaataacctgtgtagatttcaacagaagagcatgtagagattattgacaaggaggctgtgctacaaagcctgagagagaaagcggtagaagaatccagttgcgggcaaagcggtgtggttgagagaagagtggtttctgaaccgagaagtgaggctgttgtgtatgctacggtgactagtctcaggacttaccatagtcaacaatctctgcttgctaatggagacctgaaatggaagctggaaggttctggaacatcccgtaaacgctctagaaccgggaagcgaaaatcgaaggctctggcagaagaaaccaaggcataggaagaagaaaagaaagcttttggtgtatataaagaaacactagtctaaccggaataggtaatatggaagttattggcgttttgagagctgagtgaattttgtttttggtccacattcggttctcttgaaacaaaagttaaccaggaattgaaagagataatcttggttcgttgtcgtttagtatcggttgatttttgtagaagctagtgcattcgaaatattattaaaaaaaatttacaagatgatcaagcgatgccagaatctgtcgactggtaggaatctcggatttgaaaaatacataaaacgacatgctctcaataatccagtactgttgctattttagctttaaaaacctagtggtgaacaattaataatgatcaagaaaagatgttatagtacataatttagatatacattgtactgttctattttaatataatatgcaaataatgtaaaacaaatcaacgaaagttagctgtacttatatgacatcgtcagttagaattctttttttttttttatgtttttttattgaataaaaggataattatgtttttcattttcaagggattattttttccaagtggcaattaatatttcaagtgggaacatgtgtcaagcgaaactttttttttttttttcacaatattgattgcaacttttttgtttgacaacttttaactgttaggaattaaggaataaataaaagattcaaaaaaaatttcgttttttgtttgacatcaagagatggtctcctctcaaatgaaagtaaaatagaaatctatattcatgaaaaagattggacagctattcaaaatcaataatgaacgacttgtttttttttctattaacaaagaatagaaaaagaccaagcttagctacagctgtattacgcaagttttatatgaaatgaccggctaacatatatatgcaaggggaagaggagaatacaaatatcacaaaaatccaaatttcctttgtagcaacc

SEQ ID NO: 1049 - DNA, 3000 bp, Unknown
  misc_feature (1)..( 3000): cDNA_ID_2129864_gDNA_ID_1620352_Annot_ID_154365 3000 nt of promoter + ATG
atctcaccgttcttacaaagagacgaaacgcgatgaaagtaagatgtggaagaaggagaatgagcttgttcatcgtggtgtttagaagaaggtttcgatgatactgaaaatggaactttattcgggatagtgttgaaaggaagagaagccattcatgcctctctgataaacgtctctgaagataaaacagagttctttcgaatcctcgtatttaaattattttatttattatctcctcgacttcttttcgtaaaatgttctccaccgttgattcttgtggcaaatacagacacgtgtacggttttcatctgttactcgatacatatttgtaccgatcgcgattcgtatgtgtaccaaccggttttcgatttgatctcggtttagttgaattataacgttgaaaaatatataattcatttattagaatatacttcaaaagtaacgacaaaaaaaaaatacttcaaaagtatataaacaaaaaatttgagataataacagaagaagaaggtgacattttttataggcttttaatatttatctgaaacctatgtatgacctaaaagacaataaaagcattagctaacacaagcatcaaaacatatacgggaatggaagaggaatagtaagccatcgctgaaccggttgtaccgccttcggctcctcctcctcctcctccttggccgccaccgccttgtccccctccgccaatagtaccgtaaggataaggaggagtataaaaataaggatacggaggagaatacatcgtcgaaggtggtggacctggtggttggttgcaacagcctgtcgtcggaacaggagggcagcgagaacgtggcggtgaagactgtgaaggcggtgggggtggtgaatactgtggagacggtggaggagggttaccatatggagagtagcctgtagaggacggtggttgaggcggttggttacatgggtaaggagtgcaaaaaccagcgtttgaatccaaagctgagtttagattgacacagtttaaaagtgatagataaaaggtaataagaggaacagagagagaagcttgaagagacaacatgatgatgacttagagaaaatgatgagtgtttggtctttggttttgagatttataataaaaagagatgaattttttcctcggtttcgtattatctgccgcatggcattacacatgtcgggggtgttggaggatttctgaagaaaacgtttgtgtcttttagctgatgtagacaaatttttgtcatgtaatgacaaattaaaacgcatttgtattactttggaatatatagatatataccgatcggtaccattttcatcaatagatgtcccaaagaagatggattatgagtaacatgagttttaagataattgtgacaagtcgaatgaatcttttgctatgggaaagatgaagaactatgaattgtttcaagtaatcaaataatcaaattttacgttgaagacggggtttacacgatggataatatgtggctccaactaagctgttgcatgctcccgagttgcaattacattcaatcgctctggcccatgtagtgaaggctgacaagagcaaccagaaaaaagttgatgagggtcatttgttagtaaggtgctagccttcacaataaactgcttaattatgataactttaaccctcgctttgaaattaccatcgatgatggctttttggacaagtttggaaaaagtatccaccaaactcatgatttgcttgtgcattcatggtgctgggtgagtttgttttgactagtctgttgtaggattcaactacttttcaaatgatgcacaagctagtgttgaggtgtgactacactttcggacagtattgtatccgaggaaatattaattctgatggtgtgggttgtggtcttgtcgagagtggaatgaggactaacataacccatatttaagtctgcatgctgcatgttttttattaaaaaactgtgtgaggtatgttaatcttgataaataaattgatgatatataacaatacttatttatgaaacttagatatgttataagtttattcaccaaactgaattcaaaatggctttgagtgatgagtttcaaaccggttcgatagaacaagattttaatctaatataagctcatggttgagcatgcaccagaacgtcacatagaatcaatttaaatccatagtaaaccctgtcatatggtttagtattttacaaattacaacccactttatcaaatggtttcaatattcaatgtgttgacatttacctatatattttaaataataacaagacgataaatttacttatttaataactcattgtattggtttaaccaattagatgaatgttgtttacaatgattcaaggataccgaaaccgagttcaagttttgttataagatgatctacaaccgtgagcttgacacaaatattatcagtctaattctgggactaaagagattatggatcacatattcataatttcatgattacataaaaaaagtaaaaataaataaatgatatatagataaaaattggtgaaatgtattaaaagttgcaatgatatcacccacttaatttagctatgatattttaggttaatgtaattaatgtttttcttatatcaaatttttgtttagccaaactaaacaaatttgagaaatataataacatgccataaaataagttttatatgaatccaattaataccctaatttggattttcatttaaatatcacaaactttaggtttatcagggaaacataataaagaaatgttatataaaaatttagcaacacttttaaaatctaaaatctctgatattctgagaaatgtcaaaaaaaatattccagattgcatataataataaaatcataataaaaagaattaaaatatattgatacttcataaatagaagtcactgtccaagtctctgcttttttatacatcgagaggcagagaaggtgttcttcttcttgtccaaaagagaagacaaaacctaa

SEQ ID NO: 1050 - DNA, 3000 bp, Unknown
  misc_feature (1)..( 3000): cDNA_ID_2129894_gDNA_ID_1620352_Annot_ID_154372 3000 nt of promoter + ATG
attttccccctattttgatattccggctctgtgagatgtaattttctatttcgtttattattttttaaaattttatgtaagatgtaattttctttttttctctttggtttttttgttaattttttttctgaacttacgtattatgttttttttttttttaatgttcttgcatttttaagccacaatcaaatatgcagaacacaagtaaaaaaaaatgcagagagttcacttctagatgtccctagctttgtctgaaacccagctataaacaatgtccatccccctgaatcctcaaaaacaagtcatgggtatttcatgactagtccccagctcattcttatcgaaacagagaagttagactttgacgctgattttgaaaactttcaaatatattatatagaagtaatccatcatcagtttcacatttctctcgcctcttttgtgtttttttttcttcacatttgttgtacatatgaatatgatacaaagagttgataaataagaaccttaaaatacagagactcaacaaatatatctgatctgtttatcacaccattatttgatgagttgtgttgtaatatttgatctgatgaagtataataatcctctcagcgtttgtcatgtgagctcagtgtatagttgatgttgtctgatataatctattactccatcttcagtcaagtatttaaccgataaccctcgcgaaatgcattgcctgaaagaagcagaggaatgagcaagagaaatcattttttagtgtatatgaactgttctcgggaaggataaataaatctcacactaccttaatctactcgaactgatttgattaggaacagtattgtcaacgattttgacgttagcctgcgaaagaaatcgagggggcactattcagtaaaccatgtgcacaatcacggactgatacagcagagtcagaacagaaacctggtaatacttacacagttttcgtttaagatttcgtcaccagagatcatattttcaacatcttgtccttctctacggatgcacacaatgccataatctttgcaaatagttcttaacttcaaaaaccaagtgttgaaaaaggagcataactgtgagtaaatttgataaacacatctacgtttatataacaatgctaccttggtttacctgttcagggatccaaacaccgggagtgcagaaagatagcagtaaatccgagccacatagtagcatgactttgagagattctagcattagaataaatttgtgtttgtcatttgcgtagtggctagcacgtatgataaaaacatagcaagcaacactattcagacgacccagcaattactcccaaaatgtaagtgagataaactttgaatagaaagatgctaaaggcgacacaggacacttcttgcagttatcttaccctcgggtacatgtcgatttgttgttaagaaagtcttgacccttgataaaaccgtcaaagttcgttggtagttgctttgagatgcctgtagaaacagcttccacatttttgtaaacaacgcattgttccactaaagagaactgattaaaagcttttcgaggaataagaaagtacctcccacggatcaaccattacaaagtcagagctttgacatgatacattacacatctctaaacgatgttctgcagataaaaggccctacacataatctgatgaaattattagttctaagggaaactaaacagaatagtaaacagaagaactttgggagctaaaaaagaaaaagaagctcttagtttcatcacacataacatgtccattagcataggttcagaaaaaaaagagtcattatggaaagaaactaagattctcaagatgacaaataccttcttcttatatgcatcattaacaggagacatatatcctccaagaacatgaaatccttttgagcgtaattcatctctcgccagctctagcgacaaaaaaaaggaagagaacttatcagtttgatgtaaagaaacatatacatttgaacaaaaggtcacagcaatggacaagaatcaacaattgaaacctctaagttctgcagttcattcttgtcatatgccggttttataaaccaaaatatacaaagctaacacaatcatatactcaagaaacggtttcactcaagaagtaaacaacaaggcatataatcttaagctacttttgactataaaccagtattggattttcccattgaaacgagtcaaaacactgatcattatgcctcaaattgtgaaaactttcggattgatagaatctgaaacgccattgataaacatataaaaaaatgaattatatatctactctggtaaaagaactgaccaaacatgcgtaaatgcatgaaagtaggaggattgaaactcccagttgccacaagcactacacaagttttgtccctgtttcagacaaacaatcgaaaatattcaacacccggacggaattttaataataaacctggtgagaatctcatcatcataagtaaccaagcagatcaaatttacaaaatcagaattttcacaaaaaagacaaatgaagggaatcaaaatcgagaataagcttcaaaatttactcagtgtttgatccataagataatttctcgactggtaacgggacatccattgaactctgatgattgaatctcagtctcttaatggtagctccggcgaatgatcagggacagcgaaaataagacgacgacggcgaaagtattaaaagatagagagaaacgacatcgtatgaaaaaggtttgttaaaacgaaacgttttacagctaacgagaagatagatattagacacaatacgaagccgtttaaaactaaacgcatcgttcaggtagcgagggttaaaaaagctaaaaaagcttcattctatttttttcagtgaaaaacgaaagcgaaaatgaaatctttatccccaaaattttgaaattcaaatccgcgctaacagtctctctctctctctcgctctatctctagagtaggtcgtcggcg

SEQ ID NO: 1051 - DNA, 3000 bp, Unknown
  misc_feature (1)..( 3000): cDNA_ID_2129887_gDNA_ID_1620352_Annot_ID_154370 3000 nt of promoter + ATG
gctttttgacgcttttgcactactacgaagctccaaagctttttgacgtgaccttgatctctgcatcttagcaagtgataatccagggtcaatgcaagtgtctggttcaatttcctcttgacaataaccaagagatgaagatttccgcttacaaccagtagttgagacacatttgggaaccttttccccttggctacatccaggagatgtagcatcaagattagtttcaactctctgattcttggagtgttcgggagatgaacaactttgattctctctgcaatcgattgagacactttctggcaatctctctttctcatgtacatctctaggagatgcaatattaacatcctgctcatgagaatgattcgaaacttgtctgactaagttgtgtgagaggttgtgttgcggttcctcttcaagcaactgctcttctagcgggttatttaccacagaggtcaggtcttgtcttactacattgtcagctagaaacctgacaggccgttggtatgaaaagggacgactgctaggacaaacgatggaaggtcttgatgaaggaaatagaagttctgatataatctcctccttatttaactctgtatacatataaacaaacatcacaataagaatcgcaaacagaaactcttctattcaatcgtaactgaaacagatatacacgcaatgtacgttaatactagccttaacaaaatgctccttaacttatcacagaaaaatcaacatcaaagtgtgattatgaaccctaacaccatttctaatctttcaattccatcttctcacagtaattcgacatcaaatttatggtaatacgctttataaactttcaatccatttcccgtttaagtatcaaacaacttcgcagcatcattactcaatagccactaagactactaatcaattttgctctaattagccaaacaaatctacatttaccatcacggacaagaaattgagcactaaaaatcagatttaacaactaccggaagtttgggaaggtagagacggagaccagagccacgacggaggagatactccggcgagtaggcatttggaagctaaatgctggtcatagagatctacttgttgctgaacctgctcgacgattcgcctcttcctctcaaagatctgaacgaaaagattctcaatcttcacattcgccgtcttccccctcggattctccttgacggaaaacatcgccgacgacctactctagagatagagcgagagagagagagagactgttagcgcggatttgaatttcaaaattttggggataaagatttcattttcgctttcgtttttcactgaaaaaaatagaatgaagcttttttagcttttttaaccctcgctacctgaacgatgcgtttagttttaaacggcttcgtattgtgtctaatatctatcttctcgttagctgtaaaacgtttcgttttaacaaacctttttcatacgatgtcgtttctctctatcttttaatactttcgccgtcgtcgtcttattttcgctgtccctgatcattcgccggagctaccattaagagactgagattcaatcatcagagttcaatggatgtcccgttaccagtcgagaaattatcttatggatcaaacactgagtaaattttgaagcttattctcgattttgattcccttcatttgtcttttttgtgaaaattctgattttgtaaatttgatctgcttggttacttatgatgatgagattctcaccaggtttattattaaaattccgtccgggtgttgaatattttcgattgtttgtctgaaacagggacaaaacttgtgtagtgcttgtggcaactgggagtttcaatcctcctactttcatgcatttacgcatgtttggtcagttcttttaccagagtagatatataattcatttttttatatgtttatcaatggcgtttcagattctatcaatccgaaagttttcacaatttgaggcataatgatcagtgttttgactcgtttcaatgggaaaatccaatactggtttatagtcaaaagtagcttaagattatatgccttgttgtttacttcttgagtgaaaccgtttcttgagtatatgattgtgttagctttgtatattttggtttataaaaccggcatatgacaagaatgaactgcagaacttagaggtttcaattgttgattcttgtccattgctgtgaccttttgttcaaatgtatatgtttctttacatcaaactgataagttctcttccttttttttgtcgctagagctggcgagagatgaattacgctcaaaaggatttcatgttcttggaggatatatgtctcctgttaatgatgcatataagaagaaggtatttgtcatcttgagaatcttagtttctttccataatgactcttttttttctgaacctatgctaatggacatgttatgtgtgatgaaactaagagcttctttttcttttttagctcccaaagttcttctgtttactattctgtttagtttcccttagaactaataatttcatcagattatgtgtagggccttttatctgcagaacatcgtttagagatgtgtaatgtatcatgtcaaagctctgactttgtaatggttgatccgtgggaggtactttcttattcctcgaaaagcttttaatcagttctctttagtggaacaatgcgttgtttacaaaaatgtggaagctgtttctacaggcatctcaaagcaactaccaacgaactttgacggttttatcaagggtcaagactttcttaacaacaaatcgacatgtacccgagggtaagataactgcaagaagtgtcctgtgtcgcctttagcatctttctattcaaagtttatctcacttacattttgggagtaattgctgggtcgtctgaatagtgttgcttgctatgtttttatcatacgtgctagccactacgcaaatgacaaacacaaatttattctaatgctagaatctctcaaagtcatg

SEQ ID NO: 1052 - DNA, 3000 bp, Unknown
  misc_feature (1)..( 3000): cDNA_ID_2129881_gDNA_ID_1620352_Annot_ID_154369 3000 nt of promoter + ATG
tttgtttttttttttttttttagtttcagttgtgagatgtaactctttcatatgtgacttttattttcatttccttgaattttttagccacaagatcaattaagttacaataaaggaaaatcattgtcagttggctttataatattatagcttttacaagaaacaaatattatatcgcaaaattcagcaaaggagataatttaatgaaatttctctgttggagttttgatccttgaattgctattggaattcttgattgctctctccatctcctttgagttatctttgtcttcctatgttttttttggatgatttgacaaagccgtctagtcccaacattcaatttacatagcaaggtttcgattttttcaaaggacatgcaccaccaagccaagaggagagagaactaaaattcttaccgatcacatcacactccatcttgatctgaacaacacgcaatgcctaagattaaaatcacatttcgttacctgaatttccgggaatttctataaaaaaataaatatcgaagagagttcacttactagaaaatataaataatgctttgttcctctaaagagatctctttcatgactagtccacatagctcattttcatcaaaacagagatctctaagcaagtgtaatcaggtgtcttgcttgactaataagcatcgatcgtctccgagtctaatctctttgtccctttgactgttccttttacccattcatatcctcactacgtgttcatatctgcctcttccccacccaaccttcattttttaattaattgtttttcaaattttacgtactttacaaaactaactctttaccaaatcaagataatttaataataacttgaaattgattggagtgggggatagagaaagatatagacacatctgtaataagagagaccatgtgttgttacttgtttttgttgcagttgagtactgacccataactgcaaagtttgttgtccaaacaaatactattattttctaattaaaatatataataaatttaatacattgatatatatataaatatgtatatgtatatatatattttttgttcatgttgaatttaatacagtaaaaggttaattatatgttttccaagtggtacttctttactcttttttttaattggcaataaatcttttcaagtgggagtatattttaaatttttttttttttttcacaatactgattgcaacttttttgtttgacaagttgttaactgttaggaatctcggaattgaagtcatgacatgttctcgttcccagatgggatcggaaaggcttgttccaatcgagagagtgcatttttgaataaaactatataatctgtaatgaaaacaagatccggaagagacggtctcctctataatcaaaataaaatataaaacgattgtaaagctattccaaatcaattacaaacgactttttttacaacaaagaatataaaaagaccaagtttagctgtattctctagttttatattaaatgaccagctaatatatatgtgcaattttttaaagagaaaaaataaatatatatatatatatatgtgtgcaatgggtgagatgaaagggaagaagaatatcactatcaaaaaaaaaaaaaaaaaatccaaattcccattttagcagccatgagttctgtgggtgtatttagtaagaaggaaaaggatggaatataattttgggtattcacattagcacaaacaatagatccaacctcctcaaatttcaggctcaattaaaaacgtagtggtggacaagtaatgatcaagatgagatgttatagtttcataaattaatagtaatattgtgttggttttctaataagtccaacaaatcggaggggacataatttttttgttccagttagaaacaactatatagttgacatatatgttttaaaatttagacttcattactaagaaaggaaagacttataagagtttagacttttagtgatttgagatcaatataataaacgactattctttttataataaagaatttagaaagaccaaaaataattagttgttaagaaaaaaaacttagctgtattgacaagtttttatattaaatggttggctattaggcctgttacggatccggatatccgggatttttgaggtatccggatccggatccgtatccggcggatccgtcatttcagtctctggatccgtatctgccaacctcggatattcgggatcctgaagtctgtgaaaaagtacgagtatccgcggaccggatccgatccggtttttttttatcatcttctttcctcccgaacacaagcaaccgaacttcaccgccaagattctttccagaaaaaacagctccaaatctgcaacgaaagagtgaatccaacgccaaggggaagaagaagagatagaggcagcggttgtttcggtggaggttgaggatgagggtgatttggtggaggaggatgacgatttggtgccatggtggtagagatggtcgtttggtggaggctggtgtcgagaggaatgagtgaggaagataaaaggattaggttttttggaaaatgggccaagatatgggctggaaaatatcataattttaatttttagtatggcccaataaaacccataaacataaaacattgaatattaccggatccggatatccggtcatattttttatgattatccggatccggcggatataaaatattactatccgtatccggaaccgtttcacacggatatccggtttttcggatcggatcccggttccagatacggatacccgcggatcccggatatttgttccagggctattggctatatatgcaagagggagaaggagaagaaagatatcacaaaaaatttccaaatccccattatcgaaaccatgagttccgtgggagtattttgaaaggaggaaattgatggaaaaccatttttggtatacacattaacacaaacagacaacccaaactcctccagtgaatcactggcc

SEQ ID NO: 1053 - DNA, 3000 bp, Unknown
  misc_feature (1)..( 3000): cDNA_ID_2129812_gDNA_ID_1620352_Annot_ID_154348 3000 nt of promoter + ATG
ggacaaccttataccaagcttgtcaggcatagcagatttaaaagccggcacccattcctacacaaaacaatgaggaaaaaaaacacaattaggtgacaaacataagattaaaatagcttccatttccagaaactaaaattaaacagccaatggctgtggaagcaaatatatacctcaaggtttccatatccatcctcgtcctctatatcatcatactggagttttacctgtttccttgatacgtccaggacagtgcatctaaaccaacagcctctaataccgctatcttgacacagaaactctatttttgcatcagtcttaaccactccgttgtaacaaggatgtttctgaacattggttggtgaaggaaatcttttgcccgaggcattaagttttagtctcttacatgaagattcgtaagttgttaacagatgatcagacataattcttgctcgttttttcatgcttctctcagcaccaaccattacattctcaccctcactccattcttcatcttcctctatattcatcgcacagtctacaggaccagcctccatagaacttaagcaagacataatcggttggtccaaatatccacgcaatttactcaaatcaaaaggtttaactttgctgttcctgagttgccgatagcacatgtgtacccttgccaataaagaattcggaaaggaagccacacactcctcataatgctcacgggtcaagacagtggcaggaccatcaacacattctgcactgatgacctgtgaatgaggggtgataaaaacctcttttgggtttgggttcttgagagcaactgcacccttcacttcttttgtgtagtgaaaccacctcactttgaccttttttaggccacgcttatcctcatacatatcttccagatatgcaacgtaccgatcctcccctttgctcaagacaaagacaaaagattgaacctgaaaatccaaaagaagaattacgcctccaagtgagtagtctcatccaagatctttacagatacaaatcacaagaacagtcaacatatatcgaactatgcatgcactgatgccaagtcttcaacttacccctattgttgtcccatttctgcaaaatgatgggtaatgtttgagctgtttaccacacatccaaggagctcctgaccacataatctcccaactgtgaataatcaagtttatgggaagacggacctgtaagagagattttcccatcagtataacaggaaagtaaaatgcagtgacaattgtatgagagcaacaagcagctaaacatcacctcttcacttgcttgagctcgctgagcagtaaatccattgcttggaaattcgggagatccattagattcccctgactcacattttggtgactctgtaaatgacaatataacaagtgctttagaataatcagttataaagttagaagagaccaacataaaggaagaattcattccttctccactcaacagacaatttgtcacatatggtaaaagataaagataaatgcgtactcgaccagtttccttgtgtactctgcttagacagcattgaagtgagccaatccacaacttcccttctcgacctccatttgaagccagaatgaattgaattctcaggaccatgaatgcgcacaaactcctcagagacaacatagaacatgtgcctaacacttctctcagtaccaatgacagctaggatagattcaccggcagaatccttgaggaagtaatgaacaacacggttccctcgctcttgggagacaaaatgctccttccactcgacaaaatgatgatcattctcacacatttttcaaaataaaattgattcggcaagcatcaaacgctccaaaccctcctttacatcagataaaaacactaactactgccagttcaaagtcaaagtcttttgtcctaaatcaagttctaaagcaaccccaacgcaacaatctctatataccaatgacagtggaaacccttaaaaacctttaatctaatgaccaaacaatacccctaaaatcaatcccctgtgccgtggaaatcctaaagcaaatcactctaatgcataactctgatcaacatctttcccagcttcctacaacacagctaaatcgtcgaagtctctgtaaatttccagcttttaagaaatcaaataatccggacgaagaagaagttaggattagagaaagcagataagaacccagtgagcggagagttatgaagatctgtagaaagatcagagactaagccatggaaacactgatctaagctcgagagcgccgccaaacaccaagatacgactttgactgcggtaatcagcttaagcatgacgaagacgaaatgggcatctcaaaattttcagcttagaatagatttataccgattcctctaaggtttgtacagaacaaacaaatgattcaggagaaaaaaaaagtgaactttagaagcttagaatagcggcgagaagacaaaatcgacgatcgatttcggagatggagaagaagaagaaaatgagttctgattaaggtaaacttggagaaaataaggtattcccatggatgatgatctctcttctctctctctctctctctcaaagtcacaggggtttggcaaaagcagctgctttggtgaaggaagaagagagagagaagaagaaattgtgcaattactacgaaatgacgagaatatcaggaagttattgggccttatatgggtctttaatgggccttaaatgaccgtggccgactaaaaaaaaaagtcaacgaaaagtcaaatagatctctgtcttttatttttttgttctctctcgtctctctggctaccgagaaaacagagaacgttaagaatcattgcttttctcgagaaaataatatttttaattgaatcgagaaactcttcaaagttgaattaagaagaatattacctcaattgagatttgagagacacgcatagagagattgattattgcatcgaatcaagcttggtttgttagta

SEQ ID NO: 1054 - DNA, 3000 bp, Unknown
  misc_feature (1)..( 3000): cDNA_ID_2104946_gDNA_ID_1620352_Annot_ID_154351 3000 nt of promoter + ATG
aacaataatatattaaaatgttggatttcctttgtacatttgaaatgaaaaaatcggattacacgatggtgtgatcatgagatctattaaactaaattacattcgtcttttaatggatccaatggaaatatcaatctcaataagattatcttcttccatattcacatcatcaatatcttcttcttgttcttcttcaatcctaattctcagtcgactttgattaatgtttctcattgcctctatagtctctgcttcttcgctcacaagatcaatctcaatgagaccatcatcatcatcatcatcttcataatcgtagccttctccttgggacccctcagccaaacatagtcttgtcttttccttgaagattcgtaacaagaaaacagaagaggagacgaacaagattgccatggttattgtgagagaggagactccttgagagttcaagaaacagaggaaagctacagatgaaattagggttacaagaaaaaacagcagtgacagctgtgaaagaaagcaacaccgagtaaaatgcttttcatcatcagatttttccaccattatagaaactttatttaattcaaagcaaaaacaaagacagagctagttataaagagaagtcgagattgtgtcgttatccattgatgttaatggatctttgagttatgacttattcaaatctttaaaccaaagtttcgatgtttggatcttgatttaagaagagagattgaaaagagacgaatctgagttcttgaaaagtttgagacaagtctgagaaagagagagagagaaatcagaggaagtcagaggaaccaaacaagaaagctttatttgttttctcacacttacataattacacctgcaactaaattttttcgagaaaaggaaaagcattggtttttgcatgtacgtatttgaaaaaataaaacactttgaaaaatctataaaaagctttggaatttggtaaatccatgtgaagcccactaattaaggatgcttgtttttgttaaggaaatattagtatcattaagctttggttgaaaactacttgtaaagttgtactagtttaatctttctctagaagttacccccttcataagtttgtcgtttatttttttggttgtcaactaggattgtcgatctgatttattgaaaatattctcaactgaagtgatcattatttcttcctctgattgtttaaagaaatttagggaattgtcactttatcctttaggaacctacctttgtctcacaaaagactccatttgttttcaatggtaatcatgagatggttaatgatatgatatcaatgatatgatatgatatgatatgatatcatataatactaacaaaagaaattatctaagaaatgatgttattaaatcgtaagattgtgaaacgttgatagcgatgaactgaaaaattgttttaataaaagaacaagagttggcggttaaattgtttgatactcaaatttcgataatcttgaaatattaatagtgtgctttcatttggagatacaacttttactactgttagctgttgtggtaaatatccaaaaaaaaatccgatacgagtgttgttggattggatccaacgatttcgttattatgctttgtgcttccttgaaaaagtaatttgatttcttatatcttaaaagttataataagcaaattttacttaattgtttttcatagtcatagtaactctacactcttgtaactacaaaatgatatggcatactgcatttgtgaaaatatgaaagatatagagacaaagcaataatgttcacaaaaaaaaaaaaagacaaagcaataatataaagggtgatttaaaaatctatacatggaccatcaaataattaagaatctgtacatgaataccatttatttaggtatctcttttcaattaaaatctatatgacaaatatacccctacaaagtgatatggtaaaactctgataattagcagataacgcattatcgagataatattgttagcgaaatatggatggggtttgatgtatggatgaaatgacatggtgtacaaaccaacttaatatgttaataatatatttgacgatataagcaaattttcagttattaaaccaatgtttagatttcaaagacatatatatgcgaagacgataacattattattaaaagataataaaatatttaacatgaataccataaaagttgacttgcgactgaataatcatgtagaaaaaatacgtgcatcagaatagttaatagataacgtattatcgggataatattgttagcaaaatatggataggattttgatatatggatgaaaaaacttagggtacaaacctacttaacatgttaataatacaattgacgatataaacaaattaccagctattgaaccaacgatttgattttaaagattatataattatgggaagatgataacattattattaaaaggtaacaaaatatttaacgtcaaaagcaaatatggtatagagatataagggtattttcatgatagagagaaaagattcgagagtagttttttctaatacttaattttataattttatatgtatatagagtgcaatttccctaatataaacaaaaaaccaaacacatagtactagttttgtttcacaaagcacaacgcaacattttcgtctaggagtttcacgaatgagtagctgacacgtggctgaataccgaccatcgatagtagattacaaaagtatccctaacatctccttctccgccgtgtcaatcgcaaacaatcgaatccggatccgatccgattcgcctcaacaccatcattatttatctgtttcccccttttcccaagctctaacatttagggtttcgcgaaaaatcaatcaggtgaaaaataatcgaattattgtaaaattgatacataaattcacattcaaaagccaaagagctgagaaattattttttgtaaactgttggtccttcggagagtgtccatgaacgttagtcttcaatg

SEQ ID NO: 1055 - DNA, 3000 bp, Unknown
  misc_feature (1)..( 3000): cDNA_ID_2129845_gDNA_ID_1620352_Annot_ID_154359 3000 nt of promoter + ATG
tgaacatactgtttcctaaaccccaatgtattggctccatataagctgtcctctgtaccatcggaccatatggaccatccgaacaactcccgtaaaacaagctttgcccgttcgctatcatcggctctgtcacattcgagaaggaagacacttccgcagtatttgaggtcatctggttattaaaagggaagaaagagagcccgttgtaatccatagtaggcagaggaaacaactgatactgctcaaaacattgccgattgtaaccgcataaaccaagttggtcattagaccaacaactagtgtcaggaaatgtctgattcctattcgtagcctcttggatcttgttttctactgccatgaaaaccgcatagaggtcatttaaagaacactggtcgagctttttgtcccatgtaggatactttgtcgcaatcgtcggtttctccaccttagtgttgtttttctccaagcattcttgcacggtgtatgtcttggtgcagctgcttgacgcagtgtctctgtacttggttaagatttcacggactttgctcccatcctttggccataactcgggctccatgaccatttcgtcccctgctctgctcgggccgtacacaatgacacaagtgtccacaccgcagagtgttgagaactcactggctttcttatacaaacatgctttcctcttcttgtaagtcgttatcctcgttttctcgttcgttatcctcgtcatctttaccatctttcgacccatccagatacctttgcttcaatctaaaaagccataaaagagtaaaacacaacaatagatcataatcttgaaaattgaaatagtaatatcatcatttggatgtaacgatcagctaccaaaacatacagaaacactacaaatttacaaccaaagcactaatactagtaaacattttgttgtcaataaaaaatttgtaactcatatagcttttaggtttacattttaacatttcatagcaatgtaagccttacaaatgtatagggaagaaagattcatattattttattctcaattttttcactaataagcataatccttatcgttttgtcaagcttcctatgcataattccaaatccatatacgattaacacgaatagtaaaacagatgggatattaacataaagtaaatgcagagtgattactagaagaaaaaaagaatgtatataataccttctttaagagctctactttctgaagtttcttgatttaacaatggagttcctctttctgtgtttatataagacacacgcaaaaaaagaatatatgttttttttttttttttttgtcgtaaagaatatatggtttattctcgaatattgtttcctcccctaaattacggtagcaatgctgatattttatttctttccatgttttcgagtagaattaaagaggacgaagctatacaaatctttagtttctatgttcacgcacaagtgataagagttcagttaaaggaaaacattgtaattacagcatgatcaagaaagaagattttgtttgtgatttgtgccaattaattttctcaaatattccttttttgctttaattgaaaactttgttaatattcttacggaaatttggcgccggaggtggctgaggttccgtttgcaagttgcaacaatgttcttattggtcttcatggccactttggtagtttggttgtatagaaattagaaaaaagattaaagtttgttgtcgtaagtttgtcacacttctgtgatgactatttgtactgatactcgatagttcattttaatataatactaggagacatcgacaaataataaatttgtttcataaaattttaaactactagtagctgttggtgttgatcgattgatcggtaattcatagcctttgaaatatacatttaacaatttcaccaatcaccatatgctcatacgcactggtatgtaactaaaaaatgactagaacttgtaaaatgtcccatgcaattattacttagtgcgtattttgaaattttgtttttttatcctttattatctttcacattcgaataaatatcagctatatgtgataaacaaagttttgccacttgatgagtagtactacgagactgaaacgtgacatatcgtggacccatgatttaatttgatcaaactatatgacaatgaagacggaaataataggttaacttaaatatgtgagacatttttcgtatactatttatatgccaaattcactactataattggtaataggcagtgttgatggtggcgagtagcatgggatatgttctaatgggatattttacatgcttatccactaagggacgatatgtttccacgtcagcaaaatggttaattccattttctttgttaaaaaaccttattcaatggatatttaatatcatataaaaaaattaccatctaaaagtacaattagtttgactatatgctattcaagtcctcatagttttattattcaattataagtcagtcataatagaaatttaaacttgtttccatgttacacattaaacaccagtttgaaaaaatcaactctgatttttataataaaataaatgtaatctcaatcatctcctgaacttcaacaagtaaaacgttaattagttttgataatttcactgatttgtttcataaaaacacctatactcctataaataattaaatattgtaggcacgaggtatatagtagagaacgaaagttggggtcaattatagaaatatttaaaacatacgggcaaaaaatagaaaataaaggcaataaaggaaaaagtatagggtcaagaaggaattataaagttgataattttcttgatttaaaaattcagtatatatatcagaaaagccccaaataaattttgggtcgttaaaaagaaaagaaaaagagaaatagaattttgcgtttcaagtactccatctccgtctcttttcctccgcatctaaaaccatctgagaaatatctccgacgaaggagaagaaacgaaa

SEQ ID NO: 1056 - DNA, 3000 bp, Unknown
  misc_feature (1)..( 3000): cDNA_ID_2129856_gDNA_ID_1620352_Annot_ID_154363 3000 nt of promoter + ATG
agagtaaacccacaaaaccccaggaggagaaggaaacaaaaaatagaaaccttgcattgtagaagatgagatgggtcgaagaattcagccatgccgacttgaccaacatcttcaatgaaggataatttctctgcgtaacctaaagacatttaggttttgtcttctcttttggacaagaagaagaacaccttctctgcctctcgatgtataaaaaagcagagacttggacagtgacttctatttatgaagtatcaatatattttaattctttttattatgattttattattatatgcaatctggaatattttttttgacatttctcagaatatcagagattttagattttaaaagtgttgctaaatttttatataacatttctttattatgtttccctgataaacctaaagtttgtgatatttaaatgaaaatccaaattagggtattaattggattcatataaaacttattttatggcatgttattatatttctcaaatttgtttagtttggctaaacaaaaatttgatataagaaaaacattaattacattaacctaaaatatcatagctaaattaagtgggtgatatcattgcaacttttaatacatttcaccaatttttatctatatatcatttatttatttttactttttttatgtaatcatgaaattatgaatatgtgatccataatctctttagtcccagaattagactgataatatttgtgtcaagctcacggttgtagatcatcttataacaaaacttgaactcggtttcggtatccttgaatcattgtaaacaacattcatctaattggttaaaccaatacaatgagttattaaataagtaaatttatcgtcttgttattatttaaaatatataggtaaatgtcaacacattgaatattgaaaccatttgataaagtgggttgtaatttgtaaaatactaaaccatatgacagggtttactatggatttaaattgattctatgtgacgttctggtgcatgctcaaccatgagcttatattagattaaaatcttgttctatcgaaccggtttgaaactcatcactcaaagccattttgaattcagtttggtgaataaacttataacatatctaagtttcataaataagtattgttatatatcatcaatttatttatcaagattaacatacctcacacagttttttaataaaaaacatgcagcatgcagacttaaatatgggttatgttagtcctcattccactctcgacaagaccacaacccacaccatcagaattaatatttcctcggatacaatactgtccgaaagtgtagtcacacctcaacactagcttgtgcatcatttgaaaagtagttgaatcctacaacagactagtcaaaacaaactcacccagcaccatgaatgcacaagcaaatcatgagtttggtggatactttttccaaacttgtccaaaaagccatcatcgatggtaatttcaaagcgagggttaaagttatcataattaagcagtttattgtgaaggctagcaccttactaacaaatgaccctcatcaacttttttctggttgctcttgtcagccttcactacatgggccagagcgattgaatgtaattgcaactcgggagcatgcaacagcttagttggagccacatattatccatcgtgtaaaccccgtcttcaacgtaaaatttgattatttgattacttgaaacaattcatagttcttcatctttcccatagcaaaagattcattcgacttgtcacaattatcttaaaactcatgttactcataatccatcttctttgggacatctattgatgaaaatggtaccgatcggtatatatctatatattccaaagtaatacaaatgcgttttaatttgtcattacatgacaaaaatttgtctacatcagctaaaagacacaaacgttttcttcagaaatcctccaacacccccgacatgtgtaatgccatgcggcagataatacgaaaccgaggaaaaaattcatctctttttattataaatctcaaaaccaaagaccaaacactcatcattttctctaagtcatcatcatgttgtctcttcaagcttctctctctgttcctcttattaccttttatctatcacttttaaactgtgtcaatctaaactcagctttggattcaaacgctggtttttgcactccttacccatgtaaccaaccgcctcaaccaccgtcctctacaggctactctccatatggtaaccctcctccaccgtctccacagtattcaccacccccaccgccttcacagtcttcaccgccacgttctcgctgccctcctgttccgacgacaggctgttgcaaccaaccaccaggtccaccaccttcgacgatgtattctcctccgtatccttatttttatactcctccttatccttacggtactattggcggagggggacaaggcggtggcggccaaggaggaggaggaggaggagccgaaggcggtacaaccggttcagcgatggcttactattcctcttccattcccgtatatgttttgatgcttgtgttagctaatgcttttattgtcttttaggtcatacataggtttcagataaatattaaaagcctataaaaaatgtcaccttcttcttctgttattatctcaaattttttgtttatatacttttgaagtattttttttttgtcgttacttttgaagtatattctaataaatgaattatatatttttcaacgttataattcaactaaaccgagatcaaatcgaaaaccggttggtacacatacgaatcgcgatcggtacaaatatgtatcgagtaacagatgaaaaccgtacacgtgtctgtatttgccacaagaatcaacggtggagaacattttacgaaaagaagtcgaggagataataaataaaataatttaaatacgaggattcgaaagaactctgttttatcttcagagacgtttatcagagaggcatgaatg

SEQ ID NO: 1057 - DNA, 3000 bp, Unknown
  misc_feature (1)..( 3000): cDNA_ID_3060353_gDNA_ID_1620352_Annot_ID_154350 3000 nt of promoter + ATG
ggctccaaataagaagattgtcttagttagaaaatggacttccctctttaatataaatattaaatactttcacctactttctccttgcacaccaagccacaactgttttatacttgtccccacctaagataatgaatgcatgaatgcatggttttcaacaccctgaaaaagtaaaccggtaaaattcatcgtgggagtcaaaattggtagagtttaacatgcttattattaatttgcacacccatttctgttgtatgagtgtaatccacacacaaaaaaattgtttagcaaattgttacacaaaacagagcttaggtaataagaaaattagcaaattgttacagaaaatatattctcctaagttgtctagcctctagtatcccgataccatacaatccacaaaacagaggatggaataaagtgagagaggaaggaacagaacaatacataagaaataaaaagcaacataaaagattgggtgttcttgttagttaattagaagaatgttaaattgtcattataaaatattttttaaagaatgttaaatttctagaaaacttatctttgtgggatgaagagaatattattttcttttaaaaaaagttttgtattgttaaatctaaacatatacatcaaactttaaaaatcaaagcaaaaaaagaatatctctccttttgcatgcttttgacatattgaatttaataggtaattttcttaattaagatgttaaacttatggattcatgatttgaacaaaactgaaaaaagtatatggaagcgttggtgagattcatacctatcaaaatgaacaaaaggatcaccaaccgaatagtaaaaccaactactgtatttatcatggccatttttcttcttctttcttaatttctctctttattaaaaatttgttaattatatcataatcttaactgttttatataaaaagtgttttttcctagaatatacaaggtattccgcaaaaaatgccaataaaaatggttttaaattaaaaagaaagaccaaaactcatataacctcaaaaacatagtatgttatttttagttaatataaatattaaatactttcacctactttctccttgcacaccacaactgttttatacttgtccccacctaagataatgagtgcatgaatgcatgaaccatcattggccgatgcgtttcctggtgcatgtagctcacagccgtcgttctcacattttgttatttatgatcatacttttttttcattaaaaggaaaaaggtttactggtttggtttagaacaagaactactcgttataatcatacttttgtttaattaaaaaaacaaaaacaaataatttctagtacatcttatattacatactatagtttgatgataaaaataaaattcaaatgacgattatcatgtcgaaaagacaaataataattgtcttactgacctacctgcctgcctctatatatatactagtctttggtcgcctttactataaccaaacatcgagcttgccttagagtttgtctcaagcttctccttttttggtattttgtcttaagcttccttgcttctctttcttcttcttctctactctttctctctatttcaaaccttcgttttctttccttttttgtataaaatcttaaaatcaaccaagacaatggaaatgaaattgctctttacatcggctttcacccaaatgttcggctactcgaaccatatggatcaagccagcaactgccaaagcacccgcaacaaaattataaagatgatgaagaaagaagaattcccaagtggattccaagtccctcttcactaccctaaatactccaagtctgattacgaagttatggatgatctccgccttgacttgctcctcaaacaatatggattctcctttgaaggatctcttgaagacaagagggtttttgcaattgaatcatttctctggcctgatcagctttagatggtctatgttggtgttgaatgatcttatatcgctctccacatgcatatcaatgagcctatactcgagtggttgaatgtttttaaaattatgtcaaattaccatgtatatcaatcacttagtaatgttttagaactatgtcaaatactagtgtgtgttatatttctttgtgtgtggggatgttttgaagtatgcaattcttcacatatatatgtatcatatgagtgcattaataacatctttgatgtcatgtataacactaaaaaaatgtgatttatcgacttataaaaatcttaacatattgacattaacataaaacatatagattattgtatgatatagattaaacatgacgtcatgctggatattttggcttattggcttgtacattacttgtgattatgagtgtataatataaaactaattactagatttgcacaaaaaaaaaacagaaggatagaaaactaactagaaaattaagacattacatacattcttctatatgaaaaaaaacatttaaaaaacaaaacaaaacatttttatactaagatactaatgaaaaatcctatcaagaaaatgaagaagatcataaaaacaaaattatcggatttgaagagaataaattttgaccaaaaaaaaagaagataattaaaataaaataaaaacaagaattggccaactgtgagaacatcatcaatgaagaccaattgcgagatccgacaacaccgcttcttttgatttcgatcttactttcctgggtatgtctcaattcttcttcctccttcagttcgtgttctgtgtctgattgattactctcacaaaactcatcttttcattgtctaaaggtctaatctttagctataactcaaaatctgtatctaagttctgacaagtttctgttacgaaattcaaattttttgatacatatgttcatttctcagaacaggagatgtcaattttggcgatggttttcgtaacataaacatgagatttgattgttctgtgcagatctcatagttaatctggtttgagtctagaa

SEQ ID NO: 1058 - DNA, 3000 bp, Unknown
  misc_feature (1)..( 3000): cDNA_ID_2129808_gDNA_ID_1620352_Annot_ID_154347 3000 nt of promoter + ATG
ccagcgcgcaacctacatagagaacaaacaatacacatcaatcaatggtccaaaaagttaaaattctatcgagttctatctgtaaagttccaataatgggtgaggtgagcttaccgatccattggcccgtggagggacggataaggcaagaacatatcccggctccaatggcagcaaatactaaggacgcgccacatcgtactgtgatacccacaactttgtttccgagatccttagcttgctgtgatatctcgactttctcctcttcttcttcttcctcgggtttaacattcgggaacacacatctgtagatttcaatgcctacttgaactacccatgatgctgcgattcccaggaagtgacctgcataaacacagccaaagacagaacatgcatataggcttcaggagaactaaacaatgtctgatctggaaaaagaaggagcatttgatgggagggtcacgaagagtagagaaaccaaaatgttttattatacctctaagagttgtttggctgactttaaagatatatacatgtgtcggcaaccctctctgagccttgcgtaaagccgactgaggcacatctgcataatatatttatgttctccgctctattagttcatcgagctaaatatgtctactaactttttttacaacgcaagtttgttgtggaagcaaaagtaatggaagatgatgttaccctttagaagtttccatgccatacgctgtgagacataactcagagccagcctttcaaggactctccgagtggtcacaactgtggtctggatcataacaccgaaattagcagtttaaaccatgacatcatgaagcaactacagatggtaagaaccttaaatgcatactaacctcacgggcaatttgctttgctgactttttaagaggaacaatcaagtctgtgtggcggttttcttctgcagcattgtttaggaaatcatcatcatcctctgaagccgttttaggctccaaaagaggcaaataaaacatcaaaagggatctcactgtagtcattgcaagtgccctgaactcaaaggccgagagaactggttttggctggatattgtattccttggacctagaaatatacgcaaggggttgacgctgcaaaacatccgcagacattttccgtatagcaccaaggtaatcatcatctattgcagcagcagcatcacaatacgcaactctaggctcaaaagaactgtaaacataaataatctgagtcaatgtcgtagcacaaccaatcatgccaattagttctctatgaagtggtaatcaccgagagtatcaaaaagacacatgaatgcagaaacctatcaagagatctatatagaatagaaacagagcttgtaaaactcaaaacgccctgaacatcaaaaaccatatctaaaactattcatcgataattgtaatctcaccacaattaaactatacttcaaattggattgcaaaatatgatctttactagtaactgatataaatctgcaacctttcttattcaattgagcaatagaagatgatcaattctgaatttctaaaccctaatcagaaacaaaatcagaaacctagtaatcaatccaataactcaatccaccacgatccagtgaaagtcaaaacaaatccaaatccactacagagagagagaatacatacccgaagagaaacctagacgcaaaaggagcagaggcggcagcagaaacagcggcggcggaggcggaatagaaggaagatgagtggagagtgttcttagattgagatttcttcagtagatctaaaactaaagctattcccgccattactaacaaaccaagcttgattcgatgcaataatcaatctctctatgcgtgtctctcaaatctcaattgaggtaatattcttcttaattcaactttgaagagtttctcgattcaattaaaaatattattttctcgagaaaagcaatgattcttaacgttctctgttttctcggtagccagagagacgagagagaacaaaaaaataaaagacagagatctatttgacttttcgttgacttttttttttagtcggccacggtcatttaaggcccattaaagacccatataaggcccaataacttcctgatattctcgtcatttcgtagtaattgcacaatttcttcttctctctctcttcttccttcaccaaagcagctgcttttgccaaacccctgtgactttgagagagagagagagagagaagagagatcatcatccatgggaataccttattttctccaagtttaccttaatcagaactcattttcttcttcttctccatctccgaaatcgatcgtcgattttgtcttctcgccgctattctaagcttctaaagttcactttttttttctcctgaatcatttgtttgttctgtacaaaccttagaggaatcggtataaatctattctaagctgaaaattttgagatgcccatttcgtcttcgtcatgcttaagctgattaccgcagtcaaagtcgtatcttggtgtttggcggcgctctcgagcttagatcagtgtttccatggcttagtctctgatctttctacagatcttcataactctccgctcactgggttcttatctgctttctctaatcctaacttcttcttcgtccggattatttgatttcttaaaagctggaaatttacagagacttcgacgatttagctgtgttgtaggaagctgggaaagatgttgatcagagttatgcattagagtgatttgctttaggatttccacggcacaggggattgattttaggggtattgtttggtcattagattaaaggtttttaagggtttccactgtcattggtatatagagattgttgcgttggggttgctttagaacttgatttaggacaaaagactttgactttgaactggcagtagttagtgtttttatctgatgtaaaggagggtttggagcgtttgatgcttgccgaatcaattttattttgaaaaatg

SEQ ID NO: 1059 - DNA, 3000 bp, Unknown
  misc_feature (1)..( 3000): cDNA_ID_2129749_gDNA_ID_1620353_Annot_ID_154387 3000 nt of promoter + ATG
taatgtatatgactaaaataaatctaaaattttaatcattggaaactcattttggtgttcaaagaaatatttagtaacaagtaaatcatagttaatcagaatgtcaagttaaaattagaatcaggaatatgacagcatttttctttgacgacaaatgtaacaaaaatccaaaaaactgaagaaaaaataaactgccgacagaatttgttccctcataactcacacatctttgtctttcgctaatcgctacaatcaatttgattaattggaaaaagttttctttaacaaagccatgaaagccgctatttgatagattctcaaaacaggtgcaaaagatttgattaattgactcgagatgatgtatgatacacatatttggtgaatgcaatagtcattatatatcacatttaaagtatcaattttattaaagaaaagatatgcgtaaatagcattggctgttgtaggacaagagacaaaagtcacaacattaggcatcaaatcttttggaattaccaataagcaattccctaggttggtccactactaatcgtatattttggtttatataaagattttttttcttgtttttttggagttaccaataagcattcctgccttattatggcccattaagaatttttgttaatagtttgacaaaaaaaaaaaaaaaaaaagaatttttgttaatactataaatcctactttgttcttacgaatattttatcgtatgcaacaagccatgcattatcatcaacaagaaaatctaaactagtaaaccccaccagaaatggctaccgacttatttcccaagaaaacaaacttatcccaaacagaagaaatagaacaatacgttatattttccaaaagcttaagggtaaacaattttttaaaacattatgattcttccgtttatttcgctatacaactatagtcttcacgctaattactctagcttcatttacttcaactgttcctcatcgacgtgacccattttcaccaacttaccgtccaagtttcaaactcaaaaacatttgttctcaaacatataaaatgtacaaatttgcttgactgcatttaatatcgaaactcagaagaatgagaaaaggggtcctacactgtggtctttgcatgtaatctctgaaacctctttaaagtctttggttttggttgttagtgggtcccacttttcacgcagtctctgcctttgaccaaaagtaacctatcattacatttttttaatttacacatattaataggccacaacaaaaggtgttccttcattaatttctcatttgtcattgacacatccaaatctttcaaaatccaacggttcatgatttctttagaaagctcccaaatagttcctttgcacataattaattttctttttcacttcaattaaactattcaacagatttattccctttttgaatggtggaaccatacaataacttgactaagcacaaaccacttacagtatgatttatgtgctcctcctccccacatggtatacacatatgatatacgtaatatgtagtgaaagagaaacgacacgtaaacaatgcatacgtcccaatgtctatttgagagcgaatagcttttgtatactctttttgggtatttgcaaaaagattgagactcaacacagagatgccttatgtattttatttattcacatgatcacatctttatagattctctatccttatattcaaccattcattcacgttttttaattttttttaaaaaattacatttttttaatttacatttttaataggccacaacaaaaggtgttccttcattaatttctcatttgtcattgacacatccaaatctttcaaaatccaacggttcatgatttctttagaaagctcccaaatagttcctttgcacataattaattttctttttcacttcaattaaactattcaacagatttattccctttttgaatggtggaaccatacaataacttgactaagcacaaaccacttacagtatgatttatgtgctcctcctccccacatggtatacacatatgatatacgtaatatgtagtgaaagagaaacgacacgtaaacaatgcatacgtcccaatgtctatttgagagcgaatagcttttgtatactctttttgggtatttgcaaaaagattgagactcaacacagagatgccttatgtattttatttattcacatgatcacatctttatagattctctatccttatattcaaccattcattcacgtatacgtgtgtatatgtattctcatttatatgcatcaatctgagtatatgccaaaaagaaaattaaataattaccttcctttaagacataaatcctcacccgattgcctcgaatccattactttttttttttttaatacgtgggatttcaaattcttaatgttaaaaattcagtggtgaaaatatgctactacatttttaatatgcattgtttttgttttgaacaccgttacttattttatttacagatttaactctctctaaaaatacttgtctttcctaaagcaaagaagcaaagaatcgtgtcctcttacacaatcacaggctttttgcaatttttttttttgcaagtatcatttcttttcttggcttcgaattcagctccctcttcttcttctttattcactttctttcccctttttcttttatttcattataaataaatctgatccgatacatatatggttccttcttctttatgtgcaagaacaacacatggtttaaagcttcgaatctctccctttgcttcgtcatatatctaaatcaccccactcaagatttcaaattccctatatctttgtttttataaattctttctaattttattgtcacatataattgaagcctaataaatcacaccacactgtcttactctgtttttgtttcttctctactctgttttttttttttcccttcaacattgaagataaacttatcttttctctctcaaagactgaaactttatcaaa

SEQ ID NO: 1060 - DNA, 3000 bp, Unknown
  misc_feature (1)..( 3000): cDNA_ID_2129769_gDNA_ID_1620353_Annot_ID_154392 3000 nt of promoter + ATG
gaagcgagcttgcgcagttgtaagagaggtgttggggttaacggttgagaaaaggaccttgattgatcatttgacacatttcaggaaggagttttctttaccaaataagttaagagacttgattgtgagacatccagagctattctatgtgagtataaaaggcatgagagactctgtgtttctcgttgaagcatacaatgacaatggtgatcttctagataaagatgagagattggtgataagagaacgtttgatagatcttattcaagaaggaaagagaattagacgtgaacgaagaagaaaaggcgccacacttggtgataaaagcgtggaagagaaaaggaaagatgatgaaacaattgatgattatgatagtgatctggatgatgaatatgaagatgggtttgagaatttgtttgactcagaagatttaggtgtggaatatcatttcgacgaagaagatgatgatgatgaggcaggggttaatggtgaaagtgtagagtattggagtagaaagctttcgtcttcaggtagtagcagtgatgaagcaaatagtgctgtggaatcatggtgatggaaaatgttaaatagatcgttttgatatttatactcagaaaattgtacgcaattacacaataacataatgtttatgtcgttaatcttattctcattggctttagagctgtgtgtattgatgaaatagttcgggataatggtaatattgaatgggcttacgaaagaatatgaggccttttaactaaacgagcccatttaagcattgaaagaagtcgaaagtcccacatcgcttagaacaaaataagaagttgcgtttatatacaggtagagtcgaagtagtgattgtcccttcggggacatccgataaaattggaacgatacagagaagattagcatggcccctgcgcaaggatgacacgcataaatcgagaaatggtccaaattttttttgaaaattttcccggttagttaatcggtatgggtagtaaaccgacgtgtcggatctttgtcatactcattagtcattaccgaatctagttggtcagagggtttctggataataccttgtaagaacctgaagaagaggttttttgataggcatcattcttatgactatccgagaaggaatcattttgatgaagaagatgacgatgacaaggcatgagcagtgatattggagtagaaaactttcttcttctcctggtagtaagagtgatgaagcaaaaagtgttgtgaaatcatgttaagagagtagaaaaaccatcaatgttttgatatttttgtatattcgaaaattgttgcaattacacaagaacacactgtttctgtttggtatcttattctcatttgcttcagagaagcgaatttagcatacaaaactgtgcgcgttcccttctttattttctcaactgttgttcgagtctctcaatggctgcaccaacaccactcgtgacctcaccgtggtggcctgtgtcaacgttattgccttcgtttgctttcttcatgagcttcagttgtacccaccctgtagaatcaatgcaagtatcacttagttctagccaactttccaatcctccctgatgcttctctatcattctctaaatatggtaatgacttgtaagacttatttatgtaaataaattaccaagagggaagcacactgtggctccaagaactgaaccaagcaacacattccgcgcacgccaagcaagagaccccggcactgccacattttgattagaggtaaaaatatgttaggacacagaaaagttaacatcctgaatctaataagccacaagtccaaaggaggatgcagagagtttgggatgtatcagtactgattaggccaaaaactgcagcagtagctgaaccagctccaaccacattgaaaacatcatgcactcctcgggtctcagctaaaaagttttgtagactaaagaaggaagcagtgaacattccaagacgcatccctccaatgagggagccacgagttactcggatgaaccttttctccattgcatctcgcatcaacctgtgttgttcacgcttatcctgtgtactacccatcttcaacatcacttctgcatctttgctctgtttcaaaccacacacacactgattttaacacaggaaataatattcagctaaaagtcttaaactttgatatcttatgagttcagtctagtaccagaagtcactaagttacaccaaggtagtggaatcgaaacacaaatctcaaggacaagtaacgagcttgaatctgaaattgaaagcagacataccacagaagcagaagcttctttgctccctccatatagcaatcctgcaaatactccaacaacagttgctgttccccagttgggatttccagctaatcttgaagaattctgttttatataacataaaaagcaatcacaccacaagtaaactatgaaccaatcacttaaaaaccctaacttttatgtagattcttgaaatgataatcataaagaacacatattttgaaaagctttgcttctaacaatgatcttatcacagggaaaatgaatataaatacaatttcaagtaagtgatcccgattcgaatgatcttattctatgcatttgaacaatacaaccctaaaccggcttgtcgcttaaggaaaatcgttgagagggaacataaatctcacccctgggattgtttcttcgggtttttctaccgcttccatagatgactgatcaaacactatcgccgtaatctccttctccgccgtagtctctttctccttcagtccaactaaaggtagaagacgaccagaacggtttaattaatcatcggcgatctatcttaaccgatcaaattttcctagaccggttaaatttgtcataaccggtcgcatagaccaatttatgttttcttatgcggaacgtcttcgtattcctttaaaacgctttattttagccgccggggaaaaaattggtgacaagagcagagagagtcgcc

SEQ ID NO: 1061 - DNA, 3000 bp, Unknown
  misc_feature (1)..( 3000): cDNA_ID_2990683_gDNA_ID_1620354_Annot_ID_154404 3000 nt of promoter + ATG
gacactgtgaaaatcagatgtccagtagtaattagagattatcctcgcgcttaccaggcaccaagaaacttccataacaaaaacaaatgcaaaaaaatgtatacctctcttctagggacgttatttgctctttgacaactgaaagaatgatcgcctcatctgacttcgcctgcgatgaagcttgctttttttcactcactgcaacacacaagggtaatttcagtaagaaaatgactcgggaaaatgaggcgatgtcttcaggatcatatagcttgtttaccaaagaaaaaatgctttaaagttagaggtgcaaacttaggatgtctcaattagttcatgacttcatgtagacattaacacaggcaaaatgaatttgtacaagataaaaaacgcttttatcctcaccttctactttttcttgaagcctggattcacctccaagatatgaacgttcatccgtttctaagtttagacgttgacggtctgcaaatttctctagcaagcggccgattaggttatgtgcaaccaagcttgtctcatcagaaatttcttggattgctaggtactggtttttatttcttcttcgtggcttctgctcaccatgatcatcagactttatgttttcaacagaaaacaatgaccgagagctaaactgattatctacttccatctcaatatccctctcaaccttgactcgggttttgctcatagctatgtcatgtctatcactgataactattgatttattggacgtgggagtgacatagagagatctaggatagactcttgtaatactctctggcaggtctcttacaaccaccctattgacagaagagctgaaatcatgctggtttgtttcatgtgtagaatcagtcgggtccaaaaccaagcattctgcaccactttcttcatgatccgaatcagaggactccattgcatcgtcttgagtgtctttgacttcaagctttatgtttcggcatctactctcttctttattacctaatttctcgttatcaaataaattacaattctcatcatcatcatcatcatcatcatcatcatcatcattatcatcactgtcttctagatcctccatataagcatcaccgaagtcctgatcgagttcataatttggaatacattggcaaaatatttgcttcacttgagcactcacatttaatatacactctgtctcctcctcaattgcttcccttggacataccttatgctctacattccccgtcctgctgttgaccaatgaaagagcttccattaaagactttggaatggtgtccagatcactgcactcaaacagatattcaatcaacgtttttctgaccgctgatcttaagctgtcattagaaacttcagcttctgggtctaaacaaagatgcaatcttttcagctcacgaaacctaaccttacggagtaaccatactgccttcactatctcgttctgcaggttctttgtttctggtgagaaccgaaaaaaatctgtggcagcagcagttttgtagccaggacttagcttaagtgataaatctactactgacaacgctttagccaattgctcctgcagtttatcccctgcagaaagttctgagagcatcttctcgctagcttgcctcacttggttaatcagatcacttcgacgctgaccacgtctactatttttcaattgaggtatcattcttgaacctttaagtttccttttcattgcacgtagggtctgagtagacaaactatctagctcattaagtaccttcattgcagcatcacgatgggaatgaagagtaggtgttctccccaaattcatcctgcaatcttcccggaaatttgcgggatcactaagaacttgatggagctgattaataatctcttctttaccaataccttctttattctttccgaagtctctcctgaccgaatctctgataatctctttcattttcaatcgagtcttgtcaaaggaagtagagcctcctgtgagtatcattgcaataagataaagacctttattcgtcaaagaatcaagctttctaacaagttcaagatcgcagaactttaactccttctgttgaacatcattgcatactacttgttgattcttgcaaaatccaaatgcctcttctacacgcgactttatcgtctcgtagaatatctagaaacacaaaagagatctcattgaagaaaactctcaacatttatctaaagagaacgtaagtaagagagacatacatcatcttccctaagcaaagattcagggacgaatctgtttcacaacgaaaacaaagaagaagagttcatagtcatataatcaatcagctaaaccaaatggaaactaagtaatgaactcactcagtctttcccggagtatggtccttggtggagtcagacatatcacaacccaaaagccacctacaaggtttgaaagtcacagacaaaacaaaagtctgaaactttttttggagaaatattaaaggttgaaactttcacaaagccctaataagcagagagattgattcgaactcaaagcaatcgtttcctatatctaagttacaattatagtccaaattcacacacacacccatataaaaccaaaaggagagaagtggaagaagaagaaaccttcttttgagacgaatttgctcatcttgatccttaatctgtgaaagtatcgaaccaaaatcagtcttgaagaaaactgaattattatccattgccatcttcttcaaggaattggaatcgactctcctttgaattgatatcgattttggtctgtttagtttgtcttgttcacttgttctcgtaacttaaaccgggttcgaagaatttttattaaatttttgagtaaaccggcttattaggtcaatacaaaaaagcccaatggacttttaagtttatggcccaaaatataacaaacgtatccgttctacttctgaaactaacctaaaacgcagagtgtgttgaagacgacggagacggcgacggcgagaagca

SEQ ID NO: 1062 - DNA, 3000 bp, Unknown
  misc_feature (1)..( 3000): cDNA_ID_2045461_gDNA_ID_1620354_Annot_ID_154422 3000 nt of promoter + ATG
ttatcaatgaacttgagaaataaagtttgtcatgacagagtgatatacatatagaaatttctggtcatgatacgtatggaaacaagacaagaaaggatggtgttcactgttaatggactcctatggggtacactacagctcgcgatgcatcaagtagaaaactggagattagagaagtgggtagaaaaagcagaggacgcaaacggaaccttagagaagaccctatcgatatgcgctgccaagaagatgatggttcatggtacccctcgaaccatagtgactttggttggatcttgcatagatataactcttctatgctgtgcctaagactactagtagatgcactactatgggtaatggatcgtgctctattaactttcatcttgtttcttaaaatataacccaagatcgaacattgtattatacatttgctgtttctgtgataattgatttgatacattagactgatattacgacaatctgaagagttctcacatttgtacctttttgtgatataaacatatacagtgggaacgctgaaactaatgactcttgagaatctgatctttaaacatgttcatgagaagaatcaatgagtggttcgttcgattcctcaccagtttccggagattttgagactttcttctctgggtataacacatagtgttgaaacatgaagaggatgtcgaaaaatattgatatctgttaaaaacaatttgagacgtttattagagacagagagagaattgaaccaaaaaaaaaactccatcaattttcttacaagtgagagaagagtctttcccatgttcccatagaaattcttccaagaatctggaagaaccaaaggaaatagatagttttagttttctttcaaaatgttattatcagagaaaacaaaagctattgatgtgatagagaagagattgttactttggtcaatagattgtataaccatttgcagatagttagcaagtcctccagtaaaatcgagaagaatattcccgatgctccacccgactgtgctcttcctagtgaagttcatctttgcctgtgaagcaaacacataaaatctgagtaatgctgattcaatcaataatgaaaaaaattaaggtttggaatcttttctgacctgtgggatgtacttgacgcatgtcatgaagacctgaatcgaactataacaatgaacaaataaaccattatcatcaaaactgttagattaccactaaaagaattggttcagaaggctttgcgcaacaacttacttgaagattgaaatgagccatagccaagagtgtgtaggtaatgctatgaagaaacagatagctgcaaatccccacacaacaaccacaatacctatagcaagtctggatactttttgaggtccacgctgagagcaaatcactagaaatcatcaggaaaaaaagaacacttgtatgggataaagagacaaaggcaagcctaagaaacttgattactcacttcatagataaagatctggaacagtgtaacagctgtcattacaactgcatggatcgagaatgcaacatcatttgcagccacaggtatcatctgaaataagcaacaattataacaaaacgactcaaaaaaaattaaaccagctcgaacaatctaaagcgttttttttttgctgaaacttagaaaggaacaaacttttatcttcaattttgacttcattagctaataagtaaaggtaaacttgtaaccatgaagataagagccaacaagaaccatcttagaatccaaacaaaactcatttctagattccacaatcaaattcattaaatgcttaatgcttcaatgaataacagagagaaagaggaaacaaacctctttatcgccataagtgtcaaagtactgcttttgaataacaggactaaagtagaggcagacattgtagatcatatacgacgagtgctttgtcaaattcaacatcacgaagtcgaagttcaatccaacaacactttcccaaacacaaccaagatttcatcaatttcaatttcaactacagatatagaaacaaaatctcaagaacaaaaggtagattagattaccttctcctacggaaattcaaaatcagctgtgggtaaaagctaattgaccacgaagcaaacgcgatccatccaacgatttcgtacgagatctccagcggaatcgaattccacgacgccattttcctcgatctcgatcgtctgttcgatttctccaaattttgttctcgacgttgacggagatttttgaagagccttaaaaagagctaaaagcagaaaatattattggggagtgaaataaaacagtttcaaaaaattatgggtctcatgatgaagatgatgacgtgtcatgatctgggagagtctagtgatataagattccacgatcttagcgtgatgggtgaagcaggtgattttaatgagccttatctctgaatctggcgctctttatggttacgttctttctttaaagttttgaaaccggcggctaaaacgatgccgttttgagttaagtttcagcatttttgactcggatcatttttttctcgggactcggatcacttaattaacaaaacttttggatttagagtaataaaatttacttatttgggtaagaatactttagtttatttaatttacggatgaaacaatacatatcacataatgaattggtgtaagtgtaactcttgaaaattatagaaaagtttacaaactaaatttagccaatttttttaaaaaagattgtctatataacccaaatgatatttgtcaaaaaattctttacaaatattatattacagagctgattacaatgagatagaataaaattgtaattataatcacaattatcaaaacaccttcattgtagtagaggttaactatcactccgggttattgcgacgtcgtttaggcttggatctgacgatctatgtgatctaaaaccctaagcaaggaggtccccattttcgtcaccggagagggaggattaatg

SEQ ID NO: 1063 - DNA, 3000 bp, Unknown
  misc_feature (1)..( 3000): cDNA_ID_2045428_gDNA_ID_1620354_Annot_ID_154430 3000 nt of promoter + ATG
tttcagttcaggagaattttgaagcaaaagacactaatggctcaaaccaatttacatcaaagagacatattttgcactctataagctgtgagaagttaatggcgtggcaacacggaatatgcaatgaacacaacaacacgtaagtaactgttggaaatgtaaatcataacaataaataaataaagtataaataaaagtgaggtgaaaagtaccgttgcaacgcttagacgtatctcgagatatctgactgaggaaagagatctcataaatttgtcatcagggtaactataaacgtagataactgctttatcaaagctaggtttgttctcaatcgagcacgagtttgtagaataatctgcgatgaagaatttctttaaaatcttagaatctatggccaaagatcttccaatatcttcctcgtcaagtacttttgctttccgataaaaatatattaaagtctctaaagatggaacttttacactaaactttgtcacattgtcttgctcatgttgcaacacatacaaatattcgagaataggacaactcgataagagcctaacaacataatcatcatctttgtataccacaaagacaaggagaagacgtttgagaggtgggaggcataccggagaagaaacatctacaaaaaccttgttggaaagatggagatatatacacaagcgtttcacatgtataaaggcttttgggcaagctagtaggttctgcggaccacatgagctggaacgctagtttacgaaccctgcgatcaaccgcatttccaatccactttcccacgttagcattaacaggacaatgtggaccgagttttatagtcaatctttctaatataggtgccttgtggagtcgcaatgactcgttaagaaaccactaaatagactgttgtcgtcgctcactttctccaaataaacggtctagatttttttttttggtgaccaaaatctttgatatctatgtacttcagctacggcaccatcgtccaaataaactgccatctttttgacaaaatcatggtagccactgcagcctttgttggaaccaataacaaaatccgcacgagcaaatcgtccggcaatgcactgatcctatcttcacctccttcatctctccgatagcttatggctcttttcttcacaaattgtggggcactagatattaatttttgtcccaaccatatcaagccgagtataatcaaaagcgttcctaacatatttgtctcgatgaaaactagaacaatactttagggtttcattattttctgcttgtattagacggcatggtaactaggtatgattctctttccttgtttcgtattgtttaccatttttttttaaaatttttattttatattttcagtttcatctagatatggtttgattgatataggaactattattttgatttttgcggcgattaatcttctaacgaaagacgctggtaaatgataattgattttatatagaaaggtatgtggttgaattgtttctagagcttaatattttaaaagaatctatgatttcaagtgaattatattttttaaacatagaaatattaaatagaattttcgtttttgttagtctggtataaataggaagatgcacgataatttaaatttaagcaatgttcctacaaatgtgtttgctttggttcaaatttaaggataatagatagattagcatataaaatactacacaaagttataaaagtcgaccgttggaccgataatgcaaatttaataacaacaaaacgcgtacagtgtctattttaagtccaccaggttccgttgtaccaatacaaaattatatctccatataacaattggcagtattagtaaatccaatagaccaataccatctcacatgaataatcaattttctcaagcattgccccaaaattagaatctttcaaataacccaactattaaaagttaacaaagtatacatttttttggtcttcttacgaatttataaaactgttaacaatgtttcaagttgtattattttataatatgctctaagttaactgggacaaatttgcttccacggttgtttccggtttgatttctacttttttactttataaaacacacaataaaaccagatatggcggaacatttgtgacgtggcttttgtgatttgttcacaatgccgtaggcgcatattagcattagcatcgcgtcttcatttgaaaatgcctgtggttaactgacgtgtcgtcgggataaagtccaaagtattttacaaattgagtattctagtctttcaagctcacgttttaccccctattgctcttgtttatgatattacgatccgtatttgtttgaatatcttgtaaatttccttttcggtaattttttggtttagatttaaaaattaatagaattatagaatataaaccaaaaaattaccgaaaagattaccgaaattaccgaatttgttttatagattataaaccaaaaaataaattatagattatagatggtttataatctataattattgaaaatttgtttttaaaataaaataatatatttgttagtgtagttgtctacgattacgatgtttgcgtccaaccaccccaaaaacaaaatcattcaaatgaatttccattacatattattatttttatttttaaatatatctaaattacaattggaaaattaagatctaaacgttttttgttagtgttaaaacaaactatcatatcattgattcttacaatctaatactattcaaaaaaatatattctctttttcatttatctcatttgctttgtctttttacgcatataaattttgatgtcaagttgggatcttcaaaaaaaacttaagggcaatttctgtaaatttataatatggagggattaaaatttaaaaagtcgccggaaacaacaaaattcgatcgagattcaattaaaaggggaaaaaaatcgaaaaggaaacaaaaaaaccattgaagaagatcggaggcgacgacggtgatg

SEQ ID NO: 1064 - DNA, 3000 bp, Unknown
  misc_feature (1)..( 3000): cDNA_ID_3060419_gDNA_ID_1620354_Annot_ID_154428 3000 nt of promoter + ATG
tctttgattgtttttggtgtgagcgaagatgggaagatcgaattctcaatgcccatctcattggattctcctctgcttcttcatctcttctcagttttggggattctcacttcccacttcgataattcaacaaaatctcgaggtgaaatttttagggtttttcagcaatttcaactgtaaatttcgtgtagaagaatgtctgtatcactttagggtttgtaatcgatttggcttacttgggatttacttagaattctagattttgttcaaattttgaagctttgtggttgttgttctacagggttttaaagatcctgaagacggttttcatgagattcattgttcaagagaacgtagcagagttgcttggaaaatcattcaagaggtatgaattgaaagcagtggtttttattattttttatgcaaatctgtagagttttctcattgatctttgttgttgctgtgaagtatctcatgccgtatgtggaaaaggagcggtatcagttaccgagtacttgtagagttcatcgagacaatgacatttatagagaacaagaagagcacaaattgcgttcagatattaatgagtggcgttgtggattctgcaaaaaggctttttatgaagagaagtatctcgataagcatttcgattcgcgccattacaatttacttaatgcggtatatactgatgcattattgttaaaatgatccatctttctgtgacaattcatactgttttggggtctattagcgattcataacttatgtgcttttgaatccagagtcatggtaaatgtctgtcggatctttgtggagcgttgcattgtgatcttgttgtagacacagctcggcttaagtccaagtgtaatcctgcagctgctgcaaaaaaccggcacttatgtgaggtacatatttttttagttttgattcggtcaatatcatatgacaagtttggactctaatactcaaagaaaccttgtagcttctgagaattgcaaagaacatttcactgaaagatttgaacacttctgaacatattgtcttcgttctgtttcttgtgttcccgtgcttatctgctctggtgtggttgcattgcagagtttggctaatagttgttttccggtaaataaaggttcatcagccaaccgtcttcacggtattagaaccttcctgaattttactatcttatttcaacagtttttgcttgtattgatccataaagattcaccactacttttggggtttaaactttacaattgtagacttcttcgtggggggttttaatgatccatagagattcaccacccttttttgggggttttaacttttaaaactgcagatttcttcttgcgtcagttctgcgatgcacatacatgttcaggaggatcaaagcccttatctcaaaaaccaaaggtaacataataaaccctttttttgtaaatgatattatatcatatcatatctcatttaatctcagtcatatgttttgcagaagaggagtatagtgtacattattttctccatcatcgttttggtagtgcttcttctctattacagctttgtctatttgttccgaaggtaacaacaacattaaaatactgtttcagatttccttacaactctaaaaccgaaaaaggccctcatgaactcattgttcttacgttttactaatctgtagaggattaaagagaagatctcaagatttgaagcgtattagacacaatggtctgaagaagaaacccttctaaccatatcaagctttagctttaatggcggctgagagagagtacattttttttctttgcaagatgattacaattaggatcagattagtgcattttgcaacatcccttacaattatatcactacttacaccaatattgttacttagaattcaatagtgtttactgcaactagagcggtacaatcgcatttaacatttctaaaacatttcaaaggttcaacttaatttcatttttcatatttgttagtatcattcttaattatttggtttagacttttgagtcttgatcaaccatgattatctcgatcattttatcaattgggccgtttgatgaaaggccttttgggccaaattacaaaacagatatctttggaagaaccaaaacgacaacgtgggatagacgttagagatgacgtgaagaaaaaaaaggagataagtggaacctactttttcccagtataagtccaatatcactcaaagtcaggacactaatcgaatcatagcctcgtctctttcaatctcaacttcaacgataaacaaaaaaacaaagtggataaattcaaagcacttaaaataggtaaataaataatgacgtgaaatataacaagcaaggtatcctaacttttcttttgctttttttcttcttttgggcaaatctcatacatgttcctgcatattttaaacactcttcgaatgttttatcgaaaaattaaaaacattcttaattaggatgaaaattactacgacagatcacactatacggtactataacgtggataattactacatagtattgtattattgagcttgtataagtatttgtgacaataataccaaagagttttagatattttattggtttttctaaggaaatacagatagataaacctgtcgaaccggttgatttagcacaataagcggtcatgaaacgtcttctacatcaaagttcgtaaatttccatgaaacgtctttgagcaccgaggaagaaagtttaaaattcctaaagaaacacacaaattaaaaaaggcaaaacctaaaccccatatttatttgtctttttttctttatcagagaattttaaaaaggtaaaaatagattatattctattccttcagaaaatttttatcgtcctaaaatcttcgtagcctgcaacaaagaaagactaagaaagaactaaaatattttgcttcgtctaattacttttttcctttggatttaattctcagccatcgccgccgttttcggcggtgtaaaaa

SEQ ID NO: 1065 - DNA, 3000 bp, Unknown
  misc_feature (1)..( 3000): cDNA_ID_3060411_gDNA_ID_1620354_Annot_ID_154421 3000 nt of promoter + ATG
ttttcttttatggatgatcttcgaacatctactgcgaaccgtcactattatgaaataaggtcttcagaaaatttcagtaaattgtgtgtattgattacttaacagtgctttcttacagttttcacttatatttctcaggttacttcaaattccaggtgctgtgattgttgcggttctcggaattcttgttgatttcccagtgatttcactcttagcattgtgtaaaagcccgtacatgttgttcaaagggtggcaccgtttgtttcatgatctcattggacgtgaaggtcctttcttggaaacaatgtgtgtcccaatcgctggccttgtgatcttactctggcctttagctgttgttggagcagttttaggatccgtggtctctagtgtcttccttggtgcttatggcggtgtagtctcatatcaggttattaaacaatgacttttttttttgaggaaaatgtgaatgctgatgatactgaattggtttctcttgtcataacacaggagtcatcgttcttcttcggtctctgctatgttgttgcttctgtttctatttacgatgagtatagcaacgatgttcttgatatgcctgaaggttcttgctttcccaggtttgtctccattggcttatctagcaatctttacctctctctctttcttttcattctaaaacagtggttttatggttttgtaacaggccaatatatcgaagaaacgaagagggcgctagtacggcattttctggtggtctttcaagaccgaactccttcaagacaactccatcaagaggaggatcaaacaaaggcccaatgattgacctgaaaccgcttgatgtactcactagtcacactcttcttttggttatctttgtatttaaacctgaagcctattcttttgatctttgcagcttttggaggctctatttgtggaatgtaggcggcacggagagattatggtaacgaaagggattataaattcaaaagacattgaagaagctaaatctagcaaaggcagtcaagtgatcagctttggcttacctgcttattctcttcttcacgagcttttacgctctatcaaatctaactccaccggtttattactcggtatgtttcaacagttttctgtcaattttcataaccgcattatctagtaactatttgaacatcatcaagaaacaaacaaaaccgtttctgtgtttttgtttaggtgacggtgtaacggagataactaccagaaaccgcccaaaagatgcgttttttgattggtttctgaatccgtttttgatccttaaagaccagatcgaagctgcaaacctatccgaggaagaagaagagtatcttggtaaattggtattactctttggagattcagagagacttaaaagctccattgttgaatctgaatctcctcctctaactgaactcagaaaagccgaacttgatgcctttgctcgcaggtaaaaaaggcaaaaaaaaaaacacacacaatcttgttacggctttctacttcggattctaagatgtgtttttggttttggttaggcttcaaggattaaccaaatcagtatcaagatatccaacattcagaagacattttgtggaactagtcaagaaactatcaaatgatctagacaataaacataaccgttttgaaggcggttcgagatcagttccacgtcccgggaaaacggtgtctcggattttcagccaaaaatcgttcaagaaaaagacaagtagcaatgggtcagatcaagattcaccaaacagagggttaagagacattgatattgtgtaagtaaatgttatgcgaccagaattagaccgaaacttcgtctgcttttagctctgtaatgataaatttatacagattccaagtgaatatgaaactgtttcatttatctaacaaatgttttacattcagcttttgcttgatgatgtgttgtttctcagaaacagcagaaccgtttcttctgcaatagaaatagcaagcttttagtttttctttcactttagacctcatttgatctaaaacataacaaacataggctgatgttttcgttagtcataaaatcttgagcaattgggattagaaatgttaccgtaggttcatcttgagatttgttattgtcacggcgttgtgaggcggcacgaccacttgcgtttgtctttttgtcgtctcgagctttagcgaatataaccgtaaatccttcggctgatgctggatcgttcacgtcccattctccaaattttggtaatggtcgatcttgttgttgtcgttgttgattattctgaaagtttccaatcacaaaaatgtttgatttctattataatccaacgaaaacacacatgaaaatgctattttttgtatcaaatttgtgaaacaaatgagaaagaaatgagaaagatcttaccgatgccattcaaagattgtgtaaaagatgcaaacagaacatgagatgatctttcttcaaacaacaagaaaacttgtttgtcttctcttttagtttttgttttcttaaaagaatttgattacgtttaaagaattagaatttgagaacagattagcgttttctgaaagtttaaatataggttaacgttttaattattgttgaaacttgaaaacagaaaacaccaatcttttgtagcgaaacggaacgctttttctcgtaccgtcttttgttttcgagtgaacttcatcgtatcaaaactcgccacgtgatctacacacttctcgaggcgaacacgcgcatttcagaacttatccattaatctctgtgattaacctataagccggtatttataaacggtcacgattttccaagttttttaatcaacggtcgttattacgtagacgaagctaagcctcacatctacaaatacgtatacatacatttttacataataattaattaataattacaggttattaacaaattaatcatttttaatagactattaaaaaaacaatttcatttcatttgctctcttctccgagaaa

SEQ ID NO: 1066 - DNA, 3000 bp, Unknown
  misc_feature (1)..( 3000): cDNA_ID_2045517_gDNA_ID_1620354_Annot_ID_154406 3000 nt of promoter + ATG
ctatcgagacgacaccgaagaatcaaaacgagaaaaagaatcaaagagataccaaaaaccaacaacatggaggttcttcagctccatcgaaacgacctaaaccttccaatttcctcgatgcggttcgttcgttatctctctctttctatcgagtacatttgattgaagtttatggagattttgatcaattcatacgaaaaatcgcagcttagagagagattatctggtgggcaatttaggatgctcaatgagaaactctacacttgctcgtaagttctaatttcattctttccgatgatcttccttcagttttcacagtgcttaattcaaaaatctctgctttctcagtggaaaagaagctttagactactttaaagaagatccacaaatgtttgatatggtaaacatacattaactcgagaacaagaacttatgttgttgattcttttagttgaattgtaaaattgattctgttttgttattagtatcatacagggtatcaacaacaaatgtcaaattggcctgagcttcctgttaactccattattaattggctattgtctaatagctcttctttagttgtggctgattttggctgtggtgagaatttcttatcctgtattgctatatcttactttttgcctgctgaaattgtatcactctatcgacactaatattgtctcaggtgatgcaaggattgctaaaagtgtgaagaacaaagttttctcctttgatcttgtctcaaagaacccctctgttattgcctgcgatatgtcaaatgtacgttgaatctttactccattcatgttaatttcatgatttctttgttccctcagacttaactggtatttttggggtttactttgtagacttcacttgagtcttcatcagtggatgttgcagttttctgtctttcattaatgggaacaaactattctagttatatcaaagaagcacatcgagttcttcgtccaaggtacagctttgtttacttgccaatctcttcttgttcatgggattttgtcatgattctgaataatacttcctatggttttattgtattccacagtggtatgcttcttatagcggaagtaaagagcaggtttgatccaaacaatggaggagcagacccaaaagactttgtgaaagccgtttgtgatcttggatttacttcggttttaaaggtgcaatcttttcttcttctttttttcatttccactataagaaagaaactcatttggttctttgagcaggacttctccaataagatgttcatcttattccatttcaagaaaaaggttagtgaaacatacttcctttcaggtttgttattagtctcgtagcttagatctacactttgtttagcaataatccttcttttaatcgtgtggttatataggagcagatgaattcaaatcagaagataataaagtggcctgagttaaaagcttgtttatacaaacgtcgatgatgagtttacaatggaagattactcagaatactatttttgttctccactgttgtatcatttaggcacattgattgtcctcaaaatctcataaatttgcaccctataaacttttgtaagagaaaagcaatcacaaagatttttcaagtgtttagatacagattttcagatttttgtcaacatagtgttcaggtaaagtgagatttaggccgtgaatcatgaatggtgtggtgacgcattcccctaccctctgcaactgcattttttaagttttaactagtcattcaagtttctaccaaaatttaagttcaaagtgtaaagtaattataacaagtatagcctaattcgaattacaaagatcacaacacaccctcatttgtaaccatgaatcccttacggctttacctttcactattctaaaagatcgctcgtaatcatcttgttgttacacaatacaacattcagtctctcactttctattctggcctctgggaaaccaaaaccacattgattgaaaatctctaaacttttgcaaaacacttctttcatttatggagagatgcataagcaaaaaaatcccttacctctacaaagttagaccaaatgttaagttagaccaaatgtttttcttgttttgttacagatgatatgatctcacttcacttataaaagtacaaaaaggactgatcttgtagtaaaaaggttcacctttctcaccccaccgacattattaatttcttttgtttttgttttctggtccacgatctttaaattcatgcacatttttttgtccttttgtcaattaataaaaacagtgttgttcgttaaagattgataaaagattttgtttccttcttcctactatcgtcttgtttattaaaaaaaaaaagacaaatatttttgtttcactgctcctatcttcacattccaggagacttcctttcaaaattttcttaattataattattcacaagtttgactttttctgttcaaatttggtttaagtcggaattgtaaatcgatttacagttctataaattttgccgaccaaaaaaggcaaaacaaaacagagaaagagaaggataaagagacatgagatttcctgtcactttacttacgcggacatagcaaacatctttttgatcattcagagttttttttgtcctattaccacttcaaatccaaaaacaaaagtttataaatttatttccctcaaagtaccacttaatcatcgactttttgaccatttctccatctgggttttattatcttcagttctttgtgtcacaactccagtttctttttgtattttgttgtttttttcacaaattgagattgttgtttcctataaggttttgttttattctatttatggaagtctcttgatttcgcttttataacctcaaaaagcatctttcttgatagcaccaagtatgatttgatcatcaaaagggtttggatttgacaggtctctattttaggtttgtttttggttagaagttaaaaccaaaataaaatcttaacttttggaa

SEQ ID NO: 1067 - DNA, 3000 bp, Unknown
  misc_feature (1)..( 3000): cDNA_ID_2045471_gDNA_ID_1620354_Annot_ID_154419 3000 nt of promoter + ATG
gaatcacgcgataggtcacaaaaaatattaagcagagtacaagagttactaatgcaagcacgttatgcatgactaactattgtatgtaaaagaataaaatctgcttatatgtaaaagagattatttggtacttgtttagttgtttaagtcgtcgtgagcatatagcatcgtttagtctattataatttaattgtaactgcggaaaaattaaaagtaaaagagatataaataaagttatcaaaacttatcaagtagttagtgggttctttatttgtcaacacacgaaaaatcaaatttgcttggaatggttgatattagattaaaatctctaaaaatactcaaaagtaattccaaatatgaaacatagaacactaacgtccgatgtcaaccacttaacactaaaacaaagttgattaaataagctgaggtctcacgttaagtaatttaacaatggcataggaaataaagagtacacaacataagctatttctcattgcacaaataactttgaatgtattctattaaatatcgtttggaacacaaggttgattctcggacaatttccaaaaaatttgctcatgtgatcttgctcttttctcgctataccagttcatggtaatgtttctattagatagtgactagtcggcgtagtagtttgaagtttcaacaaattataagtttagacataggcccaatcttctctcgctaccagttcatggtaatgtttcaacaaattatatataagtttgatttgaagtttgttgtcttcaagtttttgttccgtactgattgggccaatgtctaaagtacactaggccgtccaaaagagtctgaaattttattataacttagacacatttcatatgggcttcgtatcttggagaatcatgagttgatcgtgatgccgtcgaaatttgaagactttggccggctttctccatcaatttggtcggacttttatatttgagagttaagtttactttgtctttataattttttttttcgtaaactatatcatttctgcttgtctatgtaatttatgacaagttgatttcaacaagaaacaaaagttaaaagttgaaaactatgatattatatatgtaaattttttcagttcttttgtttttatttaattaattttcatttctcaatttcaaattcttcatatgtatttttcctttttaatgactttaataatatatttattcccattttaaaagcgtgtctcatatgttgtttattacatttaaaataaacaattgttaataatcgtttttcttattatatatattttaattagattataagacaaataatcttatcctataaccttcaaaaaatcaaattatattatattattcaaaaaaaaaaaaatcttatacaaaaaccttcaagtcaatcgagttttatatgttggacttataagacaaataattttataacaacattcatgataccatgttaagttttatatgcttctacttaaaactaattgattataagtaaaattaacaaatcatttatacacttgtattattataggtccatcacactcctcatgtatgatttcaaacaaagtgatttttgatgagctggaggggttaaacaattttaattaaaaaatatataaaaaatactaaactttgtttgaccagtcgtaccaagttgaaccatggtctaccagttaatccaatttcaaattatgtttttgtttcaagaaaaaataatactccatctgttcttttttgtttgattgtttataaaaaaaaattgtttctaaaagattgattttttaagttttccatgtaatatttattggttagtattggtgaattgtaattttcaagaaaaatagttaattatcattggtttagaggtatagaaaactgtaaaacactaaaaataatatatttataatcaatatttaatatatttttttaatatgtatgttttttctaaacaatcaaacaaaaaagaacaaatggagtaattcagaaaccatagaagagggagcacctgtcttcgcttttgattgcttttatatttctttttcccttctttacttccgattaggttagaatgcatagagccatagattattagtcttatcacttatattatttatttttgtatataatatttacttttataaataattataaatcttatactattaaattttataaacagatttattgtaatattttccaatgataccatttaatatatagtgatgtttcatataaagttcattttaaaaatgaaaattatgtgtttagcaaaggtggcaatagcttttagaaaataaagtagaaaataatgggtttgccaactgccacataaaaaaaaaacctctcttttaatatatacttaaatgtaataaacaataagataatgataatgtgattctttaactgtcgcttagtgtcgacgttagaaaaaaagaaacactaaaaatgttcggttcatgtcgttttctccaattcctttatctcgtgcttctcttctcaatacgaggaggaggatgtgttggcccatgcgttaaacagcagcacaaaaaccgatcaccaagaaacacacccgatttatttagcagcacacgaaattgaaataatatgtaaattaaaaaatatactcttaatttattcagttttaaatgtattttttggtttagggtttatagacggtttcttaaccgtcaaatctaatgtgtgtgtgacatattcttctctctctctctctcgaatctttcgtgttgtttgctgttcaaaattgaaattttaaatattaaaaaaaaagaagaaaacttgttctgcttcttgtcgtgtccgtcacagtttgaatttctctctctctttctctcttcctcataaaaatctctgctttaccttttcttttcaaagggtttcattttgattctagggttgttctaaatgcgacattttgactgatgggtctttgttgaatttgaagagagcaaaagagaaagagattgttcta

SEQ ID NO: 1068 - DNA, 3000 bp, Unknown
  misc_feature (1)..( 3000): cDNA_ID_3060440_gDNA_ID_1620354_Annot_ID_154415 3000 nt of promoter + ATG
cgtataatcaaaacattagcacacaaatcttcacctaaaacccaatttcttagatcaacaacatcagttcatcaaattctatgccctgagggtaaatagaatcccagagaaagcctcatgcaccaagattttgaccataacaccgcattcaattttgatgtgggacactatacatccatcaatttcacaagcatcgatgaaacaatttcacagtgaggttcagatacacaaaagaaatcgaatctaccacgaaaacaaaggagaaagatagaaatcgtttagtatataagcatcgacatatgtaaattagggttaggtacaagaaaacgagacgagccacgagacgagcgatttcaaaaccaacattgtcaaaaagatcttgttctataaatagagaagtaaaggaaaggagcgagaaggacgctcaccgactatgaaatcggagaagtcgccggagattagaatcgcaccaccgggtaaaaaggaacagttaacactgcgatgaagtagaggaaacaacgattctaacggaacgggaatcgtcatcttctagaattttgatgatctttatcatacctacgaatttagactgcttgccgttttgatggctagcaataaatgaatgtatgccgtttctttaagtagacacgcactgacgcacttcacactcacacgtggtccatttaggccgttatatgcagtacatgtttttttttttttttttcatttttggtttagtcacagtacatttatgttatacccattttgatatttgtttactttatttcaaaatacatagtttgcattattcattttgtttcacatcacataaatttaatgtatagaatttatttttaattagttgcattaaaaaataatgtggaagaaagccattgttttacagaatccattctaaattaagtcctcaaaaaaactcaatatgtaatcaggtttctaattcagaatatttcaaatagtatgtgtaaaacatgtaaaagatatttccactgttttgtattttaattttgtaagttttctttatttggtaattgattgttaatatatagtaaaatgattaattagatacttcatttgaataattcaacttttaaatagatgaatacaatattgaatatacaacatgagttcgatccaaacccaccatatattaacaatcaattacccaataaacagttgaatagaaaaaaagagaaaagaaaaagtaacatctaccatatatatcattaaatcagattaatttttctctcttcgcttgtaatacgatattatttattgacaggaaagtgaatgttgaattggaatgtggaagcaaatttctcgtatgtgttttgtcaacatgttcgaaaaacttatgtgcatatggtgactacagaaaggggaggacgtgtttctctgcacatggttaacggtgacgaagctcatgctttagctgaagtggtggctccaaagctttgagatgtaggtcgtgatcatatgaaaataaatcgtgaaaaatgtattattgtgatgtaagattcttaaattcattttttttttcttttttgtcatcagattttatttacacctcaaaagagtcaattctgaggaaaattgtttacataagtgatataaagcggttcaatacgaatttttcgtgtcaatttgtgcctttacatttgcagttcgagaaattaaagataaagaaaatcttatgaattcttccttatcggtcttgaattcctccaaataagttgaaaacgctggccattcggttggggaaaacaccatcttcaccaggtctgaacagtctgtaaaaaatgctacttcttggttgtcggcaccaatcatacacttcatcgcccagaagtaaagctgttacttctgttaaattcggtttaattatgtgttaatcggatttaatcggttttaatgatctatataattatatataggttgcggtaattatttctctttaaattcttttactagtttttggcctgaattcagattgcttaagatatacttatctaacattgttaatatgaaaactaatgaatgtactcattccttgttaggtaacactttcatatatttgtatcttttgttttcgtggtgtggtaggagaataagcaacaacatttttgctagacatattcaagatttcatagaatattgaacaaaaatggttaaaagatgtaagtctacttcattcattctcacttattttattttttccccagaaaataaaaaatacatcataaattatttaacgtatttaatgaatgcgatcagcaatatcaattaagctttgaactagcggtaatagaaaatatctctttaggttgaacccgacctatgcaaatttggtggaactggtgaaaacagtggaaacatcttaaaccatccgaaattaaaagaatatagtattacaataattaatgatgaactataatattaaagaattaaaaaaaaaggtaaacaaaaaaatgaaaataagaaaaaaataaacaaaacataagcaaaacgtaattaaaaaaatagcaaacaaatgaagaaaaataattataagttcaaattcaagatcttaaaaaaaaatagatgattaattaattttaaggaatttaaattttaaaattttagatttattattttaggtttagtttttagggtttaaggattatttttttagggtttactatttagttttgaaggtttaaagttcaatacagtattaaacttgtggtattttcagaaaaaaaaacacacaaattttttaaggtattattggaacaaaaactcattaaaatggtatttatgagaatggccctgtcattaatgataacaattgttttgaaatttaattaaatcgtattatttgatcaatcgtatttttgggacaaacgtggtttacctcttctctctccttctgaagtcgccatctgaaaactcttttctcccaccgacgccggcctcacgccgtgtggtcggaaatttcttttg

SEQ ID NO: 1069 - DNA, 2076 bp, Unknown
  misc_feature (1)..( 2076): cDNA_ID_2129994_gDNA_ID_1620355_Annot_ID_154448 3000 nt of promoter + ATG
gatctgcaagttttctctatatataacttactgttttgtcactgtttctagtggtttgttcatgtctatatcctcttgtcttgtgtgctattggtttatcaatgttgagctcatcactataaatccttaagctgctctttaatcttattggaacaaaactttccggtgaagctgcaagtactttctagtttaatcttatatgttgcttgctgttacatatgggatatgaattcattgatgactatcgatttgtgaaagtatactgtcttctttataatatacttgtttctgcaagatatgttgctatgctcatcatgttgtttgttgtatgtgtctatatggcttacatacttggttcattctctgtgtgcagttggtgatttgaaccatttgatatctgccactatgtctggtgtgacttgctgtctgaggttccctggtcaactcaactctgacctccgtaagcttgctgtgaatctcatcccattccctcgtcttcacttcttcatggttggttttgctcctctcacctcaagaggttcacagcagtaccgctccctcacagtccctgagctcacccagcaaatgtgggactccaagaacatgatgtgtgctgcagacccaaggcacggacgctacctcacagcctctgccatgttccgtggcaagatgagcacaaaggaagttgacgagcagatgctgaatgttcagaacaagaactcgtcctactttgtggagtggatccccaacaacgtgaaatcaacagtctgtgatatcccacctactggtctgaagatggcttccactttcattggaaactcaacatcgatccaagagatgttcaggcgagtgagtgagcagttcacagctatgttcaggaggaaggctttcttgcattggtacacaggtgagggaatggacgagatggagttcacagaagcagagagcaacatgaacgatcttgtgtcagagtaccagcaataccaagatgcaacggctgatgaagaaggtgactacgaggatgaggaagaaggtgaataccaacaggaagaagagtactgagagtaatttagttataaaaaccgcttgaaaaaatcaatttagtcgtttgctactttttttcttaaaaaaaaaaatgagaacctcaactaccagttgcaggtttatttctatgcttgtatttgacttatctggatgatgtttatgtactttgtttttaaatttggttcggtctttagtttgaatcttcgtttaagctattattgactgtattgttcctaatctcgttaaagactttgggcttatgattgactaacctttgggcttatgattgactaacctttgggctttggatttcttcatttatttttaagagctcggcccattttcgtggtgactaaattacactcttcgagataaaacagataagaaatttacttttgatgtaataaatattgttgctacgaagtattttacttttggaaataaatagggacgacattagtgttaatactcttgtaaattttgtcagattacacattattttacagatctctcagacaaagtaaatacaaaaacgacacagtttcgtaactttcactcgcgtctcaagtacaatctctaaattactcgctttctgtgaaagacacgtgtattttgtgacttaaataacagcgagtagattttagaaccatagtcgcgagtgtttttataggcacagatatatttgaattatgtctcctcgcaacgggtcgctctctctctctcctctgcaccagtctccaagggtacagattttgaaaaaccactcctttcacttagctcgaaaagaagagggaaaaacaaaataataaaaccaaaaaaatgataaattaaagaattctttttaggaaaaacaaaagtaaagatttttcatcatgagtcttcctcctcttactcatacggtcatacccaatcactactaacctctctccattctcgaattaggtcactctatttgggttgaaaaaatctcatattttcgtctttggaaccttaagaactttctcttttggaatcggtggaatcagtgaaatg

SEQ ID NO: 1070 - DNA, 3000 bp, Unknown
  misc_feature (1)..( 3000): cDNA_ID_3060490_gDNA_ID_1620355_Annot_ID_154458 3000 nt of promoter + ATG
gagaaccgcactactactcttgattatcagagaagacgaatcagataaacagtgtgagagagagagatgatgataagaaaggaatctggatttgaatggtacccaacagatttttgtcattttttaaagatttcgctgagcatttagtaacaaggacctttttattaaggtaacgacaacttgtaagtggtaaataatccagtcttactatgttcccattttctatttgatttctttagagtattaaacagcagaatctgtatcatcaattatatagtttgtcaaatataattattattagaaatatgcattacaagggattaatggttaaggatttctctcttacaaaataaaaaagaaaaagtttatggtattcgttcgtattatgaatttttgatatgaatatcttaaattgaatatgttttgactaacatgttgtatgctgtctttttcaaaaataaaacatgttacatgttttttttttcttcttctcttttttttttttttttataaagtacatgttatatgctgtaacaattataatccaaatgtcaaacttagtttagatctttgacaagtatataatatacttttctttttaaaaattatgtattgaatatttttcactatcattcttttttttttgtcaacatttttcactatcattcttatttctttgatatgttcctcaatgttcaatttgtaaatttaaatttcaaaagccatgtaactttaaccaacttgaattttttacgtatataattctctatatctctaattagagtcatgttaggttcgattgtttaaataaaattagtcttcttgtagactattagatcatccgttcaaaaagattattgttgtttgaatggtgctctcttttctttcttcggaaaggaataaaatttatcccataaaaagaaaagaaaaagaaaaaagataatttactttatttaagtgtgattaagctgttatgattgactatcacattacatagtgttttcgtggggatacagagatcaatagataaatgataatggtaagataatggtatgttggtattggtagatgagtcagtaaatcatttactactgctaatggatcatctgaggacaagtgttgtacgttaagtgacacatggcaaaacagtgaaagagacgttaaacaagtgttacttgctgcatccactcaaattccatcccaagtcatgcatgcaactttttctttaaacatcggaaatcggagcctgaattaatgcgttaactaatggaaacaaaaaccataattacggtgtagccatctctccaattccgattccatttcaagttaaccttatcgatatggaggatagcaactctcacccgcaaaatcaaacatcaaaaagaaaaagctctcacccgcaaaagaagcaacgtatggagaatgaaacacgatcggctaagttgttggatcttgatgttcttgactgtccggtttgcttcgagccgctcactattcctacctttcaggttatgttttgaacttgcatgcattttattttgtttcatgtgacattttgatttcgcttttgttaatttattttattgaatacggctttgattgtatctcgtttggtatattatgcgtttcagtgtgatgatggacatatagtttgcaatttttgctttgccaaagtgagtaacaagtgccctggtcctgggtgtgatttacccattggtaataagcgatgcttcgcaatggagagggttctcgaatcagcctttgttccatgtcaaaatactgagtttggctgcacaaaaagtgtctcttatgaaaaagtgtcaagtcacgaaaaggaatgcaactactctcaatgctcttgccctaacctcgaatgcaattacactggctcatataacatcatctacggtcactttatgcgtcgccatctttacaatagtacgatcgtttcctccaaatggggatattccactgttgatgttctaataaacatcaaagaaaaggtttcagttctctgggaatctcgtcagaaacttttgtttgtagttcagtgtttcaaggagcgacatggtgtttatgttactgttagacgcatcgcaccacctgcttcagaattcaagaagttctcgtatcgtctttcgtatagtatcgacggacataatgttacttacgaatcaccagaagtaaagaggcttcttgaagtgaattctcaaatccctgatgacagtttcatgtttgtccctaactgtttactgcatggtgaaatgttggagttgaagcttggcatcaagaagttgaaacaaacgtaactagatctagtttggtttggggttacgaggcgttctgttttgttgtgtttgttttaattctctgtttaagaacctttgtacttttgtagtagcccactcttgaatttattgatgttgttgttttgagttagttgtataatccaaaagctttctggtttggttcccggttcggttttgtacatagtaggatttttaataaagcctgctaatgaggttcagcaagttaccattgctcaggaaactgttatggaggatcctccaacgtctctgtttaagaattcagtaccaattcgagaggatcaaattcagaacgctatcacaaattccattcgctaatcttagaattgggcataaattctggaataatgggctcatttggtattagcgtccatacacattgtaggcccaataaaataatagaccaagaaaaaactaaaaaccggacaacgccgttatctcttcttcgtgtgaccaccacacatacatacataccactcaccgtaccaaaaagattagaccaacaaaaaaaaaaaaaaaaggaccagctcagatgagtctggagtttccaagtttaaaacctctctacctcgatttgagcaaatcctgatttactctcatcctcatcatctctcatcatcgagattcatagtctcttttgccgcttggattcttccaaggttagtgagctgct

SEQ ID NO: 1071 - DNA, 3000 bp, Unknown
  misc_feature (1)..( 3000): cDNA_ID_1010577_gDNA_ID_1620355_Annot_ID_154461 3000 nt of promoter + ATG
gatcgtgaggtcttcttctcttggcgtcctctcttcatggtgtcagttttctatttcattaaacttgaacgaagaaaaacacatatatatttttggtttttgacattttttgggggtttatgacatttgtttttttggatattttctatatattggcaatacaaaagagtttataagctaagcagcccagtttcatgtcccattaggttttagatctcaagtcttaaccgacctacatttaaagggaaaacattaagaaacaatgagagattaatttagtattttcgattgatgcgcctcacactgaaacctgaggcttgtgtgttctgtttctcttcatcttgattcaattcgtttgcagtttcgtagcttgatgagaaaggaatattaagtgattcatatatagcaaagtgtttacatagtaaacctaaaaagagagtaaaactaaaatctcttctctttattcatcaatacaagttgctattaacaaagtttttggttacagcacatattcacttgctttgtattattgtatatactatacaagatgctctacacaacatttactatgacatgaatatgagacaacaaactctttatacataatgaagatgtagtaatagtaaatgtaattatgtttgagaaagagaaagagagagagagagagagacagaggtattaatgtgagtgaagagccgggtgtttctcatgcatggggtacgagcggagtcaacggcttcatggctcaaatttgaaaccacgtgtcatgcgtttgttactctacccagattctgctgattcacagactcactattaaaatccactttttcttttttctctgttcataaagcagaaaccaaaaataatccaaatatcaaaaaaccaaaaacagaacctagaaaccacaccaaaaaaaaaaaagctatttcatcaaacaaacaaaactcacatcacaaatcagaaacaaacaaaaaagaaacgcagtactaaagaaaaaaattataaacaagaatcatcgaaaagaagaatcgaaatcatcaacatattttgtttctcttcttcttttatttttataaaatataaattagttctttgataaaatctgtagaagataaagaattcttctttagaaacaaagaaaaatgacggacccccacaccgcccggacgatcgtcggaatcgttggtaagtcctccacaatttactcaaacataaagtttaattcaatcaacaacaaaaacatttgctcatgtctttgtttgtctgttatatgtttaggaaacgtgatttctttcggcttgttctgcgctccaatgtaagcacacatgatgattaaatctttttttgttttgttgcatgcaatgacatatgtgaaaattgtgcagaccaacgatggtgaagatatggaagatgaaatcggtctccgagtttaagccagatccatacgtagctacggttttaaactgcatgatgtggacattttacggacttcctttcgtccagcccgacagtctcctcgtcatcaccattaatggaactggtcttttcatggaactcgtttacgtcaccatcttctttgtcttcgctacctcccctgtccgcgtaagcctttaaaacctctaatttcaacacgaatgataaaaatatgtatatgcattctaaattattcaatttatataaacttttcagacataggtttgatagcctttaaaccaattgaaaattagtgaattagtggttgatgtttgttttagtttgttacttcaaatgtagatcgatatagattttgatatgtgaagttatgatatatatatatgtgtacagagaaagatcacaatagctatggttatcgaggtaatattcatggcggtggtgatcttctgcacaatgtattttttgcatacaacaaagcagagatcaatgcttattgggatcttgtgcattgttttcaacgtcatcatgtatgctgctcctctcaccgtcatggtatgatgcctcttctttctaaactaatcacggaaatgcaaaaattggatactacactatcaacttttttcttttgttctctttatctcgtgaatttccatttaatgagtttagttataatgtggaacagaaacttgtgataaagacaaagagcgtgaaatacatgccgttcttcctatcattagccaacttcatgaacggtgtcgtttgggtcatttatgcatgtcttaaatttgacccttatattttggtaaaccctcatatatatctttattgtttggaactcaaatccctacatctcaaaaaggactaattatcttccatgcatgaaaacagattccaaatggtcttggatcgctatcaggaataatccagcttataatatacataacttactataaaacaactaactggaacgatgacgatgaagataaagaaaagcgctattcgaatgctggaatcgaacttggccaggcttgatagtttcagctatttcatcgtctacggtgcttcatcgataggttaagatagaatcagaagtgaggtgaagttcttattactattattttgtgtaagcctatgtagaaaaaaaatgaacaagtggaacccttaagttatgaagtttcttgtgtatgaagaaatgggttttcagtttttttttttggaaatgattgtaactttcgcaagttgaatctatgtacgttgttacaattttagttttaatcgaagtttattagattacttttataacattttcttttttggaaactgtaaggaaagaaacaaatttgtcctcttaagagcagagtaataaacagagtttctctcttgttttaggttttttttttggtcctgaccggttaagaatatttccgagaaagttaccggtttagctgattcgattttaaaaacgaacccataatctaaaccggaatgtgcgattcacaattgtggttttgtaaccttaaaacacggaggaccagagataccgtttgagatgacgattgaattatg

SEQ ID NO: 1072 - DNA, 3000 bp, Unknown
  misc_feature (1)..( 3000): cDNA_ID_3594244_gDNA_ID_1620355_Annot_ID_154467 3000 nt of promoter + ATG
ggaattatgtgggggaaaaagtaaagaatggcacatgaagagagttttgcgtaattcccaaaagtaaagccagaaagatttttctcccaccccatgtgcttactctccccagtccccactttttcttaattaaattcatatttcttccatttttatttttcggcttttaatttcttagcatacttttaaaaaaaaaatattgtcacactttttaggccgattttgactgagttacacaggtcaataatgctcccaattcggcggactatagttattttagtggacatttgtgttaactaattttgtggcaaaaagaaactcggaacaaattaaaccataactgatttagactaaattatataatgtaatggccattatgtattaactaaagacaaaagtaatactacgatctacgataatacaaaaaaaaaattcagaatatcgcgtcattatcaacttgacaccaacttgtgagtctcccaaactcaatgattatgtggtcattatcggtggtgtttttaaaaaatactatgaaaactcgctctcactaatatcaagtggcttacacacttgattgactaatcaatagtttatcactactactataatgtttcaggctagattttccatcacgtgccaaaaaattccttcaaacaatttagcaagctaaccatcaaatttaattacgaatttttttctttcatatccacgtggcggatattcaaacttaattatgtgtaacatatgaatgacgtaaataatctatgcacatctcgttttactgttgtgtgttgctttaaaggctatcatggataacgtgtgtatatgaccttcgagaaaattttgaagagatccattcaacaaaacatgcatgacattttgaatatatcccaattattaaagactcaataattttcagaagtatattttgggtataaacaggtaaccgtacgtgttgctacacttgctattgtccatctataatgtgaaaaatatcaatttaaacattactgtttttatgtagtttttagttcatgtagtatttgattatctggagaagaagaaaaaaagatgataaataaaaaaattgtcggcaatagaaaactgagtttaggtcaaaatagttatgtactatagttattaccgacgtaaacactgataaattgaaaacgatgcatcactggtttttgacaaaatgtcgaattagaacaaacatgactcagtgtattagaaagtcaaaatatacacatttcctcttgaatagtagtattagcttgataactttgtttatcttaatgaaatcgtattaaagaagtttagtgccgagattaaatctcgagtcctatcactctatcaggcactagaatatataatgtcccactaaattcgataacaaattatctttaaagttaaagtatctttataattgtttttatatatggatcacgggactacaagaaaaaaagtagacgtgacaattatcttttctgtgtttttttctcgttatctctagttttgtttgatgcgtatgtatataatttggacaatactataataaagtatgcttaataagattctccaatcgtttttatattattcttaatataaaatcaaaagagattgatgatttcaaatgatgcctacaaagaataacatccgtgtcgttaatagaattcacaaggaatttatatattctaatgtacattcgacttgaaatcaaaatcatatggacattaaacaaaaaaaaaaaaactagaaaaggattaaaaagagtaaagtaaaattttgatggttcgaaattagaccaaagcgtatgaaacatcatcttttgagtaccatatattttgcaacttcaactaattaagagtgtagtataagctgggagttttggaactcaaacatcataatccattccatcatctctaaacttgggaaaaaatcccacagctaccgtattatatttgggaaatcgtataaaccaaaataagaaagttgttaattttttttaactataattaacccgacacttagaaatgtgtatcaaaaaagtaatgcaagaattatcattgacaagtttcaacaacagaattattgaaagatttactttatttgaacaaatctcactattaactttgtttttgtcaagcctctagagataggttaaaactttaacaaactttacttaacaagaaaagactatgacttttcaaaatgcaataaaaatactttaaagaagaaaagattcctctcgtctcttcctttgttcacatcactttcatctttattttctttattaattaatcatttattactcctctttcaaaaacaaacattttttatttataaaaaattcatacggcgctaatttcaccaccgctcttcctaattgattcttcaaaatccatgattactattgacccccaaacaaaaataatataaatctgatactatttggttagctttaagcatataattctcatctataactccaatcaccaaatcaagaaccgcctttagttaataaattgttcattaattttgctaacaacaatatttgtccacattacacgttccattcataaaaaaattgactccaatattaattgtatttttttacacctcgagttttgcagaaaaataaataaaagctcacatttttattttctccctctctctctctctgtgtctgtgtatgtgtggctttaccttttgtacctaaacctctcacactctctctctctggcttgctgtttactctcatcgtctcctttacttcattcgtcttcttcctctctttcccacaagctcccattgatgtgagtttcttatcacttttctttttccgatttgtcaattccttttttgcactgatttgtgcttcgcttacacattgctagtagattccccgatctgggttttttcttattcgtgttcatcatactaaagtttggtgcttttttgtgtttgtgtagatagagagagagatttaaggaaggaatc

SEQ ID NO: 1073 - DNA, 3000 bp, Unknown
  misc_feature (1)..( 3000): cDNA_ID_3409111_gDNA_ID_1620355_Annot_ID_154471 3000 nt of promoter + ATG
cctgtccttgtggatttcggctctgtctgttctgccacaagaccatttgcgatggagatgggcgttgtccaggctgcaggaaaccctatgaacggaatatggtcaaggctgagactagtattcaaggtggtggtctaacaattcggttggctcgttcgtctagcatgttttgcaagttttaaaaggagaggtgcggttttctcaaccatgttgtcttttggaactcgagaacttaagctctgttttctatgtcatctatggttctaagtctgaaacactgtggtgatgatgtagaatgtgatgtgtgaatacataaaaggtggtacagaaaatgattcaaatacatttagatagtttcaataatgaatgctatgttctcttttctaattccatatgtttggtctgcatttattccttgtcaaacattattgaaggtttaagagttattttgttgctatggtgaatcctcttgacaagttactcatgaaccaaagcttgttttttagaatcaccattcaccagagatcaactctcattacttcaaattcttttaggaaacttctgattgtttatgattagctaacaaaatcatttattcacataaagtgaggcttcttaacaacttctattaagccagcttacaaatctcttgtaaggaaaaaagctatgacccctctaatgaatataatatataatatagcttttgctcatctctataccatttacattactactatatgaataaacccactgaattcaatcagcgaaaaaggccataggggttggaaaattgtataggtcattaagctggcgagaatcatcagtgtaggctcaagtgcattgagtcttgaagcttctgtatatgaaaaggctttttctaagatccagtcacggaatttgcatcggagagctcagatctttgcgcgtttgagctgcgagtgaacagggtagacattctctgtttctagctctctcttctgaatactctttgtgaaagacaaatcttcaaccttcattagagaatctcttaatctttttacatccgagagttttaccggcttcagtaagaaatcttcagccccttcttcaagacatctgaatgacaaaataataatcacaagaaaatcagtttgagtaaactccaatttcaataaagttgatgatagctttggatcaataagttttttttttgttgtatatgtagcaaacaatcataaaatggccagttcgtaattgagttggccattgtgtgtaacacaaatacatattcctttttattttatttggtctagaggtttcctaatattgtatgcaaagtgaaaaagcatgtgaggtggctttcacaataccctaccaaatattaggcaagcaagatcatgtacttattttattgtaatatcacatcaccagaaatagaatcaaatcccaaagtaaagattttgctggttagaaacatctttatacacaaaatcatcttgggacccattaaagatcaccaaatctcaacatttgtttaattatgcaatatccaccaccaaaaatggtttaaggaaattaacttttaaccatatgagcaggaactttactttgtgatctaatccctttttgttttatctaattctttttttgatcatctaagacaaagatattcaccaaatttactatagtttgacttaagattatgatgaagttttatacctatcaatacgaggcaaaatgttctcggaggacataattaccaccggtacttctctaaaagctgaggattcctgtggaaaatcacgtaaaaaaggattagataaacataaaactcaaattccattgactaattatatcattatatgtttgtttgcttactttgatcttcttcaagagttcatatccagtcataccgggcattgagtaatcagtcataattaaattaaccttcaaatcctgaagcacaaatcacgatttaacatattgcttgagagctacggcaaaattttgttttctcttggaaattgttttatacctcaaaaccgactgatttttcctcaacatccaaaccaaggtattggagagctcttgttgcactatcaacaacagtaactgaacaaccaaaacagagctttttactcagataacttgcccgaattcagagactgatttttcaaaatatgagtaataattacctttgcaagaagatactctgagcaaacgctcgatgaatttacgatcaacgtgactgtcgtcgacggcaagaacatgaagaggatccggtgatccaaactttgaagaatggttgagaatctccatcttcctcggtagcataacttcagccattgatcaacgaatgttggaggatttggaagaaaaaggaagagaaagatatgatgtgaaaccatggtggcagtggttgggccatttatataagtagaaagaaagaaagaaagaaataaaagagggaaaaaatatgaatgaaatcgagagattttgcatatctttaagattttgtcaatttgctttcaaaatctttattttatattttatataaataatagttcggtggatttttattattaaataagttaaaacaaaaaaccgaaataaagtcaaaccaatcggttcaagtttagtcaaaacgaagaacaaaccagaaaatttggaatgggatgcaagatttaaccgacccaaaccgatattcaataacttgtagaattctttttttatttttaaattatttgtgtgtgtttgtagttttttttggtaaaagtgtgtttgtagttgaattgtggaagttcacgcatttaacttctacacttcaatacttcatctacgtagaagttcactttgaggttttgacttaagctcaagacagaaaaatgtgaaatcaagaaatcataaactaatactaaaacattacacgcatccttaatctacaattagtaaaacctctttagattaccaccttttcattcaccaaaaatataacaaattaatactaaaggcccggcccat

SEQ ID NO: 1074 - DNA, 3000 bp, Unknown
  misc_feature (1)..( 3000): cDNA_ID_3060454_gDNA_ID_1620355_Annot_ID_154469 3000 nt of promoter + ATG
tattattcttacttcatttttggttgtcattttccttattttaatttccacaaaaagctcatcattgcttaagaaaaatatgatttataaagttgctttttatttagttgacaaaaaaaaaatttgtttgtttattattctgcaactattgatctttacgtattgaattgaaaatttgaatgtttaaattatataactacaaatgtgtttttgatcatttttatattataaattataaacagctgctacattctataatttgttagttgtagtatttacttaaaacaatacaactatactaggagaaaaatgaacacagaacataaagtaggaaattggatgaaagtattatctaaattgtggtccaatagtttgtggatactttaactttagatgtatgaagactatagacttttcctagagatttatatataggtggtgtatatatacactgatttacacatattaagttatgtgtatatctaaaaaagatagtgactaatttctgaagtagagatttactatgaatttcttcagaggttgaacctaagctaaatgatatagcatgaacaagaatttaaatgttaataaatagattcgtagtatcaaaggcttaaagatttaactattatttttgcttggaatctacttttcgtgaaagattccagccaagcaaacacttggggctctgtacggacactctaaaacataataatcatttaagcaattacgatcattattctatctcttctttcttgtttgtttgttaaatgttaaaccatttatcgaataatggagatacatatataaataaaacctcttccacaccactttttttttttccatagaaacgaaaaatagttgatgatgacaaaatgaaataataacatgaaaacttatacttatagttattgtatagaaataaaatgatgagtatatataatgagtagagaaactattaaatcagtatagacccctcacctacgctttactctttcactcctctctctcctgctttgctccgccgtgagaggagaaacaaatggggaattgtcaagcggcggaggcggcaacgacggtgatacaacaaccagacggtaaatcggttagattttactgtacagtaaacgcgagcgaagtgattaagtcccatcccggtcaccacgtggctctcctcctctcttccgccgtacctcacggtggctctctccgcgtcactcgtataaagcttcttcgtccttctgataacctcttgctcggtcatgtttatagactcatctcctccgaaggtatataatatattaatcacaattcacacagaacatgtttcagttttaaattcaggaaagaacagaaccctaacttatagggttttcttcaatttgtttcttctgcttcacgtttgattacaatcatcatatacgaagtgtataaaatttacaaatcagaactaaaagctttaattttcaggattcttatcaatttatttgttctgcttcactttttgatgttaagtcagtctttcttttttgtgttctattaatagaggtgatgaaaggaataagagccaagaaatctggaaagatgaagaagattcatggagagttttctgttgcagaagaagagattaacccactaaccctaagatctgaatctgcttctgacaaagacactcaggtattattatcacatactacaattgctctgtatcagatgtttcagttttagttctctgattgaaacgatagagtgttacaaaagaataatagagttggttttgatttacagagaaggatacatgaaaagcagagaggaatgatgaacacaggaggagctaccaataaagttagagcttggcagccttctcttcaaagcatctcagaatctacaagctaaaacacttcaatccatatttttctatctttttttcttacttttgactcttttttttatcatttcatttctctttgtattgttgtttttcccaatcaaatttgtaaaggaagaagacccatttgattgtggttgaagaagaagaaacttttgtcattttttaactttaataataataactgaagaaagaaagatccaaaggattattttcattttctagatttctagattttcttttacgttttcaataaatagttatgtcatagatcaagttttacaactttttttacgtacttaaaagattgataaaattgtacttgttgttgttgaccattgaaacatttccctttattcactaaaactagcttttgcaacctttttattcaactgtattggtttgttgtatgtttttattattcaactctatttaattattcatgtagcttaacatatcaataataactaacatgccataaattccgaagaagaaaaattgttataaaagaactatatgcacctaacaaaaaaccaacaaaaccatagtattttctttttgggttacataaaaatatctttgtatgaagaagaagaaagaatcattacacagctttcactcacaagattacaagtttgcaaattgcatataaggaaactcccaaaaaatatcatcaaagatcttttcagaacacaaaaaaaaaaaggtaaaagtatatctcttttgccatagttagactcaaaaatacgacatcgtttacctcacacgtgcacactcaccgacttacagaagaacccacacgtacgttgagggtactttagtcatttagcatcgaacgaaattgtctgagcggagaagaggagtttccgttatccctttatatattatctctctcacctttcttctctttttctttgatttttattaaatcaacaaaaatagaaaaaaaaacataaaaataaaaataaaaaatcttcacgtttcttctctctctctctctctctctctcgagccaccaaatctgaattagggtttttgagaatattcatcttttgatttcaaattcttcacccactgtgtaatttcactcgtcaggattcatctgcggaatc

SEQ ID NO: 1075 - DNA, 3000 bp, Unknown
  misc_feature (1)..( 3000): cDNA_ID_2130043_gDNA_ID_1620355_Annot_ID_154462 3000 nt of promoter + ATG
gacgtcggcgaaatcgccggagctttacctgagtaaaccgggacagaagcgaatcgggtcgagaagcttcgtaatccacctagtccgacgtattcatcctcctcgtcgtcgtcatcgaagttcaaagagtaactcaaaggatcgtattgaaacttctcgcttgcgtcccaatcgcggccgcgtcgtggatcgcgattgaatcgacgaatgaaagtcttccaccgtggaccagcaacgatttctgaccactctcggatcttcaaggatgctcggatccaccaacgtggctcgtcgccgtggtcgccgctgtgattactgtcatcgacggttcgaattcgtccccaggaggagtaaccaacggcggtggagcttcttgatcggcggaagctggggaaacaacagcaacgttgatcgtaccgggtatcaggatctcgggttgggtccgactgcgaaagttccatgggccgaaactcagagaagttttttcttgggtcaaaagactcgtgatgataatataacttgattcaagttttagctgtaaaggattatgattggtcctatttattatatgcacacttgacacttgtaatataaattaagaaattgttattttttctatgttattatatgcacacttgacacttttacgaatcatggctgtaaatattaaaaccttagaaactcaattatcgatcaacacgattgagaatcataaaaagtgttaaacaatttcttaggctggtgaaaacgagtcttagaaaaaataaatatcttgagctagaatccgttataagatagttactttcctaacaatgtttttaggaatacacttgataaaacaaaattgatatttattataaaaactactattcactaagggaacgagttgaacaaatgtgatccggcgggtacaacaaactaacatttcggatcatagtacgaggggtacaaagattgagcagatgtcactgtctttggcattatcacaatctcaccattaggactgacaccagcgatgcaatacctaatttctcaaatatcatcatcttagaccattcttgttgctcaatatgatcttccataatccacatctctgcactagctttggtgtaacgtatgcatcctaattttccttggtagtttaccaaagtcaattcatcgaaactcacttcactgagctgctgattcatctgcagagttatgggcatctgaatacgatcaaagctttcgtgtctaacgtcgaacctcactagctcatagaattcgggatcatcccagctttctacatgtgctatgtaatagataaactctttgatacataaaccactactcctagcttctggagagtgattccaaatgccttggatgtcaaggctcctccattgctgcttcattggacctcccactaatgtgaaaacttgtttctcaactggatcatatccgaacaatccatcacacgagttgctccatctatcgtgttttacctccggtaataaaatcgttttcctattggtatgtttatagatcgagcttgaccaacaacagaagagtcctcgaaaattattgatacttaaaatcccaacttcgcccatggtttaatgtataattactgtctttgtctgggtatatgaatgatatatcattagtaggataagtagagggcgagaataatgaccgagtcatgatcaagagggtgatacgagatgaccacagcttcgatacacattggaacctcacaagtgacttaacagggagtctcgagagtatatcggttattacatcgaaagggatatgtataccgtttgaattttctctctcggagatttcgttctgacgttgttgtcgtcgttttggagatcgtgaggtcttcttctcttggcgtcctctcttcatggtgtcagttttctatttcattaaacttgaacgaagaaaaacacatatatatttttggtttttgacattttttgggggtttatgacatttgtttttttggatattttctatatattggcaatacaaaagagtttataagctaagcagcccagtttcatgtcccattaggttttagatctcaagtcttaaccgacctacatttaaagggaaaacattaagaaacaatgagagattaatttagtattttcgattgatgcgcctcacactgaaacctgaggcttgtgtgttctgtttctcttcatcttgattcaattcgtttgcagtttcgtagcttgatgagaaaggaatattaagtgattcatatatagcaaagtgtttacatagtaaacctaaaaagagagtaaaactaaaatctcttctctttattcatcaatacaagttgctattaacaaagtttttggttacagcacatattcacttgctttgtattattgtatatactatacaagatgctctacacaacatttactatgacatgaatatgagacaacaaactctttatacataatgaagatgtagtaatagtaaatgtaattatgtttgagaaagagaaagagagagagagagagagacagaggtattaatgtgagtgaagagccgggtgtttctcatgcatggggtacgagcggagtcaacggcttcatggctcaaatttgaaaccacgtgtcatgcgtttgttactctacccagattctgctgattcacagactcactattaaaatccactttttcttttttctctgttcataaagcagaaaccaaaaataatccaaatatcaaaaaaccaaaaacagaacctagaaaccacaccaaaaaaaaaaaagctatttcatcaaacaaacaaaactcacatcacaaatcagaaacaaacaaaaaagaaacgcagtactaaagaaaaaaattataaacaagaatcatcgaaaagaagaatcgaaatcatcaacatattttgtttctcttcttcttttatttttataaaatataaattagttctttgataaaatctgtagaagataaagaattcttctttagaaacaaagaaaaatg

SEQ ID NO: 1076 - DNA, 3000 bp, Unknown
  misc_feature (1)..( 3000): cDNA_ID_2130032_gDNA_ID_1620355_Annot_ID_154459 3000 nt of promoter + ATG
aaggatttcatgaaattcatgaaaggttacaaatcttatgttattcactcattaattttaaaaattctaatgaaatctactgttattgtattaatgattttaaaaatctatattaaaatctactgttattgaaaacagtttgtggatttaatttagtacccctaaataagtaaaaaagaaaatgatatgaaactagaaatcaacttatattgatatcagttaaggaattaaaaaagaaagttgaatactgtatgatttaaaaaagtatatctacttctaatagaaatacaaatatcaaatcttagagtcttaagttgatcagatttttagaagataaatataacagtttggaaaatataataaaaataagataagtaaaatttaggtggtaacaaaaacagggaatctcgggatatatattaattaccaaaattaaagatcatatgttaaatacttgccttacaaatttgtctcatatgtataaagaatctacttatttaatagctttaacttatttgttcatcatataagagcttaaatttgttacagtactaaatctagtttaaaccctaactgatgacgagagaaacaaggatgatctccgatctgccagaggatttgatagaagagatactatatagggttccggtagcatctctgagaagcttacgagctacttgcaaacggtggtaccatcaagctttattcaaagatccgagattcatcaaaaaatacaatgataattaaaacagcaagacagtatcatgctctcatgctggttgatcatagagtatgtccaatgagcacctttctcgctagacttgagaaaaacatatacatatctaaagatgggcatggcctaatatctccccattctaatcaaccagtcgatttatctgaagcctttcactgcgatggcatattgctatgcccttttaagaagaacatgatgattgtggtttggaacccgttttctgggcaaacaagatggatacagctgcaaaataaagacaacatcggagcctttgctctcggatacgacaagaatgaattgtgtcgtagctacaaatcttgaggtttgtgtgtatacacgagaagttggctccggaaaggatggaaatgtatgagtttacctctaattcatggaggaatcttgatgtgatcattcccgatcaggcctacttaaaatgtgatggtcatgcgtgtgcgtctttaagtggaaatacttattgggtgtcatggattgaaaaaggagacaacgacgactactcactactcagttttgatttttcaacagaaaggtttcaacgtttgtgtgctcactttcatcatcaaccatgccgtgttgatactattgctctctcggttgttagagaagaacatctttccttgttttatcagagtaggcagacactaaaggtggaaatatgggtgaccgttgagattgagaccacatttgtctcgtggagcaagttcttaacattagatttagtttctccttgtttatcgagatcaatgagcttctatattcttgatgaggagaagaaaattgttgtgtgttgtgatgaaagcgaaaatttctactactccaaattggtatggattgctagagaaggacaagaatatagaccatctcccgataagtcagttttctgtggcatacaagcagcgcattttcaatgttaccgttgtataccaaggttgtttggttatgttccaaaagattagcattgtggtttcttttgcttgctttgtcatgtccttggatgaaatgatatctgtttttttttgttttttggtgtctttagtattggtggcttttatactttcttagacttttccttcaagtcttggtaaataataattatatgctctactcatttcaaacaaaggccccgattgtttctttgcatttgcctaaatcgaaaagtaatttatataagaagtaaaaagaaagtgttgtgacgatggattaatttgaagaaaaaaaaatatggtaagacataaagaaaagaaaataggagtgggtgggttgctttgtgctttaaagttttaaacaaagaagaaaaggcaaaaaaatgcttttgatatatttaaaatattttaattcgtctccaaaaaaaaacagtttcttaatctaaagatagaagacatttgattcaaaagggaatgcccaaaaaactacaagattgaaaacaaatataattgatagagatcaatgatgctttactttagcttcgtctaggtttatatattattcccgtattctttatttgtttttcttatactacctttaacttttgtgctaatttattttcgagaattggctaatgttttcggtttgtaaaatatgcaaaaaaaaaaaaaaaaatggaatcattaaaagagttgaaaatagatttcagaatcattaaaaaaaagtaatctacttcaaaatttctaaacaaaaatatttttgtgactaaagaaaatatacggaatcgcataattgtttctcctatgtgtatatttagtaagttgatatacttctttagtaatatggaatctttgtagatggtaagaagatcaaataaaatcaaacaaacacatgcacaaaaaattcataaacaccttatgattgcgtcataaattaacgcgatgcaaaatcgttagttgattacatcttggtgcacaagaacatgcgtcacactgaatcatctgattgcgttataaactaacgtgttgcaacatcattggtttaaagacatataggtgcaggtacacatagacatgcgtcacactagatcattttggggttttaattctccacgaagaaatgttaaagtggggtctcttctattgccgggaaaacaaaagagagaagaagaaattaaagtttctttttctccttcactttctcacacacactgagaccataacaaacacacacacaaaaaagctcggcaaaaaaaaatcaaattccgggaagaagacgccggagaaaatcgaatcaaatagatg

SEQ ID NO: 1077 - DNA, 3000 bp, Unknown
  misc_feature (1)..( 3000): cDNA_ID_2130020_gDNA_ID_1620355_Annot_ID_154456 3000 nt of promoter + ATG
aagagactatgaatctcgatgatgagagatgatgaggatgagagtaaatcaggatttgctcaaatcgaggtagagaggttttaaacttggaaactccagactcatctgagctggtccttttttttttttttttgttggtctaatctttttggtacggtgagtggtatgtatgtatgtgtggtggtcacacgaagaagagataacggcgttgtccggtttttagttttttcttggtctattattttattgggcctacaatgtgtatggacgctaataccaaatgagcccattattccagaatttatgcccaattctaagattagcgaatggaatttgtgatagcgttctgaatttgatcctctcgaattggtactgaattcttaaacagagacgttggaggatcctccataacagtttcctgagcaatggtaacttgctgaacctcattagcaggctttattaaaaatcctactatgtacaaaaccgaaccgggaaccaaaccagaaagcttttggattatacaactaactcaaaacaacaacatcaataaattcaagagtgggctactacaaaagtacaaaggttcttaaacagagaattaaaacaaacacaacaaaacagaacgcctcgtaaccccaaaccaaactagatctagttacgtttgtttcaacttcttgatgccaagcttcaactccaacatttcaccatgcagtaaacagttagggacaaacatgaaactgtcatcagggatttgagaattcacttcaagaagcctctttacttctggtgattcgtaagtaacattatgtccgtcgatactatacgaaagacgatacgagaacttcttgaattctgaagcaggtggtgcgatgcgtctaacagtaacataaacaccatgtcgctccttgaaacactgaactacaaacaaaagtttctgacgagattcccagagaactgaaaccttttctttgatgtttattagaacatcaacagtggaatatccccatttggaggaaacgatcgtactattgtaaagatggcgacgcataaagtgaccgtagatgatgttatatgagccagtgtaattgcattcgaggttagggcaagagcattgagagtagttgcattccttttcgtgacttgacactttttcataagagacactttttgtgcagccaaactcagtattttgacatggaacaaaggctgattcgagaaccctctccattgcgaagcatcgcttattaccaatgggtaaatcacacccaggaccagggcacttgttactcactttggcaaagcaaaaattgcaaactatatgtccatcatcacactgaaacgcataatataccaaacgagatacaatcaaagccgtattcaataaaataaattaacaaaagcgaaatcaaaatgtcacatgaaacaaaataaaatgcatgcaagttcaaaacataacctgaaaggtaggaatagtgagcggctcgaagcaaaccggacagtcaagaacatcaagatccaacaacttagccgatcgtgtttcattctccatacgttgcttcttttgcgggtgagagctttttctttttgatgtttgattttgcgggtgagagttgctatcctccatatcgataaggttaacttgaaatggaatcggaattggagagatggctacaccgtaattatggtttttgtttccattagttaacgcattaattcaggctccgatttccgatgtttaaagaaaaagttgcatgcatgacttgggatggaatttgagtggatgcagcaagtaacacttgtttaacgtctctttcactgttttgccatgtgtcacttaacgtacaacacttgtcctcagatgatccattagcagtagtaaatgatttactgactcatctaccaataccaacataccattatcttaccattatcatttatctattgatctctgtatccccacgaaaacactatgtaatgtgatagtcaatcataacagcttaatcacacttaaataaagtaaattatcttttttctttttcttttctttttatgggataaattttattcctttccgaagaaagaaaagagagcaccattcaaacaacaataatctttttgaacggatgatctaatagtctacaagaagactaattttatttaaacaatcgaacctaacatgactctaattagagatatagagaattatatacgtaaaaaattcaagttggttaaagttacatggcttttgaaatttaaatttacaaattgaacattgaggaacatatcaaagaaataagaatgatagtgaaaaatgttgacaaaaaaaaaagaatgatagtgaaaaatattcaatacataatttttaaaaagaaaagtatattatatacttgtcaaagatctaaactaagtttgacatttggattataattgttacagcatataacatgtactttataaaaaaaaaaaaaaaagagaagaagaaaaaaaaaacatgtaacatgttttatttttgaaaaagacagcatacaacatgttagtcaaaacatattcaatttaagatattcatatcaaaaattcataatacgaacgaataccataaactttttcttttttattttgtaagagagaaatccttaaccattaatcccttgtaatgcatatttctaataataattatatttgacaaactatataattgatgatacagattctgctgtttaatactctaaagaaatcaaatagaaaatgggaacatagtaagactggattatttaccacttacaagttgtcgttaccttaataaaaaggtccttgttactaaatgctcagcgaaatctttaaaaaatgacaaaaatctgttgggtaccattcaaatccagattcctttcttatcatcatctctctctctcacactgtttatctgattcgtcttctctgataatcaagagtagtagtgcggttctctggaaaatattcgatttttaaaagactctgatgatg

SEQ ID NO: 1078 - DNA, 3000 bp, Unknown
  misc_feature (1)..( 3000): cDNA_ID_3060498_gDNA_ID_1620355_Annot_ID_154449 3000 nt of promoter + ATG
agtaaagaagtacacagaagtcaagaaacaaaaggatccatccgaaacaagtataacatttgcataaaagagaaaaactagttttcttttcttcctgcttatcatttttctaaattccgtttcttcatttgtctttaaaaaaaggtaaaaagctgattactttccatggtgatcttccatactcttcaactgagctgattgagaagctagagtctcttgacgaggaagacattgtgggttcgggaggatttggcacggtttatcgaatggttatgaacgatcttggaacctttgcggttaaaaagatagataggagtcgacaaggatcagaccgagtttttgagcgagaagtagagattttaggtagtgtcaaacacatcaatctagtgaacctacgtggatactgccgtttaccatcttcaagacttctcatctatgattatctaaccttaggaagcttagacgatcttcttcacggtaaatacagttatacatagtttatcttcattttggtctgtgatgcgtcatattaatctattttttggtttctttatctatcaagaacgagctcaagaagacggtttgttgaactggaatgctcggttgaaaattgcgctaggttccgcgaggggtcttgcttatctacaccatgattgtagtcccaaaattgttcaccgtgacataaaatcgagcaatattctactcaatgataaactagaacctcgagtctcggactttggtcttgcaaagcttcttgttgacgaagatgctcatgttaccaccgtggtagctggcacctttggctatcttgctccaggttctcttctttgctaacttcttttttgaatcttggacaataatttttaaagtttctaactctttgatgaatcttggaaacagagtatctgcaaaatgggagagcgacggagaagtctgatgtgtacagctttggagttcttctccttgagctcgttaccggaaaaagaccaacagacccgatattcgttaaaagaggcttgaacgtcgtcggatgggtaagaagacacctcaaatcttgtctccgagaagaaacgttctgtttttacttcctaagatttgggttctaataaagtgttatttctctcagatgaacactgtgttgaaagagaatcgattagaggatgtaatagacaagagatgcaccgatgtcgacgaagagtctgttgaggcattgctcgagatagctgagagatgtacagatgctaacccggagaacaggccggctatgaaccaggtggctcagttgcttgagcaagaagtcatgtcaccttcttctggtatcgattactacgatgattctcattctgattactgttagggacttatgcacggctaaaagtaaccaggagatcattagcctgcgacggttttgttgttgttgctgctgcgttatgaatgttgtgatttaggagcgagggatttgtttgtatattagatatgaaggtggagtcaagattattgagcgtgcactgttcttgtgcactttatatttttgcaacaaaatgatcgatgttattgcgtatgcattgtactatgactctttcaaagggaagacacacatacgaattatcgatgttaatgtcgttaggcttctttcttacgttttgtagcgtacattgcttagctctactaaagctggtcctatgttttacaaacctgaaagtagaagactctcaatgcacaaacgttgctacaaaactttcatctttctgaataattagctatttttatttatgaaagtgttatttctctataaatcttataatttggaaactgatattaaaaaaaaaacatcttctttttatagttacaaacaagtttttttttttttttttttctgtcaaagacttgagagttgataaaaaaaagagttgataatttcttgatttttcttctggaacattttaatattatcttctgaataatcaaatgacctttcgtttaatggaagagacttcgaccatcatcaaaaccccatccacctcttaaaaggccaacgcttttctgccctatgtgctttgctagtttcctacacgtacgtatatatctataaaatcatttttcatatatatatggtttaatgcatccatagtttatacatattttatatttaaaccctaccctatacgatacactatatacatatatcgtatagtagtaattgattatataaaattttacatagatgtacaagagcattgatatcgatagaagttagaaccttttgaagatattcgtaactcttgaaaaattcgattcttagtgacatagtgagcaataactacagattatggagattaatttgaattttagtctattttccctcttataaaagaacaattaccaaggaaatcctaattctgaattaatcatttacaaagttgtagtatatatataaaaaaaaagttgtagtatatagtattaacaaactaacacaatttttttcaactttgatagtaacctttttcaaaccaatatatattagtgttttaaagtacgccattatcttgtataatatgcatggtgtattgatagtattttatatgtatgtaaaatgaaaactaaaaggcgactactagcataaaaaataaatgatgaaatttaacaaattttgtaattttaaaggcaatatactattgtaccgtgaaaaaatatataggtaaaattttcaaaatatttgtgttgaccaaataaatggcaagatcataatattttgcataattttctatattttaaagccgattttcattgctaaaatatattgtataagtatatgctaatacacatatttgcgtgtgtgtatataaataaaaacatgcatacatgtatcatttgtctgtctcctattggctaagaaaacagagagaatcggtatttttagcctttgctaagatattttgatcaaaaatcccacttttgagcggtcttatctttattctccacctcaaaggaccatttctc

SEQ ID NO: 1079 - DNA, 3000 bp, Unknown
  misc_feature (1)..( 3000): cDNA_ID_2130009_gDNA_ID_1620355_Annot_ID_154453 3000 nt of promoter + ATG
ataaaatatattggtttgatatatatcgataaaccattacagaatagttgaaagatataaaacagttccttaaaaatattggaccattttgttctagtcgtattttagtttgatgttttatcgattggtcacaataaaaacggcaagaattactaatgagtaatcactaatgaaatgatcacacccattctaagacatagatctctagttttctaaaccagttcatttaaatttgttgcggattccactgaacatattttaaatataacaagacaccaaatctgaagtttagtttgaagatcaatgaatcgacgactacaattaaactaatataatctgattgaatacactttatattatgatgactcgagtctctcaatcagtagtgtgaacacatatcgctttatggaaaattcgagcaagtagatctcaaggcaaaccaaacattcctacaatatccacctaaaacttataaacccaaattaacaaatccatctatatatataaaaaggtatacaagactccacacgttaatgtataacacgttaaaagaccacaacactttcttgtgtctaaaacaaagaaacatacaacccttatccaaatttagaatttattatacacacacacacacatctaagtaacctaaaataaactttaataagtagacacataattgatatatcgtgtgtacacttgaatttgccaaatcatattgttaggtgaaacaattcaacattatgatgaggaagaataaaatttgaacaagtttattacaataaaccgaataaaaccagtaatctcctccattccaataatcaaataaccaaaacttatacattatctattttataaaccgagacattaaaaatattcgaaaataaattatttactttctcgccaacactcaagattttctcggaaactaaataaaagtaaaaaaggaaaagaaaaaaagtaggaaaaagaaagaaaccgaagcccacccaaagtccgcgtcttctgagagccacgtcaccatcaaaaaggacgtaaatgacgacttagcccattcacatttttcaatattccaatcatatcctttctatacggcacatacgtctgtcgttttgtctcttccctttcccttccttcttcctctccgtccacctttgacggcggttcctcttcttctctttgatcggagaccgtctcgtcgttcttcttaaccggcgccggaaagacgagcttatcgtttccttcactactgcttctaacgtacagaagattccggagcttccaacgtttcgaaaacccagctgaatggcttttgattttgctgtgtgacggagaagacgaaagtctttgaagatcatcatctccggaattcgattgtttaggtttccatacacagtacgtctccggaggaacaccagtaagatcctcttcagcttccgacgaagaattcgaagccggatctcgatcctcgctcatcagtttcctcaacgccggtctacgacgacgaggaggaagagtagtaatcttactcgtcggttgagattccaccggagcatttccaccgtacggattcaacggacggatctgaccgttacagaaaatctcgtcggcggtagcgagaggctgagaacacgtgttgcttggacagtcgaaagcgaagtcggaatcattatcgtcgtcgcggtggggagaagaatcggattgtgtttggtcgtgatctctgaattcttcgacgactcgagcggcgattgcagcgaggtcaacggcggaggagaagctgccaaaactcggagagttagaggagaaggagagtaaccgactcgtctgcatttgagagaaagttgtttcttcttgctctgttttctgaaactgaaacgtttttgagagagaagattgtacgcttcgaaatttgggtcccggggaatatttatatgggaaatataaagtctttgtattttcttcattgacggagaagaaacaaattgaaatgattacattagtggggcattaattgttatttattcaggagccaaaatctaacttaattatcatgattctaacaaggagcgtaatgaacataaaccactaacgacgtcaaatgaaattaaataaaccaccaacgtttaaacttaaccacttgttgagaataataaaagaagataagtctctccactttttcaaataaatcggtatcggtcttggtatttttatttataaagagagtataccatgaaaaattgtttaattatcttctttgatgtcacgtttaatcagacaatcacatcacgacgtaataaaacttatccatttggttattttcttctgtatattgaatattcaaacgttaatgatgtcacaaaaatgacgtacgtaataggttacgaaaatgtggtaaggattaaacaaaagaattctccgttaattccatgtactgatgttcatttaccgtgttaatattgttgttgtgtcagctcaaattttaacatgttaatcagtgttaacacgcataaaggaagcatgtgttaatatgttatcctatgtaaattattttaaataattcttataaaaagtatatttttgtcaacatatatacaacatagtgaaaaaagaaaaatatacaacatagtgctttggtgaccactatttttttgttcttctgactttagaatggaagtctaaatgtccttcaacttttagttgggcctttggctcacattatcggcccttaagaatagaagtctaaatatccttcaacttttagttgggcctttggctcacattatgggactgtataaatgggcctccgccataattagttgcatgtttcatagtggtaaattattcagatcaaactcaagcacagttcgaagttttcagcttctctcagaaacattagtttttcttcttctgttcatcaatttcatcacataaaccctaatttagattttagggttcatctgaaaactcttgcaatatttacaagctattaaatcatcaacaatg

SEQ ID NO: 1080 - DNA, 3000 bp, Unknown
  misc_feature (1)..( 3000): cDNA_ID_2106191_gDNA_ID_1620355_Annot_ID_154451 3000 nt of promoter + ATG
acctttttaagaagaagaaaaataccctgcctaaaaccaggtcattggaaatagacttcagacgcacgaggattttctcaaaaatttctcaaaaaatattgaatgttgatagaaaaaacacaaaaattccttccatttttagcattatatttgtttcaatatgtatataaataaatgaaaactctatcttttcctcttttttttttcttcttcaaactgtgtaacagactaacaggtgtattcacacaaaacagtcgtatttttttttaatatacatcaaatactgatataaaaatttacatagaagctctagtatgaatatctaaccttttaattaaaccgcactattttgttgaacacacagggcttgatggtactgacggtccaagcccacgagcactctaccgagccatggtctcgtgtatttctatttgtgggtctatatttagtagctcttggtgtcggaggaataaaaggctcgttgccaccgcacggagcggaacagttcgacgaagaaacatcgagtgggaggagacaaagatctttcttctttaactacttcatatttagcctctcgtgcggtgccttgatagccgtcacggtcgtggtctggctcgaagacaacaaaggctggtcttatggcttcggtgtctccacagccgcgatcctgatctcggtcccggttttcttggccggttctcgcgtttatcgcctcaaggttcctagtggaagtccaatcacgactctgttcaaagtgttaaccgctgctttatacgctaaatataagaaaagaagaacttcaagaattgttgtaacgtgtcacacaagaaatgattgtgatgacagcgtaaccaaacaaaactgtgacggagatgatggatttctcggatctttcctaggtgaagttgtgagagagcgtgaatcactaccacgtccactccgttgtacggaagagcaagtcaaagatgtgaagatagtcatcaagatcctacctattttcatgtctaccattatgcttaactgttgtctagctcagctctcgacgttttccgttcaacaagcttccacaatgaacacaaagctcgggtcctttactgtcccacccgcggcattaccagtttttccagtggtcttcatgatgatcttagctccgacctataaccacctcctcctccctctagcgagaaaatcaacaaaaaccgaaaccggcataacccaccttcaacgcatcggaacagggctagtcctttccatagtcgcaatggcggtggcagccttagtggaaacaaaacgcaagcacgtcgttgttagttgctgctcaaacaacaactcatcttcttattcttcttcgccgcttcctataacgtttctttgggtggctattcaatatgtgtttctcggatcagccgatctattcactctagccggtatgatggagtttttcttcaccgaagctccttctaccatgcgttcccttgcaacctcgctctcatgggcgtctcttgcgatgggatattactttagctctgttctcgtctcggctgttaatttcgtaacaggcttaaaccatcacaatccatggcttttgggggagaatctaaatcagtaccatctcgagagattctactggctcatgtgtgtgcttagtgggattaatttcttgcattatctcttttgggctagtcgttatgtgtaccggtcgaaccaagggtaaatcctaagcacatacattggtggtatcagactatcaattgtaatgagtgagcttattgtagggtaatttgttgtctgttaatgatccgattagaagaagtcaagggattagtttcttggagaataagttactatgatgctagattggtttttaattttacggctagggttataagttgaactagcacaaatcctatgctcttcaggaatatgtcatttaataaaattataaagacattattatttttatttttatttaatactccatgaaaattaattgtaacgttagaaattaatggttgtatttgctgcgtttatcaaataaataatagcaagtgcatctgtaaatcacaattcacaaccgcttttttacttttaaagttttaaccactgcccaaaacaaatcaatctcataagatgttatggtggcaagtagtccttttttcatgtaacgtacgtaaaagattgacaagttgtaatttgtaacttgtaatgaagcttggtttggataactactgactaaataaaaatcaaccgagtattcttttccgatgtatttgtggaataaaatcttcgacttttatcaatcaaaactgactcaacaactcatcccttacttttaaaattctccaaatttagaccctataatgtttatatttatcacagatataacagaaaacagtttttctttttcttttttttgtagaaacaaataattattcctgaatctaaaatagaacaataatgaaatttatcatatttcgtcaagagttcctggttttttttaaccaattaaaatttatattgagtatattgtgtaaataacaaataaacttaagggtaacaattcgaaatagtcgaaagctagggaggtctttcttgtatataaaaccgtctctgcccactgaaatatcaacttagctcataagcatatctaatcggagctcggagaaatttcggtaaaaccctaatcatcatcttctccttttgatcaatcttatcttcacatgaaaaatctctgttcaaagacatagctttgttctggaattccaaattttggggttgattttgtattttctgggtacgcgagattagatcgagatagaaaaaaaaagagcgatcttttctcattaattccggttcgacatggctagtttcagcttaaatttacaagctttgagttcagtatttgttcttatgctcatgatcttcagaattttctcaataaaaaatttgattttttgttgttgttgttgttgatgggattaggttgtgaagagaagaaag

SEQ ID NO: 1081 - DNA, 3000 bp, Unknown
  misc_feature (1)..( 3000): cDNA_ID_2024889_gDNA_ID_1620356_Annot_ID_154489 3000 nt of promoter + ATG
taataatatttcccacacatattttttggattattgaatcaattcttgatttagatttccttacactactctaaagtcttataaactttaaagcataatgtaataaaactaacgaaacacaatacaaaatgggaaagatatcagtaaaaagatatacacatataaaacatttttttgatcgatacacattaaatttttgtaaaagaaaaacgctatttatagcaatacattaacgtcgacataaaaatctttgattataagaaaaaaagaaaagaaaaaaaaaaactttgattatatacacgtctctctctctctctcacagaaaaaaatgaaaaaagaagcattagttcccaaactcacatctgaattgcctccgtttacactaaaagaccatccgaagtttgtcgtcttagtggtcatcttgttctgtatcgctttcttcattgctatgaccttttgcgggtatgaacaagataaagaaaaagaaaactatgtcccaaatattacaataccttctatggatttcacggtccttaatataaccgagactcatcttagtgtaaaatgggatttattgttaaggatccctagagatcttcctggttggtatatgtgtctcaaaggagattttcagctttccataatatacagaggtgttaccattgctacttcatccatagagaggttaaactttttttctattctattgtctatattttagaatttttaataatttattcagcttatttgttcacatatttttgtgttattccttatcatgattgatcagttacagtctgataccacggtgggctcagctgattagggtttcatcgattgcttctgaaggagacatggagggtgtgattataaaagatattatgaaggatatcaaggaaaaaggtgaaataaggttccgatcgcgattgcttcttccggattgtagatatgggacaagtggaaagatgaactatgcgtgtgatgaagccatgttaaggttcgagcctggctctcaaaggaatgcaactttgtttggagaccaccctatttgccgctatcttcgctaagtacttttcatcaatagtttgttctttagtttgtcaaatgatggactttctaaattcttttgcgttttgatatggacttgctttacctaaattaaattcctataaattaattaatggaatatatttcttctagatgttaagtgttgaacattcttaattctctctctttacgaacaatagatatgttctagagcaatatcatggagttgtacgtggtgttatgatgatttctacacgaggcatttatccttgacggacaagttgcaattattttcctccatgatattcaatttttgggatggtattttcattctccacaaatgttgcatctatgagatcaatatgcatgcaagatctctaattaatggtgtggtgcatggtctgccctcccaaaggtggatctttatcttttgtgttgtgatagtaaatttgtatatatatatctagtgtttaaaaatttgctaagcatggggtgatccaatacctacctattaaaaacgtttaatccgaacatagctacacacggaccgaatgttcttttttggagttttttataattttattaagattttgggacatttagatctctttaaattaatatttactaaattaaagagagtagttaagatccttaccaataaacgagagagatgttaagatccgtctcatcaaaaaaagagaaagattttaagatccaagtcaggtcacttttttctttggtattaatctcacaactcaattctcaactcaactcaggtcaccaagatttaacacttataattttacactttgttttcttaatcattatatactatcctaagcatatatatgaatctttcaccataagttataccatttatatatgctaatattttctaaataaaccttacaaatttgttggcgctaacaaccattgtttaattttgcttggggtggctctagttatattatatagaccttaattttgcaggaggtatgtaacacctcatattgcttcagcttagcaattcatatatagccaagacgtgtggacttctcacccaaagtttcctagtttaaatgtgaatgcctctaaacaaaagttcttgctttcgatgtctaaacttagatgtgttaccgaataaagccagatttacctcctttgaccttactatatagccagctcgctgcctccgcaactctcaaaatgacactcgcgatcatattagttgtttccaacaaattgaaaaataaaacatttcactcaaacaaaaaaagatctaaacagccgaaaaaacaagtccaatatcaaaatctgttatagcaaaaaaaaagaaggtagagtattttggtaagaaagaactctaaatgcctctacgatataatattaataagtatgttaccaaacaacttaatattagtgcaaaaaaccctttagtttgtcataaacagcaaaatctgccactataagttgttttcatgaggtcaagttgatgagagtatatgattctctgaagctcatgtcaaaagaatagaaccaatgttcttcagtcttgtccacacggtaatgcttcaaatgaacttgtctatagagaatcttccagcgtgagagattcttagtgttggtggattgacataacagaaacatacctaacattggaaaatgctaaaaactttgagtgaatgaatgaatgtatcaatcatgaattagagattccattttttatggcctaaatcaatgtttctcacttgtaaaagttgtctttttgacaactaatcatattctaattctttttctctgccctttatggaaaagctttgtgactatttctttatttatttctgtccaaatttgatgatctgtaagaatctctttattgggattgcaatttcaaacaaactttacatcttcttcttctctctgcttttgccttcacgacgagtagagagagcc

SEQ ID NO: 1082 - DNA, 3000 bp, Unknown
  misc_feature (1)..( 3000): cDNA_ID_2045557_gDNA_ID_1620356_Annot_ID_154509 3000 nt of promoter + ATG
aactttaaaggtacaagaatcattaaattcaaggatgacggaaccgagcgatcacgttggaactgtcttttcaggcaagggattaacatgaagttttttactgaggttgaagcgtaccgtccagatttaaagcatcctctatgtggtaaacgatatgaattaagtgctagaatggatgcaatatattttaaaatggatgaacgtcctccacaacctctaaacaaatggcgttcataatttgatatattttacctaaaaaccatattttttatgcaattctgttccagcttatgacctcctaattaagccagcataagaataaattttataaattgtgtatttctttttaataaatagcacatttcagagtttcttaccagtctctctactctctttttattagtttctattttcttaatggtgagtctcttatttttctcttagttttctatgagcaaaccaacatagatgctcttagtgatctatgactgtattttttatatttatattatatgaattttcttcatgaaacaatattatctcttgagcctcttgtatttaattaatttccatagtatatgagtttggttgtatcttatgcacaattcattacattttttttttaatcttgctattcttctctaggaggacataacatgcttgcatggatctctaatataggtcaaattgccaaaagaccactctatcaaataagagatcattgtagtacgttagagtcgaattccacaaaactctctagtttacacaatagactaatagttttgaattaaactaaacataaataactgacaattaaaaatagcaaaaaaatcaaaatttaagatgtaaatctggtggaggaatagttaggcttaagaatttctcaggaaatatcagaattgtagatctagcaattaattaaaaattattatcgaaccgttctagaactcaaatcacaaaactataatcaaccaactctcatatgtattgattatttgtgcatagtagtaggaattctaacttgtctgtaaatccgtaaaactaaacacgcattaacgaatgggtttgatatgctcacaaagtatctaagccaactctcgtatttatttagctacttttgcccatctaaaatagttccggtaataagcgtacttttgtgtttaaccttttattatatgagttacattctaggtgatcaatcgagaactagtgataaaatcaaatctaggtgaagaattctattggtttttcctaacagtttatcgatctaacaatttaatcccttttgagaatttataaacctaacaagcaaactactgagacatgatcatgaaaacacaaaacatgatttgaatataaagcttaaagaaatcgagaagagattagactttagaagatcttctctcaagggtgctcccacatgattcccacatgattttacctccagaattaaacttagaaaagtaaactttacctcccacatggttttagtcatgtctaacaacattgtagagactatgaatggtgtcatatagaaagcgaaaatatttagatagtcatatattttcatttaaatattatatatgcatgatacgtattgagatatactaacaaaatatttaaatctaatctcttcgtaaataattgttagagatttcttacaactactttaatgttgtaccatgtaagttccagtaaatattattgtgtacacatataggaaaaaacttatgtgatttatgtatttttagaatataactgtttggagcgctcatgtacgtgtacgtgtatctcaatattattatatagtttaagggtctagattagaatactatctagtctccaccaataatattgtgtaacataatattcattaaaaataaataacaattatataaaaagaataacatttaaacagaaatatcatataaatcgtactaaatatatagaatttggctaactagccgtatgcaccattatagataccaaacattgcacatattcttaaaagaaccggaaatggtgtaacaatccatacttcgaattcctctaacatatgtgatcaaatgacagtcaaattaaccaatgtttgtaatgtaagaattcgtatatattacacgtatatactaccgaaacaatggtacatataatcataattccgttgctactcgtttgagtaaagtatcataattcatttctctttactctcgtttttttggttttgtttccattttttttaataacataatgacacaaaaatttagaaccgtatcgaacgagaactgttcaattcagaagacaaatcggtccaaaaaagccttaatagctaattgatgagaagcccaaatgactttgtcaaaacatggttcagaaagtcaattttaccccatatgtaaatatttcttataaaattattaaactttggacttgtcaaaaccatgaccataagtttggactttgccaaaacctatttaacatcctcttcaattttaaacaattatccagctctataaaagatcttccacgatcataattttgaaaccacttgagatgaatatcaatttctatgaattttttttctttcatagttcgacgccatgtgttcttattataaggtttaaatggcctccaaaaactttttattcaaaataatcccacaatcataatttttaaattcacttacggaagaattcctcacatcgtctcctttttgtctttcttcttatgttgaacatttcaacctttttcctttgtgtaatctaaaaaccattgtaaagttcgtttcttttgctttctgaatccaaaggctgcatttcttgttttcaaagtcagaatttggtaaggctgtcactagtaactcttaaatttcatttctaagtatcatcaactccctcagttgttagcattgaatacgtttcgttcgtaaatcttttttttttttgtgtgtgttggtttagatttggtgcttttgcagcgaattggactctgtagtatatgatg

SEQ ID NO: 1083 - DNA, 2409 bp, Unknown
  misc_feature (1)..( 2409): cDNA_ID_3060510_gDNA_ID_1620356_Annot_ID_154516 3000 nt of promoter + ATG
cttcaagtttatttcgtgtcattctcatccacgaatgcgaaggtgaaggagctaaagcaaagaagaccctacagattccaaatcttgatggcgtggataagctagtgatatgccacgtggacgtagaagcccaaaaggctgatatctcttatcatcttcctaatctctctttatacaactttactctctctgtatcttcttctaaatttgttcacagagtcttgacgaagcaagaatctttacttggagattagtgagagagaaatatgttgaagagatcaaagatctgatatctgagagagataatgggagaaatgacggcgaggtcttcggttttatcgtcggggatgttcagaagttaccaccggccggtgacgacggaggtgagatcactattacggtcgagagtgatgtgccaagtgtcatccgtaaaacccgccacgtattcatcgagactctccacagatattcctctcaacgagtctcctcaggttctacttctcttcactttactacgcatcgatgtttttatttttttttggtgggtttaattgagatttcgaccatcttgtggaatttttcaggctttgttcgatgagtatttagaggataaatcaagagtattcgaagcaatgtttccagataagcccagaagtcataggcttaacgaggtactatcgaagttatagttaactagatatagagtaaaataagtcttcaaaaatgggcatttggtctagtggtatgattctcgcttagggtgcgagaggtcccgagttcaattctcggaatgcccctatttttgttttgtccttctttttatttacttgcttttttaatttgaatgaatcgaatttgtgtataggaagaatggagaattcagatgttaccaataaacttcctcttccttactgtgtggcctgtggtagatatgaggttaagatgcaaatccaacggtcaagattatccgccagatgtacctttagatataaccaaagttcttgagctcaacatggtaatcattcaacacacacacgtctctttctttgtttctttgagcttcaaacttgttactaggagtaggcacgaagttgatattaccgtgttagtatttgtgatttgctacgtttgtaacggatatttatggttattcagatgagatggaagcttcaagggcttgaccgagtaatggaaccagctgatttcagtttggaagtcaaaggagcattgtaccctgaccgaagaggaaagcacacaaggctcagaggtcaactagagatgaacataagctttgttcttcctccggttcttgagttggtacctgaagatgttcgaagaaacttggccaatgcggttagaaaactgttacataaagctctatttaccacatcccatgattgtacatgatctctgtgttttttcatttgaatcttttacaggttttgaccggtttagtggagaatatgaagcataaggttaatgggagcttgctttctgattatagcaggttcaagaatgaaagaaaattacaaagataatcgagtaaactctatctttgttgcctctgtttgaccatgtatagttctcaatccgttcatatatcagtaagaagctacttgtaagttatttaattgatatagtcaagttaagaaatcatttagtttttcagttggcgcaaattttccaaattctttggtttagctgaaaataaagttatatattgttttgattattcttataatttcttagtttagtattgtgtgttatgttaaaaatataataatttgaaatttaaattattttgttaattgcactaatctttgatctagtgtgaaaccaaatttaaaaccagagtggcctaactaaaacttttaagcattgggtttatttggtcttttatcggatttagttcgaaaatcagttaaaccaagctctatgtaaaaacagatgtatgaacttttaatctgaaggtacattttcgcctcgaaatggttaaaccagattggactatgtagacaaaaattgatgtgaaatttgagtgagatgaaaaaatcaggcctaagctttgtcaaccctctgtctgaaagtgagggttttagttcctttcaactttgaatgatgttgtgtcagtctcatccacgaccgaatgcgtaaaagactgagtaagcaaatatagatttcaagactttgataacatgtaacgtcttgtaattacgccacgtggacgtaaaagaccaaataaaccaatattccaaatctctaccgtgacggttttattcactgtctctttctcaatcttccacaaaagtctcaacgtatagagagaaaccaagacgcaatcttttagtatagatagattgagagataaagatatgtgggaaagatcaaagatccaatcttggtgaaatg

SEQ ID NO: 1084 - DNA, 3000 bp, Unknown
  misc_feature (1)..( 3000): cDNA_ID_2045549_gDNA_ID_1620356_Annot_ID_154513 3000 nt of promoter + ATG
aattaatttttaaaatccttgtaaatatttatttgcggcaaatagatttacaagggattttaaaagggttttaaaagatttacaagagattttaaaaaggtttaaaaagatttataaaagcttttaaaagagttaacttaaaatctattttggcgggaaatatttttttgaaattttttgccgggaaatttttggcgggaaatttattttggaatattttatgcaaaaaaatattaatatttcattttgttaacttaaaacaatttccaaataagggtaaaatggtcattaaaaatttaaagagcgtaaaaataaaaatggataaaacaaaagggtagagttgaaaaggggcatcatgaaaagggcattagaaagaatttttcttattggttaaaacatatactctaaaccgtttattatactttttatcattcaaacatttgtactgtaccacttatttttcattgactacacatatttctcatactgcgttttttcttaacaaatcgcactatactactaaatccatttgatctgcattgccaaatccattcctcccattggaagtctatatttacaataaagatacacgataaatgagaccaccattaatggttctacatccatacgtgctcactaatcactttgtgtgtgctctatttcctgaatttgttacgtgtgattagactaccggaaggaacagaagattgcattagtcgaaagaattttgctcttcttattttatcgcttagtagcatgtttcactttgtggatatcaaacttctgacttttattgaagctagctaccactactttcaataaactggttaatctcaattaaacaattattggtgacggttgcagtttcttggaagctgccactctcaataaactaatagaaattgttgtcttgacttttaattttttgatacagtaccattaaaacttaagaaacttaaaaaagactcacatataccaagaatccgaatccaacccgaacccaaaaatattttgggtatttttggttattttttcatttttactaaaataaccgaaccgacccgaacccgaaccgaaaccgaaccgaatttttagaatacccgaatggttctcaacctcctacccgaatagacccgatacccgaaaaaaaagaaccgaacccgaatgggtacccgaatgcccacgcctaactcaaactaacaaaagcaccaatcgctcatttccaaaacccattaaaacaagtgtagtatcacaagtcaatgaaatgtctaagttgaataagcaaagagaccaaaactcatttataactcagttagtctaaacttgaaaccagtaattgttaccttaatatcacaaaacctgtttctagtccagtatttgaagcttgcaacttctcagaaagcaaccatgtcaatccctgcaacaaaagaaagatggaaccgattcaagtcttagtgttttgcaaagggtttcatttcttaaacccaataaataaacacttctttcgtcaagaacaagctaaccaaactataaatcagaaagtacaaaaaccttctagcaacaattcaaaattcaaagacctcaattcaaaattcgaagagaagagcacaaagtaaaccaaattcttagaaccacttcaattttagctaagctaacggaaacccagaaacataaggatcgaaatacaagagaagagtccagagaagataacagaaacccagaaacataaggatcgaaatagaagagaaagtccagagaagaaaacaaacctaaagacgtcgataaacagtgaagcttgatgaacagaggagcttgacgaacagaggaagctagatgaacagaggaaggtgttgaacagaggaagctcgtcgggcaaatcgccgagagatcggagaaggagaacaaagtcgagagaagaagctgcgtcaaacgcaagtgttttagggttatgtttttttgtgattttcaaaaatattcaggacattctgatcattttctatgtcgatcgcaatttaacgctgaattaaaatagcgtcaacaccctaagtatatttcttttttttctgaccaacaaagtcttctgatctattttactgatttcaacatcaaaaaattatttgaaaacactccgcccccacccacccaattctacctttaccggagtatttttaacgtacggttgaaaaagaaaagaaacaaaaaaacccggcccatctgtatacactcaatagacccatgattcttacaaccttcaacaaaatctaagcccaattcacggcccatctcaaagcttccgctttcatctttcacaacttcgatcatctctctcagagaacacatccgatgcttctccgatcgccattcacagagccaattgcagagaacaaggatccacgtttgatgtgtttcttctgattcacgacaacaaagatctgattctcaattgagttttgaaatcaagctctcatcactctaccacatcggctcgagccttcaccattgtctcttacactaagagcttattcttcgttcaccatttctctattactgttgtctctcatagtagaagctgagcaaaatttggatctctttcgatcccgatctcttctacaaaactccgccatttttgtagtacctctctcgtgatctgcagcaaggtacactgaacttgtctcgatccacttcctcttacgctttccgttttcaaaatctccctctagaactgtgattagctcttaagttttcgtggtttttgctattcctctaatgaacttagttagatctgaatttgtgttacttaagtttagttttagtcactgaaaattctgaaccatggatgttacatagatcgtataagttactgtatatatccgaatttggtgaaatgaaaaagtaagaggaatctctaatctgaatcctgttattgaaaaagctttgactatttgcagcttgcatgcttggagtgtgttcttgtgattgagccaagaagttggggcgagt

SEQ ID NO: 1085 - DNA, 3000 bp, Unknown
  misc_feature (1)..( 3000): cDNA_ID_2045603_gDNA_ID_1620356_Annot_ID_154497 3000 nt of promoter + ATG
actccataactagtggatcccattagaagctcaggagctcgataccacaaagtcacaacacggctcgtcaattgatttttattcgaaggtgtcaccacatttgctagcccaaagtctccaagctttaaaacacctttgttattcaccaaaatgtttgatgccttaatgtctctatgtattactcctcgcatatgacaatgctctagtccccatagtagttgcttcatgtaacattttatcttgtatgacaagaattaaaagagagaaaaaaaaactcaaaaactctatccaatgtcataagaaaaaagacatgaatttcgcagtttttgtacctgtggctcggtgaatctgatgtcgggattagaggataaaccggcaagatcatgttccatatactcaaaaacaaggtaaatgctgctggatgctcgtgacgtgactatgccctcaagtttcatgatgtttggatggttgagtttccgtaaaatcaaaatctctcttgccataaacctaatgctctctggttgaagattatcaaactttaccttcttcaatgccaccatctttcccgtttctacttcacgtgctcgaaacacgctactatatgttccttgtccaatctaaacacccaaaaaaaattcatcaacacaacacaaaacaaaaaatatcatgtcttttgggtaacttccttgacaagaaaccatatattttaccttctccaacttctggaacgcctctgcctttagaggaacccaaccatggacagcctcagccgcagcagaacaaagccaagctggccaaccagcagccgcctgctcagcctctatattcctatgagacgatccaaggctcacaccaatcctcaaatcagaaccgcccaatctccttgattttcttgaacgcttgctattgtgacttgcctccaaagaatgatcaataagaactcgatgttgctggctcgtggagagcaagccaggttcagggagcggtgagtcaccctggtccgttaaacatgaaacattcttggagctgatgcaacccatttgtttatagataaacaaaaactgtttccggatttggaaacgggtctaatatgggggaattagccccacattaggccaaaagattaaatgggattgcagacaaaagacacaaagaagacgatgatgaaaaaaaaggagggaaagaggaaaccaaaaaaaaaagttcacatgacaaaatgactaaaagtaaaaggaaacattttttttttcttgtgttgaatcttcttgtgaaagagaggtaagggaagctgcaaaaacacaaccgcaaaaacagcaagagagagaataatgggacaaaaattgggtagtaatctttttttcctcttgtctttgcaaaaaagagagagagaaaggaaaagacatatttagctttgtcacctgtctaacagagaaagagagaagacccaaccgacaagttaaaaagctaagaaacaattaaggtggattagttagttaatctatcccaagttgttcagatgtcttaacaaaaatcatagtttttacaaaagacctaataatatcttctatgtacgaaacaacagacggtggggtttaagactaaagcttattaaagttgtgtaatgataattgttggtcaggtgcattgcttttaagggtcttttcagtcaaaaggaaactttaatttttacaaattcagcagcaactttaaatttccattgttttgttagtttttagttttttacacataagtaaatttcacatatataccttataggagaagaaaacatttgatagtttataactttatatccataaatcaatatcaatatagagttaccaccacacaaacatttctgacagtacaaaaacatacttgattgaaactttttgtgctctcattggttgtaatgtcttttcacataatggtttgttaaaccaaccttgttgatacttttctggatttaatcttttgctttaacatcgtctttaacatttcagcagttagatatcgataacctcaacaaattcccatatcgatcatcatatgctacaaagtcccgttaccaccaaatatctgcaatagaaaaacagaagcataaattctcaacaactttgcccaaagaaataaaaaaatgtcacacctaacgtcctaacataactgattgattaatcaagaaatatacatccataatcgaagttagggtttctcaaatacgaaatgaaccaatacatcttctaaatgtattagctacacggaatccataggcgctaaaaaaagttcaatatagttcaagaaattggtttgtggaacagtggaaggcaaggaagcgagcaagtgatcaaagaaacaattaatggagggaaaacaaacgcttggagcatctagtgagagattgtttttggtaacatattttatactatttttgtttatagaatacaaagatacaacgaagagatacagaagaccgaaatctacgaaataaacaaaaatacgaaaaagaccacaaataaaaatgaaatcaacgaaaaaaatcaccatttgacggaagaaaacacaaataagtcatcggatccgaggctagtcctcaatatctcgaatcaagtggtgcttacagcttttccgagtaaacttccaattaaagagaaagaacttggttaaacaagtttaacattttcctaaggtagtaaggtagttacatcttagttacactacgtgccgctctttgtctatatctaaatctgagacagcgtgtagttctcgtaatatgagtacaaatggtgtgtgaagtcaagtgttactatttgatataccaatcaaaatcaaatcagattattattccttaaattacaatttcactcacaatgacgtgtaacgtcgacgttgtcggtggacacaaagctccataaagacactattactgtattattatcttcgaaatatctatctcttcgtcgtcgaacccaaaaagattctccgtcttagattccgatcacgatg

SEQ ID NO: 1086 - DNA, 1111 bp, Unknown
  misc_feature (1)..( 1111): cDNA_ID_3060601_gDNA_ID_1620357_Annot_ID_154523 3000 nt of promoter + ATG
gatcaaaaccttgatgatacccaacccagatagcaatcgattgataaagaagcaaacgacggttcaaaggaccacaacaataataatatctgtaagggtcaagataagaaatgacctccaaaccaaaacaagccttaaagaaaagatttaaaatagttcagaagaacaaaaccaagaagctcttttaaaaatattggccaactccaacaactaatggaagcaagacacataaagattaatcaatatataatgtgtttagcatcactatcttgttcaggtttttctgctaaacaaatcctctatatatgaattcatcattctccactagcaaatactttattcacttcgtcactttgatgagaattacataataaaattttatttttttagcaatgtacctattactagcaaattcatagcaaattttaaaatctcatatgaaaattcttctaacaaaagactgatcctaacaatttgacaaaaaataataattgaacctagatcattcatacacttcgacgagttgagaaatctgcccttgttatgagatttgacataccttggactcgcaatacgcgatattttgcgaagacgaacccagatcgaagaaacaccaaattagattgtgttgcaaatgttaggagtctaagttttgcatcacattctaatttgatgttcttcgatcgaccagaaaaaaataaaagcttttcccggtgacctgagccagcaacgtctccgttaatcttcttcttctgaagaccaaatgtttctttacgaataatcgtgtcgttcgtctctaaagcaagaaaagttagacggcaagtagaagccaattaaacggcacactgttttaatctctaatcatcaaacaggaggtagtagtaatacttttcgacacgtggttgtgattacgactccgtttacgtttgaccagttgacctcgtcgttgatttttttttttggtgaacgggaaaaaaaaacacaacttttcaatttttctgattccaaaaatttcaaatcccatcgaagggggaaacgaaaaagtctcacttagaattgtcacaattcaatagtgaacagtgaggagaagaagaagactggagaaaaaatg

SEQ ID NO: 1087 - DNA, 3000 bp, Unknown
  misc_feature (1)..( 3000): cDNA_ID_2129953_gDNA_ID_1620357_Annot_ID_154535 3000 nt of promoter + ATG
ctatgcaacattaactttatttcgtcttccaaaataactaaaagtacatttctataattcaggttttgatagcataagagacttatattctataattctgtatacctaattttttgtacggatgatttaagatgatgtaagataaacttgaatatcagttatatactacatatacacgttttcttcttaattgtgatgcaaaatgtgaatcattgtctataaaacaactttgcactttccttcaataccattaaccacagaaactgggtaattcaatcccattagaaacagacaagagacatacatgcacacacatgttgtttcaagtatactggtttgaatatattttgtcattacttcaaaaaaatttttaattttagtcgattataccattcatacatgcatgaaaaatttgtggttgtaaaaacaatatattttgttttcatttttgtggtatttttaatttcaaatttattgatcaacaaagcagattatatattgttaactagactcatatttatttgagaagtagttgattatatttaacttagtatatataataaacgtatgtgattagagagcaatgatttggcatcatttgtatgctcttagtgctgtaatttgtcgtaagatttgttttaagcatatggtagtatatattaattattgttacatatctttttcatttgactctttaattgtttttataactgaaaagccgcctctaaaagatgaagatggcgtgtaaagtgatacattttgttagtagtttttgaaggaaacaacaaaaaatatgcaaagtggaattaacccgtaattagccttttgttacaactcaatctccatccatgtgctgccttctaaagcaactacacacgaatattctatagatatgcatctctatttctgtgcatgatactattttcaacgaaacgatcatcatagttatataatgagtcgtgactatgatggatgattaagtttaagtgatgcggtaaaagatactttagtaaaggaagatggtgcgattagaaacaaatgagaaaatttaacaaaaaaatgattgttgatattttaataggttatatagtaaaagtagttaaaacagtgtaaagtaaaagttattaatatatttataaaacgcattatacaatttaacaaaagagttatacactacattgcttcttgtcaattaataggtagctagcaagcaaaccatcccaaattttacatgtggtgaaatttgtcattacaaaaaaaaatgattttggagtgatattttgtcgttcagttagttatatatctttgcaacataatagtaatgaaataataactattttttgaacaaatttaattattaatattaaaaattggttaacataattattgataatattacgacataatttttaaattttacgtaaagtgatatatagttcttacatattcataactgctgcttattggtcactaatgatagctaagtttaaaaggaatagtaaaaaaaaattaatttatacaaaataattaaactgattcaaaatggtttttaattggtcggaaaatccaaactaaatcattgcaaatctgaagttatcaaagacggaattgtaactaagataaattgatgaagcgttccccgttatgtagacatttgtaattgtaaccaagtaagcaggttgttttatttgaaaaagaaagtgtttggttgatcacttttacctttcaattactataagatgacttttacttttcaattactataagtctataagatgataacaaaaagtaaagttatgcttgaaaaagacagagtcggtttgcgttagagactaaggaatctaatttaatatggaaagttacctgcgaaatcacatgcccatgagatgatagattctacaaagaaaagattcgtttttcaacaagaatactcatatccttcccaagaatttgacttcacagtccaaagaagagatccatgtattcgaacactaaatgtcaaaatcatctagtatagggcatggttttgtgtaaaattaagcagtcaattcatacggtaaataaacttgtaagatgattttgatcgttcgcgcttcttgagacatgtgttttgcggtacatttgcatgttaaaaaaaaaaaaaaaagagtgtctttcacaagatttaatcacccaatgtgtgtgatatagctataaactgcatgacttcaatttaccacacaagtatggctacattttctctcatccttgatttcttggaccacacacacaattatatagccgtatatattaaatacgttagacctattgtccataattaagtagtttcaattacaatagaaacaaacaaaatttgagaaaaggatttggaggaattgataaccgggagtagcaggtcgtcatgtcaaaccctaccaaactaaaacttactaaaagactaaaaccgaccaaaaagaagaaaccttcaaagagaaaaataaacgttttagacatgagaaaattagaaaaccgaaatatccggttaccagtcaaagaaagcttttcttttaaagttattatatttctccactgaattttattttttaaatgacagaaaacttaactaaataaaaaaagtaaaaatctggtaattcttttttaaaatatttggatttgtaagaaatgttaccatatgagttgctttttcccgggaaaggatttaacgaccaaaagactaaacccaaacgtcgctataaatagagagagatccatctttctccacacccgtcaaacccatcttcttcttctccatcgtccacctttaaaatcttatttttaccccaaaccaaaaaaaaaaacacttttcctttccttcacaaaagatatttcgagacaacaaaagagtctcgattttttcttcttttacgaggaatgctcgttgaaccccccctagatcttctgatttagaatcgagggttttcgtctgattctcgaagtcttttctttattggtaagaaaatg

SEQ ID NO: 1088 - DNA, 3000 bp, Unknown
  misc_feature (1)..( 3000): cDNA_ID_3060570_gDNA_ID_1620357_Annot_ID_154539 3000 nt of promoter + ATG
agtctaacaagcatatacaggtttacacaaattatatgtatcacatattgcaagatactacatgacagcaaaattctggaattataagaaacagaagcagaggccaacctcttaggttgcttgtgcgtgtcaaaacttctcaccagattcaggatgaactgacacatcccttgatcagtctggtcataaaacaacttatacagcaagatgcggacagtaaaagcttccttagagtcttcaggtagcaatttgatcaccagatctagtaagcaaagctgcattggaaaaaccacgtgaacaatgaacaccatgagtatactagtttctggataaaatgcagaaggaaatgactatcatttctccatttctccatctcataaaccaatgatacttgcatatgtctaaagaaaaagatgagctacaaaaaccatttaaaaagcaaataggcggcagaagaacagtcttagggaactagccagtaagagattaaagcatgcatattgcataccatggttttcacaagagagcttgctgcagatagaaacttaaaatctttagtttctttcagaccatcaaatgcacagcgccattttgaaatgacaagcaaaaacattctgtcgttaattgttgctgcaatcggcgcacaaatgtcactcttggaaaagtttactccagccttctggttggtagtgagttcagaggtttcctctgtttctattgctggctgaaaaaaaagccagacaatcataaaattaccgagattcagccttgtcgaaatgaaggaaaaataaatgcatagcaacttagaccaatgagagacaaaaccaaagtagctcaattactcacactagaagccgaagacttgtgaaactgaaaagaggtgatggactgagcaacttggaagaaagtaacaatgtcgctattttgaatggagggatgctccttttcaatatcttcacataatgactgcatcagaactaagagatatggtacgctggcatcagcatcagcatcaggatacttaaaaccaagtataaacaaaagaggttgttatattgtgtcatctaccattatatccgcctgacataaactgattgatgaaatcatgcagcaacttcaaaactttgtcatttgtcacagacattggtccatgttcccagacaatcttttcggtggctccacgaccttgctgaggcttaagcattgtgctttccgtagtagaaggtattccctttagtacagctttagtgccatcctatcaaaaatctcattcaagttacataactatttacataaacctaaaattttaagcatcattgcgagaaacaataccatggtaacccgggtgaatgtcccaccaaattgtgaatgacgctgattcatattattgagtcttgcaagctttcttttaacttcctcctccttcattaatgtcttcaaactatctacagaagcttgtttcccctgatccaactgcaaaacaaaacatgatgatcgacgtcagcatcaataccaacaatctcaggaatcatattgatccagttgaatcattaaccttctcaggagcctttgcaacgagctccatgtcttgacccaagagaatataatgataaatctcaagcagaagtaagttgtcatgcctcaacaaactattgaaaccctcaatagtctgagttatcacaagaactatatccatcacattctcacgagacagaacttcgagaaactgatccctcaacgacaaaaagtaacaagtagactctccagctttctgaatcggagatacatcatgaatagcaagtaaattcctgaataaagtaagcacaagctgaaccaatttccaatcttcctcattgaatacatctctgtaaagcataaataatatcagtaagaaagaaaaaatcgttttgcattacttaacacaacaatgagtttcgaacttacaattctaagttctcaagaggagcttcaagcaaagacacaatcactgcaacaatattactaaaagtaattgcagatttcaatccccatagatactctaactgctgaggaatatcatctgaagaaggctctataggcattgtaagaaacaccaacactttaactgaacaaaaacagatcacaatctcatcagaaaaattacaaagcatcacacttttatttaagggcaacagagcaaactcagtacctgcatttaaaactaagttatgttcatcttggtaatgctcaatgatcggaatcaaatctttagagactatattccacgcacagacttgtttgaaaacttctctgctctcaggatcgtcgcgtctcagaaatctcagtaaatctttcaaattgtcgagacagtactcgcttttcgagtacccaattcttcttctgtcttcgtcttcctcgggaagacccagatcgctgcagattactgataatccttccaaatctatcttcttcttcgttgagattctctcctccacatccattttcttccgcggaatacaaaaatgaaataaaaaatctcaatgaaattaagaagagatttttagcgaatcaaaacgtaaacttcgagaaatcagaattcgaaaaggctcagcttctctgtatcatcactaatctcaagtgattagggctcttgtgagcgcgaatagctccagacagtttcccgccatttcgcaatcctcaaaagttacaagtcaaactaaaacaccgagatttggcccacatggtctaaatgggcttataaattggtccaaaagtacgagtttaaacgccgtcgttttgggttgtgtcttattttgtttttttctaaaaattaatttaattttccaactacttaatgatttgtcatgcttcttcgatacgaactaagcacttcttctccgccttcgtaagttccgccgaaaagaaccaaatccttcactactctgtctcagctttcgacctctctcttctcattcctttgcaacttctcacttctcgaattccttctcttcaaaatcagaa

SEQ ID NO: 1089 - DNA, 3000 bp, Unknown
  misc_feature (1)..( 3000): cDNA_ID_2129965_gDNA_ID_1620357_Annot_ID_154538 3000 nt of promoter + ATG
tccaagtgtgtttgacatcatggttgcatggtatgcaaacatctcactcatatggttctgtagtagcaaaaaaatgttcttgttattttggattagataacaaatagactcaatggtgcagagtttcaagacaaggaaatcaggcgtggcttaccttgaaggcttgaccaagattaggtggcatttcaccgctagtaatggttgcttctgttcgcaatgcaacagtgtgcatcactccagcagctttcaatgggaacctgatatcaagtaaagttgagattcatgcatataataaacattcaatgccattataagctaaatcaatagagtacatgaaaagatactgccacttactttccgtgagcagtttctcctgaaagcattaccgcatcagcaccttctctaacagcgatagcaatgtctgagacctctgcccgggttggagttggatgaactatcatactctcaagcatgttagtcgcaacaataacagcttttcccatactacggcacaggttaatgatctcctcctgtataacaaattaaaatcaagagtttcaacttcaacaagttctaaatctccttctctgggttatcttaaaaatgagaggcaagtactaacctgaagaatggggacttcttcaattggaagctctgcaccaagatcacctcttgcaaccattgcctgtaagacatacacaaatctaattagacaatcacatgcacaagagccattccaaccatatgatatatttattgtttcacaaaacaacatccaatcagttgctctcacataaggagattacatactgtaagacatataaaagtcagaagaacaaaatagacaaggttgacagaaaaaatcaccccatctgatgctgtgataatggagtgcaagttaggtatggagtctgcactctcaattttcactatcacgtgtatatcagcaccactatctgcaaatatttgtaacaaacaatctcaaggttagaccaaaaaggaaatatcataggcaaatcattcacttaggatggaataggttccaagtatttactttgaaggtatttcttcaactcgtgtacaacttgagcatctttgacaaaggaaactgcataaaagtcaactttgttctccactccaaatttaatatcctcccagtccttctctgcggcaagaaaataattacaaaaaataagcatcagagtaagatctttcagacttaaatatgcaacacttcaaccaaagcaacaagaaaaagtgaaaaagagggtaaacagaaaattcgaaccagtgattgaaggtaaagttgcactctttcctcggacattcaggtgtctccttgacttaagttctccaccatcaacaacttcacatttgacagagtctttggtctttgacttcaccataaacgacatcataccacctacaacatagtaaaagcgccatcaatatattggaaaagactaaagcagatgtaaaacccttgtacaccaaataataagatgtacataccatcaacaagaagcatgtcacccgcttccacgtcattaacgaaatcatcatagttaacactgacacaacttggtgtgctgactcctctctcaattgtaaaggtaaactcttgaccaggatctaacataattggctgaggtaaatctccactcctaacttccggaccctatgaacaatgaaactaatcgtcaaaggcgatacatggacatagagactctcaagtaaatagataaataggaaacaaaaacaaaccttggtgtcaagcatgatagcaatagtgttgtctttagtttgtgcattgtattctttaaccaaatcaataaccttcttatgtgaagcatgatctccatgagacatattcatcctagcaacattcatcccagcttcagccaatttccatatcatttctcgtgtgttggtcgacggaccaacggtgcaaacaatctttgtcttcctcctcactgtcggcttcgaccacatccctaccgatgtatcaccaaactgctgcatttccaacaacctctcaagctgctcctctctctaatccacattgtaagacaacaaatttatcatcagctcacataaagacaaaagaaattcaattttacagattgaaacagttacataacgcatcaaattgaaatgctatctcaattactacaaaactcaaaacccagaaataaaaaacgcagcttcaatacagaacataagcttacacatacgttaggcacatcttcaggagaaacaggaatgacttcagtctcaacacgagcggatctcacagtagtatcaaccactcttctgcttcttacagagactcttccacttctctttgcttcgttgccaagaaccttcactgcaaaactcgctggtttcaatagcttctcggatcttgtagacacagatccaccgttgggagataacatcgagccttgaattgacctggtagcaaccacttgagccatttctgattttgaagagaaggaattcgagaagtgagaagttgcaaaggaatgagaagagagaggtcgaaagctgagacagagtagtgaaggatttggttcttttcggcggaacttacgaaggcggagaagaagtgcttagttcgtatcgaagaagcatgacaaatcattaagtagttggaaaattaaattaatttttagaaaaaaacaaaataagacacaacccaaaacgacggcgtttaaactcgtacttttggaccaatttataagcccatttagaccatgtgggccaaatctcggtgttttagtttgacttgtaacttttgaggattgcgaaatggcgggaaactgtctggagctattcgcgctcacaagagccctaatcacttgagattagtgatgatacagagaagctgagccttttcgaattctgatttctcgaagtttacgttttgattcgctaaaaatctcttcttaatttcattgagattttttatttcatttttgtattccgcggaagaaaatg

SEQ ID NO: 1090 - DNA, 3000 bp, Unknown
  misc_feature (1)..( 3000): cDNA_ID_2129951_gDNA_ID_1620357_Annot_ID_154534 3000 nt of promoter + ATG
tttgaattcaggagtactgagagctctaatcgtcttccaagacacaagagaaatgcttctgctgcttctgatatcagtagcatatcttcccgctcttcgagttctgtttcaggtttggaaaactgattattgtatcttcttattacatttgcattcaacttcgtgttcttagttcttacgtcttattgtttcatctatgccttatggcttctagcttccagaaaacgcactacaaatctatgtttcgacgagaaacttttcctgcaatcactttacaaggtaaaaagacaaaccttatcacaagtttgctacattgtttttcaatggatgtcttacaattattgtcattttctgtaggtcttgagttctgtatcggaaacaactccgctaatcatatacttgagagatgttgagaagcttcttgagtcagaaagattctacaagttgttccaaaggctcttgaacaagctctctggtcctgtcttaattcttggctcaagagtattagaacctgaagatgattgccaagaagtagacgaaagtatttccgctctatttccttacaacatcgagatcagaccaccagaagatgaatctcagctcgtgagctggaaatctcggttagaagacgacatgaaaatgattcagtttcaagacaacaagaaccacattgcagaggttcttgctgctaatgatatccaatgcgatgacttgtcttcgatatgccacgcagatacaatgtgtttgagtaaccatattgaggaaattgtggtttctgcaatcacttatcatttgatacacaccaaagaaccagaatacagaaacggaaagcttgtaatatcttccaaaaggtaagtgtacaagaatctgtttattcattcatttgcagatactaactgatcttctagctacttaactgattcatgatcttgaaacagtttgtctcatggactaagtatattccaagaaggtggaaacagatcatttgaagactcgttgaagctagatacaaacactgactctaagcgaaaaggaggagaagtatgttcaaagagtgagtcaaaatctggtcctgaaaacaaaaacgagtcagaaatatcacttccttcaaacaagaatgacaatccattacctccaaaagcacctgaggttgttcctgataatgagtttgagaagcgtataagaccagaagttataccagcaaatgagattggtgtgacatttgcagatattggttctctagacgaaacaaaagattcgcttcaagaacttgtaatgcttccacttagaagaccggatctttttcaaggcggtcttctcaagccatgtagaggaatcctattattcggtccacctggtactggcaaaacaatgcttgcaaaagcaattgcaaatgaagctggagctagtttcatcaatgtctccatgtctacaatcacttcaaaatggtttggagaagacgaaaagaatgtgagagctctgtttactttagcagctaaagtatctccaacgattatatttgtggatgaagttgatagtatgttgggacaaaggacaagagttggagagcatgaagctatgaggaagattaagaatgagtttatgacacattgggatgggctaatgacgaaacccggtgaaaggattctcgttcttgcagcgacaaacagaccgtttgatcttgatgaagctatcattaggaggtttgagagaaggtataaaagaaattttggtaaaatgcaaaacctctaaatcagtctttacactattttgactgatttttgttttgtgttggatataacagaataatggtgggacttccttcgattgagagcagagagaagatcttgagaactttgttgtcgaaagagaaaacagagaatcttgatttccatgagcttgggcagataacagaaggctacagtggaagtgatctcaaggtctgtgtcttctctaaccataaccaaagactgtcgtgtaaaatcgttggaaactgactgtttgttgaacttttgtacaaacagaacttatgcatcacagctgcttatagaccagttagagagctgattcagcaggaaagattgaaagatcaggtaaaagactaagaatggccctctcttgcgctctatattcgatcaaagtctcttaggattttgaaatatcttggtggttttaggagaggaagaagagagaagaagcaggaaaaggcacagaagaatcaaaagaagaagaagcagaagcttctgaggaaagagttattacattgagacctttgaacatggaagacatgagaaaagctaaaacccaggtctaactaaaatcttatctgtttgacaaaaaaaaaactaaaatcttatctcattttgtcaagaaaagacaagaaaactaaaaaccctaactagttatgttgtcgtgttattgcaggtagctgcgagttttgcatcagaaggagcaggaatgaatgagctaaagcaatggaatgatttgtatggagaaggaggctcaaggaaaaaggaacagctcacttacttcctttgaaaattgcaaacagatattgatgtgtgtttcttgatgcacacgatatatatataacaaagagatcccgcatatcacaaagaaagagtcttcaattacttgttaggccattccatttttagataactttttaggtttcatcttattctctttctttttgtgttttatagaattttctacaaaactatgatttttttttatatgttcatatttatgtcattgtgaatgtgtagttaatgtagtaaagatattttataaaaatattatgattgtttgttacatagaaattttcatatacatttgaactagaaatcatatgaaaagaataacaaaaattataccaaaccaaatattataccggttccggtttgatttggaattaagtaaattacacaaaaccgatacaatgattaaagaaccttgacgtcgacgatgattgtgtgatctccccagaaaagagaaatg

SEQ ID NO: 1091 - DNA, 3000 bp, Unknown
  misc_feature (1)..( 3000): cDNA_ID_3060597_gDNA_ID_1620357_Annot_ID_154525 3000 nt of promoter + ATG
atgctcagaaatttcaactgaatgctagcacaagtgacatgtcaacatcatatttcgggggcaagtccccgttcccgcaactggaccaattcatagaatccactgcttccacggggaatgtcccaggttgcatttaatctttgttcaacttgttgtgttgtggagagatctcaattctcatcttcttaaaatacatatgctgtgatatttaggtaagatacgctgctggtactggttctcagaagatggcctgattgtgtacagtatgttaagaaacagatattgcgaacggattggcagggaacataaaagcaatcatggtaccatctgctctcaacccatttatgatatacgagtatcgagtatgttatgtaatctctgcaccaaataacatttttttatgcctaacatttgttcaaacaaactatgttgttttagtgatgtacatcgttgatctcagaaggggaatctattatcagaaatgctacgatccagactgccgaggtgtgtatacgatccttactcattgtcttggcaaacaatatgaaagcaaaatcttgttcctaaaaaaaccaactctgtctgcagattatcggtctccaatacgtccagttccagatagttaccttcctgaagatatggtctactatcaaggagctacacagaatctctgtgacaatctttactctgaaggagaatgtcacgttgataaagaatgcgatccagatagtgctgctagcagaggctcatggtggcttgaagcagttaaagtcgcagatgatcttgaaagcaaacccaagacacttgaacctcttacctgggtcagttgacttattgttattgacttaagactctgtctaatttctcgagaatattataaagaaaaagctttggctcacaggaaaattacgaggaagatgatgactggtgggtagcagctgcagaagagtcactaaaacaaatcgcatctctaagtccttccccaaaatgcccttgatttagacatctacctaagtcaagaccaatctgggttcgtcttcttcccttttctctatttaaaaccaccatcgttccctaaatcaatgaatctctcaaaattcaatggctgcattaccagtattcataccagcagagtcatttccatcgatcctctcacatgaaaccttgatcaatcactttcggaccaatcttccgaaacattcatcaacaatcacaagccctgtccggcaaaactacaccgtttcatcaccttcctctctcctcctcatgccttcttggtcatcttcttcttctctcccttacatgggcgtcaagctcgtgacctatttccctcataactcttctcagaacttacctggcatccatggatcctacacactctttagctccactacaggccaaaccttagctacaatggatggtactgttttaaccctttaccgtacttcctctgtttcaggcttaggatccaaaatcctagctagagacgatagtcaagtgctgatcatggttggttccggtgctctcgcaccacacctgatcaaatcccatctagctgcgaaaccaagcttgagaagagtgatcatatggaacagaactccacaaagggctcaggagttagctgaaaccctctccaaggatcctcaacacaaggagatttcattcgatagccacgattcgctagatcaaatcattcctctaggagatattataagctgtgcaacaaactcaactgttccattggtcaaaggtgagttcttgaaacccggaactcatcttgaccttgttggatcgtttagccatgaaatgaaggaatgtgacgacaatgcgatacagagagggagtgtgtttgtcgataatgacactgcgatgatagaagcaggagagctcgcgggagcgtttgagagaggagtgattaagagagaagacatttgtgggaatttggtggagttgatcaaaggtgacaaagaagggagaaagagttcaacagacataacagtgtttaagtccgtcggttcgggtaccgtagatctcttaaccgcacaacttgttcacgagacttacctcagccgttgttaagcagtgtgaatgaatcttgtttgatcattgcgtttgcgaatatttcacattgttatttaaacgaaataaattattgatatggacctatggttttgttgttgtatagatggagttttattgccaaattttggattggttgaattctgatcgcaggtgaagcaagttgactttttgctgaactccgttcaggttttgctgatagccggtttggttagttgtccttctcaaattaactaattgaaaatgatatactcctaaatttcctattaactaattaaaattagtagctggagatgtgaatggaaattgattagtaccaatgtaaaaacggacaaattagtatgaaattgtaaaagcggacaaattcgtttactcgcatctgattttgtatgtaaacagtgttctctaatagtggcttcatgaatctctctaataaaatatgacttgttgacaaccacaaaaaatggcattgtgctaattagatccaatccaactatctaagtatacatatcactgacttatctttttttttgggatcaaaatcactgaattatctaaaatacatatttttggatttatatttgaaccaaacaaaaagacaggcgtatataaaagagactaatcaatcaattagtcatcgaagccgtcttagctcagtggtagagcgcgtggcttttaaccacgtggccgtgggttcgatccccacagacggcgaagtagttaattttatatttgatgcttttttttggggccaatcgggttttcggcccattaattaaaggcggtgataggaaaaaaaaacaaaaaagcaaatgacctaattgagtcagcttcttcttccctcttctctcttcacttagaagaaccgcaaagaaaagaccttattcacacaggtcgtctttgcgaagctcatcgtcgacg

SEQ ID NO: 1092 - DNA, 3000 bp, Unknown
  misc_feature (1)..( 3000): cDNA_ID_3060584_gDNA_ID_1620357_Annot_ID_154531 3000 nt of promoter + ATG
aaccgtgcagcggctaattcatcggaggcattgagatctggccggggatactgcagttactgtgattctattgtttggcacgaaaacttgagatgtctgaacaaacaatgtcggttgaaatcaggcaacaagccactcgacctcataacaactcaccaggtaagctattcttgcttcaaatgtttgtctcgttttatatatacatgctaaacaagctatttatctgcctttggtggttttgttacctcacaggttgtcaactatttgctggggatagagagttctgatgatgaaagcgaatcagacgatgaagcctttcctggacgactatggaaactttcttacgtgcctgattacttgtaaatcactaaagagaaatatatggccctatatgggcttgtggtacctcattggaccatttggccttactaagaatgtttgtgtagtttcaagcctacttgattagctttttgtttgcagatacgtatggtaatattgtgttttatctaaaagaagtttctacttttctaataacacttgaatttacgaaagagtataataatctaccaaaataatggaatataagaatttgattttttttaatgaaaaaatctgtagcctccttataaggaatgaagaataaaatgttgcagtgaagagtgaatggtaatcagaataatcagaaataaaagttaattaatgcttgaaagttgaaaacctgaaaacctaattactctgtgactcattgtcgatcatagattcattggagaaaaattgattaatgaattcgtatgtatatgtttaaaagatattgaggaagttgagtaagctagtgtgtaaagaatgcaagtctacacaatgtttattaattattatatacatattatacgagtaacgtagtgataattagtcgtggaaaccattattagggtcttttaaagatatgaagcacattttcttatgataagaagagctactattgaattatatcttcaagttttctttatgttatgctgttaatttatttttatgagcacctttttataggcgaaaacataaaaattcgttcaactcctaataaacaattctataaaatgtgatgatgcatacacacattccatgacaattgcgtggaagtagttccgaacgaatgaataggcataacttttgtattattctattaatcatatttaggtctaacagtataagcactttagtcggtatagctccatgctatccttagaaaactattgtaatagtcaataaaaaacaaaataatagttttccgttttcccaatttgtcaccagctattatatagtttaaaccaaattcttagtaaagaatgctttaatgtaaccaaggaaagttaataagtttggtttgttggttcataggtttgctgcattgaaagcaacaattgcataacaaacttagaagcttaaaatcgaatcgaaatatagaaaacaaagttgggaacatattaaacaagtagtataaaacagagttcgtctaatgaataacttattctcacttgtattaaagctaagaaacaaagtattttaacaacacacaaaaaaaaaggaaaagttaaaagcaaactgttctttaaactttaaagtgaaagaggtgtaaaattttgaacttcacgaaagaaagagcttttcgagtcaaagcttttgaggttaaaacctttgctatactcatagacatgataaatggatactagtacatacgtaacaatttattctttaagagtagagacaaaaggaaaattgaagtatgtaaaatgggccaactatacttttgtcatggaaagaaccccaagttatctttatacactaaggtcagagttcagaccgtcagatagctaaactcttctgctttttctgtgtagtaaactagtaaatgtttctttttgtcattcttatttatttatgtctgtgttcttcattctgtcttgttttttactatcttattaggtattttattactataagagtcaatttgagattttgtaactatagttggtatcatttataaagataataacatttttcaatctttgctcaaatataataacagttgtttaactatattagggatacatatacatatatattaagactagaaaagttaattgaacgttcatacgatattttgtgatataaattttaggttcaagaaaactcaaaaaccatgtattgaagatatgttgcggtcaaaccacgagtcggtcttaagcttttgcttcgagttgagcatgcatgcatctctcgttttaccctaaaggtgcaaagagaaagtatgttaagagaggttttgtttttcttttcttccatgctccactcctctttcttttttttcttttttttaaatccttattagtttcgtagattatattcttattttcaattttgtttcaaaatatattattttcaatttatattgattagagaaaatttattatatataaagacataaatttttacagcataagaaagagttaattttcagaaaaggaaaattaaaataattttaaaattttataaatatttagtttcagatattagaaaccagcatattttacaaaaaaataaaaaataatccaagcactttattctaaagaaaaagctactattatggcatagaatgctaaataaatgaagacaacagataaaacaaattaacctgtgcattagaaaaaaaaaaggcaaaggaaaagaataaagaaaaagaaaggagcggtaataaaaagtagagagaaaactcaaaaaaacaaaaataaaacattactttttatttctcttttttcttcctttaccaaacaaaaaataataaaccccatttcgaaaaaagctcaccttctctttcttctttttctttctatataaaatcctcacttcaccatttccgttgacaaagccaaactctttactctatctttatctctatctctctttctttctttctccattactctctttctctctttctaaatg

SEQ ID NO: 1093 - DNA, 3000 bp, Unknown
  misc_feature (1)..( 3000): cDNA_ID_2129932_gDNA_ID_1620357_Annot_ID_154527 3000 nt of promoter + ATG
gtcacataaataaagcttgctgccaaaaaaagaagggttaaatctttaaaaccccgacctaaatagttgttttatctagaagagacaagttaaagcgttatattaatggcatcttgaatactatattgaggcattaagatgtctagatatttttgagatttagctgaggaaatctattttcgtcttcgatatctattttaagatcttcataatcttaaaattcaatcaaactctttagaaaggctgtcgttacgcatttctttacatttaaaaataaatgtcttttatacatataaattaatttgtggtcaatgacataaaatgaaacataaaacaaaatgagtgaataatagtgcaagtgtgggtccttactccttacgataggattttgaacattattttatactccataagtgttctattatgaaacacataattaatatataattacaattgttaaaccaaattttgttatacaatattcacatttaacataaaccaaaatattatttaaatataaagaaagctaaactcgaattgaaatatagtagttttaaattttcgtaatcagctgttaagcctgtaatttgacaagagaattctcatagtatacagcaaaaaaaaagacaaaatctctcaagtcccaaatgagcaaaaatacaaatagtgtcagacaaacgttttaaaaacgttgagaattttcttaaattatttttggaagtatacaagaatataattttttcaaaatgattttgaattttggaaattttgtttagttacgtcacaataattttgaaattattattttttttgtcggcaactgtgattttgaaattagtttcttaccaacataattattttcttataagaatgaaggaattgaataaaacaaaaatacggcgaataatattacatgttgattgctaacagagaagagtaaatcgcacggcccagaggcacctcagataaacggacgaatcagaaaagaggaagccaatatatacggaagcagacaatcattacctttcatcgcaatatgactcactatcctgcgctgttactgctactgtacgccaaaacaaatgcggtccctacctttgacttggtttaaaaaagtcaaaattaaagcagcttttgtgggataagattgttgagagagaggacaagaatctgtatctaaattccacttacgaaattacgagaactctttgtgtctgtgagataacaaaaaaattaaaaatggaaaaaaaaataaagtagagagtgacacaagtgctttgtttggttcgaatattatttgtaccattaccattttattttctagcacacaattttgcaatttttctctctttttttggcctaatgatttgagatattcgtgctttcttaccttttaatttgtaagatcttgtgaacattttaaatcatacaaatatctcttaaatcagtgatgagattcgttttgtgaggaggaggaatctagaattgatcttgtatatatatatatatatgcaattttaaaccattcaattcttggattctttttttaaaaaacgtctaaattgttggattcttttatgagaactctgaacaatgttacttacgttacgtacgtttaaaacaatttaatatttcttcttgttcttgtgtatatctcagcattgacattcacgctaaaaacaaactaattatgtatattttgtgtaccggagaaatgttgtttggataactaccaagttgtaaaacatactataagctactgctcaaaattttgtactataaagtatattgattcaatatcatcacagaatgatgtttagtttgtctccaaatacaaaaatcatggatttataaacaaaaaccctgagaaaaaaaaacatgttgggtttaataaaacatggagataaaagtctaaactaataaacctagcgggtatttctttttcttaaaagacatgattaatattttcttcgcatctatattttggaaagtgaaaaaacatactacatacattagttagataaatcttgttttcgcaagaaaatctgatagtacttgctaaaattttattattttcctcgttattttaatgagatttgagaattgtaaaactagatttttgagggctagtggtcgttttataacaatgttagtcgcgtcacctagtaacctgactttaccgaatagttaataattttcttaaatgccaacataccaaatcattaccagtttaccactcaaccttagtccttaattgataggaatgtccattgtttgatgaaaaaaaaaaatgaaaaaaattgataggaatgtccattaagttaaaattcttacaatacatgttagtgttttactgtttgctgactgaatcttaaattgatttaccattagtggttggtggtaaatttgaaattttgtcttacatgctttgtttgttcagaaagacagaaaccatgaagcattttcctaaggtataagaacattatcgtaaatctgttttctagttacacagaaacaaactttcctctatcattattttatcactcagcaaacttaaatcattgaagtgaaaagacaaattgatcaacctcatttgtaaaatctattcacaatatatatgtataaattattagttaccgaatcttattggtactctttcaaatattaacaaatatacgatgatggagtacaacataatatatgattttttgaaaagagtataaataagtgaaaaagaggaaagaaaagaagatatgaaaacccatcaaaagttaaaaaaatttctttttgtcaaatgtataaataattgaaaagaataggcaagtcaagtgctctctctcccacacccatcgattcctctcggacactgccccaatctctctctctctttcgacaaagaaaaagtcagcgccgtcctttacgccatagtttgtctcctcctctctctcctcctctcaccaacataatcaaagaagctttcctcacgaattcaagatcgcc

SEQ ID NO: 1094 - DNA, 3000 bp, Unknown
  misc_feature (1)..( 3000): cDNA_ID_3060679_gDNA_ID_1620359_Annot_ID_154577 3000 nt of promoter + ATG
catttttctataaatccaaactaacatctactttctttaaatctataaccctaaacacttttttaaactcaaaccgatatataattttgtttaattttaaatctaaactctagtgacttatttataaacccaaacctaaaaataatttcgttttattgtaaatttaaactctaatttatatttataaatctaaactgacttataattttgtttaattgtaaaatctaaattttaaatataattaatcttgtttaattaaaagtatacagatttgttattttagtttattatataatatgatataataactagtttaaattaaaagtaagagtttattcttagaggtaaatgcaagtattgtccgaaaaaacaaatctaattcaagtagtgtccgaaaaaaaattctaactagtttgatagttaaaattttgatttaaaaaaggaaaaaaatcaaacaagatattaattagaagtgtgagacacggcacaagagtcacatgagtgtacgtacttatcaagattgactctgtctgagtctgaagtcccaaaccatgatggcaccacttccacatacgatcgtgccccgtattttggatagaatacggacagtggttttcgtttggacacgtgtcctgctttatctcttcgtcgccccaaaaaataccacaatgtcttatctcaaccacacgtgttctgcttatcccaacctcacaatttgtaccaaaatacacactttgcatggaagattttctaattatacaactcacattattcgaatttaaatttcgattttttagtttcaagaaaatcattctttgatgggtacttgtcttatttaacaggttgtatacttgtattcattgttctgccaaatgaaaataaaaatgaaaatgatgttcattgtttaataaaagtactaagataacaatcacgacaaatttctgtctagttcattaaatatttaatcaaactctaaacgattttcaaacaatttttataattcaaaaaataagttacatatctttgtttaacataatataataaaaataacatgaataaattattttaacataaaaaattcagtttttcaaaaataagtttagaagtttacgttctaaaataaggtaaaatatgaatgctgttttaagacgcaatctagataattttttttaataaaaaccgagatacatttaaatctatctaaataacttataactacctaattgttacataatctaccaatttaactctatgtaaaataaaactgattttagtaacatttaagcagtacgagaatgctagcgcctaattaaacgatcttctaatccactttcttgaatatttgttttaactaaatctaaacaaaaatatagttatataaccacaaatattaatgaaatttaaacttatagtaactgaaatacccaaaactaaaaaaaaaaaccaaaattataataattataaataagaagatattagtttatgtttacaatcgaaataatcaaataaatgattgtctttatttaggactacgatcaagaaccgaatgggcttttccaaaccaaaccgagatttgaattttatggtgcggattcggttaactggagaatagctatcaacaacaatttaaaatagatttagctagatcggtttggttcggttcgttttgtattctctgtcactcctcacaatcgcttatattttatattgtatgtttaaaagtcaacatcgaaatattgtacgttagtatgtcacttatgataatgtttattcgtaaacacaatttgaaaaggtcaaagaaagaggaaagatagttaatcaagcccttgttgtcaaaaataattattttatttactgtcatcgtaatgtttatcaatgcagttattaatctcatttttttctcttccgaagtcgacgaacaataaaaaaaaccaatctcattcgaagtacttattactgatatgatgctgagctgacacagtcgtaagccttggacaacaatcattcatgacgtcactgctgtgacgctagaatgatgacattatatcaatgtttttttgtctgaattttgttatggtaaaaataatgaaaatgtagagcttgagtattttgattttcgttttattgtaaactagctgaatctgaatcttgagcagttaattaatttcgtaatttattaattctattctgactttttaaaatataatatatattaactttggtagatgcttaaggtaattcttttttaataaataagatggttagagtatcttaaagttagcttataagaaaatcggaaaaattacttttggtgggttaattgtttctgtttgaagtaatgtgtgtagatttttcttatgaatttagattaaaaactatttgtttttcagatgttttaagaaaaaaattgtcattcatagcttgtccattcttacataccttaataagaaaaattataaagttttgtggattcacggaagctaatctaggttatgtatttgcccaaaaaataatctaggttttgttatggaattaagaaggaaaaaaaaattgagataaatagtatataaaaacaatttaaactaagtattattagcttaattgataaagattttaggtgaaacttaaaaatagttggttaaagagattacaaacattaaccaaattaaccaagaacctcctagtatttaaaaaaaacacttaaaaatatccaaacatttaattttttaatcataaatcttataaaacccacagctgtcctttcgaaaatccactatattcggtggattaagaattaaaaatcattcgaataatatgcatacttatataacaaaaacaattcacttgaaaacataatcaattgagagtaggaccgagtaacactgcattgttttatatatatcatcgatgcacatcgcatacataatatactcaaagtcgagccttccttcctttatctcttataccctttttgattcttcttcaattttctgacatcaa

SEQ ID NO: 1095 - DNA, 3000 bp, Unknown
  misc_feature (1)..( 3000): cDNA_ID_3060662_gDNA_ID_1620359_Annot_ID_154592 3000 nt of promoter + ATG
gaactcttcgaaaaaatataagacgatatgtgatcataattctaatcttaacatggataaaggttatataagttgtagtctcttcattataatccaactcaaaaacaggtccaaaaatacctgtaataaaacgcatagttagttcagagaaataaggaaagaggatatctctaacttgaactcataaatcaatgaaagtgaaaaagttcggaccagaaaaatcttctcatcttttcaaagcaacagactactagttaaacatgcaagaaactcttctcaaaatagacatcaagtcaaactgagaacaaaaacgaatatatattagagtcaggaatatatatgcgtatagtatgtgatcatattgcataataattatcgtctataaacaaacgtaaacttcaacgtcgttagtagactataacttaaaattatatttattataatggaacatattttaaattttgttaatgtaagctatttacttttatttaatatagtttacaatttgattacaaaaatatatttttaatcaatctttctaataactcccaattcttattaactaccaattactttaaaaaatctattatatatttttactctcttttactctaattatcacttttcttttcctcctgatacatcttttcccaattactgtactctcaattactctaatgttatccaatcagaccctaaataatgtatctacaaagagtcatgtatgtataaaccacgtgtaaacctaatagataaacccacgtgaagagaggtatggatgctaacttcaagaccgatccaataatagttgaaaataacacggactgattaaatttccttcataacaagtcaacgaaagtcttttattaatggtaacggtaacatgtcacacgctcccaattaaatgctaatctcaaatcttaataagcatttttcttagctcctcgagcctcccataggattactctttaagacttggtgatagtagttgttgaaatttgatgaacatgcaagtgacacatattacatatacggctctactttctaccaagtggtaccacaacgtacacaaataaaaatttaacaaaaagaaaaacgtacacaaataaattaaattcttaaaagaatatttcctccaagtcaaagaagaaacaagtttactcttcttttaacgtccgggtcttcttttaacgtccgggttatatatatagtaattgctaaaagcccaaaactttatgtgatttagaacaaacagactttatgtgatttagaacaaacaattttcagaatcatacattttcttaatgccttgagcaacttttgatcaccataatttactgtctttttcgaaaacttatgtaagtgagttgttattgttgttctaataataattataaaaatggcaacattgttatggtggggaatcctcgaggaatataccgatgccaaatcagctgtgaaatgaagagagagacgtcatagaaagtaggtgggcctctagtgggccgtgcatgttctcaaaagttttccactttcctcacatttttctccttttttggtctttttcaattaaacgccacattcatttttatttttattttgttgcaaacttagctattttaaatctattgtaaagtttatcaaatttttatttttattattatagaatgtttgttattagaaaatatatcttttgtaatgaaaggctgtaatttatttattttgatataaacttgccaaacaaatgttttccgtatcctcgtttttcaagatagagtattttttattattataaaatatatatcttttgcaatgaaaatttttaatttaaaatttgtttattatttgattatgtcatagtattaatagatactatatcttttgcattttttgaaaatagtgaaagaaacttttcgcatgctttgtgttgtgagttgttgaagaaaaaaacttttagagtgtgagttgttgacaaacaaaattaaatacatcttttgcatgctttttttttctttttcttaattcactaattaatggacctttagatttacaaatggttaacataaataaattaaaggttgtggatacgaaactagttaatttaatagtattgtttactttttgtattttgaataatctatatatagagtaaacctataaaattcatattttcatatattattttctaaaattcctacaaatgatttaggacttatcaataaaagttttgaagatgttttaaatattttgtggtaattttgaattaatataaaaaatcaattctatgttttagaatacctctatttcatatatatatgttaaatatggaagatccaagaaaaccaaattgggttcgaaatgtttcaccattttaataaattctgatttgtttttttttttgtaaaattaataaaatgtatgatttttctagtccttatagtttaacattgcttcggaaatcccatgaattgctactgacttttagtatttgtggttacagcaattatttgtaaattgtaacactagatttttgcatccaataataagagtgaaaacttaaaatgatgaaggattttaggattttaggagttctttcaaaaaattcaactagatgtcaaatatatatcaattagtcgattacttttaaatatagtatatgtttggtaacaaaaacattggtaaatccgaatgccaaatggcaacggctggtccaaacttaacagctatagggttcttcctttacaagttggagatttgtacacatatttaataacgcacacacacacacgtttatacataaagactcaaatctataaatagaggtatagagtgaaaggaaacgcctaagaatccggaaagctcaaaacaaaaattgagagaaaaatatagcattagatacgggaaggtccacgtaagacccgtactctactttgattctctcaatctccttcaatttttttctagattttttttgtgatcaatctttgatctaagaagatg

SEQ ID NO: 1096 - DNA, 3000 bp, Unknown
  misc_feature (1)..( 3000): cDNA_ID_3060651_gDNA_ID_1620359_Annot_ID_154596 3000 nt of promoter + ATG
gtcaaataggtaattataaaatgataggaaaaaaataggtgaaatttgggtggggatttttttgtatcttttaatttttgattccgcgcgggtttggtttaaaatattaccaaggaataactgacacgtgatatattatctctctaactctcgataagacaaaacaaaaacgaaataagtagacgaattcaaaatttaattaagtgcatacaatacatgtcctcaaaaaatgaattaacaatgaatataaaagagaaaaaaaatcactggtgggacccgtttagtgggaccgttaattaacggagttaggatcatattatccgttagaagacagtgttagttctctctctctaatctataaatatcttcttcatcttcttcttcccccactctgctcttcttcctcttgttgctatcgtctctctctctcgggtcaaaattagggtttcgtttcactatccaggtatgtctctctctctctctctctctctctctctctctctctctctctctctctctctctctctctctctctatcttacctttcttctctgtgtaatttgcttctgaaatttctaatttcgtggagaatcttcttcatcttaccatcggatctggtagctctcacttcgattcatttcaaatttggatttcaaatttcgttcttagagatgtataatcgtggaatttgtaatctatagcttaattacgttcaagtagattcgagatttgatgtgattttgaagaattgattagctgaaaatgtggagtgatctacgttgtctgtgatgatgatattgatggttttcttcttcttcggctttcttcggttctgcagagtgtatacaaaggttgttgtggagcttttatcagatcacaggaataagatggaggtatttggaaaatctcccatggttgttacatctgccaatgttatttacttgtctgcaattctgggtcgcgattgcgatggacacaaatgtgattggaaatgtgagaatgaaaatgtttgtgggaatatgtatcgctgcaaactaactggactaactcatgtctgcgacaagaactgtaaccagcggattctctatgataaccatagctctttgtgccgagccagtgggaggattttccctctctcgtccgtcgaggagcaggcggttaaaggtgttcggaggaagcttgacgccgctgagagtcatccttctgagagctgttcgtttaagcgtcgtcgtcgtgatgctcagttccatgcttctcctttcgagaggtcttttactgctgtgagccctatctgcagcccggctggagacggaatggagttggtttagattccatgttgatctccgcaaatcctgagactgagaggcctctttatcttacgtagaataacttcccttttctctttcttttggacaactatggatatgagacattgtgctattgctctcgcagggaggtctaggcatatcctccctgccttaaagagagcttttatcttagtaatgttgaactttatgtagtacttatgtaggagagactttataattctaatgctttattctggatcttactgctgtcgtatttaggtgatgtttgatatctcttcttgtccacctttagttttttcttgtgattggacacgatatttaggcaggcttttattcagctatgtatcttgttttggctactattacgcagagcctgacacaccatggttgatttctgtaagtgtggtgctacagggttttacacattgctaaccaattcccttgatcctttctgatcgaaacctaattctaacaaattatgtgtttatttccagctttccatttccttgattgatgagtatttggggttctgaaattgttttctgtttgtgcaggtttcaaatgttgcaattcaggagagtttaattgtgtttcttttatgtgtactgatttgtctgtttgaattttctttatcaaaggagtaaatctaactgatggaagtttaaaccttactttgtaggtcctcttgtgtttgtgctcagcaggaaacaacaatcatggtgtgattcattgtcattggcaacataagctgttactccttaactgtgagaagaaggcgggcattgaataggtatgaactacccaaagaggatgcggttggccaactgtgttcaaaactatcaacgaaacatggtaattatgtgtattgatgatcaaagaattgttaccgttagttacccttcgtttttcatttacctgtgggctctgcttctgtaccaatacctggctatatctgaggttctgatatttttccaatatctatgaccaggtacaatctctttaagtttctgatgaagacaacttccatgagtcccatctaaatcgcagtcttggtaagtcatagcgtacttacaaccttcttgttcctaactgcttgttatagtcctaggctacagccttacaacatcccctactctgaagtatatttacaatggtgaactaaattaactcaacaataaaaaaaactattaatcgtcatatagaaaataatctccaggtttgcttcataagtagaactgagaatggaaatgttgcttcaagttgttgtttttcagcgtggatttaatgcaatagtttagctgacagaaaggtgaatgtctaggcattcgatggtttcctgggatcgttgaagattctcttctgaagaagttggcaaagtatcaaatgttgactctgccgctacgataagataacggtacgggaatatttctccctaatagctaacgaaaataacaatcactattttactttttgttgattttttctaatttctactatacaaatttgattaccaggaaaatattttatttttattttttatcatttgtttttttttttaccaaagatatatttggttactttattcaactcaattgtcaaggaacctggatctagtgtaaattctcttacatgagacatcacttcattagttctataataatataataaaccg

SEQ ID NO: 1097 - DNA, 3000 bp, Unknown
  misc_feature (1)..( 3000): cDNA_ID_3060666_gDNA_ID_1620359_Annot_ID_154591 3000 nt of promoter + ATG
aagttgtattgattcaggttcaatggtagttgaaccgtgtcaaagtgtcactctgtaaccaagtgaagaaatttgttgtcatttaaccgtaaaattgtcaattttactgatgtcaaagatatatatatttttttggtaattttgcatatgcatatggtatatatggatcatatatattccatgtttattttcaaccctttactttaaaagttacgaagaatttagaacaaattacaaatatggacttggatcaaaaatgttcataaattctacttctatagctttttctttccccgtttataatatatggtattcggaggtaacatttttcttattttttctgtcaaccacattaattgtttgagatctctttaacccttttgtagttaggacaaatgttaagaatccataatagtaaaactaaatatgtatttatttttggagcttttatttttaatctttttttaaaacactatatatatagtgggtggttttctatatttttttaactaacgttgatataggatttaacccacgatataccgtgggacaatttgtgtttcgcacaatcttgattcgatatgtttaatattggtagtgtaacaaaataataaaatgaaaagagcaattgggtagggtcggatcatcatgagatatttagtaatttaacaacttgtagttttggtgacttcttaaattttgatcagatagaacatagccactaagtaggatcatgaggaaatacataattttctaaataaaataaaaataaaaagagagatttccacatattcaagttttaatattttttctttgtttttcaaataaattaaaactaaactaaaatccacatctaattaccattcaaatttttcaaacaactaacatttacaccaaaaaaaaaaattacaaactaaaattcgaaagccaaaaactattttaaaagctacatacatttatgattttaaacaacggaaaataaaatatttccagaaactgaactttgagatagaaagtaaacgtctttagtaactaagtgattggttggcatgtcaccgtaaattattcgctgtaaaattttgaccgtcagcgtgtaaaatgcaaccgtgtattttattgttatacgtgtagatattagggatataaagtcttagaagtaaatttattagtcgtatcttaaaatatgattagtaaatattttataaaatattatagttaaccaaactatataataaacaacaacacaaattttgtgatgcacatataggttaaatggaatctatataaacatgtaaaatagtttatatgttagtcggataataactacatattagttgaaaagaatatatacatataaattttttgttcaaatgttgttcaaaatttatacataagtatacattaacaaacaaaactatacatggtatttatactattagtatatatccatctagtgcctagtgtacattatataagcaacacataaaaaatgatcatgaggaaataaaattaaaataaaagagagattaaattaaaaatataacttatagaacttataacaacatatggttttaggttgtagaaatataagatttacggtcacaagattttttttttttctaaaactaattcacaacaatttggtcttcacaaaaacaattatggttgtaaaagattacattccaactaatcaaacactataagagactatcctcaaactagaaacgcagaggtctaaacccaaaaacaaaacaaaaagcaatgacttagataaactttgttggatatgggcttcgccccatttaacattcggaggcccaaacaaagagtcattgaaaacctcagttaagaatgatgaagaccagcccccctgagaaagccgcagcccattgcgagatgaggcccattttctggaaaggatcagccgccatagaagtttcatatcgctcagaaaatggtactgtgtactttcattgaagtactataaatattgacagaggaatgccagaaaaggacacctgaagtcggacgagaatagtacaagaacattctcattcggattcaaagacataagctcgacaattgacttgtgtagttttattcttgttgtatctcttaaaacgaggcttggctgtaaacatatcttgtaaacggccgaacgttaagtttagataaataagatcttccttttcgctcgctactttcttctctgtttttgaggtttagttttgagtaccaacggacttcgatatcaaacgttttaaagtttaaacctatttgatttacattatttggtttaaataaattgattcagacttcacacgaccaagaaaaaaaaatggttgaattgggttctcatctattgggctttaacaacaaacactattagtaagatgggctggccagttgtgtaaactgtttcatattggtaaatcaatatgataccaattaagtttatttaattcttctttaacttccgtacaactatcacgaagcttcctttatagcatcaacgtgtcaatatatgattcgctaggtgacatctctcgttcagacatcctcaccttttgactcatataacccctatttccgtaactattttactgcaatacttcaggggtaaaataggtatttacattctgttttgccttttacgcgtaacgaacgtggttttgtgttttatgactttctgggaaacagtggtacgcctatccacgcgccactttttcatctctttgtctttgatatctctcttgtctgaccaaatcgtgtcacatctccttcttctccactttaccaaatcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatg

SEQ ID NO: 1098 - DNA, 3000 bp, Unknown
  misc_feature (1)..( 3000): cDNA_ID_2130683_gDNA_ID_1620359_Annot_ID_154578 3000 nt of promoter + ATG
agcaagcgagtgagagaagacaatttactgatacaaatattcttatctcatatgatcttttccttgtccggtagaagacaatttctttgttgcctctttttctttgtccggatagtcccactggcgatattttattttttttgggtgatttttctattgtggtcccatccctgtatataagttatgattttcatgcaaacaaaattttaagaaaatagtgtagtcgtgcaacagttcgagggtcattcacctatttgtattttagtaaagtgtgaaaattatataaattcttagttttagaatttatatttatataagcaaatctatttgtgttttaatcatatttttaatatggaagatgtaagcttttgttaagctttataagttaactactaaaagcaaaacgagttaattaatgcaaataacaccatgataatataaaaatgtttaaaattttacttagaccaagtaaacggtcaataaactaatttgaaaagggaccaagaaaatctatgtatatttggtagatttgatatacctaaggtcaagtagaatttgggagtgaatgggtaaattttttcaaagggagaaaaaaggagagatttgggaattttcaacattagagcccacaagaaataagattatttttaatcaaatggttttttctcgaagaaaaatatatttaacctaagaaaaatgattcaaaaaaaaaaatcaaatttggggaatcagaatggtaaacaaaaaaaagcatcttcaatcaaagaaacatttattgtactatactagttacttttcggtcaaaaaaatatcttcctctttttttttttttagcagcaaagaaatatcttaaagaaccatatcctttgatcaaaaaaaaaaaaaaaaaaaaagaaccatatccttatctcatgtgagttttttttgttttttttttgtcaaagaatctcatgtgagtttctttgtccgtgtgaggcaatttccttgtcaacactcaggagtttcattttttctgtgtatcttctattggatgaagcatgtttaatgatcattcaagctctgattcaagacacatgatgtaaaattgtttttttttggacagatataaaaagtcttcattaaaagaaatattttcagtattaaaaatttaaaatgtgccgtcaacccagcataatagagattgactaatgactattctactggacgaccttgcatggaaagtgggagacttgtgcccacaattatctatatccaaaatgattacttattattgactgtctattgtaccttttttgacgaccgtgtatactgtatatgcatcaatattaacgctgctaagatacgatttacatggaactcttatgtatcgattggcatcaatatttacccatggaaacgagaaacataatgacttacagttagcttaattttgattaaagtcttcaagtccttcgaaatttctaaatcattatggcaaaaaaaaatgtagaaatttaaaatatggtagtttgtaaaacaaatcttagctagtgaccaatcataaattcaaataaaatagtttggacaattttatcatatgatttaaacacgcaatttcattttaattccactttactatttagcatatcaaatgattaaaaaaattaaaattaaaatggcgtctttaatttaaacctttttttttgttttttagctatctgtcatttactaacagaaacttaccaaattcccatttaatcataagaaactacaattgacccaatgaccatgtaatgcatagatggtcacaggaaaatgagtataatagacttaagactgacgtcctcttttacacatcatctttacctgttctttctcttttttttttttgattctcctatatgtttaaaacgtttatcctttattttatcctgaactcgatgtcaaataaaatattttagctttgatctttttatataaattgaattatctccacgattctactaaataatatatttttctttttgcatatattttggttaattttgcaatatttggtttagctttttgaatatattttcgtttatttttttagaacgaacacacaaaaattttgagtgagaatacatccttctattacaaattaaaacatctgaatgatatctattttaatcattaacataacatgttagtctattaagaaaccatagaataaaacgatatcattttaaagttacccacataacattttattttaaacaacaatgaatagataatatttttttgttagtggtaattagaacataacatttcatcacacgttttattatgttgaatagatgtgttctcatttaagattgcaaatataatgtgttttaatgaatgttttggccactagtgactttgaacttagttaactctatttattatctattattttgatctcttaacaagtgaactatttatatatatgattcagtttctgttcttatgtaattatttaatcttcattcttttaactttttcaactagtaataaacttcaagaatattgttttgttgacaaatctcgtacacgttttctaatacacgcgaccgagacattttgaaacacacaccttggtaagtcttctaaaataagcttttcctcttattgatgttgcgtaataaaatatatcaaaatacttgttctgtgtttacgtagttggcgcgatatgctgcaatagtgttttcttaaaaagcaccaacacaaaatggaaataaccgtttgaatcattccacttgaacttcatttagtcgttaaaaggcaacccagttcagtcaagaaatgattatttaattgctaacaaaaaaatactattttaaagattcaataggacgcgtgtgccctagctacctctttctctatataagagaaaatggatgcattaacatttctcaaattcctctaaacatcttcagtctctctcaaataaaagcaaaactaagaatttgttataactaattaacgtcaaggaatatg

SEQ ID NO: 1099 - DNA, 3000 bp, Unknown
  misc_feature (1)..( 3000): cDNA_ID_3060670_gDNA_ID_1620359_Annot_ID_154589 3000 nt of promoter + ATG
acatgtcaattattattacttaaagttcattttatagcaggtataccaaaaagttaagtccaaattcgcagttttagaggaattttttactacaagtaaagtgataatatcatcagttttaccaaacgatggagaccaattttagtttgtagcataatatagaaagtataaactaatttagagatggacacaaggtaaaatacaagtgattcatttttcagctgttgtgtatgaaaaattgttttatatgttacttttattcgttcgaaacggatattcaacattttacattaaaaaaaatttcgttgcaggttattatgaaaaaaatacatttctattgtaccgttttaatatttttataacaaacactaaaaatatcatttacctctgtaacaaaaaaaaaatcatttgcctgaaaaattcttcaatttcattacctaatccactccaaacaattacatagtaaaaatgagatttttgttatttacgaatactttcattcttataagcaatacagtggatatactaaatttaaaattttgtaactctttaagacttattaaaaattattgccaaactcaccaagaaatatggaaataaatgtacttttttgttaaatcatatttggataaaagatggactcatagatacgcacaaaaatgtatacattcagcatattgtgtaagctgagtcagctccaggtgtttgggcacatgtaaacatggacccgacctttttacctctttttctgttataagtttttaaaataaaattagattacttcacaaagactataaaaaggattataattccaaaaacaaaacaaaattataaaagtaaaaaagatatagttaactagaaagttaccaaacatggattataaaccggtcaactacgtacattaagaatctgagtgaattctctgaacactttcatctatcattttcttatagctaattttgtcttagtggcgaaccgtaaatgcctctaaaggttcactttaatttctaaatagttcttccaactatcgagcttatttgttttatactttatatgatagttgtaatatgtcataatgtctgagttgcgatatatcaaatagggcacgacggataagaacacacattgatggtgatatcaaccagaaatatatgatatacgtgttgtctataaaacgcccctaatttattcattaacttcacataatcacgtaaactaacattagtcgcataatcgagtaacaaacatctactggtctacaagagttgtcttaagtcttgactgccaaacaaaatgaaattattctctcatttgtccaaatttaatctaaagcatcccacgtgatttctactttttccaccatgccaaggggtttttacaaacactttaatctacccaaatatatttttaatagttttcattttattgggcaccccatgttgcatctatccccaaaaattgcttttgaagaaatgtgaatactatttttctatttttatgaaaatatagaacacattgtttagtgagttttctactgattagattgttcttagtatcgagaatacaagtaaccgaaacttgtggttaaaggattttgatgcctctgctaaaaggagataaatcaaatctaccaaatccgctttaacgaacaaagagaaactaatctaatggtttcatacaatgtatgcaactatagtttgatttgtcttttctaaccacttcgaactatagaaattacttgcaatgagaaataaatagtatactttctgaactattttttttttttcgattacattacacactacaaacaaaatagtttgtgtgtgaaatttagcttttaactttgtaatgtattacttataaaacataaaaataaaacctcttcgtattgtaaatgataagtattttcttagtaaataaattatttagctgacaacataatgttgggtagagatgatgacacgtcatcttatcatctttttctcgaactaacattgggttagaagttatattaaaattaagaataggaaagattaaattactatagaaaattaaggaggaacaatataaatgtaaccaataaagtcggtgagtatgatgcaaagtattgtccttttcgatgccaaaaattattttctcatggtacgttccttttatttatacatagttttccgcgttatcatgaatatacgtttctcccatgaaaaaaaaaatatacatatcagaagggagtaatccacataacatgaaaagaaaaggaacaagctaagtggtaggaatttgcaagtaataaattgttttcttagaatattgtaatacatatgtggtttttatatcaaacttagaatttgatttctcatgttgaggtgtgaaaaactaaattatcatgcaaaaacttgtagattttgaatacagtaaaagatcacatatcttacaactaaaattaacaagattaaatttcatattttggaagcctaactgaaaaaaactgactcaacaaaacgaacaacatccggacataactaatacgatgcccattatacaatcattcaaggtacatgatcaaagcacacccacattctatgcctataaaacctaccgacctcggaccatcttgttccgggccctcttcaaaaaatagtaaattgcaaaagaaagaaaatcgaaaaggttgtttgtaaaataattacaaaacataattagtggtgagaataaatctaaatataaggtacaagggggtgaaggggtgtgtgtctatatatgttggatgattagtttctgccatgtgctatggaatcaacctcttatgctttatgttctgtttagctcctaccttatactataactttaattattcatcaataattctaattctccttcgttttttaatatactagtgtttcatataaatactcgctctctctactcattccctccataacatatatttcttcttcgtttcattcataatcgtcttataaccacagattctaaaacatg

SEQ ID NO: 1100 - DNA, 3000 bp, Unknown
  misc_feature (1)..( 3000): cDNA_ID_2130689_gDNA_ID_1620359_Annot_ID_154580 3000 nt of promoter + ATG
gttgggctttggcccaattggtttacctggtagtcagaaatgcaggcggcctgactaccccctggcattagtcggaaagcatccaaactcgggacagacagtgtggtggtccttcgggaagaagtctactctgaagtacttcggtgcgtttctaccggagctgaccggatcagccgatagggtttatcaaaaaaaaaaaaaaaaaaaaaaaacaaacaaacttatctggactggttggatacggttgcacatcttaccttggcaaattatcctcttctagatatcattctcatccgtatgtgtttctaaaccatcatatatttcgtacgtaaggaaaggaatacttgaaggcagctgcagagagaaaaaaaagaaaaaaaaaaaaaaaaaaaggcaccacagggctggcttgacttgggccagctagtccaaacatacacgaaggcttcgtcgctagttcgggatgataaactgcaagtaattaattgtttttttttaattgtaacatattgtaattaacaaatataccaaattacaattacattatggcacatctgactagatgaaatgaataatattctcttttctcttcttgttgagtatataagatttatagtgcgccaactcaactggtggtgtttttagagaaatacaacaagttgaataaaagattactattttacactataactcgtcgaaattgttgtcccaaaaaaaaaaaaaaaaaaaaaaactcgtcgaaaaagaattatgttcattatgctaaaaaaagagataaaaagaaatgttcatctactataaattggagagaaatgaatatattggaaaagtttcttctagtttccacctcacattcaataaattttcattgatcttcatttagttttttttttttttcatgtttaccatttccctttatgattaagttctaacatgttttatgtttaaaataaataaaaaaaacaatttttaacatatgtttcgttcctatcatgtttaacgtgttaatcttgtttaacataatgaccaaaagtaatttaaatatttatgaactgtagcatgaagataagaacacaaattttcccaaaaacgcagtaaaaatttgaaaatattaaatgatcaaacgaaagaaaaagcgtgaataatctatgttctgtcaataattgagataaaatattttagcaaaagcataactaagataatacaagaacatgctacatcttatgttgtcgggcgggaatctagggtttcataagaaataaatgaggaatactatttatttttttcaaaacgtattcaaatcattagtaatcaccaatcttgaaaaatacagtcaaaattgaacatcgtcgtgatttattttttaagagtgatgtttttatatgattgtgtagggttttaaatatgtgcgttggttagaataaacagtccaagattaggcatcaactgtttttttaataggcatcaactgtttcaccataacatgttaagattacgattttagattaaaacaaaaaaggaatctggttttgatttttagtttactgagttctgcatattgcgtttcaaaagagttaaattgtgtggatagtaagatgatccatgatattaatattaattataaaaaaatattcatatttatttctaaatatagatattttgaatttttatatccaattaactaacttttgaaaactgactcgatagaaacaattatatttaataaatttgaaagcattttttttttacagaactaaaaaaaaacgcggtcataagacatgttatgttaatactcgtggtccttaccaaacaaaaaatactcgtggtttgatgaccttgatacgtggcaaacagcaaaatatatgcgttgtgggaaaattagagcggactaacccaattaacacttaattattaaagagaaaattttgtttttttttgttttttgaaaatacagtacttattcatgttttcaaaataatatacttaagacctaattattgtatattaattcttattcttatttttttcatttggatagtttagaaactatagaagaataaaaataataatcaaaataaaaaaataatatgccttatctaatttattatgaagatccttaacaaattttgttttaaatccaaactagccaaactggacgaaacaaagtttgattggatcggttaaagttctgtttagtaatataaatcgttcgattgaaaagtaaaaatagtttggttattcgttcagcttagatttaaaccaaaagtcgaatgcaaactattagtgttttcttaaactaaaccctaagtctagattttttctccaaatagcctccttccttgctcgatcttcttaatcccatcacatatattttggttttgatctcttcatataattagttgatttatttccacgatcctacattcctactaaacaaaaagtattgctttgaacattttgaaaatgtaaaatggtagagtaatagatatgtgattattagtgaaaacacgttttatttgaatgaccgggaacctttcaaacaaaccccattggtgagtctttagaaattctactttcgtcttgattgaagttgtgtgtatgttaaataatatatttgaaaacacttgatttatgttaaattacggacttaaacgtgatatgttgtaattggtcttattttataacgcgatgggaataaaccgtttgaataattccagtctaagtttgtttagtcacgagactcacgactatcatccaattatttaaacaaaagtcatcaaaaggcaaccggttcagtcaaaattaggattacttaataattaacaaaaactatgcgcaagattccattggtacgcgtgtgccctagctatgtctctctatataagaggaaatggatgcattaaaatttctcacaatcctctaaacaccttcactctttcagtctcaaataaacgtacaatctataaataaaattttaaagaagtaacgaccaagaaaatg

SEQ ID NO: 1101 - DNA, 3 bp, Unknown
  misc_feature (1)..( 3): cDNA_ID_2130592_gDNA_ID_1620360_Annot_ID_154613 3000 nt of promoter + ATG
gat

SEQ ID NO: 1102 - DNA, 3000 bp, Unknown
  misc_feature (1)..( 3000): cDNA_ID_3060687_gDNA_ID_1620360_Annot_ID_154623 3000 nt of promoter + ATG
gtagcgaaagtcgctcctgaaagcgctataaagtttgctgcttatgaaatgctgaaaccaataattgggggagcggatggtgacattggtacaagcgggaggcttttggctggtggattggctggtgcagtggctcaaacagctatttatcctatggatctcgtgaagactcggttacagacttttgtgagtgaagttgggacaccaaagctgtggaaactcacaaaggatatttggattcaagaaggaccccgagctttttacaggggtctttgtccttctctaattgggattatcccttacgcaggaattgaccttgctgcttacgaaactcttaaagacttatcaagggcacattttcttcatgacactgcgggttagttacttatcgtgccttgaaagttcttgatatttctcatgatactaaaccgtatatgatgtgcagagccaggtcctttgatacaactgggatgtggaatgacttctggagctcttggagcatcgtgtgtttacccattacaggtcataagaacaaggtaaaaactcacaatctttagctttttgagtttatctatttcttcgttttggtttgaaactgagtttagtcatttatcatcagaatgcaagctgatagctcaaaaacaagcatgggccaagagtttctgaaaacgctaagaggcgaaggtctaaaaggtttttacagaggaatcttccccaacttcttcaaagtcattccttccgcaagcatttcgtaccttgtctacgaagctatgaagaaaaatcttgcccttgattaaaaaaagcaagaaacctaatgttgtgttcacagagagatacagtgaaaactccttgatggtgacgacaaaaaaaaaacttgagctttccgttttcctttttttggattcggtaaaggtcattcgagtgtagaaaatgtaacttgatctgattgattcttgattcttctttagtagtttggtgagtccataaacactcatttcttaagaaaatagtttttatgctaaatcgttcgtttccctttaaaagagaaaactttagaggatctggtgaagctctttgatcaactgaatgataaattatagtagttgttcatatctcttgaagctgtgtagaacccttaaacatctgcatcagtttcatgcccaattcatcacttccggcagaatctctaatgatttcaaacaaaactctgttttcgccaatgtcctcttcgccatcacctctatttcaccgtctgcgtcggcgtcgaaggaggtcgtgagctacgcgacttcagttttcagattcatcacaaacccttcaacgttttgtttcaatacgatcattaggatttgtacgcttcatgagccgtcgtctctgtcttctaaacgtttcttcgtcgagatgcgacgtcgctctgttcctccagatttccacactttccctttcgtattcaaggcttgtgcagcaaagaagaatggtgatcttacattagtcaagactctgcattgtcaagctttgagattcggattgttatctgatttgttcactttgaacactctgattcgtgtttactcattgattgctccaatcgatagtgccttgcaactgttcgacgaaaatcctcaaagagatgttgttacctacaatgtgttgatcgacgggttagtgaaggcacgtgagattgttcgtgcaagagagttgtttgattcaatgcccttacgtgatttggtttcgtggaatagtctcatttctggttatgcgcagatgaatcattgcagagaagcaatcaaactcttcgacgagatggttgctttgggtctaaaacccgataatgtcgccattgtttcaactctttcagcttgtgcacaatcaggggattggcaaaaagggaaagctattcatgattacacgaaaaggaagagacttttcattgattccttcttagctactggattggtggatttctatgcaaaatgtggtttcatcgatacagcgatggagatcttcgaattatgttcagataaaactttattcacatggaatgcaatgatcactggtcttgcaatgcacggtaacggtgagctaacggttgattacttccgtaagatggttagttctggaatcaaaccagacggagtaaccttcataagtgttttagtgggttgcagccattctggtctagttgatgaagccaggaacctttttgaccaaatgagatctttgtatgatgttaatagagagatgaagcattacgggtgtatggcggatttgcttggaagagcaggattgatcgaagaagcagcggaaatgatcgagcaaatgcctaaagatggaggaaacagagagaaactcttagcatggagcggtttgttaggcggatgcagaatccacgggaacatagagatcgcggagaaagccgcaaatcgagtcaaggcgttgagtcccgaagatggaggagtgtataaagttatggtggaaatgtatgcaaacgcagagagatgggaggaagtagttaaggttagagaaataatagacagagacaagaaagtgaagaagaatgttggatttagtaaagttttgtcatagtttggatttaattaaaattaataaactatgattactaatgtaacaatcattaagagtaaggacttaaaaactttaatggcccaggcccaataactatgctcaactagctgttaaatgtgtacgtacgtatatagcaaaataacagtgcacgtagaagagctcgcttttgaatgacgtggcctgttatgattggttagcttcgcgtggcgagagatttgattggtggaaacaacaaaatgacacactcgaccgggtctacgggattgaatatataatttattcagagaaaccgaaaaatacatatcactctttctccttcacgagggatttttgttccgatctacttctccggcttatcaccgatttagatctaagcctgaggtttccttttgcattttagagattccgagaatg

SEQ ID NO: 1103 - DNA, 3000 bp, Unknown
  misc_feature (1)..( 3000): cDNA_ID_2130642_gDNA_ID_1620360_Annot_ID_154625 3000 nt of promoter + ATG
tctcacgagaaagacaagtaaaagaaaaattattgttctcctttcgttttctgttttcaaccattcaagtgagagagagaactgacatagaaaagggcaaaacggtcaattaacaacgttgggcgaaaaaaagtataagatcaaagaaaaaaatccgacctgccggaatcgaaccagcgacctaaagattatctgcaaacattacagtcttccgctctaccaactgagctaaggtcggttgttaattgcaattaaaaattaattatatttaaattataaactcctagttttgtggcaaatctgacgcgtatcatgactacaaccattcacttaccaattacaattgattttgtaaacctttgactaaaactatggcactaaacgaagacgacacaatctattccaacgtttacaaacattcaacaaccctcagaagttgatctcacgtctctctgcgaagaattttccggttactgcctcttcggaaaggaccaggctaagccaaactccagtatcagctgcatcttcaggtggcatatttccggcgtagccagtcatcgcagtcttcacccaaccagggcaaaagctgttaacataaatcttctcttcctctcctcgtctctcaagttcttttgccattagtctcgtgtaagcattgactgcaagcttagacatggagtagtcagtgaatgtctgaggccacccgcctgattcccaagttccgtcttttacttggttgatgaatttagagacagttctgtctataagttcctcggtcagcaaatctggactgcttagctgatctctcaactctacatttgccagtctctgcaattcatgaatttcaacgagattttcttttttcaaaaaaaatcaaagatatgagtgaaagagtttcttacattacgtcttccatttactctacctagccgagaactaacattgactacacgagcgccatgaggagatggtctcatcaagggtatcatagcttttgtcatgtttttggttccttggtagttagtagatataactgtttcagcaaattcaaccgtattatctgagccgagattgtagttaacacctgcattattcacctgaaaaacatagcaacacaaatgcatgtaattcaaatctaagaaaacattagaactatcctccaagattacgaatcgataaggatcttacgagaatatctaaacctccaaatgtttgcttaagccagcaaccaaactctctaatcgacgaagagtctgtgacatcaagttgatgaaaataaaccttgagaccttcttcttggtgcctcaaagatttaactgcttcaagaccagcattcacgtttctagctgtaagaacaaccgtcaatccgtgaaccgcaagctgtcttgcaatctcgaatccaatcccgcggtttgaaccagtcactactgctacattttcacaagaccaccacctaaaaaatcatttgacgcctaatgacaagtcaaattcaaaaagagggcttgagagacacatacttcatcattttcaatttctctaaattcttttggtttagtgaaacacaaatctgtaagtaccaacaacaataccaattcagtctccaactcccaaatagagaaaaatagaaactcatcaaacactgtaagcgacactaagaaatggatttaagcaagtgaaattagagattaacacatcgaatgctgtgaaattgagaatctcgcagagtaaatgatgatagatcttaggatacaaagaagccgaaacaattggacaaattaggtctcttcatacctatggtggtcagagtaaggaatagttcgaaggagagagatctcctgcattcttttctcccttctctctcgagctttctccttgttcgtcatcgtcttcttcgctcgcgtcgcgtgtttgggtgtaccgtttatcttactcctgaatcaaattcgttgtacattagccatcagctctaaggaattaataaatgagaccttcaactttaataaaaaccacataatggcccaaaccttatactcttaactattcaatccaccagacaccagtaacgcttggcagtcaaatctttattgagtgggttcatactctaaaccgtttactgaaatttaattcaactaaacaaaccaatgatttttcatacaccattaattacaaaaactacaagatgaaaaacttttcacgatatttgttcgaaaatctaaaccaatgattttttccctcaatcttcgtttatagtttaatttatggtcgtctatctacttttgtttgttttatttgtcgtcggttgtctaatatccatccattctcacataaatgtttagtggtactatgataacctaacatgattgtgtgagataaaatagaagaggacaatactagcgggtttgtgacgagagcggtgacgtcactggtttacacgtgtcacgtactaacgattctcgcgtccatacgtctctgcgttcatgggctattgataagtattaaatagacaactcccgaatttgttttgttactcatcacaatagcgggaaactcatccggcttctggaaatttccgtttatccgattcgttctcacgtaaatcactctctctctctcgctctctcgctctctctgtatcgtctctgtttgatttcgcaattgaattctgggtttaggaatctcttattgtatttaatttgacaatcaaattttgggttttttaaataccaaactagaaagtgagattacgaaagattgttccatagtggatacgttcgtctttcaaaaggtaagtcaaactttttttttttgggcaaaggaattttgaataagcagcacaagtactaaaatcttctgattaaaattaggtttcaagtggttatcctctattgttcatagtttgagctaggtttagagtttgtgatatcttatccatgtttatgaatttgattagctgaatcaatctctttccttttatatatgatcatgaaacaggagatgatg

SEQ ID NO: 1104 - DNA, 3000 bp, Unknown
  misc_feature (1)..( 3000): cDNA_ID_3060718_gDNA_ID_1620360_Annot_ID_154630 3000 nt of promoter + ATG
gaaagataatgctcatcaaagtaaaaagttcaaaaacaagatatagaatcggcttattcaggcatgaatattgtcatatacaatttacaaatcagatgcatcttgatttacattttccccaggttcaacaagtgaaaacgaaacccctagtcttcattcgactagcaaactagctgatgactacacaagataactacggcaaatccctagaactaagctgcatcatccaagtaaaattatgaaacctgagaattcacaaaatccatagattaaccttctctgcatagactgatagatagaactcacctgaaattcgctcagttggttgactccgactcagacggaaagcagaaatcgaggagaatgtgttacatagaaggaagatcaaaacgcagctcgataacttcatttttctctctcagaaattttggttcctccctaaaaactcttcaaaatcccagatcatataaagtatataaagatcaactagaacagctgaaatgtcagaagaagtagttgctaaaaccggaaccccgagattgagacttcaaaaccggaacaaaatttacaaaattcgctaccgattgttagatctcactcacgcccagcgttgacagcgagagcccagcgattttcatttgaagatgcgaagaaagcaagaagaaagttgaagaagattcgtctatggcctatacgacgtcgtttgaaagggatccatttttcgcaaaggaaagtcgttggggacttgaacattccacgtcagcctcttttccactttaaaaaataacaatgtaatgggctgaccgagaagatataaacgcagcccattatttaatgggcaaaagtgttttctttttgggttaaagtgtgattccgttcttgtgaacctagttgtaaacttttgtaactgcaaagtgtagttcggtcttgtttatccggtatattgaattttgaaacagtaataaatagctgaattaagtcacttttgagttgtttttctttaatgtgaaaatgatactgagaaaatagggtagtaataggaggctttagaacagattattcagtcttttcaagattctaaaactccaacagttaaataacagtggtgaaaacagtatcaagagtacgagccgctactcgcaatgatgaagatgatgatatataatagtaatgaatttatatgttgtaaacttgtaatgttaaagattaataataaactaaatgagagaaaggacaaagaaaaggtaagaggaaactgagggagtgagacagtcaaaataaaacagactgagagcattaagaatgccagtctctcagaacttcgatttgacctgtcgtttcctcattggctacctttccaacattaaagttttttatcggctcaattccaatgttataattttttatatattttcacatcattcttttttttcactgtttagtcacaaagtttacgtaacccatatgtccaatcccacactttaatttgtatttttagttccaacatataaaaataacaaaataaccattgcttttttccccactttaatttgtaagttctttctgttatttaataaatttgacattaccaaaaaaaaaatttttagatgggtgaatatatatagaaatgtaacttatcaaattgattcggttttctgattttcttaacgactaaaaaaaatatatgtgtactagggcaataggggtaattacaaatcagggagatgacaacacgtaagagatagttgaagagattagaccgaaacacacctgacctcctctccttctggagttttcacactgcatttatcaattaatgtttcctaaaacgcagatagataaaggtttcatttattagcttatgtttatttaaagcaaaagaacaacttgtggctatatatagtagattaacaatctcagactcagagtgctgatatttcttatcatacaaaatttatcttcccctaacaatacttccaaagcttatttagatagacatatatggaattatggataatggattcccttaagttatatgaatcataggggaatataattttagtaacttatcgggcttctgcaaagattgtgcatggtaccatgcgtccatgccaatacagttaaagtttacataatacaaatttttacgtatttctatatatcatatatgacttacagattatcatagcttaatatagccagtattgccaactttccattcgtacctagaacttataagaagattggaaaggatattaaaattgaaaaagacgtaggttggccatgtatcttaagatagttaaacgatatcagcaatctatcaataatcaatctatcgtaacaaatatttttgtcataaatgtatttgtagatttttttttttatacttttagatggttaaatgttcaagaaatctaaccaaatggtggaatggttccgtttgatcgtgctctcatggtacaaacaatgagaccccccaaaaaaaaaaaacccccgaggatgaaattaaaacaaataacacagcttgaacaaaacatcaaaaacagaggatcatcacagtaaatattaatacttgaacaaaacatcaaaaagataggatcatcacagtaaatattaatatgcataaagaagagaatcaccacagtgaaaaccctaatcattttatattcctacgtgtcaaattatgaatggtcataatcagagtagagaaaaagaatgtcgatgaaagaaaaagtttgacttgttaagtcccaactgtcaatttcccagcaagacacatatcttcttttacatcacattacatctacacataaatgctttattgcaaaaatagcgatataaaaaaagaatatacaaaaacctagtatttattttctagattctttactgttgtatatatagaagttgctcgagtggtcatttttacaataaagcaatctgctcaaaagagtaaagaaagagagaaaaagagagtgatagagagagagagaaaaatagatt

SEQ ID NO: 1105 - DNA, 3000 bp, Unknown
  misc_feature (1)..( 3000): cDNA_ID_3060726_gDNA_ID_1620360_Annot_ID_154628 3000 nt of promoter + ATG
cggagagtagcaaatgacggcgtctagaagattcctcttcctcctcttcttgcaatcgtctccgttcagctctaacggcagctttgataccgtaccgttcaccaacaagaagctcccaacgaaagatatgagagagactattcatcatctcttcaagctcctcgtccttcatacccacaagcgtgctcgccgtaaaacctaactccgctatcttcgccgccgtgtagaaacgtataccgtacggaccgaatagtccctctaaaccaccaagtcgcatcccaaaagcagccgtctgcggtgtcaccggctgttgctgcagcggaggtggaaccggaggtggtgcttgaaccaatgctctcgttgggttccaccggaataagccactcgtgaaaccttcaggatccataatctatttttctctctctctctatcactctctttttctctctttctttactcttttgagcagattgctttattgtaaaaatgaccactcgagcaacttctatatatacaacagtaaagaatctagaaaataaatactaggtttttgtatattctttttttatatcgctatttttgcaataaagcatttatgtgtagatgtaatgtgatgtaaaagaagatatgtgtcttgctgggaaattgacagttgggacttaacaagtcaaactttttctttcatcgacattctttttctctactctgattatgaccattcataatttgacacgtaggaatataaaatgattagggttttcactgtggtgattctcttctttatgcatattaatatttactgtgatgatcctatctttttgatgttttgttcaagtattaatatttactgtgatgatcctctgtttttgatgttttgttcaagctgtgttatttgttttaatttcatcctcgggggttttttttttttggggggtctcattgtttgtaccatgagagcacgatcaaacggaaccattccaccatttggttagatttcttgaacatttaaccatctaaaagtataaaaaaaaaaatctacaaatacatttatgacaaaaatatttgttacgatagattgattattgatagattgctgatatcgtttaactatcttaagatacatggccaacctacgtctttttcaattttaatatcctttccaatcttcttataagttctaggtacgaatggaaagttggcaatactggctatattaagctatgataatctgtaagtcatatatgatatatagaaatacgtaaaaatttgtattatgtaaactttaactgtattggcatggacgcatggtaccatgcacaatctttgcagaagcccgataagttactaaaattatattcccctatgattcatataacttaagggaatccattatccataattccatatatgtctatctaaataagctttggaagtattgttaggggaagataaattttgtatgataagaaatatcagcactctgagtctgagattgttaatctactatatatagccacaagttgttcttttgctttaaataaacataagctaataaatgaaacctttatctatctgcgttttaggaaacattaattgataaatgcagtgtgaaaactccagaaggagaggaggtcaggtgtgtttcggtctaatctcttcaactatctcttacgtgttgtcatctccctgatttgtaattacccctattgccctagtacacatatattttttttagtcgttaagaaaatcagaaaaccgaatcaatttgataagttacatttctatatatattcacccatctaaaaattttttttttggtaatgtcaaatttattaaataacagaaagaacttacaaattaaagtggggaaaaaagcaatggttattttgttatttttatatgttggaactaaaaatacaaattaaagtgtgggattggacatatgggttacgtaaactttgtgactaaacagtgaaaaaaaagaatgatgtgaaaatatataaaaaattataacattggaattgagccgataaaaaactttaatgttggaaaggtagccaatgaggaaacgacaggtcaaatcgaagttctgagagactggcattcttaatgctctcagtctgttttattttgactgtctcactccctcagtttcctcttaccttttctttgtcctttctctcatttagtttattattaatctttaacattacaagtttacaacatataaattcattactattatatatcatcatcttcatcattgcgagtagcggctcgtactcttgatactgttttcaccactgttatttaactgttggagttttagaatcttgaaaagactgaataatctgttctaaagcctcctattactaccctattttctcagtatcattttcacattaaagaaaaacaactcaaaagtgacttaattcagctatttattactgtttcaaaattcaatataccggataaacaagaccgaactacactttgcagttacaaaagtttacaactaggttcacaagaacggaatcacactttaacccaaaaagaaaacacttttgcccattaaataatgggctgcgtttatatcttctcggtcagcccattacattgttattttttaaagtggaaaagaggctgacgtggaatgttcaagtccccaacgactttcctttgcgaaaaatggatccctttcaaacgacgtcgtataggccatagacgaatcttcttcaactttcttcttgctttcttcgcatcttcaaatgaaaatcgctgggctctcgctgtcaacgctgggcgtgagtgagatctaacaatcggtagcgaattttgtaaattttgttccggttttgaagtctcaatctcggggttccggttttagcaactacttcttctgacatttcagctgttctagttgatctttatatactttatatgatctgggattttgaagagtttttagggaggaaccaaaatttctgagagagaaaaatg

SEQ ID NO: 1106 - DNA, 3000 bp, Unknown
  misc_feature (1)..( 3000): cDNA_ID_3060734_gDNA_ID_1620360_Annot_ID_154624 3000 nt of promoter + ATG
ttgataagtattaaatagacaactcccgaatttgttttgttactcatcacaatagcgggaaactcatccggcttctggaaatttccgtttatccgattcgttctcacgtaaatcactctctctctctcgctctctcgctctctctgtatcgtctctgtttgatttcgcaattgaattctgggtttaggaatctcttattgtatttaatttgacaatcaaattttgggttttttaaataccaaactagaaagtgagattacgaaagattgttccatagtggatacgttcgtctttcaaaaggtaagtcaaactttttttttttgggcaaaggaattttgaataagcagcacaagtactaaaatcttctgattaaaattaggtttcaagtggttatcctctattgttcatagtttgagctaggtttagagtttgtgatatcttatccatgtttatgaatttgattagctgaatcaatctctttccttttatatatgatcatgaaacaggagatgatggctcgttaccacaggagatcgatgatcttgtgcttagttctgctctcattaagcatatcgccgagccaaggcttcctagggacagaggaaaagatcaaatccgctgtcttttactcaccaaaacttgtgatgaatccaggatcagttgcaaatccttacttattcgacatcgatttcccaagaggtcatatcggcctcaaagctttcgatgctgaagtggttgacgaagcgggcaaacccgttcctctacacgagacctatctccaccattggattgtcgagccatactatgtacgtaaaggttccaagcttccacagagagaaatgttcaggaatcatggattttccagggaagatcctgaaagcaatcttgattccaagtcagatattattcttgtgaaaaatggagggttgtgcaggagtttaacactcagacatttctttggtttaggatcagaaacccgcgaaacctcgacgtatgttcctgatccctacgctattgaaatcggtaatcctgaggaaacacctgatggttatgaattcaaatggcttcttaacattcacgcgatagacaccagaggtgtggaagataagaaaggatgcatagaatgtttgtgtgatctgtataatgttaccattgatgagtatggtcgagctataaggcctggatacaaaggaggtttatactgctgctatgataagactcaatgtcgggtgaaaagcggatttgacaatggggagaaaacaagaactctgtatttgaagtataccgtgagatgggttgattgggacagctcggttttgcccgctaaggtttatattttcgatgttacagattcttgggaaagatcaaaaggagatagccaagaacatatttgccatgtcagtaagaactttcatatctgcttaatgccgttacttctacttcattctctaataattttccgggtctttgtgattttcaggtggaatacgaggtgaaaccgtgcaaaaccaatggcgatggatgcgttgacgttaagaaaaagagcttagtgatgccatttgatgggtatattgtctacggggtagctcaccagcacgctggtggtatcggtggtgctctataccgagaggtaactaagagactgatttagtttaggctactgcaaaacgaaaagattgaaactttgttattgaattgagactcttgttgtgttgtggatcagaacggtgaagggatatgcgcttcaatgccgaagtatggcaatggagatgaacctggaaacgaagctggttacattgttggaatgtcgtcttgttatccagctgatccagtgaaagtgagctatggagagacattgactttggaatctaattacagtaatgccgttggtcataccggagttatgggactcttttacatcctcgttgctcagcagctgccggaaccagatagctccttgcctaataaacaacattttgaggtaatcactccacccggtaccagaactcggttaaggtcaaaccggttacgatacatatacagtgtattgccatgtgattatttaactgacgttaatatctctcacttccttgtaggcacctgcgagaagcttgagctttttagccatttttgcagtgacggtagttgtggctgttgtggttttaatagccgccgtgatataccggagacagaaacgggaagatggttaccaatcacttagtacttaaaaaagagcaaaaaccatgtcgactctatatatgtcttcaaagtgaattctgtttgtatacatagaataaaagattattttgttgtcatcttcctctgatgtgatatctctgtaatagttacgtgtaagaagaacttttctttctcaaatacatcacattcacacaataaactaacattattttcgttgtcttggttccaaaccctttaatacttgcaaaattacaattttttttaatctctataacttatgaattactctacatccaaatttgtgatgtttcactgtctaaaatcatctgtatgatcaaaaattcaaaagttgatattcagttactagagttagttataaaaaaaaacttttaccgtcactgttctggttcaacccagatattgttctcgttcaaagcagctaaaccggtgaaaactgactcgttgctgtgattcactcaaactagaccggttttatttgactggtgttttttgtgtgtcatatatgtcggaaacagttttgagtggtccacgaacaataatggagactccagctgtccatggaagatttgaggcagatattttttgctcaccgacctcaaatctcagagacaaaagttttgtccaaataaatttcatttttgaattctgattttgattatttccgaaattcttttttcttccaagaatgaagggaccatagaatcgtccaaaactgttgaaacttgaaagctttccaattttgctcatctgggtttctcgattgatcgttaaccagcaatg

SEQ ID NO: 1107 - DNA, 3000 bp, Unknown
  misc_feature (1)..( 3000): cDNA_ID_3060738_gDNA_ID_1620360_Annot_ID_154622 3000 nt of promoter + ATG
tttaagtttaaccaacacatctaaaccaatttaataaaattaatatttttccaaatttcttaaatatacaagcgatgaaattgagaaaaagtaaactcgtaatttttccaccaaaaaacataaacccgtgattttcccgccaaaaacataaacccatgattttcctaccaaaaacgtaaatccataattttcccgctaaaaacgtaaactcctaattttcccacaaaaacgtaaacccgtaattttccttccaaaaacgtaaacccgtgattttcccgccaaaaacgtaaactcctaattttcccgccaaaaacgtaaacccgtaattttccttccaaaaacgtaaacccgtaattttccttccaaaaacgtaaacccgtgatttttccgccaaaaacgtaaacccatgattttcccgccaaaaacgtaaatccataattttcccgccaaaaacataaacccgtaattttccgccaaaaacgtaaacccgtgatttttccgccaaaaacgtaaacccgtgattttcccgccaaaaacgtaaatccataattttcttgccaaaaacataaacccgtaatttttcaccaaaaccgtaaatccgtgattttcccgcctaaaacgtaaacccgtgattttcccgccaaaaacgtaaatccataattttcccgccaaaaacataaacccgtaattttccgccaaaaacgtaaacccgtgattttcccgccaaaaacataaatccgtgattttcccgccagaaacgtaaactcgagattttcccgccaaaaacgtaaacccgtaattttctcgccaaaaacgtaaaaacctataatttttccgccaaaaacgtagatccgtgattttacgtacaaaaaacgtaaacccgtaaaaagtggaatccgtaaatatcttaagtttgatgataatgaattaataattattattatttattattgttttataataataattaattaaattattacttaaatgagttaacccatttaacaactcaacccataaaattaaatgagttatgggttgacccaaacccatttaacaaaatgagttgggtcaacccataactcatttaaccctatactcatttgattatgagttgagttgagttgggttacccattttgacacccctaaagatatcacaccctaaagatatcacaatctaaataaaattgagaaagaagacgtttttttgacaatatgaaaatatgagctaagtttcatcgcgtcactttttgatttataactgttgatttaatttgttatttttaccaaaaaaaaaagaaaagaggttatatggaaaatgactagtagctaatcgtattagcgttgacaacggatagtgtgatatatatatatatatagtcggacgattagctagctcataaagctaagtgacaaaactaattatcaacggtgaatgagattggtcggcaagtaggtagagcgtggacagatcaattttcagacagaattcaaagtattaatgaccaatttgatacccttgaatgaagaaccaaactaattaaaacgtgcaaggaaaaaaacgtgtatctcctcctcgtgtattcacacctcctatttaatttatcatggatttattacttatattaattgcagatatgtttttcctcaaaatcacatgcaattgtttcctcattcttcaacaaattaatattacgcttactactatttctcatttcaaacttggtcaaatttacatattcagttaagacaaaataaaattatatagttaatattttccaacaaattaaaaatatacatttatattaatatatatatatatatactattgttttggtaacgttatctagtttcctatcaaaataattttaaatgttacattaaaaatacaaaaatacatttgttacaaaatggtttgtattgctatattataagaaagaaatacatagaattgagttgttgacaaaaaaaaacatagaattgatttaatgtagcttaaaaaaagaacataacttttttaaaatttgttttcaccacataacttttttaaaaaagtttacaaaacccatatttttctaagaaagataaacaagtgtagtaaataatttaaattttttttcttcaaaataaactattttctgcgaaattaaatctaaaatatttaatggcataaagaggtaaataaatgaaaagtattagggtaaaattacatatataagtataatatccgatttctctcatgatgtccttgtttatatttcatccacctctcctctgcacaatcttcttcttctcagctctctctctctcaatctcgagatccgttctctttaaatctgtctctttctcttcaatctcattgtctttgagctcttttgttgagatcaatctcagattgaaatcaatcatcatagacaattaagttttgatttacgttttttttttaatttcttcatcagatctagtttttaccaataacggataaattcaggtatgttcatcatcgtagatctatctctgtctattgattcaaattggatgtatttagattcaatcctgatctgatcttttggctttttgcgatcgcaagttttgattggtgagaattcgtttttttctagctcgatcgaactctgtagtgtagatcgagacgaatgtagagtttcgtgattcgtttttggttatatgatgttatgttttaattgatgcatgtgagttttttttgttttttttttgtgtgtgtgttgtgattcattgatctgtgagaaaagttttctgaatcatggttgtgtttattgatttgttggagtatgaatcatagaagaaccaatgcaatcattttgaaaaggaaaacaaccttttttaaaaaactttattctcatttcgcgagtgtttttagtgattgtggtaagtgggtaacctttttgatgttaggattactattgtttgatgttttttttttcattgtttatcgtgcaggtcttagccaatcaccaac

SEQ ID NO: 1108 - DNA, 3000 bp, Unknown
  misc_feature (1)..( 3000): cDNA_ID_2130607_gDNA_ID_1620360_Annot_ID_154616 3000 nt of promoter + ATG
ccctgatgaagaaagaagatcgatagagtaggccacaatgagaatcacaaaccactccacagacatgaggtagaacagcttatccattccgctttccttgagatctttccacttcatcccgtttccccgggaggcatattgcgcgaactcatacaatccgcggaataaggaaaagccgggatacaactccaaagcaagaatccctttttctgtaacatagatatatactagttacttaagtggtcacacataaacatgtgtattcgttcttcaaggtattgattttgttaacttaccggggaatgtgggagattcaagcagttcaccaaagagaaacattcccaagagcccacttgcaaacaccaatgtataagcaacaactacaattataagccgatttttttttatcatgaagccgttgatatataacatattcgtgagatgattcaagaaatgtgatgttagtacctgttgcagtcttaacctttgagaatatggaagaagctaaaaaggcgaaggagatttgcagatttacgaagataaaatagaaaatgaactggacgctgtagtcattgagccggaagtacctgagtcctatcgctgaaccgaagatcaccaaagaaataacataaaacatagatagagtaagaaaataggcataggaaatcatccaatatggaccaatgcctagcccgtgcattttcattataattcttaggcgctcttgtttctcatacaccaatgatgtcaagatcacctgcaaatattatatacacacaaccacataatgtgatgaatactttgttgagtttagtacttgcaatggcataaagtaagaaattgttaaataacttacggggaatagaagaagaacaacccaagtgaaaaaaagcgggcctagcatggaagcgatatcaagattgaatttagtttggtgtttaggaacttctttgacaaactcgaataatatcctcgtcccggggcctttaagaaacttaagataagcatttgatacctgcaagttttgcacggtgtgaacattaattggatccgttcaataacagaaacatgtaaaagagtactacagcgtgacttagattcataccagattgagcaagcgaggaactcgaaccaaaggtgcccttgaagggtcatcaatgtttgttgagttataccagatcgtcacatcgaagttgtttctatccgtattcaagagatcatatgctaaagacaacaaaaatacatcaacagtaagaaatcacagcttgattcttaagcatatgtatatagaagaaaatgaaacaaacctgcagcaatctcatttgtcatcctctcaggatttcccttccaattacccttgaaaagctcatcattgacctctacagagttatttctccatagagacaacccttgaagacacgtcaccgctgagataatattagacacaaccactaagttgatcatcaaagtgaagaaaaccacatttttcactgttcattttatcatctcaagctttgaacataaaaaaaaaaaactacctgtatgaatttttccaaatgagagtggccatgtagagtttggactgcactgagattggatactgtagataggaaaatccgactcaatcccgggatctgcataattgtttgtgcctagtgctagtgttgaaccctgaagtcactcacatgcacatgacctctagttaaaaatctaaaacagagagataaatgtttgcacttgcttgattgaaagaaatatcaaaacgtaccaagacattataggctaaactagacaagaggtcagaggaattcacagcaaacgaaccaccaaacatattcccagataaagctgtagtagaaacacttaactgataagttacatagcaaaaaatagagagtaaatgtatcaaagaagcgcatataccttgaccaagggaatggttattcccagtaagaagtatagtaacaggacaagttccagtttttctacaagacttatcaggaaggtcattgtacgaaaagaaaccaccgctgacagcacgagattcaggttctggaatctgtaacaggggaggcaacagtggagggtttgggatgggacaatcaccaatagaaaaatcatcttgacttccacacttagtcaaatcagcggccttattcaccacaacatcaagcaaaagttgaatccctaggagaaataagcaaaggagtagtggaaccaggacaagcctaatattcgtccatatgtgtctcctctgcacccacccaaaatgtcatataatcgattcaaaaccatgttttcaaacaacgatcgtaacaattttgtcacacatacacatacctggtaggttaagttctttctaagtaacgcatttgcttgcgcccagaaactggcttgactaggatccgccattgatgaagaagaaaaagagctccgttagtctttaaaatttttcttactgacaccactttttagtattcttctccaaaacgcttctcttctaatattttttttttagggtttttaattaatcaaataatagttgatgaaaatccaagaaaaccctcttgattgttgtatacagtgtaacaacaatctgatacattacccctttgtaatgatggattggatacagatagtcttcccaagaagtcaataaatactaattggaaacatttcaaatttaatactatgtagaaacggaaagattaaaaaaaacttaagtgtacttacaaatacagaaaacgcgtttcctttaactgaataaaatcatggaaaaaactaggaaaaaaactttttaagaattctcaactttcaaaccttttttagagtaataaacaaaattacttctttttttttctctagaataattgataagagtctttgtccatagtttcataggcgtttccttacgaaaaacctaattaaagataaacgttattcatttgtttcaaaaaaaaaaaaaaaaacctctaatcttcttcttcctctgtgatcatg

SEQ ID NO: 1109 - DNA, 3000 bp, Unknown
  misc_feature (1)..( 3000): cDNA_ID_2130611_gDNA_ID_1620360_Annot_ID_154617 3000 nt of promoter + ATG
ccctgaatttttttcaatgaatcaatagttgaataataaatgtaactgttgtaacacttttatctcaagtcacatgagctaggaacatctttggcaaaagccatacattatcggaaagcaacatacctttacagcatgaaaaggcgaagttttggtgcatttgcagcatccaagctttgttgttccaggatatgtctttgcaagaccatgtatctgaactgcaatgttaggatcaactcttccatccattgcttgttgtttaactaaaatctcctcttcaagcacatcttcgtcctctggtgtaatatgctctactggtggaactgaaccaatacagctacagatgctcccttcttcaaaagtgtagaaaaacatgttttaacttataattagttttatttagtgcaatagagaaaaataccttccactttgttgccttctttgccagtccaataactaggttttagaaagtagaagatcgattttctcacaccggatgcattggggatgatgttgtcaaagtagagagccaatacaaaccagaaaaagaacgttcccacgagccatatgtagattttattctgccaaaaacacagtttgttcagagaatgatacctacacaactattagatccaaaatctatctcagaaaggttggcatacagttgtaataacgcaagtgctctcgccccctgcacatattgctctttcactccaactgattccagagtctccgggagatgatgtcgcttcaagaagcagctgcagacccgcagaaaaggtattcggtggaaagagtgaccaaatgacacggctaccaatcgaatatgcgcttgaataagggaatccagcagttgttacaatctgcaataagaagtagaaatcgtaagagtccaagatttaaataagaaccaaaatttcagctactatatatgttagcaagagaggccaaacctgtgttataaaaccaaccagaaacacaaggaaaccaacagttgttgccgaagatgatttgctaatgatagatgatagcgcgaatgctaggccaatctagcaacacaagtaaatatataataacttaaatgatacacaaataatatctttgaagaaagcagagtacataatttgaaaatgaagttttttaccatattaaactgaaaaagaaagaaaagtaggaagacaagaacaaaactgttcttcaagaaaaactcaaactggaacatcattccaaagaggaccaagaagagtgaggagacaaaggtaaggattccttcccatatgagccatgacaaccaatatgcagattcataaacacccatcgttgtcattgcctgttgagcaacaaagaaacaaaacaatgatccaatacgcaaaacctcaggctaccaaaaaacaagaacagagattattataaaacctcgcgaagttttagctctttctcggtaaccacagacccgagttggagaacaaaaccaaacatggagaaagcaagaaagaacactggtcccataagataaaatgcagaaatgatcacttcaccaccaatcgctggacgcgcaaattccttaaatccaaaatcccaactaaactttggatctgaaaatgtataaggacttgacttattattccatgttataagaagcacccacatatgtatacatacacactgctacaaaaatcttcctaacacaaattaagattcaagaatataaagtacctccaattaaagaccttgcgatttcacgctctgcagcaatttgaagaggaacaaggaacttaaacgtaggatcttcacgccgaccacgttttttctccgatgaagagtttgtttgaattccatagctgatcactgtagcattcttttccacaaaatgcaaagcccctgttacttgcgatggatgtgacataaaccatgcatctacttcctcaggctttgtaaatgattgaacctgaaagagaccaaaccacaccagaaacataactattcagattttcgtacattagagactatggaagatgatgaagagacataatcatgacaaaaaaccttattggttggaattggtcgtccaggattgttagccataattgcagagacaatgtcagtgacacgacggctctggttgccactccacacgaagtcaaaacatggaagtctcacgaaaaacttatcctcacatggaagaatcggaagagagactaatgctttaggatctgtgacattcttgtgcctagtcgaggttaagtcgctcgctttggaagattcctctatagagaagatgagaaggatgaagaagaacgaagagaagagatgaagacacgtggctctcttgttcctccatgaaagcagtagattcttcttgaacaaagctgtgaattgctgatgaaaaagcggcaagccttctcgcagagtcatgatcacagaggaagaagaagattagaggtttttttttttttttttgaaacaaatgaataacgtttatctttaattaggtttttcgtaaggaaacgcctatgaaactatggacaaagactcttatcaattattctagagaaaaaaaaagaagtaattttgtttattactctaaaaaaggtttgaaagttgagaattcttaaaaagtttttttcctagttttttccatgattttattcagttaaaggaaacgcgttttctgtatttgtaagtacacttaagttttttttaatctttccgtttctacatagtattaaatttgaaatgtttccaattagtatttattgacttcttgggaagactatctgtatccaatccatcattacaaaggggtaatgtatcagattgttgttacactgtatacaacaatcaagagggttttcttggattttcatcaactattatttgattaattaaaaaccctaaaaaaaaaatattagaagagaagcgttttggagaagaatactaaaaagtggtgtcagtaagaaaaattttaaagactaacggagctctttttcttcttcatca

SEQ ID NO: 1110 - DNA, 3000 bp, Unknown
  misc_feature (1)..( 3000): cDNA_ID_2130895_gDNA_ID_1620361_Annot_ID_154644 3000 nt of promoter + ATG
ctcttctccaaagtccttcattagaggaataaacctctatgtggtaaagttcagagtcagaggcagaagaaaaagagttgttgcttcttcctctgaggcaaaagactttatagtgaggagatcttgaaggatcaaaggctaatgagagtgcgatgtgaccggcgatctgatggagaagagtgtactgttttgtcgtcggattataaacatagtaatttgtgttgaaatggttagaagaagcacaagaacatttgcagaggagaagtccattggttgattgcattatgatcatatctgtttgatgatcagtaaaccaaagtggtaatgatgatgaaatccgttggttggttgcgtcatcatcaagagagacaaagctatacttgatctctcttggtgagtgtaagaaaaagccagagatgggtaaggggtggttggacttgatgacacggtttgagaaaacagggtttgtaatgagcgaaagccagcgtttggatacgcgtttgaatcttaaaagagttttgattggaagaaaagagaggatttgaatcaagacatcatcgatatctgccacaattgtagccgatgaagaagagaaaccaccatttctacggcttctggccgatcttggagcttttgttcttgttcttgaacaagaggacatcgctggagtggtttaaaaagaaacttgtttagggtttattggagtgaggaagaagagagactctggtgttggattatatagagaggtaaggatgtgatgagttatgtttttttggtcaagaagattgtggaggaagctttgcttatcaattattctttgagtttcgttgacattgacctgttctcacttctgaattttgagtcgtgtctaatacaaatcttagcttataaactctgtattcttctgaaacttaaagttttttaaatattgttatctcgaaactgctatagacctgtagaggatcaaggataagttacatgtttaggatgttccaaccacaaacgtgaacaacacgacagttaatttttgaactctttacaagaacaagaaagaaaaaaggtccaaaaaacatgacaacccccaaaaaaagaaaatgtaacgtgacgtagatctctatgactctatcgactcccatcgttttgcatgtagaccccaaacaacgtaaccatccaaaaacaaagtatgagctgaagaattacatcaaaacaaatctcatcagtcatagaaatttaacatttatcacaacatgttttcttttcttatcttcttgttggaggtttataaggttgttatcgctgtcgtggcctctatagtcttcttcgtgttctcgggtctaacactcgctggtacagccgtcggattaaccgtaaccacaccgcttttcatcatattcagcccgattctcgtaccagccacgatagccattactctcttaaccacagggtttacgaccggtggcgcccttggagctacggccattgctctcatcaggttgctgatttagtaaatcaaacaaattttattgaaatattcatatggtacaatgtttttttttctaatttaatttaatgaaactatgacatatatacaaacacacacacttgtgttattgtgtatgtgtgatgtaggcgcggcatgggagtaaagtcgaagaacaatatacctgcaataggagctccaccaactatgtttgcccagttcagtttaacgccaaagattaattatgaaggaacttttaaagggtcttggggaggaaaatcgtcaccccaagctacgccaaattttagttatggaggaacttggacagcaaattggggaggaagatcctttactggaaagtttggagatcagtctggcggtggaagtaccgcaggtggaagtacacccgaagctgctggtgctggtgctggtgctgctgctgctggtgctggtgctgctgctgctgcgggtgctgctgctgctgctgttcctggtcttggtgcagctagtgctggtgctggtcctggtgctggtgcaggtacacccgcacccgcacctacgggtaaggcgggtaaggccggctcaaagaaaaagtagatccgttcagtgatgtggctaataatggcctttttgttggaaataataagcttttttaaaatggaaaattggcccaaatttcttttcttctttaagtcatgttttgtgcgtatcgatccgtgcagtgccgtagctaacgtgacagtttcacatagtcatctttttttttcccagataaaacctaatattcaatcccagccatcgttctgtgtctagaaatttttgaaagatttggaccctcaaattagcagagaattaaataaaaaaaattggagcctctgcattcatttgcgccggttgcacacccttaaaacccccccgaggtgaacgacattggtcgagctgttccaacatgtagcagcttcaaaattcaacgtttcatgtttatgagtaattcaaaattctatgatcaaatttttttagtaaaaaaattacaattaaacgtcttatgtttatatgtaatgttgaatctgcttatagtgaaagtctgtctgatctaaaaatacaacaactctattgtatcagttggaaaaacatctttcacgtgattaagatgaatgtgcatttacgtacgtgaacatcaaaatatggtcgatttttaggtgatcatgatttcgtctatgtgaaggtgtttgttaaataaggctattattgtcattccagcaacaaacgagttaatgaataataggcctcaggcccattatcaatctgaaatccatccccgtaactggcccacccaatacaaacccgacccgactcacaatctctctttcatttcaattttgaaaattttctctcgaaaaagtcgatatccatggcttctcgcagtctcgtatcacagtgaatccaggagcttagattatcatagatcataggcattgattcttctcttctgagaatctcgttgcacatactcaaatatg

SEQ ID NO: 1111 - DNA, 3000 bp, Unknown
  misc_feature (1)..( 3000): cDNA_ID_2130931_gDNA_ID_1620361_Annot_ID_154652 3000 nt of promoter + ATG
ctagagaaagatttgacaaggaaggaacttgaaatgcaggatctgaaaaattcagtcgcttctgaaaccaaagcatcacctacatcaagtgttaatgagcttcatctagaaatcatggttagtgatattggttgaaaccgtttgattgtcaatatttcccatagcatcattcttgattgcactctttgtatttctcagaaattccaaaaagagatagaggagaaagaatccttgctagaaaaacttcaagactccttgaaggaagccgaactaaaggctaatgaacttaaagcttcatatgaaaacttatatggtatgttagcgatacatttatattcttggatttgtgtaaaagagattagtcatcttgatttacagaccagtttactttaatatagttcaagctagctacagtgattctatctaaaacgtacatgcagagtccgccaagggtgaaattgaagcccttgagaaagctgaggatgagctaaaggagaaagaagatgaactccattctgcagaaacggtgcaccttcgttaagagtttggttctttacttgtttgcacttagtactgaactgtgattctgtttcaggagaagaaccattatgaggatataatgaaggacaaggtcttacccgagattaaacaggctgagactatatataaggagcttgaaatgaaacggcaggtaagcaattataaaattctactagtaataaacatgaaaagggacaaaaatatcataatgagcaatgcaatttcattatatatatatgtttgtatgcaagttaattattgctcttggattcattttttttaaatactttgttcaactgctgaatttcaggaaagcaacaagaaggcctccataatttgtcctgagagtgagataaaagctttgggtccttgggatgggccaactcctttgcagcttagtgctcagattaacaaaataaatcataggctgaagcgagagaatgagaagtgcttaagtttctgtgccttgtgattgttcctacatacggaaattacccgttgaatgcctgttaatgttacatgcgtttatctcttattgatacagttattctgaatcaatcgatgacctcaggattatgcacggggaaaaagaacagaagattgggaagaaacgcaaaacttacaaaagctgtcgagaaaaactcaaggtttacagatatattttcccttcatccaaaattccgagatatatgtgctaattcatttaatgtgtgcattactgtttaatcaggtctgcaaagatgcagtagactcacggtggaacaagctccaaagaaataaagatcttctgaagcgagaattaacttggcagtacgaattgttttgcccataattaccaataccattggctaactctttagttatgtgattttcatatgctattttccttgattggtgatcatcaaagcagattcaaccatcatttaggaaagaaaggtatcagtggaaatatcagagtctcttatgaagacaaaactttgtccatagaggtaactggtgccatattgctacaatttgcatgtgatatgtctatattattactttaatttactggttggttgcacttttgtattcgacaggtaaagatgcctcaagatgcaacaaacagtgctgttcgagatactagaggactttcaggtgctgtttctctgctctagatttgcatatgaattatttaagacttaaattcactcattctagaaacgttagaacaaggttcagtggaataagttaagtaactaagcccttgaagatggtacttaaatctaagaatctaaaactattttgacctttgtttactatatgccctctatgttgtcctatatttgaatctctagaagctaatgctccattgagagtataaccttattcgttcaaattatcagctatttacatttctagggagcttcaaagtttgatcaatcctactcttatcataaattccaggtggggaacggtctttctcgactttatgcttcacattagctcttcagaatatgactgaagccccaattcgagcaatggacgagtttgatgtgtttatggtaatctccttttgggaattttatttcttacaacttgatctcggtttgcatagtataatatcatacaccacttcttctcataacttggagcttctaaaacaaaattcaaacaccttgagagaaataacgtgttaacgattcggtttctgcaacctcaggacgcagttagcaggaaaatcagcttagacacattgattgatttcgcattgaaacaaggttcacagtggatgttcatcactcctcatgatataaggtaacttccatccacttagtgaagtaacacacaacactgtttctttaaagcataggaactatgtaacattgtaatctctcttttgcaaattacacagtatggtgaagtcacacgagaagataaagaagcaacaaatggctgctccacgttcttgagctacaaagaacctctccttttgtaaattcaccatcttactctcttttggccataacttaatggggtctttctaactttatcctatattttggaagtttctcttttgtcaataatctcaacagatagatataatgattatgatctagtggcttcagattttttgatgaaaagattgaaagtgacaggttcaattttttcttcttcactgtacatttgagaccgtttgtacattattcctagaaatctaaacagtttccaaaacgaaagctaacaaaaagagaccgaatctttcgtctttagagagagacaacaaaaatatcattttttataaacaaaatctaaaatccctaaaaacaaaatttttgctctgtgaatgtaaaagttctctagttcctcaaagcttcaaactttccatttctattgcagaaatccgttaaagctctttctcgggaaaatcaaaaccgagaaaaaaccttcaagaaacgttgacggagaatgtgaagtatc

SEQ ID NO: 1112 - DNA, 3000 bp, Unknown
  misc_feature (1)..( 3000): cDNA_ID_3060754_gDNA_ID_1620361_Annot_ID_154657 3000 nt of promoter + ATG
gatataactaagaaaatgtcaaagagaccatattgtatcggagaaggactgaagaaaggagcatggactacagaagaggataaaaaactcatctcttatatccacgaccacggtgaaggaggctggcgtgacattccagaaaaagctggtacataactatatatagacgcatttgtgtctctataatatgaatttattcacaatctgttactaatatgtattaattattctcttaattgatcatttgatctttatctgctttttttcgagtttagggctgaaacggtgtggaaagagttgtagattacggtggactaactatttgaaaccagatatcaagagaggagagtttagctatgaggaagagcagattatcatcatgcttcatgcatctcgtggcaataagtacgtatggcatttctctaggcttgtttgtgctcatatcagtttagtgaagacatgatcatcaatgttttgatatatatgtaccctgtgtttttattttattttactaggtggtctgtcatagctagacatttgccaaaaagaacggataacgaggtcaaaaactattggaacacacatctcaagaaacgtttaatcgatgatggcattgatcccgtgacacacaagccactagcttcttctaaccctaatccagttgagcccatgaagttcgatttccaaaagaaatccaatcaggatgagcactcttcacagtctagttctacaactccagcatctcttcccctttcctcgaatttgaacagtgttaaatccaaaattagcagtggtgagacgcagatagaaagtggtcacgtgagctgcaagaaacgttttggacgatcgagctctacatcaaggttgttaaacaaagttgcagctagagcttcttccatcggcaacatcttatcaacatccatagaaggaaccttgagatctcctgcatcatcttcaggactcccagactcgttctctcaatcatatgagtacatgatcgataacaaagaagatctcggtacgagcattgatctcaacatccccgagtatgatttcccacagtttcttgagcaactcattaacgatgacgacgaaaatgagaacattgttgggcccgaacaagatctccttatgtccgatttcccatcaacattcgttgatgaagacgatatacttggagacataaccagttggtcaacttatcttcttgaccatcccaattttatgtatgaatcggatcaagattccgacgagaagaacttcttatgatctgtctatagatggcttgtcaatttcccaatgttgacatgcccaagattatgattaggcttttctcttagataaatttcaagttgtttgaaacaaataatcccgtggatcgattagtttttgatttgccggagtttttatatttttgtaactcttttgtaatataattttaaatagctttacatatatacattatatatgacaaataagaatctaagcgaaaacgtttacaaaaatatatacattataggtccacaaaaacactataacacaaaaggtaaatagcaatgagtgggcaacaatattggatctgtgacccggcaaaatttatccgctaacaaaaacgaatctgaataaatgtccactgatatatgtgtatgtgtgtgtgagagagatatgacttatgcgagcttttgtttctatgtgtgtggctgcacatgaatgatttagtttttgttgtgtgtgtgaaaatgaaagttgtattttttctgtcggccgattaaaaactccaaattcgaaacagaatttgaaccaaaaatagacacacaataatcctcacgatcaaataaacccaaaagaaacgtagctattacaagtacgatctctcaggaacaaataatccgcatagccaaaataggctacatttcaggtagtcacatatatgactgcaatcacgaaatcacacgttgagctatcccaaaaagctctcttcttcgaattcgatgaattggtcgtaactgagagttttatgaatggattaaatgaaatagacgtatataaaaagtggaataaataatgcctttatgtttgcataaaactagtccttaattgtatttatgtatttcgtttccttttaatggaattttctatgtgcactcaataaaaattgacctaagattcttttcatatttgaatataagtttcattcaagaacaaatccattgatcaaaccaaattacatactgccaaaaactttaaacgtggaaatcttttatatgctccagcaaagtggagattttataaattggaaaatagaagaaaaccttactttatgataaatttaaataaaattgaaaaatttcctcatgtaatttaacaaaactaaattattgcagcattttcgttactcattattaagtgaaaactgtataatggtcaaaagtgcatctaattaactcctattaatagttcaaactaacacacgaatctttttcagattcatatgaagagttgaatctttttttattttccagctgaatcttctgatccaaaaccagaaggtccaaaacacatttctgtttttttcaccaaaaaacaaacaaacacaattctgtttaaagtaacctaattaggccgttaagaatataaaccttatttgggtcgtcaagaacataaaagcctgtataatagttttcttcttttttgggctaaagttttagttttaataatcaaaattaaacaactaatctatttgttaaatcatcatcttaacaaacctcggaacaaggacaagatcaccaggtttacaaacgaagcaacgaatcaacaattggaatcaaaaccttacctagaaagataaaccctaaagtaaattcagtttttcactttacctgcagaattggacaaagtaacttgatcttcatataatccctcgatgatccctcaaatgttcttaagaaatttcgaaacttttcacattcaccactcgattgaaccggacccgtttattca

SEQ ID NO: 1113 - DNA, 3000 bp, Unknown
  misc_feature (1)..( 3000): cDNA_ID_3060750_gDNA_ID_1620361_Annot_ID_154660 3000 nt of promoter + ATG
aatgacttaaacgaagtaaccatattatatagtaggaaccaaaaaaccgtgcaagatttgattgataatatcaagacttcaacagacctgctcccacttttccaaggtccacttgccaccagtgtagctctacaacaaatcagtcaattaaatgatatatatcacaaaataaagatcacaagtagataatgctactcaaaagtcaagaggttaaccataagaagctccatattctccttggttgggaaaaggtttataagaccccttatttcatcatcatctagcacagactcatccattgccatgattgcagcctggacgatgcaatctggttaatctttcatagcttaatgataattaataatccacatttactcgggtaatgtaggtttttggagcttaccatcatatctgcaggcagccgaatatttaataacattagcgtaagttccgtgtcagtggctctcctaaggtcaatcttgaaagccaataagacaaaaaaaaaactcttcaaaaagagtggaatattgaatcacaacagtcacttaattgtttatagctacgtgataaaagtctccaccagaaaagagcaagttaaaatatctgtgttaggaatatttaacattaccagtggatctttttcaggttttgctgccccaagagagaaaaaggtctctatttctgatacatcaagttctattgcactagccaaaaaaaaaaaggagagaaaaaaatgatagagtaattgcaaagcaaaggtcaatgatataggaactttaattcttccttcttcaatccgttggaattcggtttcttgaagggattaccagagaatctgttcatcctcgatatcgccgtggcatacttgttgtatctgtaactcatcccataagctccccggcaaagcccttgttattttaacccagttaaatcgcttcagggaggacttctttttagatggacatggaaaacaacacactatacccttaagtgcacaagttggaggtggggctcctacaaatatcagaggaggtggtggcagtggcgcttctctacgcacacgagtaggtggataacaacaacacagaacttctgcatcaaacatcggaagtggaggtggaggtggaggtggacgtggtagtactcttctacgcatagcaggaggaggaggtggcggcagtggtgctcttctacgcataggaggaggaggaggtggcggcagtggtgctcttcttcgcataggaggaggaggaggaggaggcggtggtggaagtggaactcttccacgcataggaggcgacaccacggcatcagcgccagagatctcgacaggggacattggatcaggaaccaaacggatgatttagtagagagatttaataacaaacatatttcttcaccgacctagatcaaataacactagttcatagcaaaaatactcagaaaatattaacagaatgatcaatggcagcacaattgactttgagaaaaatttgaacagtcgacggacgagacagagtatttgatgtccatttttttgaataataattactactggcatattaattgacgaattcatctacccaaaacgacgaagtcaggttgacgaaaaaaaaaaaaacgacgaagtcagaaagaccaatgggccgaaaccaagccccactcttatttatgatgtctcggttagaccatcctttccattacaaaacaataaaatttgcattaaaaccctcgaaggaagtaaaaaaaatgaaactttgagctaatgcaacatagtactgaaacattgttagcattgttttagaacccataaggagaagtcacgtgactccgtaagttatcaatgggcttttaagtaaattaagcccagcctttaatatatgggtctcctccgctgattaagaaaatataaatgagaataactagtaaaaaaattaatatatgggtctcgtaaagacattccccacccccctttattaaagttttacatgatgaaaatatagcaaccagacatgaatatgacgggttactaataccgattcaattactaaaaattggtatgtagtgacttattttaaatcaataataacgtgtttcgacagaagggaaaatcacaagttgatcgtaaatgaaaacgtggttgtaattataaatatagtttttttttttacgtttccacgtaggattagacaaaacacctagaggcttaaagatagagagaagagaagggtctggtcgtgtgtccgaaccaagtctcgctctttttttctcgaaagtccaccactactatgctctttcgtttccaagagttcaatttcaattacgcaaccatggaaaaatcaaaaaagctttttgtttgctattattaaatacctctaaaaatatgaattaaacccttttgtgaataattaataactttattgacacacaaataaaaaaataaactgctggaagatttgtcgaaatctggtttcttccttcgtttttttcatttctgctccttcttctccttttttcacctgaaattcttcatctcactgtcacttccttctctctctatctccctcttttattttatttttaacaactttttgattagcttcgaagattctttgttcccacgattgagagaagattcggcattgtacatagagatcgattcatttggaacgaaactagtttgaaaaattctcaactttggggtttggctttgtgattacgacttgcgtttttgtttccaaaattggattattggtggaggcagagaggtgaagaaggaattctgggaattgggtctttatcacgctcttgtaattaagcgaaatttgtcaactttttagctaggggtgagaaattagggtttgtgacctgaatttttgggggaagaaggggatctggggtttaggtcaacggaattggagcaatcgagaatgatctgcttgttggtttactaaatcgacggtttggatctgatcggaggagagacagcgccatcccatg

(The sequence listing continues in the following parts.)

What is claimed is:

1. A vector construct comprising:
    a) a first nucleic acid molecule comprising a nucleic acid sequence having at least 99% sequence identity to the nucleotide sequence of SEQ ID NO:1728 or a fragment thereof which comprises the last 1,000 nucleotides from the 3' end of SEQ ID NO:1728 that functions as a promoter; and
    b) a second nucleic acid molecule to be expressed;
    wherein said first and second nucleic acid molecules are operably linked and said first nucleic acid molecule is heterologous to said second nucleic acid molecule.

2. A host plant cell comprising an isolated nucleic acid molecule according to claim 1, wherein said first nucleic acid molecule is flanked by exogenous sequence.

3. A host plant cell comprising the vector construct of claim 1.

4. A method of introducing an isolated nucleic acid molecule into a host cell comprising:
    a) providing an isolated nucleic acid molecule comprising a nucleic acid sequence having at least 99% sequence identity to the nucleotide sequence of SEQ ID NO:1728 or a fragment thereof which comprises the last 1,000 nucleotides from the 3' end of SEQ ID NO:1728 that functions as a promoter; and
    b) contacting said nucleic acid molecule said host cell under conditions that permit insertion of said nucleic acid molecule into said host cell.

5. A plant or cell of a plant which comprises the vector according to claim 1 which is exogenous or heterologous to said plant or plant cell.

6. A plant which has been regenerated from the plant cell according to claim 5.

7. The vector construct according to claim 1 wherein said first nucleic acid molecule has 1 to 5 nucleotide changes as compared to the nucleotide sequence of SEQ ID NO:1728.

8. The vector construct according to claim 7 wherein said first nucleic acid molecule has one nucleotide sequence change from SEQ ID NO:1728.

9. The vector construct according to claim 1 wherein said first nucleic acid molecule is SEQ ID NO:1728.

10. A method of producing a plant comprising transforming a plant with the vector construct of claim 1.

11. The method of claim 10, wherein the first nucleic acid molecule has 1 to 5 nucleotide changes as compared to the nucleotide sequence of SEQ ID NO:1728.

12. The method of claim 10, wherein the first nucleic acid has one nucleotide change from SEQ ID NO:1728.

13. The method of claim 10, wherein the first nucleic acid molecule is SEQ ID NO:1728.

14. The method of claim 10 wherein said first nucleic acid molecule has at least 99% sequence identity to the full length nucleotide sequence of SEQ ID NO:1728.

\* \* \* \* \*

UNITED STATES PATENT AND TRADEMARK OFFICE
CERTIFICATE OF CORRECTION

Page 1 of 1

PATENT NO. : 9,029,523 B2
APPLICATION NO. : 11/004678
DATED : May 12, 2015
INVENTOR(S) : Alexandrov et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 3282 days.

Signed and Sealed this
Twenty-ninth Day of December, 2015

Michelle K. Lee
*Director of the United States Patent and Trademark Office*